US008084598B1

(12) United States Patent
Bentwich

(10) Patent No.: US 8,084,598 B1
(45) Date of Patent: Dec. 27, 2011

(54) BIOIONFORMALITY DETECTABLE GROUP OF NOVEL REGULATORY OLIGONUCLEOTIDES AND USES THEREOF

(75) Inventor: Itzhak Bentwich, Kfar Daniel (IL)

(73) Assignee: Rosetta Genomics Inc., Rehovot (IL)

( * ) Notice: Subject to any disclaimer, the term of this patent is extended or adjusted under 35 U.S.C. 154(b) by 1204 days.

(21) Appl. No.: 10/707,980

(22) Filed: Jan. 29, 2004

Related U.S. Application Data

(63) Continuation-in-part of application No. 10/707,147, filed on Nov. 24, 2003, and a continuation-in-part of application No. 10/651,227, filed on Aug. 29, 2003, and a continuation-in-part of application No. 10/604,985, filed on Aug. 29, 2003, now abandoned, and a continuation-in-part of application No. 10/649,653, filed on Aug. 28, 2003, and a continuation-in-part of application No. 10/604,926, filed on Aug. 27, 2003, now abandoned, and a continuation-in-part of application No. 10/604,726, filed on Aug. 13, 2003, and a continuation-in-part of application No. 10/604,727, filed on Jan. 13, 2003, now abandoned.

(60) Provisional application No. 60/468,251, filed on May 27, 2003.

(51) Int. Cl.
C07H 21/04 (2006.01)
(52) U.S. Cl. ..................... 536/24.5; 536/23.1
(58) Field of Classification Search ................. 536/23.1, 536/24.5
See application file for complete search history.

(56) References Cited

U.S. PATENT DOCUMENTS

| 6,573,099 B2 | 6/2003 | Graham |
| 2002/0086356 A1 | 7/2002 | Tuschl et al. |
| 2003/0108923 A1 | 6/2003 | Tuschl et al. |
| 2003/0228691 A1 | 12/2003 | Lewis et al. |

FOREIGN PATENT DOCUMENTS

| WO | WO 01/68836 | 9/2001 |
| WO | WO 02/44321 | 6/2002 |
| WO | WO 02/094185 | 11/2002 |
| WO | WO 01/75164 | 2/2003 |
| WO | WO 03/029459 | 4/2003 |
| WO | WO 03/070884 | 8/2003 |
| WO | WO 03/070903 | 8/2003 |
| WO | WO 03/070918 | 8/2003 |
| WO | WO 03/074654 | 9/2003 |

OTHER PUBLICATIONS

Krutzfeldt et al. (2006) Nature Genetics 38:514-519.*
Lee, R. C., R. L. Feinbaum and V. Ambros. The C. elegans heterochronic gene lin-4 encodes small RNAs with antisense complementarity to lin-14 Cell Dec. 3, 1993 843-854 75.
Wightman, B., I. Ha and G. Ruvkun. Posttranscriptional regulation of the heterochronic gene lin-14 by lin-4 mediates temporal pattern formation in C. elegans Cell Dec. 3, 1993 855-862 75.
Gallinaro, H., L. Domenjoud and M. Jacob. Structural study of the 5' end of a synthetic premessenger RNA from adenovirus. Evidence for a long-range exon-intron interaction J Mol Biol Jul. 15, 1994 205-225 240.
Lu, C. and R. Bablanian. Characterization of small nontranslated polyadenylylated RNAs in vaccinia virus-infected cells Proc Natl Acad Sci U S A Mar. 5, 1996 2037-2042 93.
Crawford, E. D., E. P. Deantoni, R. Etzioni, V. C. Schaefer, R. M. Olson and C. A. Ross. Serum prostate-specific antigen and digital rectal examination for early detection of prostate cancer in a national community-based program. The Prostate Cancer Education Council Urology Jun. 1996 863-869 47.
Engdahl HM, Hjalt TA, Wagner EG. A two unit antisense RNA cassette test system for silencing of target genes. Nucleic Acids Res. Aug. 15, 1997 3218-27 25.
Dsouza, M., N. Larsen and R. Overbeek. Searching for patterns in genomic data Trends Genet Dec. 1997 497-498 13.
Moss, E. G., R. C. Lee and V. Ambros. The cold shock domain protein LIN-28 controls developmental timing in C. elegans and is regulated by the lin-4 RNA Cell 1997 637 88.
Fire, A., S. Xu, M. K. Montgomery, S. A. Kostas, S. E. Driver and C. C. Mello. Potent and specific genetic interference by double-stranded RNA in Caenorhabditis elegans Nature Feb. 19, 1998 806-811 391.
Waterhouse, P. M., M. W. Graham and M. B. Wang. Virus resistance and gene silencing in plants can be induced by simultaneous expression of sense and antisense RNA Proc Natl Acad Sci U S A Nov. 10, 1998 13959-13964 95.
Ngo, H., C. Tschudi, K. Gull and E. Ullu. Double-stranded RNA induces mRNA degradation in *Trypanosoma brucei* Proc Natl Acad Sci U S A Dec. 8, 1998 14687-14692 95.
Verma, S. and F. Eckstein. Modified oligonucleotides: synthesis and strategy for users Annu Rev Biochem *no. date in Pubmed* 1998 99-134 67.
Wuchty, S., W. Fontana, I. L. Hofacker and P. Schuster. Complete suboptimal folding of RNA and the stability of secondary structures Biopolymers Feb. 1999 145-165 49.
Mathews, D. H., J. Sabina, M. Zuker and D. H. Turner. Expanded sequence dependence of thermodynamic parameters improves prediction of RNA secondary structure J Mol Biol May 21, 1999 911-940 288.

(Continued)

*Primary Examiner* — J. E Angell
(74) *Attorney, Agent, or Firm* — Polsinelli Shughart PC; Teddy C. Scott, Jr.

(57) ABSTRACT

The present invention relates to a first group of novel oligonucleotides, here identified as genomic address messenger or GAM oligonucleotides, and a second group of novel operon-like polynucleotides, here identified as genomic record or GR polynucleotides. GAM oligonucleotides selectively inhibit translation of known target genes, many of which are known to be involved in various diseases. Nucleic acid molecules are provided respectively encoding 2147 GAM oligonucleotides, and 313 GR polynucleotides as are vectors and probes both comprising the nucleic acid molecules, and methods and systems for detecting GAM oligonucleotides and GR polynucleotide and specific functions and utilities thereof, for detecting expression of GAM oligonucleotides and GR polynucleotides and for selectively enhancing and selectively inhibiting translation of the respective target genes thereof.

4 Claims, 31 Drawing Sheets

OTHER PUBLICATIONS

Chang, P. L. Encapsulation for somatic gene therapy Ann N Y Acad Sci Jun. 18, 1999 146-158 875.

Zhang, M. Q. Large-scale gene expression data analysis: a new challenge to computational biologists Genome Res Aug. 1999 681-688 9.

Grisaru, D., M. Sternfeld, A. Eldor, D. Glick and H. Soreq. Structural roles of acetylcholinesterase variants in biology and pathology Eur J Biochem Sep. 1999 672-686 264.

Fire, A. RNA-triggered gene silencing Trends Genet Sep. 1999 358-363 15.

Tabara, H., M. Sarkissian, W. G. Kelly, J. Fleenor, A. Grishok, L. Timmons, A. Fire and C. C. Mello. The rde-1 gene, RNA interference, and transposon silencing in C. elegans Cell Oct. 15, 1999 123-132 99.

Ryo, A., Y. Suzuki, K. Ichiyama, T. Wakatsuki, N. Kondoh, A. Hada, M. Yamamoto and N. Yamamoto. Serial analysis of gene expression in HIV-1-infected T cell lines FEBS Lett Nov. 26, 1999 182-186 462.

Olsen, P. H. and V. Ambros. The lin-4 regulatory RNA controls developmental timing in Caenorhabditis elegans by blocking LIN-14 protein synthesis after the initiation of translation Dev Biol Dec. 15, 1999 671-680 216.

Tuschl, T., P. D. Zamore, R. Lehmann, D. P. Bartel and P. A. Sharp. Targeted mRNA degradation by double-stranded RNA in vitro Genes Dev Dec. 15, 1999 3191-3197 13.

Reinhart, B. J., F. J. Slack, M. Basson, A. E. Pasquinelli, J. C. Bettinger, A. E. Rougvie, H. R. Horvitz and G. Ruvkun. The 21-nucleotide let-7 RNA regulates developmental timing in Caenorhabditis elegans Nature Feb. 24, 2000 901-906 403.

Pitt, J. N., J. A. Schisa and J. R. Priess. P granules in the germ cells of Caenorhabditis elegans adults are associated with clusters of nuclear pores and contain RNA Dev Biol Mar. 15, 2000 315-333 219.

Hammond, S. M., E. Bernstein, D. Beach and G. J. Hannon. An RNA-directed nuclease mediates post-transcriptional gene silencing in Drosophila cells Nature Mar. 16, 2000 293-296 404.

Slack, F. J., M. Basson, Z. Liu, V. Ambros, H. R. Horvitz and G. Ruvkun. The lin-41 RBCC gene acts in the C. elegans heterochronic pathway between the let-7 regulatory RNA and the LIN-29 transcription factor Mol Cell Apr. 2000 659-669 5.

Fortier, E. and J. M. Belote. Temperature-dependent gene silencing by an expressed inverted repeat in *Drosophila Genesis* Apr. 2000 240-244 26.

Mourrain, P., C. Beclin, T. Elmayan, F. Feuerbach, C. Godon, J. B. Morel, D. Jouette, A. M. Lacombe, S. Nikic, N. Picault, K. Remoue, M. Sanial, T. A. Vo and H. Vaucheret. Arabidopsis SGS2 and SGS3 genes are required for posttranscriptional gene silencing and natural virus resistance Cell May 26, 2000 533-542 101.

Sijen, T. and J. M. Kooter. Post-transcriptional gene-silencing: RNAs on the attack or on the defense? Bioessays Jun. 2000 520-531 22.

Brenner, S., M. Johnson, J. Bridgham, G. Golda, D. H. Lloyd, D. Johnson, S. Luo, S. McCurdy, M. Foy, M. Ewan, R. Roth, D. George, S. Eletr, G. Albrecht, E. Vermaas, S. R. Williams, K. Moon, T. Burcham, M. Pallas, R. B. Dubridge, J. Kirchner, K. Fearon, J. Mao and K. Corcoran. Gene expression analysis by massively parallel signature sequencing (MPSS) on microbead arrays Nat Biotechnol Jun. 2000 630-634 18.

Ryo, A., Y. Suzuki, M. Arai, N. Kondoh, T. Wakatsuki, A. Hada, M. Shuda, K. Tanaka, C. Sato, M. Yamamoto and N. Yamamoto. Identification and characterization of differentially expressed mRNAs in HIV type 1-infected human T cells Aids Res Hum Retroviruses Jul. 1, 2000 995 1005 16.

Nilsson, M., G. Barbany, D. O. Antson, K. Gertow and U. Landegren. Enhanced detection and distinction of RNA by enzymatic probe ligation Nat Biotechnol Jul. 2000 791-793 18.

Kent, W. J. and A. M. Zahler. Conservation, regulation, synteny, and introns in a large-scale C. briggsae-C. elegans genomic alignment Genome Res Aug. 2000 1115-1125 10.

Kennerdell, J. R. and R. W. Carthew. Heritable gene silencing in Drosophila using double-stranded RNA Nat Biotechnol Aug. 2000 896-898 18.

Smith, N. A., S. P. Singh, M. B. Wang, P. A. Stoutjesdijk, A. G. Green and P. M. Waterhouse. Total silencing by intron-spliced hairpin RNAs Nature Sep. 21, 2000 319-320 407.

Voinnet, O., G. Lederer and D. C. Baulcombe. A viral movement protein prevents spread of the gene silencing signal in Nicotiana benthamiana Cell Sep. 29, 2000 157-167 103.

Mette MF, Aufsatz W, van der Winden J, Matzke MA, Matzke AJ. Transcriptional silencing and promoter methylation triggered by double-stranded RNA. EMBO J. Oct. 2, 2000 5194-201 19.

Yang, D., H. Lu and J. W. Erickson. Evidence that processed Small dsRNAs may mediate sequence-specific mRNA degradation during RNAi in Drosophila embryos Curr Biol Oct. 5, 2000 1191 1200 10.

Anandalakshmi, R., R. Marathe, X. Ge, J. M. Herr, Jr., C. Mau, A. Mallory, G. Pruss, L. Bowman and V. B. Vance. A calmodulin-related protein that suppresses posttranscriptional gene silencing in plants Science Oct. 6, 2000 142-144 290.

Fagard, M., S. Boutet, J. B. Morel, C. Bellini and H. Vaucheret. AGO1, QDE-2, and RDE-1 are related proteins required for post-transcriptional gene silencing in plants, quelling in fungi, and RNA interference in animals Proc Natl Acad Sci U S A Oct. 10, 2000 11650-11654 97.

Pasquinelli, A. E., B. J. Reinhart, F. Slack, M. Q. Martindale, M. I. Kuroda, B. Maller, D. C. Hayward, E. E. Ball, B. Degnan, P. Muller, J. Spring, A. Srinivasan, M. Fishman, J. Finnerty, J. Corbo, M. Levine, P. Leahy, E. Davidson and G. Ruvkun. Conservation of the sequence and temporal expression of let-7 heterochronic regulatory RNA Nature Nov. 2, 2000 86-89 408.

Llave, C., K. D. Kasschau and J. C. Car Rington. Virus-encoded suppressor of posttranscriptional gene silencing targets a maintenance step in the silencing pathway Proc Natl Acad Sci U S A Nov. 21, 2000 13401-13406 9.

Cogoni, C. and G. Macino. Post-transcriptional gene silencing across kingdoms Curr Opin Genet Dev Dec. 2000 638-643 10.

Elbashir, S. M., W. Lendeckel and T. Tuschl. RNA interference is mediated by 21- and 22- nucleotide RNAs Genes Dev Jan. 15, 2001 188-200 15.

Bernstein, E., A. A. Caudy, S. M. Hammond and G. J. Hannon. Role for a bidentate ribonuclease in the initiation step of RNA interference Nature Jan. 18, 2001 363-366 409.

Vaucheret, H. and M. Fagard. Transcriptional gene silencing in plants: targets, inducers and regulators Trends Genet Jan. 2001 29-35 17.

Thomas, C. L., L. Jones, D. C. Baulcombe and A. J. Maule. Size constraints for targeting post-transcriptional gene silencing and for RNA-directed methylation in Nicotiana benthamiana using a potato virus X vector Plant J Feb. 2001 417-425 25.

Galyam, N., D. Grisaru, M. Grifman, N. Melamed-Book, F. Eckstein, S. Seidman, A. Eldor and H. Soreq. Complex host cell responses to antisense suppression of ACHE gene expression Antisense Nucleic Acid Drug Dev Feb. 2001 51-57 11.

Sharp, P. A. RNA interference—2001 Genes Dev Mar. 1, 2001 485-490 15.

Mallory, A. C., L. Ely, T. H. Smith, R. Marathe, R. Anandalakshmi, M. Fagard, H. Vaucheret, G. Pruss, L. Bowman and V. B. Vance. HC-Pro suppression of transgene silencing eliminates the small RNAs but not transgene methylation or the mobile signal Plant Cell Mar. 2001 571-583 13.

Matzke, M. A., A. J. Matzke, G. J. Pruss and V. B. Vance. RNA-based silencing strategies in plants Curr Opin Genet Dev Apr. 2001 221-227 11.

Schisa, J. A., J. N. Pitt and J. R. Priess. Analysis of RNA associated with P granules in germ cells of C. elegans adults Development Apr. 2001 1287-1298 128.

Di Serio, F., H. Schob, A. Iglesias, C. Tarina, E. Bouldoires and F. Meins, Jr. Sense- and antisense-mediated gene silencing in tobacco is inhibited by the same viral suppressors and is associated with accumulation of small RNAs Proc Natl Acad Sci U S A May 22, 2001 6506-6510 98.

Elbashir, S. M., J. Harborth, W. Lendeckel, A. Yalcin, K. Weber and T. Tuschl. Duplexes of 21-nucleotide RNAs mediate RNA interference in cultured mammalian cells Nature May 24, 2001 494-498 411.

Piccin, A., A. Salameh, C. Benna, F. Sandrelli, G. Mazzotta, M. Zordan, E. Rosato, C. P. Kyriacou and R. Costa. Efficient and heritable functional knock-out of an adult phenotype in Drosophila using a GAL4-driven hairpin RNA incorporating a heterologous spacer Nucleic Acids Res Jun. 15, 2001 E55-55 29.

Vance, V. And H. Vaucheret. RNA silencing in plants—defense and counterdefense Science Jun. 22, 2001 2277-2280 292.

Argaman, L., R. Hershberg, J. Vogel, G. Bejerano, E. G. Wagner, H. Margalit and S. Altuvia. Novel small RNA-encoding genes in the intergenic regions of *Escherichia coli* Curr Biol Jun. 26, 2001 941-950 11.

Grishok, A., A. E. Pasquinelli, D. Conte, N. Li, S. Parrish, I. Ha, D. L. Baillie, A. Fire, G. Ruvkun and C. C. Mello. Genes and mechanisms related to RNA interference regulate expression of the small temporal RNAs that control C. elegans developmental timing Cell Jul. 13, 2001 23-34 106.

Hutvagner, G., J. McLachlan, A. E. Pasquinelli, E. Balint, T. Tuschl and P. D. Zamore. A cellular function for the RNA-interference enzyme Dicer in the maturation of the let-7 small temporal RNA Science Aug. 3, 2001 834-838 293.

Hammond, S. M., S. Boettcher, A. A. Caudy, R. Kobayashi and G. J. Hannon. Argonaute2, a link between genetic and biochemical analyses of RNAi Science Aug. 10, 2001 1146-1150 293.

Vaucheret, H., C. Beclin and M. Fagard. Post-transcriptional gene silencing in plants J Cell Sci Sep. 2001 3083-3091 114.

Wesley, S. V., C. A. Helliwell, N. A. Smith, M. B. Wang, D. T. Rouse, Q. Liu, P. S. Gooding, S. P. Singh, D. Abbott, P. A. Stoutjesdijk, S. P. Robinson, A. P. Gleave, A. G. Green and P. M. Waterhouse. Construct design for efficient, effective and high-throughput gene silencing in plants Plant J Sep. 2001 581-590 27.

Mattick, J. S. and M. J. Gagen. The evolution of controlled multitasked gene networks: the role of introns and other noncoding RNAs in the development of complex organisms Mol Biol Evol Sep. 2001 1611-1630 18.

Carter, R. J., I. Dubchak and S. R. Holbrook. A computational approach to identify genes for functional RNAs in genomic sequences Nucleic Acids Res Oct. 1, 2001 3928-3938 29.

Moss, E. G. RNA interference: it's a small RNA world Curr Biol Oct. 2, 2001 R772-775 11.

Ketting, R. F., S. E. Fischer, E. Bernstein, T. Sijen, G. J. Hannon and R. H. Plasterk. Dicer functions in RNA interference and in synthesis of small RNA involved in developmental timing in C. elegans Genes Dev Oct. 15, 2001 2654-2659 15.

Ruvkun, G. Molecular biology. Glimpses of a tiny RNA world 'Science Oct. 26, 2001 797-799 294.

Lee, R. C. and V. Ambros. An extensive class of small RNAs in Caenorhabditis elegans Science Oct. 26, 2001 862-864 294.

Lau, N. C., L. P. Lim, E. G. Weinstein and D. P. Bartel. An abundant class of tiny RNAs with probable regulatory roles in Caenorhabditis elegans Science Oct. 26, 2001 858-862 294.

Lagos-Quintana, M., R. Rauhut, W. Lendeckel and T. Tuschl. Identification of novel genes coding for small expressed RNAs Science Oct. 26, 2001 853-858 294.

Itaya, A., A. Folimonov, Y. Matsuda, R. S. Nelson and B. Ding. Potato spindle tuber viroid as inducer of RNA silencing in infected tomato Mol Plant Microbe Interact. Nov. 2001 1332-1334 14.

Mattick, J. S. Non-coding RNAs: the architects of eukaryotic complexity EMBO Rep Nov. 2001 986-991 2.

Elbashir, S. M., J. Martinez, A. Patkaniowska, W. Lendeckel and T. Tuschl. Functional anatomy of siRNAs for mediating efficient RNAi in Drosophila melanogaster embryo lysate Embo J Dec. 3, 2001 6877-6888 20.

Ambros, V. microRNAs: tiny regulators with great potential Cell Dec. 28, 2001 823-826 107.

Blaszczyk, J., J. E. Tropea, M. Bubunenko, K. M. Routzahn, D. S. Waugh, D. L. Court and X. JI. Crystallographic and modeling studies of RNase III suggest a mechanism for double-stranded RNA cleavage Structure Dec. 2001 1225-1236 9.

Crete, P., S. Leuenberger, V. A. Iglesias, V. Suarez, H. Schob, H. Holtorf, S. Van Eeden and F. Meins. Graft transmission of induced and spontaneous post-transcriptional silencing of chitinase genes Plant J Dec. 2001 493-501 28.

Smallridge, R. A small fortune Nat Rev Mol Cell Biol Dec. 2001 867 2.

Eddy, S. R. Non-coding RNA genes and the modern RNA world Nat Rev Genet Dec. 2001 919-929 2.

Lu, C. M. miRNA bead detection Genaco Biomedical Products PHS 398 2001 1.

Matzke, M., A. J. Matzke and J. M. Kooter. RNA: guiding gene silencing 2001 1080 293.

Grosshans, H. and F. J. Slack. Micro-RNAs: small is plentiful J Cell Biol Jan. 7, 2002 17-21 156.

Meshorer, E., C. Erb, R. Gazit, L. Pavlovsky, D. Kaufer, A. Friedman, D. Glick, N. Ben-arie and H. SOREQ. Alternative splicing and neuritic mRNA translocation under long-term neuronal hypersensitivity Science Jan. 18, 2002 508-512 295.

Paddison, P. J., A. A. Caudy and G. J. Hannon. Stable suppression of gene expression by RNAi in mammalian cells Proc Natl Acad Sci U S A Feb. 5, 2002 1443-1448 99.

Moss, E. G. MicroRNAs: hidden in the genome Curr Biol Feb. 19, 2002 R138-140 12.

Banerjee, D. and F. Slack. Control of developmental timing by small temporal RNAs: a paradigm for RNA-mediated regulation of gene expression Bioessays Feb. 2002 119-129 24.

Elbashir, S. M., J. Harborth, K. Weber and T. Tuschl. Analysis of gene function in somatic mammalian cells using small interfering RNAs Methods Feb. 2002 199-213 26.

Han, Y. and D. Grierson. Relationship between small antisense RNAs and aberrant RNAs associated with sense transgene mediated gene silencing in tomato Plant J Feb. 2002 509-519 29.

Nicholson, R. H. and A. W. Nicholson. Molecular characterization of a mouse cDNA encoding Dicer, a ribonuclease III ortholog involved in RNA interference Mamm Genome Feb. 2002 67-73 13.

Puerta-Fernandez, E., A. Barroso-Deljesus and A. Berzal-Herranz. Anchoring hairpin ribozymes to long target RNAs by loop-loop RNA interactions Antisense Nucleic Acid Drug Dev Feb. 2002 1-9 12.

Giordano, E., R. Rendina, I. Peluso and M. Furia. RNAi triggered by symmetrically transcribed transgenes in Drosophila melanogaster Genetics Feb. 2002 637-648 160.

Martens, H., J. Novotny, J. Oberstrass, T. L. Steck, P. Postlethwait and W. Nellen. RNAi in Dictyostelium: the role of RNA-directed RNA polymerases and double-stranded RNase Mol Biol Cell Feb. 2002 445-453 13.

Mourelatos, Z., J. Dostie, S. Paushkin, A. Sharma, B. Charroux, L. Abel, J. Rappsilber, M. Mann and G. Dreyfuss. miRNPs: a novel class of ribonucleoproteins containing numerous microRNAs Genes Dev Mar. 15, 2002 720-728 16.

Seggerson, K., L. Tang and E. G. Moss. Two genetic circuits repress the Caenorhabditis elegans heterochronic gene lin-28 after translation initiation Dev Biol Mar. 15, 2002 215-225 243.

Morel, J. B., C. Godon, P. Mourrain, C. Beclin, S. Boutet, F. Feuerbach, F. Proux and H. Vaucheret. Fertile hypomorphic Argonaute (ago1) mutants impaired in post-transcriptional gene silencing and virus resistance Plant Cell Mar. 2002 629-639 14.

Catalanotto, C., G. Azzalin, G. Macino and C. Cogoni. Involvement of small RNAs and role of the qde genes in the gene silencing pathway in Neurospora Genes Dev Apr. 1, 2002 790-795 16.

Boutla, A., K. Kalantidis, N. Tavernarakis, M. Tsagris and M. Tabler. Induction of RNA interference in Caenorhabditis elegans by RNAs derived from plants exhibiting post-transcriptional gene silencing Nucleic Acids Res Apr. 1, 2002 1688-1694 30.

Pasquinelli, A. E. and G. Ruvkun. Control of developmental timing by micrornas and their targets Annu Rev Cell Dev Biol Epub 2002 Apr. 2, 2002 495-513 18.

Paddison, P. J., A. A. Caudy, E. Bernstein, G. J. Hannon and D. S. Conklin. Short hairpin RNAs (shRNAs) induce sequence-specific silencing in mammalian cells Genes Dev Apr. 15, 2002 948-958 16.

Beclin, C., S. Boutet, P. Waterhouse and H. Vaucheret. A branched pathway for transgene-induced RNA silencing in plants Curr Biol Apr. 16, 2002 684-688 12.

Eddy, S. R. Computational genomics of noncoding RNA genes Cell Apr. 19, 2002 137-140 109.

Lagos-Quintana, M., R. Rauhut, A. Yalcin, J. Meyer, W. Lendeckel and T. Tuschl. Identification of tissue-specific microRNAs from mouse Curr Biol Apr. 30, 2002 735-739 12.

Kent, W. J. Blat—the Blast-like alignment tool Genome Res Apr. 2002 656-664 12.

Hutvagner, G. and P. D. Zamore. RNAi: nature abhors a double-strand Curr Opin Genet Dev Apr. 2002 225-232 12.

Nilsson, M., J. Baner, M. Mendel-Hartvig, F. Dahl, D. O. Antson, M. Gullberg and U. Landegren. Making ends meet in genetic analysis using padlock probes Hum Mutat Apr. 2002 410-415 19.

Pasquinelli, A. E. MicroRNAs: deviants no longer Trends Genet Apr. 2002 171-173 18.

Lai, E. C. Micro RNAs are complementary to 3' UTR sequence motifs that mediate negative post-transcriptional regulation Nat Genet Apr. 2002 363-364 30.

Schwarz, D. S. and P. D. Zamore. Why do miRNAs live in the miRNP? Genes Dev May 1, 2002 1025-1031 16.

Brantl, S. Antisense-RNA regulation and RNA interference Biochim Biophys Acta May 3, 2002 15 25 1575.

Li, H., W. X. Li and S. W. Ding. Induction and suppression of RNA silencing by an animal virus Science May 17, 2002 1319-1321 296.

Zamore, P. D. Ancient pathways programmed by small RNAs Science May 17, 2002 1265-1269 296.

Chen, S., E. A. Lesnik, T. A. Hall, R. Sampath, R. H. Griffey, D. J. Ecker and L. B. Blyn. A bioinformatics based approach to discover small RNA genes in the *Escherichia coli* genome Biosystems Mar.-May 2002 157-177 65.

Lee, N. S., T. Dohjima, G. Bauer, H. Li, M. J. Li, A. Ehsani, P. Salvaterra and J. Rossi. Expression of small interfering RNAs targeted against HIV-1 rev transcripts in human cells Nat Biotechnol May 2002 500-505 20.

Draghici, S. Statistical intelligence: effective analysis of high-density microarray data Drug Discov Today Jun. 1, 2002 S55-63 7.

Silhavy, D., A. Molnar, A. Lucioli, G. Szittya, C. Hornyik, M. Tavazza and J. Burgyan. A viral protein suppresses RNA silencing and binds silencing-generated, 21- to 25-nucleotide double-stranded RNAs Embo J Jun. 17, 2002 3070-3080 21.

Ayash-Rashkovsky, M., Z. Weisman, J. Diveley, R. B. Moss, Z. Bentwich and G. Borkow. Generation of Th1 immune responses to inactivated, gp120-depleted HIV-1 in mice with a dominant Th2 biased immune profile via immunostimulatory [correction of imunostimulatory] oligonucleotides—relevance to AIDS vaccines in developing countries Vaccine Jun. 21, 2002 2684-2692 20.

Tabara, H., E. Yigit, H. Siomi and C. C. Mello. The dsRNA binding protein RDE-4 interacts with RDE-1, DCR-1, and a DExH-box helicase to direct RNAi in C. elegans Cell Jun. 28, 2002 861-871.

Bettencourt, R., O. Terenius and I. Faye. Hemolin gene silencing by ds-RNA injected into *Cecropia pupae* is lethal to next generation embryos Insect Mol Biol Jun. 2002 267-271 11.

Hooper, N. M. and A. J. Turner. The search for alpha-secretase and its potential as a therapeutic approach to Alzheimer's disease Curr Med Chem Jun. 2002 1107-1119 9.

Liu, Q., S. Singh and A. Green. High-oleic and high-stearic cottonseed oils: nutritionally improved cooking oils developed using gene silencing J Am Coll Nutr Jun. 2002 205S-211S 21.

Zeng, Y., E. J. Wagner and B. R. Cullen. Both natural and designed micro RNAs can inhibit the expression of cognate mRNAs when expressed in human cells Mol Cell Jun. 2002 1327-1333 9.

McManus, M. T., C. P. Petersen, B. B. Haines, J. Chen and P. A. Sharp. Gene silencing using micro-Rna dasignod hairpins RNA Jun. 2002 842-850 8.

Reinhart, B. J., E. G. Weinstein, M. W. Rhoades, B. Bartel and D. P. Bartel. MicroRNAs in plants Genes Dev Jul. 1, 2002 1616-1626 16.

McCaffrey, A. P., L. Meuse, T. T. Pham, D. S. Conklin, G. J. Hannon and M. A. Kay. RNA interference in adult mice Nature Jul. 4, 2002 38-39 418.

Hannon, G. J. RNA interference Nature Jul. 11, 2002 244-251 418.

Dennis, C. The brave new world of RNA Nature Jul. 11, 2002 122-124 418.

Jacque, J. M., K. Triques and M. Stevenson. Modulation of HIV-1 replication by RNA interference Nature Jul. 25, 2002 435-438 418.

Cullen, B. R. RNA interference: antiviral defense and genetic tool Nat Immunol Jul. 2002 597-599 3.

Ma, C. and A. Mitra. Intrinsic direct repeats generate consistent post-transcriptional gene silencing in tobacco Plant J Jul. 2002 37-49 31.

Novina, C. D., M. F. Murray, D. M. Dykxhoorn, P. J. Beresford, J. Riess, S. K. Lee, R. G. Collman, J. Lieberman, P. Shankar and P. A. Sharp. siRNA-directed inhibition of HIV-1 infection Nat Med Jul. 2002 681-686 8.

Pomerantz, R. J. RNA interference meets HIV-1: will silence be golden? Nat Med Jul. 2002 659-660 8.

Zeng, Y. and B. R. Cullen. RNA interference in human cells is restricted to the cytoplasm RNA Jul. 2002 855-860 8.

Xiang, C. C., O. A. Kozhich, M. Chen, J. M. Inman, Q. N. Phan, Y. Chen and M. J. Brownstein. Amine-modified random primers to label probes for DNA microarrays Nat Biotechnol Jul. 2002 738-742 20.

Llave, C., K. D. Kasschau, M. A. Rector and J. C. Carrington. Endogenous and silencing-associated small RNAs in plants Plant Cell Jul. 2002 1605-1619 14.

Rhoades, M. W., B. J. Reinhart, L. P. Lim, C. B. Burge, B. Bartel and D. P. Bartel. Prediction of plant microRNA targets Cell Aug. 23, 2002 513-520 110.

Hipfner, D. R., K. Weigmann and S. M. Cohen. The bantam gene regulates Drosophila growth Genetics Aug. 2002 1527-1537 161.

Liu, Q., S. P. Singh and A. G. Green. High-stearic and High-oleic cottonseed oils produced by hairpin RNA-mediated post-transcriptional gene silencing Plant Physiol Aug. 2002 1732-1743 129.

Stoutjesdijk, P. A., S. P. Singh, Q. Liu, C. J. Hurlstone, P. A. Waterhouse and A. G. Green. hpRNA-mediated targeting of the *Arabidopsis* FAD2 gene gives highly efficient and stable silencing Plant Physiol Aug. 2002 1723-1731 129.

Suzuma, S., S. Asari, K. Bunai, K. Yoshino, Y. Ando, H. Kakeshita, M. Fujita, K. Nakamura and K. Yamane. Identification and characterization of novel small RNAs in the aspS-yrvM intergenic region of the *Bacillus subtilis* genome Microbiology Aug. 2002 2591-2598 148.

Milligan, L., T. Forne, E. Antoine, M. Weber, B. Hemonnot, L. Dan Dolo, C. Brunel and G. Cathala. Turnover of primary transcripts is a major step in the regulation of mouse H19 gene expression EMBO Rep Aug. 2002 774-779 3.

Hamilton, A., O. Voinnet, L. Chappell and D. Baulcombe. Two classes of short interfering RNA in RNA silencing Embo J Sep. 2, 2002 4671-4679 21.

Lee, Y., K. Jeon, J. T. Lee, S. Kim and V. N. Kim. MicroRNA maturation: stepwise processing and subcellular localization Embo J Sep. 2, 2002 4663-4670 21.

Klahre, U., P. Crete, S. A. Leuenberger, V. A. Iglesias and F. Meins, Jr. High molecular weight RNAs and small interfering RNAs induce systemic posttranscriptional gene silencing in plants Proc Natl Acad Sci U S A Sep. 3, 2002 11981-11986 99.

Park, W., J. Li, R. Song, J. Messing and X. Chen. Carpel Factory, a Dicer homolog, and HEN1, a novel protein, act in microRNA metabolism in *Arabidopsis thaliana* Curr Biol Sep. 3, 2002 1484-1495 12.

Jiang, M. and J. Milner. Selective silencing of viral gene expression in HPV-positive human cervical carcinoma cells treated with siRNA, a primer of RNA interference Oncogene Sep. 5, 2002 6041-6048 21.

Martinez, J., A. Patkaniowska, H. Urlaub, R. Luhrmann and T. Tuschl. Single-stranded antisense siRNAs guide target RNA cleavage in RNAi Cell Sep. 6, 2002 563-574 110.

Allshire, R. Molecular biology. RNAi and heterochromatin—a hushed-up affair Science Sep. 13, 2002 1818-1819 297.

Reinhart, B. J. and D. P. Bartel. Small RNAs correspond to centromere heterochromatic repeats Science Sep. 13, 2002 1831 297.

Volpe, T. A., C. Kidner, I. M. Hall, G. Teng, S. I. Grewal and R. A. Martienssen. Regulation of heterochromatic silencing and histone H3 lysine-9 methylation by RNAi Science Sep. 13, 2002.

Baulcombe, D. DNA events. An RNA microcosm Science Sep. 20, 2002 2002-2003 297.

Llave, C., Z. Xie, K. D. Kasschau and J. C. Carrington. Cleavage of Scarecrow-like mRNA targets directed by a class of Arabidopsis miRNA Science Sep. 20, 2002 2053-2056 297.

Mochizuki, K., N. A. Fine, T. Fujisawa and M. A. Gorovsky. Analysis of a piwi-related gene implicates small RNAs in genome rearrangement in tetrahymena Cell Sep. 20, 2002 689-699 110.

Hutvagner, G. And P. D. Zamore. A microRNA in a multiple-turnover RNAi enzyme complex Science Sep. 20, 2002 2056-2060 297.

Coburn, G. A. and B. R. Cullen. Potent and specific inhibition of human immunodeficiency virus type 1 replication by RNA interference J Viral Sep. 2002 9225-9231 76.

Caudy, A. A., M. Myers, G. J. Hannon and S. M. Hammond. Fragile X-related protein and VIG associate with the RNA interference machinery Genes Dev Oct. 1, 2002 2491-2496 16.

Ishizuka, A., M. C. Siomi and H. Siomi. A Drosophila fragile X protein interacts with components of RNAi and ribosomal proteins Genes Dev Oct. 1, 2002 2497-2508 16.

Voinnet, O. RNA silencing: small RNAs as ubiquitous regulators of gene expression Curr Opin Plant Biol Oct. 2002 444-451 5.

Golden, T. A., S. E. Schauer, J. D. Lang, S. Pien, A. R. Mushegian, U. Grossniklaus, D. W. Meinke and A. Ray. Short Integuments1/Suspensor1/Carpel Factory, a Dicer homolog, is a maternal effect gene required for embryo development in *Arabidopsis* Plant Physiol Oct. 2002 808-822 130.

Merkle, I., M. J. Van Ooij, F. J. Van Kuppeveld, D. H. Glaudemans, J. M. Galama, A. Henke, R. Zell and W. J. Melchers. Biological significance of a human enterovirus B-specific RNA element in the 3' nontranslated region J Virol Oct. 2002 9900-9909 76.

Froeyen, M. and P. Herdewijn. RNA as a target for drug design, the example of Tat-TAR interaction Curr Top Med Chem Oct. 2002 1123-1145 2.

Carmell, M. A., Z. Xuan, M. Q. Zhang and G. J. Hannon. The Argonaute family: tentacles that reach into RNAi, developmental control, stem cell maintenance, and tumorigenesis Genes Dev Nov. 1, 2002 2733-2742 16.

Provost, P., D. Dishart, J. Doucet, D. Frendewey, B. Samuelsson and O. Radmark. Ribonuclease activity and RNA binding of recombinant human Dicer Embo J Nov. 1, 2002 5864-5874 21.

Zhang, H., F. A. Kolb, V. Brondani, E. Billy and W. Filipowicz. Human Dicer preferentially cleaves dsRNAs at their termini without a requirement for ATP Embo J Nov. 1, 2002 5875-5885 21.

Mallory, A. C., B. J. Reinhart, D. Bartel, V. B. Vance and L. H. Bowman. A viral suppressor of RNA silencing differentially regulates the accumulation of short interfering RNAs and micro-RNAs in tobacco Proc Natl Acad Sci U S A Nov. 12, 2002 15228-15233 99.

Gottesman, S. Stealth regulation: biological circuits with small RNA switches Genes Dev Nov. 15, 2002 2829-2842 16.

Galin, G. A., C. D. Dumitru, M. Shimizu, R. Bichi, S. Zupo, E. Noch, H. Aldler, S. Rattan, M. Keating, K. Rai, L. Rassenti, T. Kipps, M. Negrini, F. Bullrich and C. M. Croce. Frequent deletions and down-regulation of micro-RNA genes miR15 and miR16 at 13q14 in chronic lymphocytic leukemia Proc Natl Acad Sci U S A Nov. 26, 2002 15524-15529 99.

Gaudilliere, B., Y. Shi and A. Bonni. RNA interference reveals a requirement for myocyte enhancer factor 2A in activity-dependent neuronal survival J Biol Chem Nov. 29, 2002 46442-46446.

Jones, L. Revealing micro-RNAs in plants Trends Plant Sci Nov. 2002 473-475 7.

Schauer, S. E., S. E. Jacobsen, D. W. Meinke and A. Ray. Dicer-LIKE1: blind men and elephants in *Arabidopsis* development Trends Plant Sci Nov. 2002 487-491 7.

Okazaki, Y., M. Furuno, T. Kasukawa, J. Adachi, H. Bono, S. Kondo, et al. Analysis of the mouse transcriptome based on functional annotation of 60,770 full-length cDNAs Nature Dec. 5, 2002 563-573 420.

Dennis, C. Small RNAs: the genome's guiding hand? Nature Dec. 19-26, 2002 732 420.

Uchida, N., S. Hoshino, H. Imataka, N. Sonenberg and T. Katada. A novel role of the mammalian GSPT/eRF3 associating with poly(A)-binding protein in Cap/Poly(A)-dependent translation J Biol Chem Dec. 27, 2002 50286-50292 277.

Huttenhoper, A., J. Brosius and J. P. Bachellerie. RNomice: identification and function of small, non-messenger RNAs Curr Opin Chem Biol Dec. 2002 835-843 6.

Wood, N. T. Unravelling the molecular basis of viral suppression of PTGS Trends Plant Sci 2002 384 7.

Cohen, O., C. Erb, D. Ginzberg, Y. Pollak, S. Seidman, S. Shoham, R. Yirmiya and H. Soreq. Neuronal overexpression of "readthrough" acetylcholinesterase is associated with antisense-suppressible behavioral impairments Mol Psychiatry *No date in pubmed* 2002 874-885 7.

Mlotshwa, S., O. Voinnet, M. F. Mette, M. Matzke, H. Vaucheret, S. W. Ding, G. Pruss and V. B. Vance. RNA silencing and the mobile silencing signal Plant Cell *No date in pubmed* 2002 S289-301 14 Suppl.

Tang, G., B. J. Reinhart, D. P. Bartel and P. D. Zamore. A biochemical framework for RNA silencing in plants Genes Dev Jan. 1, 2003 49-63 17.

Kawasaki, H. and K. Taira. Short hairpin type of dsRNAs that are controlled by tRNA(Val) promoter significantly induce RNAi-mediated gene silencing in the cytoplasm of human cells Nucleic Acids Res Jan. 15, 2003 700-707 31.

Ashrafi, K., F. Y. Chang, J. L. Watts, A. G. Fraser, R. S. Kamath, J. Ahringer and G. Ruvkun. Genome-wide RNAi analysis of Caenorhabditis elegans fat regulatory genes Nature Jan. 16, 2003 268-272 421.

Kamath, R. S., A. G. Fraser, Y. Dong, G. Poulin, R. Durbin, M. Gotta, a. Kanapin, N. Le Bot, S. Moreno, M. Sohrmann, D. P. Welchman, P. Zipperlen and J. Ahringer. Systematic functional analysis of the Caenorhabditis elegans genome using RNAi Nature Jan. 16, 2003 231-237 421.

Tuschl, T. Functional genomics: RNA sets the standard Nature Jan. 16, 2003 220-221 421.

Iyer, L. M., E. V. Koonin and L. Aravind. Evolutionary connection between the catalytic subunits of DNA-dependent RNA polymerases and eukaryotic RNA-dependent RNA polymerases and the origin of RNA polymerases BMC Struct Biol Jan. 28, 2003 1 3.

Shi, Y. Mammalian RNAi for the masses Trends Genet Jan. 2003 9-12 19.

Cerutti, H. RNA interference: traveling in the cell and gaining functions? Trends Genet Jan. 2003 39-46 19.

Zeng, Y. and B. R. Cullen. Sequence requirements for micro RNA processing and function in human cells RNA Jan. 2003 112-123 9.

Kawasaki, H., E. Suyama, M. Iyo and K. Taira. siRNAs generated by recombinant human Dicer induce specific and significant but target site-independent gene silencing in human cells Nucleic Acids Res Feb. 1, 2003 981-987 31.

Reiner, A., D. Yekutieli and Y. Benjamini. Identifying differentially expressed genes using false discovery rate controlling procedures Bioinformatics Feb. 12, 2003 368-375 19.

Doench, J. G., C. P. Petersen and P. A. Sharp. siRNAs can function as miRNAs Genes Dev Feb. 15, 2003 438-442 17.

Gupta, V., A. Cherkassky, P. Chatis, R. Joseph, A. L. Johnson, J. Broadbent, T. Erickson and J. Dimeo. Directly labeled mRNA produces highly precise and unbiased differential gene expression data Nucleic Acids Res Feb. 15, 2003 e13 31.

Boffelli, D., J. McAuliffe, D. Ovcharenko, K. D. Lewis, I. Ovcharenko, L. Pachter and E. M. Rubin. Phylogenetic shadowing of primate sequences to find functional regions of the human genome Science Feb. 28, 2003 1391-1394 299.

Kasschau, K. D., Z. Xie, E. Allen, C. Llave, E. J. Chapman, K. A. Krizan and J. C. Carrington. P1/HC-Pro, a viral suppressor of RNA silencing, interferes with *Arabidopsis* development and miRNA unction Dev Cell Feb. 2003 205-2174.

Carmell, M. A., L. Zhang, D. S. Conklin, G. J. Hannon and T. A. Rosenquist. Germline transmission of RNAi in mice Nat Struct Biol Feb. 2003 91-92 10.

Dostie, J., Z. Mourelatos, M. Yang, A. Sharma and G. Dreyfuss. Numerous microRNPs in neuronal cells containing novel microRNAs RNA Feb. 2003 180-186 9.

Lagos-Quintana, M., R. Rauhut, J. Meyer, A. Borkhardt and T. Tuschl. New microRNAs from mouse and human RNA Feb. 2003 175-1799.

Wilson, J. A., S. Jayasena, A. Khvorova, S. Sabatinos, I. G. Rodrigue-Gervais, S. Arya, Sarangi, M. Harris-Brandts, S. Beaulieu and C. D. Richardson. RNA interference blocks gene expression and RNA synthesis from hepatitis C replicons propagated in human liver cells Proc Natl Acad Sci U S A Mar. 4, 2003 2783-2788 100.

Lim, L. P., M. E. Glasner, S. Yekta, C. B. Burge and D. P. Bartel. Vertebrate microRNA genes Science Mar. 7, 2003 1540 299.

Maniataki, E., A. E. Martinez De Alba, R. Sagesser, M. Tabler and M. Tsagris. Viroid RNA systemic spread may depend on the interaction of a 71-nucleotide bulged hairpin with the host protein VirP1 Rna Mar. 2003 346-354 9.

Ambros, V., B. Bartel, D. P. Bartel, C. B. Burge, J. C. Carrington, X. Chen, G. Dreyfuss, S. R. Eddy, S. Griffiths-Jones, M. Marshall, M. Matzke, G. Ruvkun and T. Tuschl. A uniform system for microRNA annotation Rna Mar. 2003 277-279 9.

Findley, S. D., M. Tamanaha, N. J. Clegg and H. Ruohola-Baker. Maelstrom, a Drosophila spindle-class gene, encodes a protein that colocalizes with Vasa and RDE1/AGO1 homolog, Aubergine, in nuage Development Mar. 2003 859-871 130.

Hershberg, R., S. Altuvia and H. Margalit. A survey of small RNA-encoding genes in *Escherichia coli* Nucleic Acids Res Apr. 1, 2003 1813-1820 31.

Zhou, A., S. Scoggin, R. B. Gaynor and N. S. Williams. Identification of NF-kappa B-regulated genes induced by TNFalpha utilizing expression profiling and RNA interference Oncogene Apr. 3, 2003 2054-2064 22.

Brennecke, J., D. R. Hipfner, A. Stark, R. B. Russell and S. M. Cohen. bantam encodes a developmentally regulated microRNA that controls cell proliferation and regulates the proapoptotic gene hid in *Drosophila* Cell Apr. 4, 2003 25-36 113.

Lim, L. P., N. C. Lau, E. G. Weinstein, S. Abdelhakim, S. Yekta, M. W. Rhoades, C. B. Burge and D. P. Bartel. The microRNAs of *Caenorhabditis elegans* Genes Dev Apr. 15, 2003 991-1008 17.

Xu, P., S. Y. Vernooy, M. Guo and B. A. Hay. The Drosophila microRNA Mir-14 suppresses cell death and is required for normal fat metabolism Curr Biol Apr. 29, 2003 790-795 13.

Xie, Z., K. D. Kasschau and J. C. Carrington. Negative feedback regulation of Dicer-Like1 in *Arabidopsis* by microRNA-guided mRNA degradation Curr Biol Apr. 29, 2003 784-789 13.

Carmichael, G. G. Antisense starts making more sense Nat Biotechnol Apr. 2003 371-372 21.

Yelin, R., D. Dahary, R. Sorek, E. Y. Levanon, O. Goldstein, A. Shoshan, A. Diber, S. Biton, Y. Tamir, R. Khosravi, S. Nemzer, E. Pinner, S. Walach, J. Bernstein, K. Savitsky and G. Rotman. Widespread occurrence of antisense transcription in the human genome Nat Biotechnol Apr. 2003 379-386 21.

Boutet, S., F. Vazquez, J. Liu, C. Beclin, M. Fagard, A. Gratias, J. B. Morel, P. Crete, X. Chen and H. Vaucheret. Arabidopsis HEN1: a genetic link between endogenous miRNA controlling development and siRNA controlling transgene silencing and virus resistance Curr Biol May 13, 2003 843-848 13.

Ambros, V., R. C. Lee, A. Lavanway, P. T. Williams and D. Jewell. MicroRNAs and other tiny endogenous RNAs in C. elegans Curr Biol May 13, 2003 807-818 13.

Liang, X. S., J. Q. Lian, Y. X. Zhou, Q. H. Me and C. Q. Hao. A small yeast RNA inhibits HCV Ires mediated translation and inhibits replication of poliovirus in vivo World J Gastroenterol May 2003 1008-1013 9.

Grad, Y., J. Aach, G. D. Hayes, B. J. Reinhart, G. M. Church, G. Ruvkun and J. Kim. Computational and experimental identification of C. elegans microRNAs Mol Cell May 2003 1253-1263 11.

Abrahante, J. E., A. L. Daul, M. Li, M. L. Volk, J. M. Tennessen, E. A. Miller and A. E. Rougvie. The Caenorhabditis elegans hunchback-like gene lin-57/hbl-1 controls developmental time and is regulated by microRNAs Dev Cell May 2003 625-637 4.

Lin, S. Y., S. M. Johnson, M. Abraham, M. C. Vella, A. Pasquinelli, C. Gamberi, E. Gottlieb and F. J. Slack. The C elegans hunchback homolog, hbl-1, controls temporal patterning and is a probable microRNA target Dev Cell May 2003 639-650 4.

Zamvil, S. S. and L. Steinman. Diverse targets for intervention during inflammatory and neurodegenerative phases of multiple sclerosis Neuron Jun. 5, 2003 685-688 38.

Ambros, V. MicroRNA pathways in flies and worms: growth, death, fat, Stress, and timing Cell Jun. 13, 2003 673-676 113.

Moss, E. G. and L. Tang. Conservation of the heterochronic regulator Lin-28, its developmental expression and microRNA complementary sites Dev Biol Jun. 15, 2003 432-442 258.

Smalheiser, N. R. EST analyses predict the existence of a population of chimeric microRNA precursor-mRNA transcripts expressed in normal human and mouse tissues Genome Biol Epub 2003 Jun. 18, 2003 403 4.

Kawasaki, H. and K. Taira. Hes1 is a target of microRNA-23 during retinoic-acid-induced neuronal differentiation of NT2 cells Nature Jun. 19, 2003 838-842 423.

Lai, E. C., P. Tomancak, R. W. Williams and G. M. Rubin. Computational identification of Drosophila microRNA genes Genome Biol Epub 2003 Jun. 30, 2003 R42 4.

No author listed. Whither RNAi? Nat Cell Biol Jun. 2003 489-490 5.

Bartel, B. and D. P. Bartel. MicroRNAs: at the root of plant development? Plant Physiol Jun. 2003 709-717 132.

Dykxhoorn, D. M., C. D. Novina and P. A. Sharp. Killing the messenger: short RNAs that silence gene expression Nat Rev Mol Cell Biol Jun. 2003 457-467 4.

Saunders, L. R. and G. N. Barber. The dsRNA binding protein family: critical roles, diverse cellular functions Faseb J Jun. 2003 961-983 17.

Steinman, L. and S. Zamvil. Transcriptional analysis of targets in multiple sclerosis Nat Rev Immunol Jun. 2003 483-492 3.

Qi, Y. and B. Ding. Inhibition of cell growth and shoot development by a specific nucleotide sequence in a noncoding viroid RNA Plant Cell Jun. 2003 1360-1374 15.

Jackson, A. L., S. R. Bartz, J. Schelter, S. V. Kobayashi, J. Burchard, M. Mao, B. Li, G. Cavet and P. S. Linsley. Expression profiling reveals off-target gene regulation by RNAi Nat Biotechnol Jun. 2003 635-637 21.

Bashirullah, A., A. E. Pasquinelli, A. A. Kiger, N. Perrimon, G. Ruvkun and C. S. Thummel. Coordinate regulation of small temporal RNAs at the onset of *Drosophila metamorphosis* Dev Biol Jul. 1, 2003 1-8 259.

Sempere, L. F., N. S. Sokol, E. B. Dubrovsky, E. M. Berger and V. Ambros. Temporal regulation of microRNA expression in *Drosophila melanogaster* mediated by hormonal signals and broad-Complex gene activity Dev Biol Jul. 1, 2003 9-18 259.

Heetebrij, R. J., E. G. Talman, M. A. V Velzen, R. P. Van Gijlswijk, S. S. Snoeijers, M. Schalk, J. Wiegant, F. V D Rijke, R. M. Kerkhoven, A. K. Raap, H. J. Tanke, J. Reedijk and H. J. Houthoff. Platinum(II)-based coordination compounds as nucleic acid labeling reagents: synthesis, reactivity, and applications in hybridization assays Chembiochem Jul. 7, 2003 573-583 4.

Borodina, T. A., H. Lehrach and A. V. Soldatov. Ligation-based synthesis of oligonucleotides with block structure Anal Biochem Jul. 15, 2003 309-313 318.

Johnson, S. M., S. Y. Lin and F. J. Slack. The time of appearance of the C. elegans let-7 microRNA is transcriptionally controlled utilizing a temporal regulatory element in its promoter Dev Biol Jul. 15, 2003 364-379 259.

Carrington, J. C. and V. Ambros. Role of microRNAs in plant and animal development Science Jul. 18, 2003 336-338 301.

Smale, S. T. The establishment and maintenance of lymphocyte identity through gene silencing Nat Immunol Jul. 2003 607-615 4.

Bridge, A. J., S. Pebernard, A. Ducraux, A. L. Nicoulaz and R. Iggo. Induction of an interferon response by RNAi vectors in mammalian cells Nat Genet Jul. 2003 263-264 34.

Seitz, H., N. Youngson, S. P. Lin, S. Dalbert, M. Paulsen, J. P. Bachellerie, A. C. Ferguson-Smith and J. Cavaille. Imprinted microRNA genes transcribed antisense to a reciprocally imprinted retrotransposon-like gene Nat Genet Jul. 2003 261-262 34.

Zeng, Y., R. Vi and B. R. Cullen. MicroRNAs and small interfering RNAs can inhibit mRNA expression similar mechanisms Proc Natl Acad Sci USA Aug. 19, 2003 9779-9784 100.

Schramke, V. and R. Allshire. Hairpin RNAs and retrotransposon LTRs effect RNAi and chromatin-based gene silencing Science Aug. 22, 2003 1069-1074 301.

Wiznerowicz, M. And D. Trono. Conditional suppression of cellular genes: lentivirus vector-mediated drug-inducible RNA interference J Virol Aug. 2003 8957-8961 77.

Lau, N. C. and D. P. Bartel. Censors of the genome Sci Am Aug. 2003 34-41 289.

Houbaviy, H. B., M. F. Murray and P. A. Sharp. Embryonic stem cell-specific MicroRNAs Dev Cell Aug. 2003 351-358 5.

Aravin, A. A., M. Lagos-Quintana, A. Yalcin, M. Zavolan, D. Marks, B. Snyder, T. Gaasterland, J. Meyer and T. Tuschl. The small RNA profile during *Drosophila melanogaster* development Dev Cell Aug. 2003 337-350 5.

McManus, M. T. MicroRNAs and cancer Semin Cancer Biol Aug. 2003 253-258 13.

Baner, J., A. Isaksson, E. Waldenstrom, J. Jarvius, U. Landegren and M. Nilsson. Parallel gene analysis with allele-specific padlock probes and tag microarrays Nucleic Acids Res Sep. 1, 2003 e103 31.

Boutla, A., C. Delidakis and M. Tabler. Developmental defects by antisense-mediated inactivation of micro-RNAs 2 and 13 in *Drosophila* and the identification of putative target genes Nucleic Acids Res Sep. 1, 2003 4973-4980 31.

Palatnik, J. F., E. Allen, X. Wu, C. Schommer, R. Schwab, J. C. Carrington and D. Weigel. Control of leaf morphogenesis by microRNAs Nature Sep. 18, 2003 257-263 425.

Klein, R. J. And S. R. Eddy. Rsearch: finding homologs of single structured RNA sequences BMC Bioinformatics Sep. 22, 2003 44 4.

Caudy, A. A., R. F. Ketting, S. M. Hammond, A. M. Denli, A. M. Bathoorn, B. B. Tops, J. M. Silva, M. M. Myers, G. J. Hannon and R. H. Plasterk. A micrococcal nuclease homologue in RNAi effector complexes Nature Sep. 25, 2003 411-414 425.

Lee, Y., C. Ahn, J. Han, H. Choi, J. Kim, J. Yim, J. Lee, P. Provost, O. Radmark, S. Kim and V. N. Kim. The nuclear RNase III Drosha initiates microRNA processing Nature Sep. 25, 2003 415-419 425.

Sledz, C. A., M. Holko, M. J. De Veer, R. H. Silverman and B. R. Williams. Activation of the interferon system by short-interfering RNAs Nat Cell Biol Sep. 2003 834-839 5.

Bergmann, A. and M. E. Lane. HIDden targets of microRNAs for growth control Trends Biochem Sci Sep. 2003 461-463 28.

Khvorova, A., A. Reynolds and S. D. Jayasena. Functional siRNAs and miRNAs exhibit strand bias Cell Oct. 17, 2003 209-216 115.

Schwarz, D. S., G. Hutvagner, T. Du, Z. Xu, N. Aronin and P. D. Zamore. Asymmetry in the assembly of the RNAi enzyme complex Cell Oct. 17, 2003 199-208 115.

Abbott, A. L. Heterochronic genes Curr Biol Oct. 28, 2003 R824-825 13.

Hake, S. MicroRNAs: a role in plant development Curr Biol Oct. 28, 2003 R851-852 13.

Carthew, R. W. Making and breaking with nucleases and small RNAs Nat Struct Biol Oct. 2003 776-777 10.

Krichevsky, A. M., K. S. King, C. P. Donahue, K. Khrapko and K. S. Kosik. A microRNA array reveals extensive regulation of microRNAs during brain development RNA Oct. 2003 1274-1281 9.

Mattick, J. S. Challenging the dogma: the hidden layer of non-protein-coding RNAs in complex organisms Bioessays Oct. 2003 930-939 25.

Nelson, P., M. Kiriakidou, A. Sharma, E. Maniataki and Z. Mourelatos. The microRNA world: small is mighty Trends Biochem Sci Oct. 2003 534-540 28.

Michael, M. Z., O. C. SM, N. G. Van Holst Pellekaan, G. P. Young and R. J. James. Reduced accumulation of specific microRNAs in colorectal neoplasia Mol Cancer Res Oct. 2003 882-891 1.

Allinson, T. M., E. T. Parkin, A. J. Turner and N. M. Hooper. ADAMs family members as amyloid precursor protein alpha-secretases J Neurosci Res Nov. 1, 2003 342-352 74.

Kawasaki, H. and K. Taira. Retraction: Hes1 is a target of microRNA-23 during retinoic-acid-induced neuronal differentiation of NT2 cells Nature Nov. 6, 2003 100 426.

Saxena, S., Z. O. Jonsson and A. Dutta. Small RNAs with imperfect match to endogenous mRNA repress translation. Implications for off-target activity of small inhibitory RNA in mammalian cells J Biol Chem Nov. 7, 2003 44312-44319 278.

Basyuk, E., F. Suavet, A. Doglio, R. Bordonne and E. Bertrand. Human let-7 stem-loop precursors harbor features of RNase III cleavage products Nucleic Acids Res Nov. 15, 2003 6593-6597 31.

Stevenson, M. Dissecting HIV-1 through RNA interference Nat Rev Immunol Nov. 2003 851-858 3.

Wienholds, E., M. J. Koudijs, F. J. Van Eeden, E. Cuppen and R. H. Plasterk. The microRNA-producing enzyme Dicer1 is essential for zebrafish development Nat Genet Nov. 2003 217-218 35.

Gibbs, W. W. The unseen genome: gems among the junk Sci Am Nov. 2003 26-33 289.

Chang, J., P. Provost and J. M. Taylor. Resistance of human hepatitis delta virus RNAs to dicer activity J Virol Nov. 2003 11910-11917 77.

Wang, D., A. Urisman, Y. T. Liu, M. Springer, T. G. Ksiazek, D. D. Erdman, E. R. Mardis, M. Hickenbotham, V. Magrini, J. Eldred, J. P. Latreille, R. K. Wilson, D. Ganem and J. L. Derisi. Viral discovery and sequence recovery using DNA microarrays PLoS Biol Nov. 2003 E2 1.

Aukerman, M. J. and H. Sakai. Regulation of flowering time and floral organ identity by a MicroRNA and its APETALA2-like target genes Plant Cell Nov. 2003 2730-2741 15.

Finnegan, E. J. and M. A. Matzke. The small RNA world J Cell Sci Dec. 1, 2003 4689-4693 116.

Enright, A. J., B. John, U. Gaul, T. Tuschl, C. Sander and D. S. Marks. MicroRNA targets in *Drosophila* Genome Biol Epub 2003 Dec. 12, 2003 R1 5.

Rosok, O. and M. Sioud. Systematic identification of sense-antisense transcripts in mammalian cells Nat Biotechnol Jan. (Epub 2003 Dec. 14) 2004 104-108 22.

Yl, R., Y. Qin, I. G. Macara and B. R. Cullen. Exportin-5 mediates the nuclear export of pre-microRNAs and short hairpin RNAs Genes Dev Dec. 15, 2003 3011-3016 17.

Cao, X., W. Aufsatz, D. Zilberman, M. F. Mette, M. S. Huang, M. Matzke and S. E. Jacobsen. Role of the DRM and CMT3 methyltransferases in RNA-directed DNA methylation Curr Biol Dec. 16, 2003 2212-2217 13.

Ye, K., L. Malinina and D. J. Patel. Recognition of small interfering RNA by a viral suppressor of RNA silencing Nature Dec. 18, 2003 874-878 426.

Johnston, R. J. and O. Hobert. A microRNA controlling left/right neuronal asymmetry in Caenorhabditis elegans Nature Dec. 18, 2003 845-849 426.

Xayaphoummine, A., T. Bucher, F. Thalmann and H. Isambert. Prediction and statistics of pseudoknots in RNA structures using exactly clustered stochastic simulations Proc Natl Acad Sci U S A Dec. 23, 2003 15310-15315 100.

Lewis, B. P., I. H. Shih, M. W. Jones-Rhoades, D. P. Bartel and C. B. Burge. Prediction of mammalian microRNA targets Cell Dec. 26, 2003 787-798 115.

Robinson, W. H., P. J. Utz and L. Steinman. Genomic and proteomic analysis of multiple sclerosis. Opinion Curr Opin Immunol Dec. 2003 660-667 15.

Gibbs, W. W. The unseen genome: beyond DNA Sci Am Dec. 2003 106-113 289.

Stark, A., J. Brennecke, R. B. Russell and S. M. Cohen. Identification of Drosophila MicroRNA targets PLoS Biol Dec. 2003 E60 1.

Stein, T. D. and J. A. Johnson. Genetic programming by the proteolytic fragments of the amyloid precursor protein: somewhere between confusion and clarity Rev Neurosci *no date in pubmed* 2003 317-341 14.

Szymanski, M., M. Z. Barciszewska, M. Zywicki and J. Barciszewski. Noncoding RNA transcripts J Appl Genet *No Datein Pubmed* 2003 1-19 44.

Griffiths-Jones, S. The microRNA Registry Nucleic Acids Res Jan. 1, 2004 D109-111 32.

Chen, C. Z., L. Li, H. F. Lodish and D. P. Bartel. MicroRNAs modulate hematopoietic lineage differentiation Science Jan. 2, 2004 83-86 303.

Kim, J., A. Krichevsky, Y. Grad, G. D. Hayes, K. S. Kosik, G. M. Church and G. Ruvkun. Identification of many microRNAs that copurify with polyribosomes in mammalian neurons Proc Natl Acad Sci U S A Jan. 6, 2004 360-365 101.

Ohno, M., E. A. Sametsky, L. H. Younkin, H. Oakley, S. G. Younkin, M. Citron, R. Vassar and J. F. Disterhoft. BACE1 deficiency rescues memory deficits and cholinergic dysfunction in a mouse model of Alzheimer's disease Neuron Jan. 8, 2004 27-33 41.

Vella, M. C., E. Y. Choi, S. Y. Lin, K. Reinert and F. J. Slack. The C. elegans microRNA let-7 binds to imperfect let-7 complementary sites from the lin-41 3'UTR Genes Dev Jan. 15, 2004 132-137 18.

Kao, S. C., A. M. Krichevsky, K. S. Kosik and L. H. Tsai. BACE1 suppression by RNA interference in primary cortical neurons J Biol Chem Jan. 16, 2004 1942-1949 279.

Hofacker, I. L., B. Priwitzer and P. F. Stadler. Prediction of locally stable RNA secondary structures for genome-wide surveys Bioinformatics Jan. 22, 2004 186-190 20.

Ruvkun, G., B. Wightman and I. Ha. The 20 years it took to recognize the importance of tiny RNAs Cell Jan. 23, 2004 S93-96, 92 p. following S96 116.

Bartel, D. P. MicroRNAs: genomics, biogenesis, mechanism, and function Cell Jan. 23, 2004 281-297 116.

Han, M. H., S. Goud, L. Song and N. Fedoroff. The *Arabidopsis* double-stranded RNA-binding protein HYL1 plays a role in microRNA-mediated gene regulation Proc Natl Acad Sci U S A Jan. 27, 2004 1093-1098 101.

Hartig, J. S., I. Grune, S. H. Najafi-Shoushtari and M. Famulok. Sequence-specific detection of MicroRNAs by signal-amplifying ribozymes J Am Chem Soc Jan. 28, 2004 722-723 126.

Nishitsuji, H., T. Ikeda, H. Miyoshi, T. Ohashi, M. Kannagi and T. Masuda. Expression of small hairpin RNA by lentivirus-based vector confers efficient and stable gene-suppression of HIV-1 on human cells including primary non-dividing cells Microbes Infect Jan. 2004 76-85 6.

Ota, T., Y. Suzuki, T. Nishikawa, T. Otsuki, T. Sugiyama, R. Irie, A., et al. Complete sequencing and characterization of 21,243 full-length human cDNAs Nat Genet Jan. 2004 40-45 36.

Bromberg JF et al. Stat3 as an Oncogene. Cell 1999;98:295-303.

Fabani MM and Gait MJ. miR-122 targeting with LNA/2'-O-methyl oligonucleotide mixmers, peptide nucleic acids (PNA), and PNA peptie conjugates. RNA 2008;14(2):336-46.

Petris MJ et al. Copper-regulated Trafficking of the Menkes Disease Copper ATPase Is Associated with Formation of a Phosphorylated Catalytic Intermediate. Jo. Biol. Chem. 2002;277(48):46736-42.

\* cited by examiner

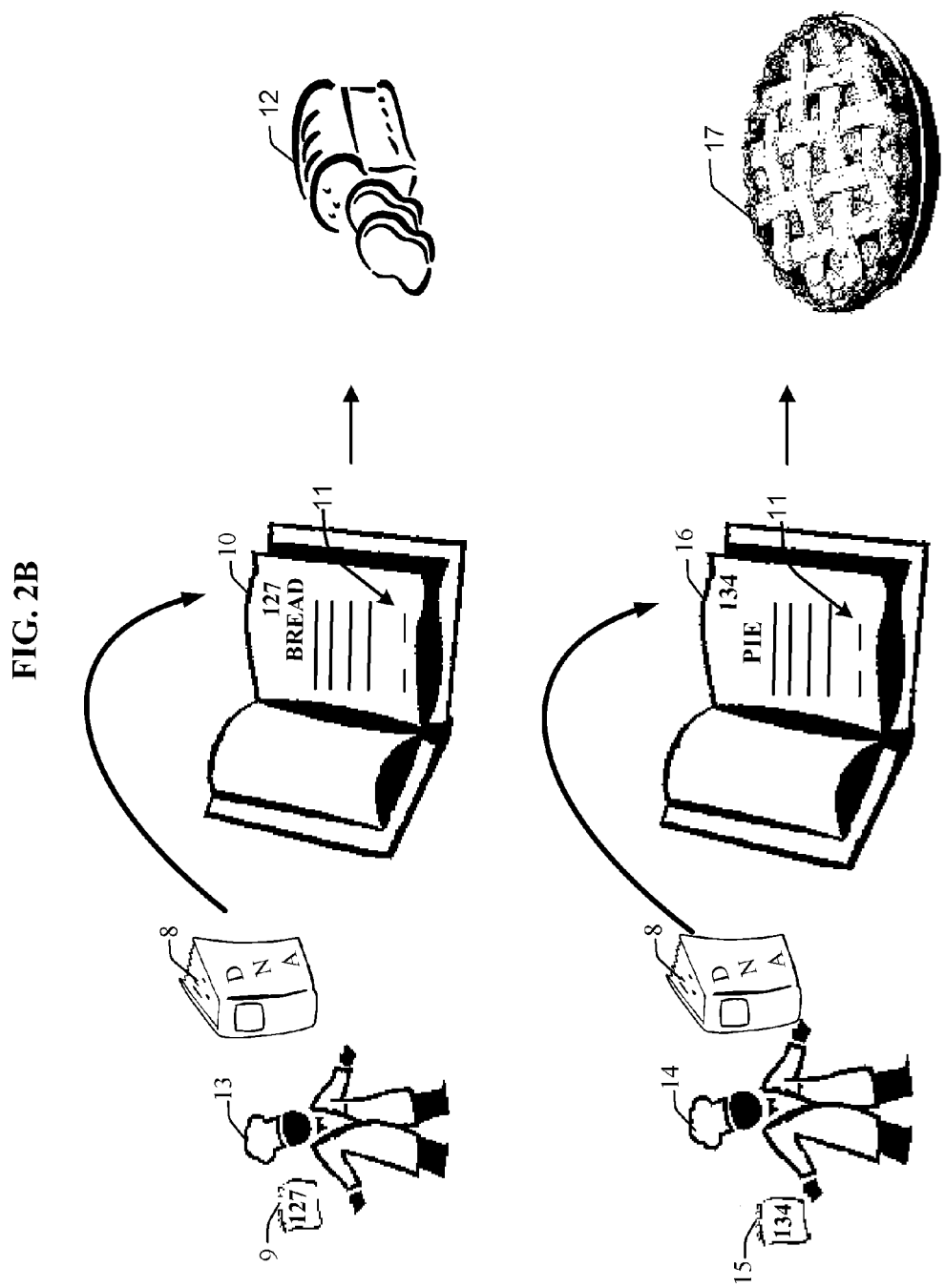

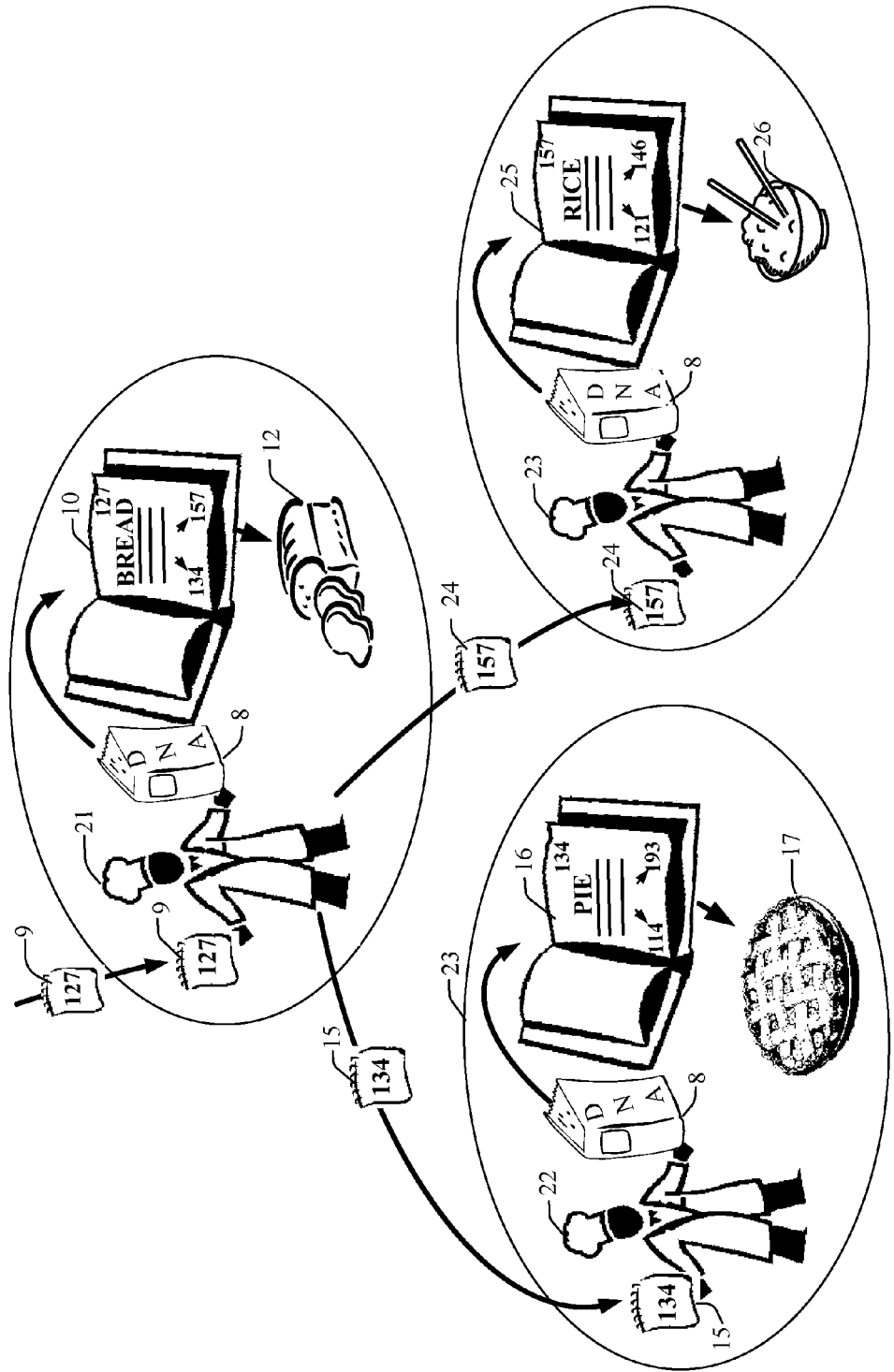

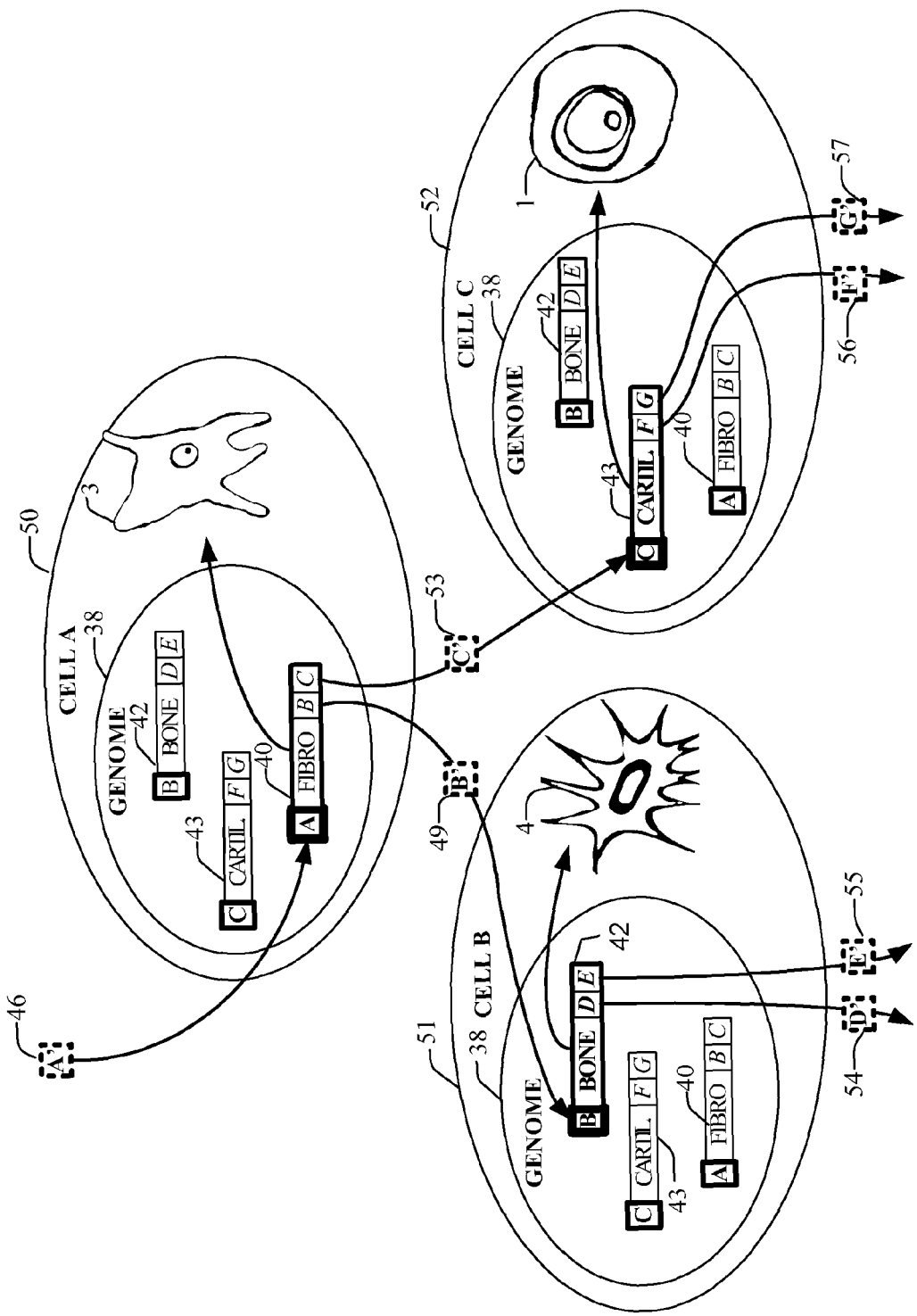

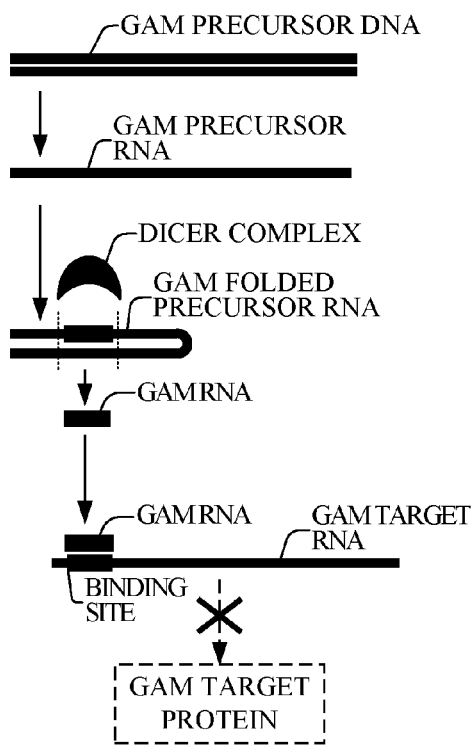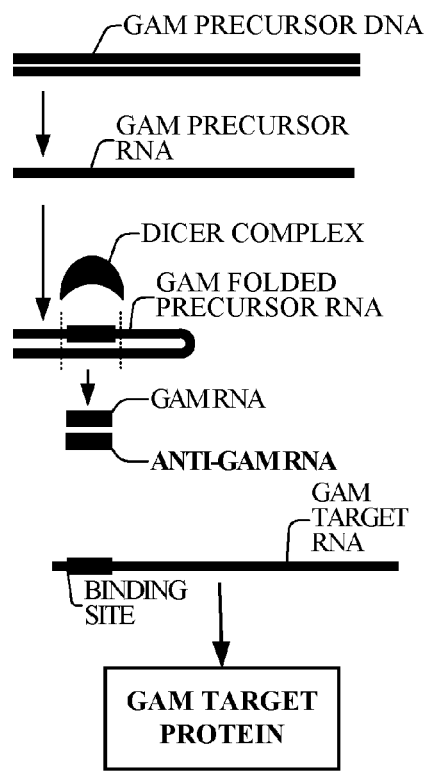
FIG. 20A
FIG. 20B

FIG. 21B

| GAM Detection Accuracy Group | Number of published hairpins | Precision on hairpin mixture | Lab validation of Human GAMs | | | Hairpins in RNA databases | Hairpins of the present invention |
|---|---|---|---|---|---|---|---|
| | | | Sent | Positive | % success | | |
| A | 228 | 76% | 101 | 37 | 37% | 2821 | 1503 |
| B | 135 | 41% | 56 | 13 | 23% | 19950 | 367 |
| C | 27 | 18% | 7 | 1 | 14% | 11765 | 19 |
| D | 20 | 10% | 4 | 1 | 25% | 7876 | 2 |
| Overall | 410 | 44% | 168 | 52 | 31% | 42416 | 1891 |

FIG. 22B

| NUMBER | NAME | SEQUENCE (5 TO 3) | SEQUENCED | Seq ID |
|---|---|---|---|---|
| 1 | hsa-miR-21 | TAGCTTATCAGACTGATGTTGA | + | 142622 |
| 2 | hsa-miR-27b | TTCACAGTGGCTAAGTTCTGCA | + | 142623 |
| 3 | hsa-miR-186 | AAAGAATTCTCCTTTTGGGCTT | + | 142624 |
| 4 | hsa-miR-93 | AAGTGCTGTTCGTGCAGGTAGT | + | 142625 |
| 5 | hsa-miR-26a | TCAAGTAATCCAGGATAGGCTG | + | 142626 |
| 6 | hsa-miR-191 | AACGGAATCCCAAAAGCAGCTG | + | 142627 |
| 7 | hsa-miR-31 | GGCAAGATGCTGGCATAGCTGT | + | 142628 |
| 8 | hsa-miR-92 | TATTGCACTTGTCCCGGCCTGT | + | 142629 |
| 9 | GAM3418-A | ATCACATTGCCAGGGATTACCA | + | 142630 |
| 10 | GAM4426-A | GAAGTTTGAAGCCTGTTGTTCA | + | 142631 |
| 11 | GAM281-A | CACTGCACTCCAGCCTGGGCAA |  | 142632 |
| 12 | GAM7553-A | TAGGTAGTTTCCTGTTGTTGGG | + | 142633 |
| 13 | GAM5385-A | TCACAGTGAACCGGTCTCTTTC | + | 142634 |
| 14 | GAM2608-A | TAAGGTGCATCTAGTGCAGTTA |  | 142635 |
| 15 | GAM1032-A | CTAGACTGAAGCTCCTTGAGGA | + | 142636 |
| 16 | GAM3431-A | TAATACTGCCGGGTAATGATGG |  | 142637 |
| 17 | GAM7933-A | TAGCAGCACATAATGGTTTGAA |  | 142638 |
| 18 | GAM3298-A | AAAGTGCTCATAGTGCAGGTAG | + | 142639 |
| 19 | GAM7080-A | TTTCCACAGCGGCCAATTCTTC | + | 142640 |
| 20 | GAM895-A | AGCTGCCAGTTGAAGAACATTT |  | 142641 |
| 21 | GAM3770-A | AAGTTAAGAGCTCCCAGGCCTG |  | 142642 |
| 22 | GAM337162-A | ACTGCACTCCAGCCTGGGCAAC | + | 142643 |
| 23 | GAM8678-A | GTGTTCCAGGAAGTCGTCTTGA |  | 142644 |
| 24 | GAM2033-A | TCAAGCTCATTCCTCTAACCTC |  | 142645 |
| 25 | GAM2776-A | CATTGCACTCCAGCCTGGGCAA | + | 142646 |
| 26 | GAM8145-A | ACATGATCTCCTCACTCTAGGA |  | 142647 |
| 27 | GAM25-A | AATTGCTTGAACCCAGGAAGTG | + | 142648 |
| 28 | GAM7352-A | TGTTTAAGTAGCTTATTTATCT |  | 142649 |
| 29 | GAM337624-A | TCTAAGAGAAAGGAAGTTCAGA | + | 142650 |
| 30 | GAM1479-A | GAAGGCAGTAGGTTGTATAGTT | + | 142651 |
| 31 | GAM2270-A | ATCACATTGCCAGTGATTACCC | + | 142652 |
| 32 | GAM7591-A | TTGGAGTAATTCAGTATAGGTT | + | 142653 |
| 33 | GAM8285-A | AGTAGACAGTGGCAACATAGTC |  | 142654 |
| 34 | GAM6773-A | CTAGCCTGTTTGTCCTCACCCC | + | 142655 |
| 35 | GAM336818-A | TGAGGTGGGATCCCGAGGCC | + | 142656 |
| 36 | GAM336487-A | TGGCTAGGTAAGGGAAG | + | 142657 |
| 37 | GAM337620-A | AATCATCATTATTTTGAAGTTTA | + | 142658 |
| 38 | GAM336809-A | T AAGGCATTTT A TGGT | + | 142659 |
| 39 | GAM5346-A | GCTGTTGTTAAGGGCACTTGGG |  | 142660 |
| 40 | GAM8554-A | TTCATGGGAGCAGGTGGTACAG |  | 142661 |
| 41 | GAM2701-A | ACTGCACTCCAGTCTGGGTGAC |  | 142662 |
| 42 | GAM7957-A | TCACTGCAACCTCTGCCTCCCG |  | 142663 |
| 43 | GAM391-A | CAGATCACATCCATCCGTCACC |  | 142664 |
| 44 | GAM6633-A | GCACTCAAGCCTGGGTTACAGA |  | 142665 |
| 45 | GAM19 | AGAGAGTGGCAGGTCTGTTCCT |  | 142666 |
| 46 | GAM8358-A | GATGAGGCAGCACTTGGG |  | 142667 |
| 47 | GAM3229-A | TGAGGTGGGAGAATTGCTTGAA |  | 142668 |
| 48 | GAM7052-A | CATGTAATCCCAGCTACTCAGG |  | 142669 |
| 49 | GAM3027-A (mmu-MIR-29c) | TAGCACCATTTGAAATCGGTTA | + | 142670 |
| 50 | GAM21 (mmu-MIR-130b) | CAGTGCAATGATGAAAGGGCAT | + | 142671 |
| 51 | GAM oligonucleotide (mmu-MIR 30e) | TGTAAACATCCTTGACTGGAAG | + | 142672 |

FIG. 24A

EST72223 (705 nt.)

EST72223 sequence:

CCCTTATTAGAGGATTCTGCTCATGCCAGGG<u>GTGAGGTAGTAAGTTGTATTG</u>
<u>TT</u>GTGGGGTAGGGATATTAGGCCCCAATTAGAAGATAACTATACAACT  MIR98
TACTACTTTCCCTGGTGTGTGGCATATTCACACTTAGTCTTAGCAGTGTTGCC
TCCATCAGACAAAGTTGTAGATGTTCCTTGGATAATTTGGACTGGAAGAAAAGA
GACATGGAAGGGGACAGATGGTGTTTAGGGTGAGGCAGATGTCATTATAAAGT
GACTTGTCTTTCATTAATTGGAGCATATAATTATTTTACCTTTGGGCATGAACTC
ATTTTGCTATTCTTCAACTGTGTAATGATTGCATTTTATTAGTAATAGAACAGGA
ATGTGTGCAAGGGAATGGAAAGCATACTTTAAGAATTTTGGGCCAGGCGCGGT
GGTTCATGCCTGTAATCCCAGCATTTTTGGGAGGCCGAGGCGGGTGGATCAC
CTGAGGTCAGGAGTTCGAGACCAACCTGGCCAACACGGCGAAACCCCGCCTC
TACTCAAATACAAAAATTAGCCAGGCTTGGTGACACTCGCCTGTGGTCCCAGC
TACTCAGGAGGCTGAGGCAGGAGAATTGCTTGAACCCAGGAAGTGGAG  GAM25
GCTTCAGTGAGCTGAGAACACGCCACTGCACTCCAGTCCTGGGCAAC
AGAGCAAGACTCTGTCTCAGGAAAAAAAAAG

FIG. 24B

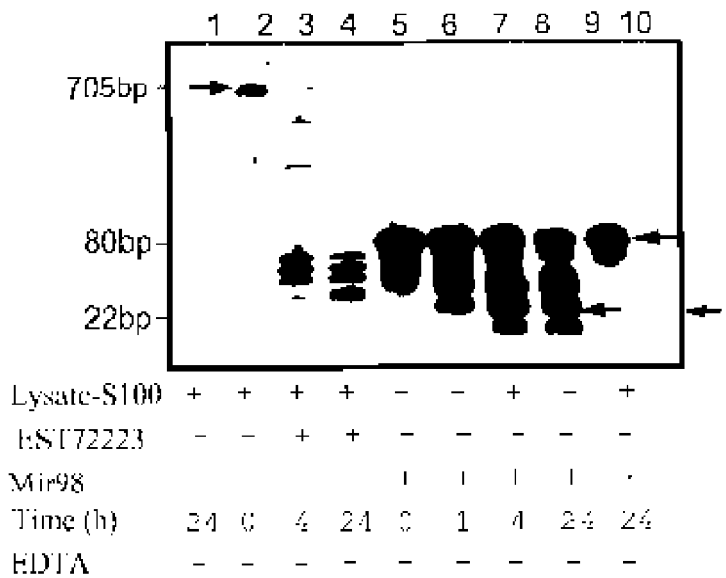

BIOINFORMALITY DETECTABLE GROUP OF NOVEL REGULATORY OLIGONUCLEOTIDES AND USES THEREOF

CROSS REFERENCE TO RELATED APPLICATIONS

This application is a continuation in part of and claims priority from the following patent applications, the disclosures of which applications are all hereby incorporated herein by reference: U.S. patent application Ser. No. 10/707,147 filed 24 Nov. 2003, U.S. patent application Ser. No. 10/604,985 filed 29 Aug. 2003, U.S. patent application Ser. No. 10/651,227 filed 29 Aug. 2003, U.S. patent application Ser. No. 10/649,653 filed 28 Aug. 2003, U.S. patent application Ser. No. 10/604,926 filed 27 Aug. 2003, U.S. patent application Ser. No. 10/604,726 filed 13 Aug. 2003, U.S. patent application Ser. No. 10/604,727 filed 13 Aug. 2003, and U.S. Provisional Patent Application Ser. No. 60/468,251 filed 7 May 2003. This application also claims priority from International Application Number: PCT/IL 03/00970, filed 16 Nov. 2003, the disclosure of which application is hereby incorporated herein by reference. All of the aforesaid patent applications are entitled "Bioinformatically Detectable Group of Novel Regulatory Genes and Uses Thereof"; U.S. patent application Ser. No. 10/707,147, filed 24 Nov. 2003, entitled "Bioinformatically Detectable Group of Novel Regulatory Genes and Uses Thereof" is a continuation in part of and claims priority from the following patent applications, the disclosures of which applications are all hereby incorporated herein by reference: International Application Number: PCT/IL 03/00970, filed 16 Nov. 2003, U.S. patent application Ser. No. 10/604,985 filed 29 Aug. 2003, U.S. patent application Ser. No. 10/651,227 filed 29 Aug. 2003, U.S. patent application Ser. No. 10/649,653 filed 28 Aug. 2003, U.S. patent application Ser. No. 10/604,926 filed 27 Aug. 2003, U.S. patent application Ser. No. 10/604,726 filed 13 Aug. 2003, U.S. patent application Ser. No. 10/604,727 filed 13 Aug. 2003, and U.S. Provisional Patent Application Ser. No. 60/468,251 filed 7 May 2003. All of the aforesaid patent applications are entitled "Bioinformatically Detectable Group of Novel Regulatory Genes and Uses Thereof"; International Application Number: PCT/IL 03/00970, filed 16 Nov. 2003, entitled "Bioinformatically Detectable Group of Novel Regulatory Genes and Uses Thereof" is a continuation in part of and claims priority from the following patent applications, the disclosures of which applications are all hereby incorporated herein by reference: U.S. patent application Ser. No. 10/604,985 filed 29 Aug. 2003, U.S. patent application Ser. No. 10/651,227 filed 29 Aug. 2003, U.S. patent application Ser. No. 10/649,653 filed 28 Aug. 2003, U.S. patent application Ser. No. 10/604,926 filed 27 Aug. 2003, U.S. patent application Ser. No. 10/604,726 filed 13 Aug. 2003, U.S. patent application Ser. No. 10/604,727 filed 13 Aug. 2003, U.S. Provisional Patent Application Ser. No. 60/468,251 filed 7 May 2003, and U.S. patent application Ser. No. 10/345,201 filed 16 Jan. 2003. All of the aforesaid patent applications are entitled "Bioinformatically Detectable Group of Novel Regulatory Genes and Uses Thereof"; U.S. patent application Ser. No. 10/604,985, filed 29 Aug. 2003, entitled "Bioinformatically is a continuation of U.S. Provisional Patent Application Ser. No. 60/468,251, filed 7 May 2003, entitled "Bioinformatically Detectable Group of Novel Regulatory Genes and Uses Thereof" the disclosure of which is hereby incorporated herein and claims priority therefrom; and is a continuation in part of and claims priority from the following patent applications, the disclosures of which applications are all hereby incorporated herein by reference: U.S. patent application Ser. No. 10/651,227 filed 29 Aug. 2003, U.S. patent application Ser. No. 10/649,653 filed 28 Aug. 2003, U.S. patent application Ser. No. 10/604,926 filed 27 Aug. 2003, U.S. patent application Ser. No. 10/604,726 filed 13 Aug. 2003, U.S. patent application Ser. No. 10/604,727 filed 13 Aug. 2003, U.S. patent application Ser. No. 10/345,201 filed 16 Jan. 2003, U.S. patent application Ser. No. 10/321,503 filed 18 Dec. 2002, U.S. patent application Ser. No. 10/310,914 filed 6 Dec. 2002, and U.S. patent application Ser. No. 10/293,338 filed 14 Nov. 2002. All of the aforesaid patent applications are entitled "Bioinformatically Detectable Group of Novel Regulatory Genes and Uses Thereof"; U.S. patent application Ser. No. 10/604,926, filed 27 Aug. 2003, entitled "Bioinformatically Detectable Group of Novel Regulatory Genes and Uses Thereof" is a continuation of U.S. patent application Ser. No. 10/345,201, filed 16 Jan. 2003, entitled "Bioinformatically Detectable Group of Novel Regulatory Genes and Uses Thereof" the disclosure of which is hereby incorporated herein and claims priority therefrom; and is a continuation in part of and claims priority from the following patent applications, the disclosures of which applications are all hereby incorporated herein by reference: U.S. patent application Ser. No. 10/604,726 filed 13 Aug. 2003, U.S. patent application Ser. No. 10/604,727 filed 13 Aug. 2003, U.S. Provisional Patent Application Ser. No. 60/468,251 filed 7 May 2003, U.S. patent application Ser. No. 10/321,503 filed 18 Dec. 2002, U.S. patent application Ser. No. 10/310,914 filed 6 Dec. 2002, and U.S. patent application Ser. No. 10/293,338 filed 14 Nov. 2002. All of the aforesaid patent applications are entitled "Bioinformatically Detectable Group of Novel Regulatory Genes and Uses Thereof"; U.S. patent application Ser. No. 10/649,653, filed 28 Aug. 2003, entitled "Bioinformatically Detectable Group of Novel Regulatory Genes and Uses Thereof" is a continuation of U.S. patent application Ser. No. 10/321,503, filed 18 Dec. 2002, entitled "Bioinformatically Detectable Group of Novel Regulatory Genes and Uses Thereof"; the disclosure of which is hereby incorporated herein and claims priority therefrom; and is a continuation in part of and claims priority from the following patent applications, the disclosures of which applications are all hereby incorporated herein by reference: U.S. patent application Ser. No. 10/604,926 filed 27 Aug. 2003, U.S. patent application Ser. No. 10/604,726 filed 13 Aug. 2003, U.S. patent application Ser. No. 10/604,727 filed 13 Aug. 2003, U.S. Provisional Patent Application Ser. No. 60/468,251 filed 7 May 2003, U.S. patent application Ser. No. 10/321,503 filed 18 Dec. 2002, U.S. patent application Ser. No. 10/310,914 filed 6 Dec. 2002, and U.S. patent application Ser. No. 10/293,338 filed 14 Nov. 2002. All of the aforesaid patent applications are entitled "Bioinformatically Detectable Group of Novel Regulatory Genes and Uses Thereof"; U.S. patent application Ser. No. 10/651,227, filed 29 Aug. 2003, entitled "Bioinformatically Detectable Group of Novel Regulatory Genes and Uses Thereof" is a continuation of U.S. patent application Ser. No. 10/310,914, filed 6 Dec. 2002, entitled "Bioinformatically Detectable Group of Novel Regulatory Genes and Uses Thereof"; the disclosure of which is hereby incorporated herein and claims priority therefrom; and is a continuation in part of and claims priority from the following patent applications, the disclosures of which applications are all hereby incorporated herein by reference: U.S. patent application Ser. No. 10/604,985 filed 29 Aug. 2003, U.S. patent application Ser. No. 10/649,653 filed 28 Aug. 2003, U.S. patent application Ser. No. 10/604,926 filed 27 Aug. 2003, U.S. patent application Ser. No. 10/604,726 filed 13 Aug. 2003, U.S. patent application Ser. No. 10/604,727 filed 13 Aug. 2003, U.S. Provisional Patent Application Ser. No. 60/468,251 filed 7 May 2003, U.S. patent application Ser. No. 10/345,201 filed 16 Jan. 2003, U.S. patent application Ser. No. 10/321,503 filed 18 Dec. 2002, U.S. patent application Ser. No. 10/310,914 filed 6 Dec. 2002, and U.S. patent application Ser. No. 10/293,338 filed 14 Nov. 2002. All of the aforesaid patent applications are entitled "Bioinformatically Detectable Group of Novel Regulatory Genes and Uses Thereof"; U.S. patent applications Ser. Nos. 10/604,727 and 10/604,726, filed 13 Aug. 2003, entitled "Bioinformatically Detectable Group of Novel Regulatory Genes and Uses Thereof" are a continuation of U.S. patent application Ser. No. 10/293,338, filed 14 Nov. 2002, entitled "Bioinformatically Detectable Group of Novel Regulatory Genes and Uses Thereof", the disclosure of which is hereby incorporated herein and claims priority therefrom; and are a continuation in part of and claims priority from the following patent applications, the disclosures of which applications are all hereby incorporated herein by reference: U.S. Provisional Patent Application Ser. No. 60/468,251 filed 7 May 2003, U.S. patent application Ser. No. 10/345,201 filed 16 Jan. 2003, U.S. patent application Ser. No. 10/321,503 filed 18 Dec. 2002, U.S. patent application Ser. No. 10/310,914 filed 6 Dec. 2002, and U.S. patent application Ser. No. 10/293,338 filed 14 Nov. 2002. All of the aforesaid patent applications are entitled "Bioinformatically Detectable Group of Novel Regulatory Genes and Uses Thereof"; U.S. Provisional Patent Application Ser. No. 60/468,251, filed 7 May 2003, entitled "Bioinformatically Detectable Group of Novel Regulatory Genes and Uses Thereof" is a continuation in part of and claims priority from the following patent applications, the disclosures of which applications are all hereby incorporated herein by reference: U.S. patent application Ser. No. 10/345,201 filed 16 Jan. 2003, U.S. patent application Ser. No. 10/321,503 filed 18 Dec. 2002, U.S. patent application Ser. No. 10/310,914 filed 6 Dec. 2002, and U.S. patent application Ser. No. 10/293,338 filed 14 Nov. 2002. All of the aforesaid patent applications are entitled "Bioinformatically Detectable Group of Novel Regulatory Genes and Uses Thereof"; U.S. patent application Ser. No. 10/345,201, filed 16 Jan. 2003, entitled "Bioinformatically Detectable Group of Novel Regulatory Genes and Uses Thereof" is a continuation in part of and claims priority from the following patent applications, the disclosures of which applications are all hereby incorporated herein by reference: U.S. patent application Ser. No. 10/321,503 filed 18 Dec. 2002, U.S. patent application Ser. No. 10/310,914 filed 6 Dec. 2002, and U.S. patent application Ser. No. 10/293,338 filed 14 Nov. 2002. All of the aforesaid patent applications are entitled "Bioinformatically Detectable Group of Novel Regulatory Genes and Uses Thereof"; U.S. patent application Ser. No. 10/321,503, filed 18 Dec. 2002, entitled "Bioinformatically Detectable Group of Novel Regulatory Genes and Uses Thereof" is a continuation in part of and claims priority from the following patent applications, the disclosures of which applications are all hereby incorporated herein by reference: U.S. patent application Ser. No. 10/310,914 filed 6 Dec. 2002, and U.S. patent application Ser. No. 10/293,338 filed 14 Nov. 2002. All of the aforesaid patent applications are entitled "Bioinformatically Detectable Group of Novel Regulatory Genes and Uses Thereof"; U.S. patent application Ser. No. 10/310,914, filed 6 Dec. 2002, entitled "Bioinformatically Detectable Group of Novel Regulatory Genes and Uses Thereof" is a continuation in part of U.S. patent application Ser. No. 10/293,338, filed 14 Nov. 2002, entitled "Bioinformatically Detectable Group of Novel Regulatory Genes and Uses Thereof", the disclosure of which is hereby incorporated by reference and claims priority therefrom.

REFERENCES CITED

Altschul, S. F., Gish, W., Miller, W., Myers, E. W., and Lipman, D. J. (1990). Basic local alignment search tool. J. Mol. Biol. 215, 403-410.

Ambros, V., Lee, R. C., Lavanway, A., Williams, P. T., and Jewell, D. (2003). MicroRNAs and Other Tiny Endogenous RNAs in C. elegans 1. Curr. Biol. 13, 807-818.

Dan Gusfield, Algorithms on strings, trees, and sequences: computer science and computational biology, Cambridge University Press, 1997.

Elbashir, S. M., Lendeckel, W., and Tuschl, T. (2001). RNA interference is mediated by 21- and 22-nucleotide RNAs. Genes Dev. 15, 188-200.

Gibbs, W. W. (2003). The unseen genome: gems among the junk. Sci. Am. 289, 46-53.

Gussow, D. and Clackson, T. (1989). Direct clone characterization from plaques and colonies by the polymerase chain reaction. Nucleic Acids Res. 17, 4000.

Hamosh A, Scott A F, Amberger J, Bocchini C, Valle D and McKusick V A. (2002). Online Mendelian Inheritance in Man (OMIM), a knowledgebase of human genes and genetic disorders. Nucleic Acids Res. 30: 52-55.

Jenuth, J. P. (2000). The NCBI. Publicly available tools and resources on the Web. Methods Mol. Biol. 132, 301-312.

Kirkness, E. F. and Kerlavage, A. R. (1997). The TIGR human cDNA database. Methods Mol. Biol. 69, 261-268.

Lagos-Quintana, M., Rauhut, R., Lendeckel, W., and Tuschl, T. (2001). Identification of novel genes coding for small expressed RNAs. Science 294, 853-858.

Lau, N. C., Lim, L. P., Weinstein, E. G., and Bartel, D. P. (2001). An abundant class of tiny RNAs with probable regulatory roles in Caenorhabditis elegans. Science 294, 858-862.

Lau, N. C. and Bartel, D. P. (2003). Censors of the genome. Sci. Am. 289, 34-41.

Lim, L. P., Glasner, M. E., Yekta, S., Burge, C. B., and Bartel, D. P. (2003). Vertebrate microRNA genes. Science 299, 1540.

Mathews, D. H., Sabina, J., Zuker, M., and Turner, D. H. (1999). Expanded sequence dependence of thermodynamic parameters improves prediction of RNA secondary structure. J. Mol. Biol. 288, 911-940.

Reinhart, B. J., Slack, F. J., Basson, M., Pasquinelli, A. E., Bettinger, J. C., Rougvie, A. E., Horvitz, H. R., and Ruvkun, G. (2000). The 21-nucleotide let-7 RNA regulates developmental timing in Caenorhabditis elegans. Nature 403, 901-906.

Southern, E. M. (1992). Detection of specific sequences among DNA fragments separated by gel electrophoresis. 1975. Biotechnology 24, 122-139.

Tom M. Mitchell, Machine Learning, McGraw Hill, 1997.

Wightman, B., Ha, I., and Ruvkun, G. (1993). Posttranscriptional regulation of the heterochronic gene lin-14 by lin-4 mediates temporal pattern formation in C. elegans. Cell 75, 855-862.

Zhang, H., Kolb, F. A., Brondani, V., Billy, E., and Filipowicz, W. (2002). Human Dicer preferentially cleaves dsRNAs at their termini without a requirement for ATP. EMBO J. 21, 5875-5885.

Zuker, M. (2003). Mfold web server for nucleic acid folding and hybridization prediction. Nucleic Acids Res. 31, 3406-3415.

BACKGROUND OF INVENTION

1. Field of the Invention

The present invention relates to a group of bioinformatically detectable novel oligonucleotides, here identified as Genomic Address Messenger or GAM oligonucleotides, which are believed to be related to the micro RNA (miRNA) group of oligonucleotides.

2. Description of Prior Art

Micro RNAs (miRNA), are short ~22 nt non-coding regulatory RNA oligonucleotides, found in a wide range of species, believed to function as specific gene translation repressors, sometimes involved in cell-differentiation.

The ability to detect novel miRNAs is limited by the methodologies used to detect such oligonucleotides. All miRNAs identified so far either present a visibly discernable whole body phenotype, as do Lin-4 and Let-7 (Wightman, B., Ha, I., and Ruvkun, G., Cell 75:855-862 (1993); Reinhart et al. Nature 403: 901-906 (2000)), or produce sufficient quantities of RNA so as to be detected by the standard molecular biological techniques.

Studies reporting miRNAs (Lau et al., Science 294:858-862 (2001), Lagos-Quintana et al., Science 294: 853-858 (2001)) discovered 93 miRNAs in several species, by sequencing a limited number of clones (300 by Lau and 100 by Lagos-Quintana) of small segments (i.e. size fractionated) RNA. MiRNAs detected in these studies therefore, represent the more prevalent among the miRNA oligonucleotide family, and can not be much rarer than 1% of all small ~20 nt-long RNA oligonucleotides.

The aforesaid studies provide no basis for detection of miRNA oligonucleotides which either do not present a visually discernable whole body phenotype, or are rare (e.g. rarer than 0.1% of all size fractionated ~20 nt-long RNA segments expressed in the tissues examined), and therefore do not produce significant enough quantities of RNA so as to be detected by standard biological techniques.

The following U.S. Patents relate to bioinformatic detection of genes: U.S. Pat. No. 6,369,195, entitled "Prostate-specific gene for diagnosis, prognosis and management of prostate cancer", and U.S. Pat. No. 6,291,666 entitled "Spike tissue-specific promoter", each of which is hereby incorporated by reference herein.

BRIEF DESCRIPTION OF SEQUENCE LISTING, LARGE TABLES AND COMPUTER PROGRAM LISTING

Reference is made to the appendix submitted on the compact disc. The compact disc contains SEQ.TXT (20,424 KB, Aug. 18, 2005), which is a replacement Sequence Listing in accordance with 37 C.F.R. §§1.821-1.825, the contents of which are incorporated by reference herein.

A CD including large tables relating to genomic sequences are attached to the present application, appear in 11 table files (size, creation date), incorporated herein: TABLE1.TXT (368 KB, 21 Jan. 2004); TABLE2.TXT (20,568 KB, 21 Jan. 2004); TABLE3.TXT (168 KB, 21 Jan. 2004); TABLE4.TXT (1,191 KB, 21 Jan. 2004), TABLE5.TXT (152 KB, 21 Jan. 2004), TABLE6.TXT (9,339 KB, 21 Jan. 2004) and TABLE7.TXT (197,627 KB, 21 Jan. 2004), TABLE8.TXT (619,419 KB, 21 Jan. 2004), TABLE9.TXT (670,091 KB, 21 Jan. 2004), TABLE10.TXT (1,677 KB, 21 Jan. 2004) and TABLE11.TXT (54 KB, 21 Jan. 2004), all of which are incorporated by reference herein.

LENGTHY TABLES

The patent contains a lengthy table section. A copy of the table is available in electronic form from the USPTO web site (http://seqdata.uspto.gov/?pageRequest=docDetail&DocID=US08084598B1). An electronic copy of the table will also be available from the USPTO upon request and payment of the fee set forth in 37 CFR 1.19(b)(3).

A CD including a computer program listing of a computer program constructed and operative in accordance with a preferred embodiment of the present invention is enclosed on an electronic medium in computer readable form, and is hereby incorporated by reference herein The computer program listing is contained in 6 files, the name, sizes and creation date of which are as follows: AUXILARY_FILES.TXT (117K, 14 Nov. 2003); BINDING_SITE_SCORING.TXT (17K, 14 Nov. 2003); EDIT_DISTANCE.TXT (144K, 24 Nov. 2003); FIRST-K.TXT (96K, 24 Nov. 2003); HAIRPIN_PREDICTION.TXT (47K, 14 Nov. 2003); TWO_PHASED_SIDE_SELECTOR.TXT (4K, 14 Nov. 2003); and TWO_PHASED_PREDICTOR.TXT (74K, 14 Nov. 2003).

SUMMARY OF INVENTION

The present invention discloses over a thousand novel regulatory microRNA (miRNA) oligonucleotides referred to here as Genomic Address Messenger (GAM) oligonucleotides, which GAM oligonucleotides are detectable using a novel bioinformatic approach, and go undetected by conventional molecular biology methods. Each GAM oligonucleotide specifically inhibits translation of one of more target genes by hybridization of an RNA transcript encoded by the GAM, to a site located in an untranslated region (UTR) of the mRNA of one or more of the target genes.

The present invention represents a scientific breakthrough, disclosing novel miRNA oligonucleotides the number of which is dramatically larger than previously believed existed. Prior-art studies reporting miRNAs ((Lau et al., Science 294: 858-862 (2001), Lagos-Quintana et al., Science 294: 853-858 (2001)) discovered 93 miRNAs in several species, including 21 in human, using conventional molecular biology methods, such as cloning and sequencing. Bioinformatic detection of miRNA oligonucleotides has not been done prior to the present invention: Despite advanced genome projects, computer-assisted detection of genes encoding functional RNAs remains problematic (Lagos-Quintana et al., 2001).

Molecular biology methodologies employed by these studies are limited in their ability to detect rare miRNA oligonucleotides, since these studies relied on sequencing of a limited number of clones (300 clones by Lau and 100 clones by Lagos-Quintana) of small segments (i.e. size fractionated) of RNA. MicroRNAs detected in these studies therefore, represent the more prevalent among the miRNA oligonucleotide family, and are typically not be much rarer than 1% of all small ~20 nt-long RNA oligonucleotides present in the tissue from the RNA was extracted.

Recent studies state the number of miRNA genes to be limited, and describe the limited sensitivity of available methods for detection of miRNA: The estimate of 255 human genes is an upper bound implying that no more than 40 miRNA genes remain to be identified in mammals (Lim et al., Science, 299:1540 (2003)); Estimates place the total number of vertebrate miRNA genes at about 200-250 (Ambros et al. Curr. Biol. 13:807-818 (2003)); and Confirmation of very low abundance miRNAs awaits the application of detection methods more sensitive than Northern blots (Ambros, 2003).

The oligonucleotides of the present invention represent a revolutionary new dimension of genomics and of biology: a dimension comprising a huge number of non-protein coding oligonucleotides which modulate expression of thousands of proteins and are associated with numerous major diseases. This new dimension disclosed by the present invention dismantles a central dogma that has dominated life-sciences during the past 50 years, a dogma which has emphasized the importance of protein coding regions of the genome, holding non-protein coding regions to be of little consequence, often dubbing them junk DNA.

Indeed, only in recent months has this long held belief as to the low importance of non-protein coding regions been vocally challenged. As an example, an article titled The Unseen Genome—Gems in the Junk (Gibbs, W. W. Sci. Am. 289:46-53 (2003)) asserts that the failure to recognize the importance of non-protein-coding regions may well go down as one of the biggest mistakes in the history of molecular biology. Gibbs further asserts that what was dammned as junk because it was not understood, may in fact turn out to be the very basis of human complexity. The present invention provides a dramatic leap in understanding specific important roles of non-protein coding regions.

An additional scientific breakthrough of the present invention is a novel conceptual model disclosed by the present invention, which conceptual model is preferably used to encode in a genome the determination of cell-differentiation, utilizing oligonucleotides and polynucleotides of the present invention.

In various preferred embodiments, the present invention seeks to provide an improved method and system for specific modulation of the expression of specific target genes involved in significant human diseases. It also provides an improved method and system for detection of the expression of novel oligonucleotides of the present invention, which modulate these target genes. In many cases the target genes may be known and fully characterized, however in alternative embodiments of the present invention, unknown or less well characterized genes may be targeted.

Accordingly, the invention provides several substantially pure nucleic acids (e.g., genomic DNA, cDNA or synthetic DNA) each comprising a novel GAM oligonucleotide, vectors comprising the DNAs, probes comprising the DNAs, a method and system for selectively modulating translation of known target genes utilizing the vectors, and a method and system utilizing the GAM probes to modulate expression of target genes.

A Nucleic acid is defined as a ribonucleic acid (RNA) molecule, or a deoxyribonucleic acid (DNA) molecule, or complementary deoxyribonucleic acid (cDNA), comprising either naturally occurring nucleotides or non-naturally occurring nucleotides.

Substantially pure nucleic acid, Isolated Nucleic Acid, Isolated Oligoucleotide and Isolated Polynucleotide are defined as a nucleic acid that is free of the genome of the organism from which the nucleic acid is derived, and include, for example, a recombinant nucleic acid which is incorporated into a vector, into an autonomously replicating plasmid or virus, or into the genomic nucleic acid of a prokaryote or eukaryote at a site other than its natural site; or which exists as a separate molecule (e.g., a cDNA or a genomic or cDNA fragment produced by PCR or restriction endonuclease digestion) independent of other nucleic acids.

An Oligonucleotide is defined as a nucleic acid comprising 2-139 nucleotides, or preferably 16-120 nucleotides. A Polynucleotide is defined as a nucleic acid comprising 140-5000 nucleotides, or preferably 140-1000 nucleotides.

A Complementary sequence is defined as a first nucleotide sequence which reverse complementary of a second nucleotide sequence: the first nucleotide sequence is reversed relative to a second nucleotide sequence, and wherein each nucleotide in the first nucleotide sequence is complementary to a corresponding nucleotide in the second nucleotide sequence (e.g. ATGGC is the complementary sequence of GCCAT).

Hybridization, Binding and Annealing are defined as hybridization, under in-vivo physiologic conditions, of a first nucleic acid to a second nucleic acid, which second nucleic acid is at least partially complementary to the first nucleic acid.

A Hairpin Sturucture is defined as an oligonucleotide having a nucleotide sequence that is 50-140 nucleotides in length, the first half of which nucleotide sequence is at least partially complementary to the second part thereof, thereby causing the nucleic acid to fold onto itself, forming a secondary hairpin structure.

A Hairpin Shaped Precursor is defined as a Hairpin Structure which is processed by a Dicer enzyme complex, yielding an oligonucleotide which is about 19 to about 24 nucleotides in length.

"Inhibiting translation" is defined as the ability to prevent synthesis of a specific protein encoded by a respective gene by means of inhibiting the translation of the mRNA of this gene. For example, inhibiting translation may include the following steps: (1) a DNA segment encodes an RNA, the first half of whose sequence is partially complementary to the second half thereof; (2) the precursor folds onto itself forming a hairpin-shaped precursor; (3) a Dicer enzyme complex cuts the hairpin shaped precursor yielding an oligonucleotide that is approximately 22 nt in length; (4) the oligonucleotide binds complementarily to at least one binding site, having a nucleotide sequence that is at least partially complentary to the oligonucleotide, which binding site is located in the mRNA of a target gene, preferably in the untranslated region (UTR) of a target gene, such that the binding inhibts translation of the target protein.

A "Translation inhibitor site" is defined as the minimal DNA sequence sufficient to inhibit translation.

There is thus provided in accordance with a preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein the oligonucleotide has at least 80% sequence identity with a nucleotide sequence selected from the group consisting of SEQ ID NOs: 1-1436.

There is still further provided in accordance with another preferred embodiment of the present invention a bioinformatically detectable isolated oligonucleotide which is endogenously processed from a hairpin-shaped precursor, and anneals to a portion of a mRNA transcript of a target gene selected from the group consisting of genes shown in Table 11, Row 1, wherein binding of the oligonucleotide to the mRNA transcript represses expression of the target gene, and wherein the oligonucleotide has at least 80% sequence identity with a nucleotide sequence selected from the group consisting of SEQ ID NOs: 1-1436.

There is additionally provided in accordance with another preferred embodiment of the present invention a bioinformatically detectable isolated oligonucleotide having a nucleotide sequence selected from the group consisting of SEQ ID NOs: 1-1436.

There is moreover provided in accordance with another preferred embodiment of the present invention a bioinformatically detectable first oligonucleotide which is a portion of a mRNA transcript of a target gene, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs: 1-1436.

There is further provided in accordance with another preferred embodiment of the present invention a bioinformatically detectable first oligonucleotide which is a portion of a mRNA transcript of a target gene selected from the group consisting of genes shown in Table 11 row 1, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs: 1-1436.

There is still further provided in accordance with another preferred embodiment of the present invention a bioinformatically detectable oligonucleotide having a nucleotide sequence selected from the group consisting of SEQ ID NOs: 1-1436.

There is additionally provided in accordance with another preferred embodiment of the present invention a bioinformatically detectable isolated oligonucleotide which is endogenously processed from a hairpin-shaped precursor, and anneals to a portion of a mRNA transcript of a target gene associated with Multiple Sclerosis, wherein binding of the oligonucleotide to the mRNA transcript represses expression of the target gene.

There is moreover provided in accordance with another preferred embodiment of the present invention a bioinformatically detectable isolated oligonucleotide which is endogenously processed from a hairpin-shaped precursor, and anneals to a portion of a mRNA transcript of a target gene that is differentially expressed in a tissue affected by Multiple Sclerosis relative an unaffected tissue, wherein binding of the oligonucleotide to the mRNA transcript represses expression of the target gene.

There is further provided in accordance with another preferred embodiment of the present invention a bioinformatically detectable isolated oligonucleotide which is endogenously processed from a hairpin-shaped precursor, and anneals to a portion of a mRNA transcript of a target gene, the expression of which target gene correlates with Multiple Sclerosis or susceptibility thereto, wherein binding of the oligonucleotide to the mRNA transcript represses expression of the target gene.

There is still further provided in accordance with another preferred embodiment of the present invention a bioinformatically detectable isolated oligonucleotide which is endogenously processed from a hairpin-shaped precursor, and anneals to a portion of a mRNA transcript of a target gene responsible for the formation of Multiple Sclerosis, wherein binding of the oligonucleotide to the mRNA transcript represses expression of the target gene.

There is additionally provided in accordance with another preferred embodiment of the present invention a bioinformatically detectable isolated oligonucleotide which anneals to a portion of a mRNA transcript of a target gene selected from the group consisting of: CBLB, CNP, CTLA4, HLA-DRA, ICOS, IL12B, IL1RN, ITGA4, MCP, NCF1, NOTCH3, NRG1, PTPRC, PTPRZ1, SPP1 and TNFSF10, wherein binding of the oligonucleotide to the mRNA transcript represses expression of the target gene.

There is moreover provided in accordance with another preferred embodiment of the present invention a bioinformatically detectable isolated oligonucleotide which is endogenously processed from a hairpin-shaped precursor, and anneals to a portion of a mRNA transcript of a target gene selected from the group consisting of: CBLB, CNP, CTLA4, HLA-DRA, ICOS, IL12B, IL1RN, ITGA4, MCP, NCF1, NOTCH3, NRG1, PTPRC, PTPRZ1, SPP1 and TNFSF10, wherein binding of the oligonucleotide to the mRNA transcript represses expression of the target gene.

There is further provided in accordance with another preferred embodiment of the present invention a bioinformatically detectable isolated oligonucleotide which anneals to a portion of a mRNA transcript of a target gene selected from the group consisting of: CBLB, CNP, CTLA4, HLA-DRA, ICOS, IL12B, IL1RN, ITGA4, MCP, NCF1, NOTCH3, NRG1, PTPRC, PTPRZ1, SPP1 and TNFSF10, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 4, 5, 8, 9, 14, 15, 17, 20, 22, 23, 24, 26, 27, 28, 29, 30, 31, 32, 35 and 4239-4700, and (b) the complement of a sequence selected from the group consisting of SEQ ID NOs: 7889, 7893, 7901, 7918, 7921, 7925, 7946, 8042, 8083, 8089, 8113, 8209, 8258, 8262, 8289, 8304, 8311, 8324, 8377 and 7887-8381.

There is still further provided in accordance with another preferred embodiment of the present invention a bioinformatically detectable oligonucleotide having a nucleotide sequence which has at least 80% sequence identity with a nucleotide sequence selected from the group consisting of: (a) a sequence selected from the group consisting of SEQ ID NOs: 1, 4, 5, 8, 9, 14, 15, 17, 20, 22, 23, 24, 26, 27, 28, 29, 30, 31, 32, 35 and 4239-4700, and (b) the complement of a sequence selected from the group consisting of SEQ ID NOs: 7889, 7893, 7901, 7918, 7921, 7925, 7946, 8042, 8083, 8089, 8113, 8209, 8258, 8262, 8289, 8304, 8311, 8324, 8377 and 7887-8381.

There is additionally provided in accordance with another preferred embodiment of the present invention a bioinformatically detectable isolated oligonucleotide which anneals to a portion of a mRNA transcript of a target gene associated with Multiple Sclerosis, which target gene is selected from the group consisting of genes shown in Table 11, row 4, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 4, 5, 8, 9, 14, 15, 17, 20, 22, 23, 24, 26, 27, 28, 29, 30, 31, 32, 35 and 4239-4700, and (b) the complement of a sequence selected from the group consisting of SEQ ID NOs: 7889, 7893, 7901, 7918, 7921, 7925, 7946, 8042, 8083, 8089, 8113, 8209, 8258, 8262, 8289, 8304, 8311, 8324, 8377 and 7887-8381.

There is moreover provided in accordance with another preferred embodiment of the present invention a bioinformatically detectable isolated oligonucleotide which anneals to a portion of a mRNA transcript of a target gene selected from the group consisting of: CBLB, CNP, CTLA4, HLA-DRA, ICOS, IL12B, IL1RN, ITGA4, MCP, NCF1, NOTCH3, NRG1, PTPRC, PTPRZ1, SPP1 and TNFSF10, wherein binding of the oligonucleotide to the mRNA transcript represses expression of the target gene, and wherein the oligonucleotide has at least 80% sequence identity with a nucleotide sequence selected from the group consisting of SEQ ID NOs: 1, 4, 5, 8, 9, 14, 15, 17, 20, 22, 23, 24, 26, 27, 28, 29, 30, 31, 32, 35 and 4239-4700.

There is further provided in accordance with another preferred embodiment of the present invention a bioinformatically detectable isolated oligonucleotide which includes from about 19 to about 22 nucleotides, which nucleotides are partially complementary to a target gene selected form the group consisting of: CBLB, CNP, CTLA4, HLA-DRA, ICOS, IL12B, IL1RN, ITGA4, MCP, NCF1, NOTCH3, NRG1, PTPRC, PTPRZ1, SPP1 and TNFSF10, and wherein the oligonucleotide is endogenously processed from a hairpin-form precursor, and includes at least 19 contiguous nucleotides from a sequence selected from the group consisting of SEQ ID NOs: 1, 4, 5, 8, 9, 14, 15, 17, 20, 22, 23, 24, 26, 27, 28, 29, 30, 31, 32, 35 and 4239-4700.

There is still further provided in accordance with another preferred embodiment of the present invention a bioinformatically detectable first oligonucleotide which is a portion of a mRNA transcript of a target gene selected from the group consisting of genes shown in Table 11 row 4, and anneals to a second oligonucleotide that is endogenously processed from a hairpin precursor, wherein binding of the first oligonucleotide to the second oligonucleotide represses expression of the target gene.

There is additionally provided in accordance with another preferred embodiment of the present invention a bioinformatically detectable first oligonucleotide which is a portion of a mRNA transcript of a target gene selected from the group consisting of genes shown in Table 11 row 4, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs: 1, 4, 5, 8, 9, 14, 15, 17, 20, 22, 23, 24, 26, 27, 28, 29, 30, 31, 32, 35 and 4239-4700.

There is moreover provided in accordance with another preferred embodiment of the present invention a bioinformatically detectable isolated oligonucleotide which is endogenously processed from a hairpin-shaped precursor, and anneals to a portion of a mRNA transcript of a target gene associated with Alzheimers disease, wherein binding of the oligonucleotide to the mRNA transcript represses expression of the target gene.

There is further provided in accordance with another preferred embodiment of the present invention a bioinformatically detectable isolated oligonucleotide which is endogenously processed from a hairpin-shaped precursor, and anneals to a portion of a mRNA transcript of a target gene that is differentially expressed in a tissue affected by Alzheimers disease relative an unaffected tissue, wherein binding of the oligonucleotide to the mRNA transcript represses expression of the target gene.

There is still further provided in accordance with another preferred embodiment of the present invention a bioinformatically detectable isolated oligonucleotide which is endogenously processed from a hairpin-shaped precursor, and anneals to a portion of a mRNA transcript of a target gene, the expression of which target gene correlates with Alzheimers disease or susceptibility thereto, wherein binding of the oligonucleotide to the mRNA transcript represses expression of the target gene.

There is additionally provided in accordance with another preferred embodiment of the present invention a bioinformatically detectable isolated oligonucleotide which is endogenously processed from a hairpin-shaped precursor, and anneals to a portion of a mRNA transcript of a target gene responsible for the formation of Alzheimers disease, wherein binding of the oligonucleotide to the mRNA transcript represses expression of the target gene.

There is moreover provided in accordance with another preferred embodiment of the present invention a bioinformatically detectable isolated oligonucleotide which anneals to a portion of a mRNA transcript of a target gene selected from the group consisting of genes shown in Table 11, row 2, wherein binding of the oligonucleotide to the mRNA transcript represses expression of the target gene.

There is further provided in accordance with another preferred embodiment of the present invention a bioinformatically detectable isolated oligonucleotide which is endogenously processed from a hairpin-shaped precursor, and anneals to a portion of a mRNA transcript of a target gene selected from the group consisting of genes shown in Table 11, row 2, wherein binding of the oligonucleotide to the mRNA transcript represses expression of the target gene.

There is still further provided in accordance with another preferred embodiment of the present invention a bioinformatically detectable isolated oligonucleotide which anneals to a portion of a mRNA transcript of a target gene associated with Alzheimers disease, which target gene is selected from the group consisting of genes shown in Table 11, row 2, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1-36 and 1437-4027, and (b) the complement of a sequence selected from the group consisting of SEQ ID NOs: 4999, 5017, 5084, 5137, 5246, 5293, 5319, 5455, 5489, 5538, 5587, 5637, 6039, 6050, 6274, 6334, 6347, 6362, 6417, 6433, 6478, 6575, 6606, 6685, 6809, 6827, 6843, 6869, 6892, 7045, 7321, 7353, 7383, 7442, 7445, 7468 and 4738-7634.

There is additionally provided in accordance with another preferred embodiment of the present invention a bioinformatically detectable isolated oligonucleotide which anneals to a portion of a mRNA transcript of a target gene selected from the group consisting of genes shown in Table 11, row 2, wherein binding of the oligonucleotide to the mRNA transcript represses expression of the target gene, and wherein the oligonucleotide has at least 80% sequence identity with a nucleotide sequence selected from the group consisting of SEQ ID NOs: 1-36 and 1437-4027.

There is moreover provided in accordance with another preferred embodiment of the present invention a bioinformatically detectable isolated oligonucleotide which includes from about 19 to about 22 nucleotides, which nucleotides are partially complementary to a target gene selected form the group consisting of genes shown in Table 11, row 2, and wherein the oligonucleotide is endogenously processed from a hairpin-form precursor, and includes at least 19 contiguous nucleotides from a sequence selected from the group consisting of SEQ ID NOs: 1-36 and 1437-4027.

There is further provided in accordance with another preferred embodiment of the present invention a bioinformatically detectable first oligonucleotide which is a portion of a mRNA transcript of a target gene selected from the group consisting of genes shown in Table 11 row 2, and anneals to a second oligonucleotide that is endogenously processed from a hairpin precursor, wherein binding of the first oligonucleotide to the second oligonucleotide represses expression of the target gene.

There is still further provided in accordance with another preferred embodiment of the present invention a bioinformatically detectable first oligonucleotide which is a portion of a mRNA transcript of a target gene selected from the group consisting of genes shown in Table 11 row 2, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs: 1-36 and 1437-4027.

There is additionally provided in accordance with another preferred embodiment of the present invention a bioinformatically detectable isolated oligonucleotide which is endogenously processed from a hairpin-shaped precursor, and anneals to a portion of a mRNA transcript of a target gene associated with Duchenne disease, wherein binding of the oligonucleotide to the mRNA transcript represses expression of the target gene.

There is moreover provided in accordance with another preferred embodiment of the present invention a bioinformatically detectable isolated oligonucleotide which is endogenously processed from a hairpin-shaped precursor, and anneals to a portion of a mRNA transcript of a target gene that is differentially expressed in a tissue affected by Duchenne disease relative an unaffected tissue, wherein binding of the oligonucleotide to the mRNA transcript represses expression of the target gene.

There is further provided in accordance with another preferred embodiment of the present invention a bioinformatically detectable isolated oligonucleotide which is endogenously processed from a hairpin-shaped precursor, and anneals to a portion of a mRNA transcript of a target gene, the expression of which target gene correlates with Duchenne disease or susceptibility thereto, wherein binding of the oligonucleotide to the mRNA transcript represses expression of the target gene.

There is still further provided in accordance with another preferred embodiment of the present invention a bioinformatically detectable isolated oligonucleotide which is endogenously processed from a hairpin-shaped precursor, and anneals to a portion of a mRNA transcript of a target gene responsible for the formation of Duchenne disease, wherein binding of the oligonucleotide to the mRNA transcript represses expression of the target gene.

There is additionally provided in accordance with another preferred embodiment of the present invention a bioinformatically detectable isolated oligonucleotide which anneals to a portion of a mRNA transcript of a target gene selected from the group consisting of: CASQ1, DMD, ITGA7, LAMA2, NOS1 and SPARC, wherein binding of the oligonucleotide to the mRNA transcript represses expression of the target gene.

There is moreover provided in accordance with another preferred embodiment of the present invention a bioinformatically detectable isolated oligonucleotide which is endogenously processed from a hairpin-shaped precursor, and anneals to a portion of a mRNA transcript of a target gene selected from the group consisting of: CASQ1, DMD, ITGA7, LAMA2, NOS1 and SPARC, wherein binding of the oligonucleotide to the mRNA transcript represses expression of the target gene.

There is further provided in accordance with another preferred embodiment of the present invention a bioinformatically detectable isolated oligonucleotide which anneals to a portion of a mRNA transcript of a target gene selected from the group consisting of: CASQ1, DMD, ITGA7, LAMA2, NOS1 and SPARC, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 5, 8, 11, 14, 18, 24, 26, 27, 28, 29, 30, 33, 35, 36 and 4028-4238, and (b) the complement of a sequence selected from the group consisting of SEQ ID NOs: 7644, 7672, 7697, 7737, 7739, 7755, 7766, 7768, 7780, 7791, 7793, 7809, 7815, 7868 and 7635-7886.

There is still further provided in accordance with another preferred embodiment of the present invention a bioinformatically detectable isolated oligonucleotide which anneals to a portion of a mRNA transcript of a target gene associated with Duchenne disease, which target gene is selected from the group consisting of genes shown in Table 11, row 3, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 5, 8, 11, 14, 18, 24, 26, 27, 28, 29, 30, 33, 35, 36 and 4028-4238, and (b) the complement of a sequence selected from the group consisting of SEQ ID NOs: 7644, 7672, 7697, 7737, 7739, 7755, 7766, 7768, 7780, 7791, 7793, 7809, 7815, 7868 and 7635-7886.

There is additionally provided in accordance with another preferred embodiment of the present invention a bioinformatically detectable isolated oligonucleotide which anneals to a portion of a mRNA transcript of a target gene selected from the group consisting of: CASQ1, DMD, ITGA7, LAMA2, NOS1 and SPARC, wherein binding of the oligonucleotide to the mRNA transcript represses expression of the target gene, and wherein the oligonucleotide has at least 80% sequence identity with a nucleotide sequence selected from the group consisting of SEQ ID NOs: 5, 8, 11, 14, 18, 24, 26, 27, 28, 29, 30, 33, 35, 36 and 4028-4238.

There is moreover provided in accordance with another preferred embodiment of the present invention a bioinformatically detectable isolated oligonucleotide which includes from about 19 to about 22 nucleotides, which nucleotides are partially complementary to a target gene selected form the group consisting of: CASQ1, DMD, ITGA7, LAMA2, NOS1 and SPARC, and wherein the oligonucleotide is endogenously processed from a hairpin-form precursor, and includes at least 19 contiguous nucleotides from a sequence selected from the group consisting of SEQ ID NOs: 5, 8, 11, 14, 18, 24, 26, 27, 28, 29, 30, 33, 35, 36 and 4028-4238.

There is further provided in accordance with another preferred embodiment of the present invention a bioinformatically detectable first oligonucleotide which is a portion of a mRNA transcript of a target gene selected from the group consisting of genes shown in Table 11 row 3, and anneals to a second oligonucleotide that is endogenously processed from a hairpin precursor, wherein binding of the first oligonucleotide to the second oligonucleotide represses expression of the target gene.

There is still further provided in accordance with another preferred embodiment of the present invention a bioinformatically detectable first oligonucleotide which is a portion of a mRNA transcript of a target gene selected from the group consisting of genes shown in Table 11 row 3, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs: 5, 8, 11, 14, 18, 24, 26, 27, 28, 29, 30, 33, 35, 36 and 4028-4238.

There is additionally provided in accordance with another preferred embodiment of the present invention a bioinformatically detectable isolated oligonucleotide which anneals to a portion of a mRNA transcript of HEXA gene, wherein binding of the oligonucleotide to the mRNA transcript represses expression of HEXA gene.

There is moreover provided in accordance with another preferred embodiment of the present invention a bioinformatically detectable isolated oligonucleotide which is endogenously processed from a hairpin-shaped precursor, and anneals to a portion of a mRNA transcript of HEXA gene, wherein binding of the oligonucleotide to the mRNA transcript represses expression of HEXA gene.

There is further provided in accordance with another preferred embodiment of the present invention a bioinformatically detectable isolated oligonucleotide which anneals to a portion of a mRNA transcript of HEXA gene, wherein binding of the oligonucleotide to the mRNA transcript represses expression of HEXA gene, and wherein the oligonucleotide has at least 80% sequence identity with a nucleotide sequence selected from the group consisting of: (a) a sequence selected from the group consisting of SEQ ID NOs: 4,8,23 and 4701-4737, and (b) the complement of a sequence selected from the group consisting of SEQ ID NOs: 8400, 8401 and 8382-8405.

There is still further provided in accordance with another preferred embodiment of the present invention a bioinformatically detectable oligonucleotide having a nucleotide sequence which has at least 80% sequence identity with a nucleotide sequence selected from the group consisting of: (a) a sequence selected from the group consisting of SEQ ID NOs: 4,8,23 and 4701-4737, and (b) the complement of a sequence selected from the group consisting of SEQ ID NOs: 8400, 8401 and 8382-8405.

There is additionally provided in accordance with another preferred embodiment of the present invention a bioinformatically detectable isolated oligonucleotide which anneals to a portion of a mRNA transcript of HEXA gene, wherein binding of the oligonucleotide to the mRNA transcript represses expression of HEXA gene, and wherein the oligonucleotide has at least 80% sequence identity with a nucleotide sequence selected from the group consisting of SEQ ID NOs: 4,8,23 and 4701-4737.

There is moreover provided in accordance with another preferred embodiment of the present invention a bioinformatically detectable isolated oligonucleotide which is endogenously processed from a hairpin-shaped precursor, and anneals to a complementary portion of a mRNA transcript of HEXA gene, wherein binding of the oligonucleotide to the mRNA transcript represses expression of HEXA gene, and wherein the oligonucleotide has at least 80% sequence identity with a nucleotide sequence selected from the group consisting of SEQ ID NOs: 4,8,23 and 4701-4737, and.

There is further provided in accordance with another preferred embodiment of the present invention a bioinformatically detectable isolated oligonucleotide which includes from about 19 to about 22 nucleotides, which nucleotides anneal to a portion of a mRNA transcript of HEXA gene, and wherein the oligonucleotide is endogenously processed from a hairpin-form precursor, and includes at least 19 contiguous nucleotides from a sequence selected from the group consisting of SEQ ID NOs: 4,8,23 and 4701-4737.

There is still further provided in accordance with another preferred embodiment of the present invention a bioinformatically detectable first oligonucleotide which is a portion of a mRNA transcript of HEXA gene, and anneals to a second oligonucleotide that is endogenously processed from a hairpin precursor, wherein binding of the first oligonucleotide to the second oligonucleotide represses expression of the target gene.

There is additionally provided in accordance with another preferred embodiment of the present invention a bioinformatically detectable first oligonucleotide which is a portion of a mRNA transcript of HEXA gene, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs: 4,8,23 and 4701-4737.

There is moreover provided in accordance with another preferred embodiment of the present invention a bioinformatically detectable isolated oligonucleotide which anneals to a portion of a mRNA transcript of APP gene, wherein binding of the oligonucleotide to the mRNA transcript represses expression of APP gene.

There is further provided in accordance with another preferred embodiment of the present invention a bioinformatically detectable isolated oligonucleotide which is endogenously processed from a hairpin-shaped precursor, and anneals to a portion of a mRNA transcript of APP gene, wherein binding of the oligonucleotide to the mRNA transcript represses expression of APP gene.

There is still further provided in accordance with another preferred embodiment of the present invention a bioinformatically detectable isolated oligonucleotide which anneals to a portion of a mRNA transcript of APP gene, wherein binding of the oligonucleotide to the mRNA transcript represses expression of APP gene, and wherein the oligonucleotide has at least 80% sequence identity with a nucleotide sequence selected from the group consisting of: (a) a sequence selected from the group consisting of SEQ ID NOs: 2, 34 and 1757-1768, and (b) the complement of a sequence selected from the group consisting of SEQ ID NOs: 5097, 5104, 32101, 120890 and 5097-5112.

There is additionally provided in accordance with another preferred embodiment of the present invention a bioinformatically detectable isolated oligonucleotide which anneals to a portion of a mRNA transcript of APP gene, wherein binding of the oligonucleotide to the mRNA transcript represses expression of APP gene, and wherein the oligonucleotide has at least 80% sequence identity with a nucleotide sequence selected from the group consisting of SEQ ID NOs: 2, 34 and 1757-1768.

There is moreover provided in accordance with another preferred embodiment of the present invention a bioinformatically detectable isolated oligonucleotide which is endogenously processed from a hairpin-shaped precursor, and anneals to a complementary portion of a mRNA transcript of APP gene, wherein binding of the oligonucleotide to the mRNA transcript represses expression of APP gene, and wherein the oligonucleotide has at least 80% sequence identity with a nucleotide sequence selected from the group consisting of SEQ ID NOs: 2, 34 and 1757-1768.

There is further provided in accordance with another preferred embodiment of the present invention a bioinformatically detectable isolated oligonucleotide which includes from about 19 to about 22 nucleotides, which nucleotides anneal to a portion of a mRNA transcript of APP gene, and wherein the oligonucleotide is endogenously processed from a hairpin-form precursor, and includes at least 19 contiguous nucleotides from a sequence selected from the group consisting of SEQ ID NOs: 2, 34 and 1757-1768.

There is still further provided in accordance with another preferred embodiment of the present invention a bioinformatically detectable first oligonucleotide which is a portion of a mRNA transcript of APP gene, and anneals to a second oligonucleotide that is endogenously processed from a hairpin precursor, wherein binding of the first oligonucleotide to the second oligonucleotide represses expression of the target gene.

There is additionally provided in accordance with another preferred embodiment of the present invention a bioinformatically detectable first oligonucleotide which is a portion of a mRNA transcript of APP gene, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs: 2, 34 and 1757-1768.

There is moreover provided in accordance with another preferred embodiment of the present invention a bioinformatically detectable isolated polynucleotide which is endogenously processed into a plurality of hairpin shaped precursor oligonucleotides, each of which is endogenously processed into a respective oligonucleotide, which in turn anneals to a portion of a mRNA transcript of a target gene, wherein binding of the oligonucleotide to the mRNA transcript represses expression of the target gene.

There is further provided in accordance with another preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein the target gene does not encode a protein.

There is still further provided in accordance with another preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein a function of the oligonucleotide includes modulation of cell type.

There is additionally provided in accordance with another preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein the oligonucleotide is maternally transferred by a cell to at least one daughter cell of the cell, and a function of the oligonucleotide includes modulation of cell type of the daughter cell.

There is moreover provided in accordance with another preferred embodiment of the present invention a method for bioinformatic detection of microRNA oligonucleotides, the method including: bioinformatically detecting a hairpin shaped precursor oligonucleotide, bioinformatically detecting an oligonucleotide which is endogenously processed from the hairpin shaped precursor oligonucleotide, and bioinformatically detecting a target gene of the oligonucleotide wherein the oligonucleotide anneals to at least one portion of a mRNA transcript of the target gene, and wherein the binding represses expression of the target gene, and the target gene is associated with a disease.

BRIEF DESCRIPTION OF DRAWINGS

FIGS. 2, 3 and 4 are schematic diagrams which, when taken together, provide an analogy that illustrates a conceptual model of the present invention, addressing the genomic differentiation enigma;

FIG. 6 is a schematic diagram illustrating a 'genomically programmed cell differentiation' concept of the conceptual model of the present invention, addressing the genomic differentiation enigma;

FIGS. 20A and 20B are simplified diagrams, which when taken together illustrate a mode of oligonucleotide-therapy applicable to novel oligonucleotides of the present invention;

FIG. 21B is a table summarizing laboratory validation results which validate efficacy of a bioinformatic oligonucleotide detection system constructed and operative in accordance with a preferred embodiment of the present invention;

FIG. 22A and FIG. 22B are a picture and a summary table of laboratory results validating the expression of 43 novel oligonucleotides detected by a bioinformatic oligonucleotide detection engine constructed and operative in accordance with a preferred embodiment of the present invention, thereby validating the efficacy of the oligonucleotide detection engine of the present invention;

FIG. 24A, is an annotated sequence of EST72223 comprising known miRNA oligonucleotide MIR98 and novel oligonucleotide GAM25 PRECURSOR detected by the oligonucleotide detection system of the present invention; and FIGS. 24B, 24C and 24D are pictures of laboratory results, which when taken together demonstrate laboratory confirmation of expression of known oligonucleotide MIR98 and of novel bioinformatically detected GAM25 RNA respectively, both of FIG. 24A, thus validating the bioinformatic oligonucleotide detection system of the present invention.

BRIEF DESCRIPTION OF SEQUENCES

A Sequence Listing of genomic sequences of the present invention designated SEQ ID NO: 1 through SEQ ID NO: 142,621 is attached to this application, and is hereby incorporated herein. The genomic listing comprises the following nucleotide sequences: nucleotide sequences of 2147 GAMs precursors of respective novel oligonucleotides of the present invention; nucleotide sequences of 4737 GAM RNA oligonucleotides of respective novel DNA oligonucleotides of the present invention; and nucleotide sequences of 135,737 target gene binding sites of respective novel oligonucleotides of the present invention.

DETAILED DESCRIPTION

Figure 1:
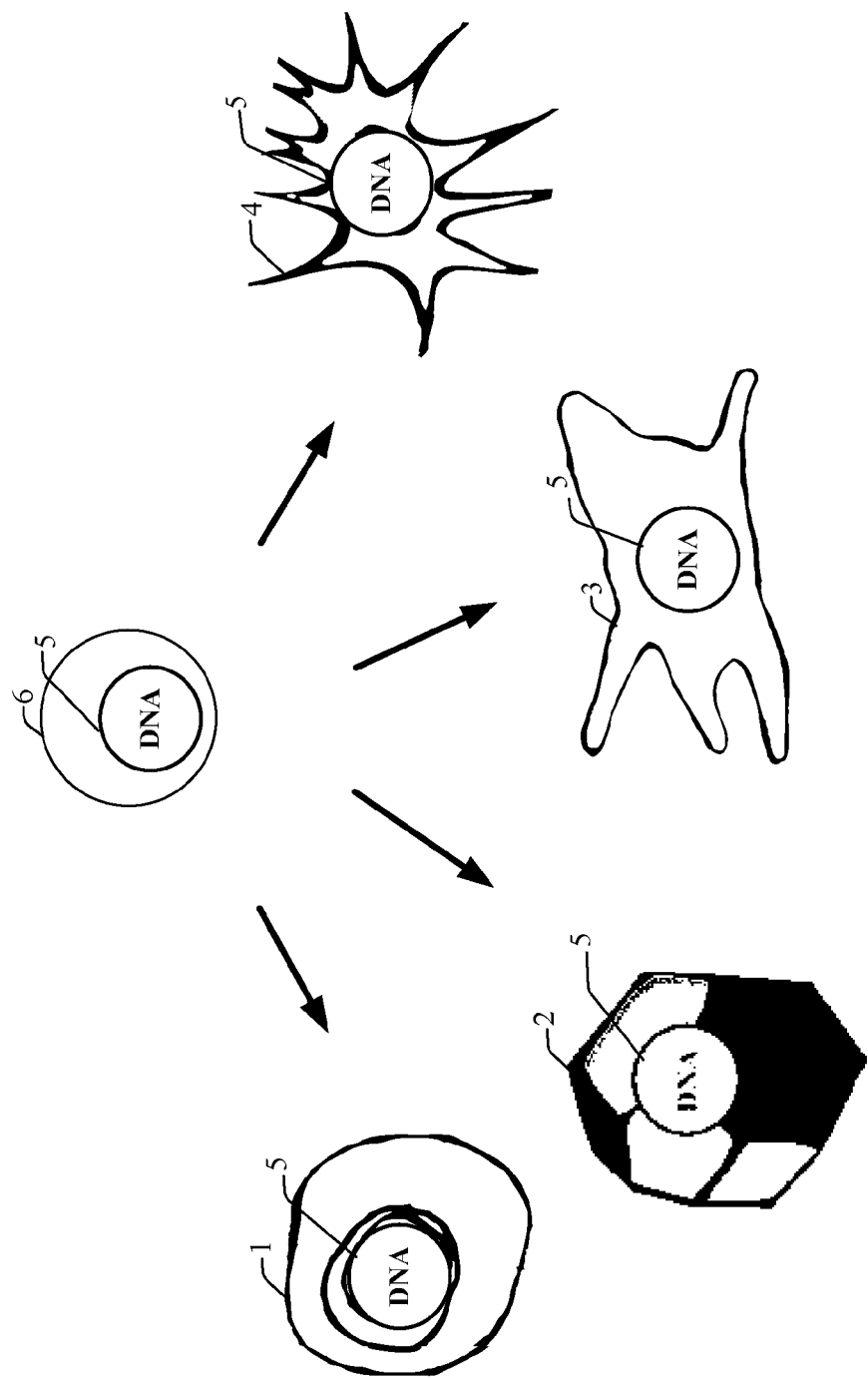
FIG. 1 is a simplified diagram illustrating a genomic differentiation enigma that the present invention addresses.

Reference is now made to FIG. 1 which is a simplified diagram providing a conceptual explanation of a genomic differentiation enigma, which the present invention addresses, inter alia.

FIG. 1 depicts various types of cells in an organism, such as a cartilage cell designated by reference numeral 1, a liver cell designated by reference numeral 2, a fibroblast cell designated by reference numeral 3, and a bone cell designated by reference numeral 4, all containing identical DNA designated by reference numeral 5. Notwithstanding that the various types of cells are all derived from an initial fertilized egg cell designated by reference numeral 6, each of these cells expresses different proteins and accordingly acquires a different shape and function.

The present invention proposes inter alia that the inevitable conclusion from the foregoing is, however, strikingly simple: The genome must contain a modular differentiation coding system. The genome of each cell must include multiple modules or records, possibly a different one for each cell type, as well as a mechanism causing each cell at its inception to be instructed which one of the multiple records governs its behavior.

This modular code concept may be somewhat difficult to grasp, since most persons are accustomed to view things from an external viewpoint. An architect, for example, looks at a plan of a building, which details exactly where each element (block, window, door, electrical switch, etc.) is to be placed relative to all other elements, and, using the plan, instructs builders to place these elements in their designated places. This is an example of an external viewpoint: The architect is external to the plan, which itself is external with respect to the physical building, and with respect to its various elements. The architect may therefore act as an "external organizing agent": seeing the full picture and the relationships between all elements, and being able to instruct from the outside where to place each of them.

According to a preferred embodiment of the present invention, genomic differentiation coding works differently, without any such external organizing agent. It comprises a smart block (the first cell), which is the architect and the plan, and which continuously duplicates itself, somehow knowing when to manifest itself as a block and when as a window, door, or electrical switch.

Reference is now made to FIGS. 2A-4 which are schematic diagrams which, when taken together, provide an analogy that illustrates a conceptual model of the present invention, addressing the genomic differentiation enigma.

Figure 2A:
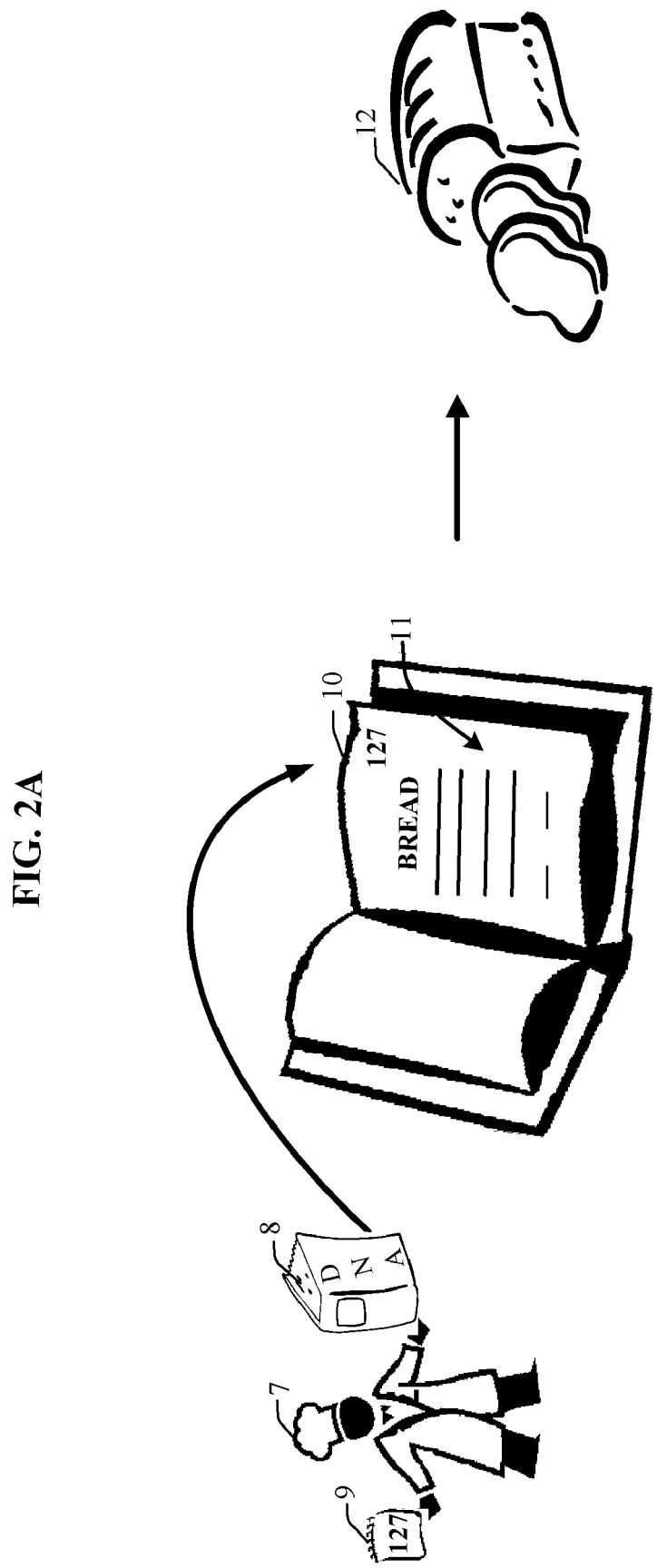

Reference is now made to FIG. 2A. An imaginary talented chef, designated by reference numeral 7, is capable of preparing any meal provided that he is given specific written cooking instructions. This chef 7 is equipped with two items: (a) a thick recipe book, designated by reference numeral 8, and (b) a small note, designated by reference numeral 9, having a number scribbled on it. The recipe book 8 comprises multiple pages, each page detailing how to prepare a specific meal. The small note 9 indicates the page to be opened, and therefore the meal to be prepared. The chef looks at the page number written on the note, opens the recipe book to the appropriate page, and prepares the meal according to the written instructions on this page. In the example shown in FIG. 2A, the chef 7 is holding a small note 9 bearing the number 127. He therefore opens the book to page 127, as designated by reference numeral 10. Since this page contains the recipe for preparing bread, the chef 7 prepares a loaf of bread, designated by reference numeral 12. Pages of the book, such as page 10 in the example shown in FIG. 2A, contains additional information, designated by reference numeral 11 which additional data is further elaborated hereinbelow with reference to FIGS. 3 and 4.

Reference is now made to FIG. 2B, which depicts two identical chefs, a first chef, designated by reference numeral 13, and a second chef, designated by reference numeral 14, both holding an identical recipe book, designated by reference numeral 8. Although the first chef 13 and the second chef 14 are identical, and hold identical recipe books 8, they differ in that they hold different small notes: the first chef 13 holds a small note designated by reference numeral 9, having the number 127 written on it, whereas the second chef 14 holds a small note designated by reference numeral 15, having the number 134 written on it. Accordingly, the first chef 13 opens the book 8 to page 127, as designated by reference numeral 10 and, based on the instructions written on page 127 prepares a loaf of bread, designated by reference numeral 12. The second chef 14 opens the book 8 to page 134, as designated by reference numeral 16 and, based on the instructions written on page 134, prepares a pie, designated by reference numeral 17. Pages in the book, such as pages 10 and 16 in the examples shown in FIG. 2B, contain additional information, designated by reference numeral 11 which additional information is further elaborated hereinbelow with reference to FIGS. 3 and 4.

Reference is now made to FIG. 3 which illustrates a mode by which an imaginary chef can duplicate himself yielding two identical chefs, instructing each of the identical duplicate chefs to prepare a different meal. As an example, FIG. 3 shows chef 21 duplicating himself, yielding two duplicate chefs: a first duplicate chef designated by reference numeral 22 and a second duplicate chef designated by reference numeral 23. The duplicate chefs are identical to each other and to chef 21.

Like chefs 7 and 13 (FIGS. 2A and 2B), FIG. 3 shows chef 21 holding a recipe book 8 and receiving a note 9 bearing the number 127. The chef 21 therefore opens the book 8 to page 127, as designated by reference numeral 10, and prepares a loaf of bread 12. However, FIG. 3 also elaborates some of the additional information 11 (FIGS. 2A and 2B) found in page 10: the bottom of page 10, bears two numbers, 134 and 157.

Chef 21 is trained to perform the following three actions when he is finished preparing a meal: (a) Duplicate himself yielding two duplicate chefs, the first duplicate chef 22 and the second duplicate chef 23; (b) Duplicate his recipe book 8, handing an identical copy to each of the duplicate chefs 22 and 23; and (c) Write down the numbers found at the bottom of the page he was instructed to open the book to. In the example of chef 21, since he was instructed to open the book to page 10, he writes the numbers 134 and 157 on two respective notes designated by reference numerals 15 and 24, and hands note 15 bearing the number 134 to the first duplicate chef 22 and note 24 bearing the number 157 to the second duplicate chef 23.

Accordingly, the first duplicate chef 22 receives note 15 bearing the number 134 and therefore opens the recipe book 8 to page 134, as designated by reference numeral 16, and prepares a pie, designated by reference numeral 17. The second duplicate chef 23 receives note 24 bearing the number 157 and therefore opens the recipe book 8 to page 157, as designated by reference numeral 25, and prepares rice, designated by reference numeral 26.

It is appreciated that while chef 21 and duplicate chefs 22 and 23 are identical and hold identical recipe books 8, they each prepare a different meal. It is also appreciated that the meals prepared by the first duplicate chef 22 and the second duplicate chef 23 are determined by chef 21, and are mediated by the differently numbered notes 15 and 24 passed on from chef 21 to duplicate chefs 22 and 23 respectively.

It is further appreciated that the mechanism illustrated by FIG. 3 enables an unlimited lineage of chefs to divide into duplicate, identical chefs and to determine the meals those duplicate chefs would prepare. As an example, since the first duplicate chef 22 is directed to page 134, as designated by reference numeral 16, when he duplicates himself (not shown), he will instruct his two duplicate chefs to prepare meals specified on pages the numbers of which are written at the bottom of page 134, i.e. pages 114 and 193 respectively. Similarly, the second duplicate chef 23 will instruct its duplicate chefs to prepare meals specified on pages 121 and 146 respectively, etc.

Figure 4:
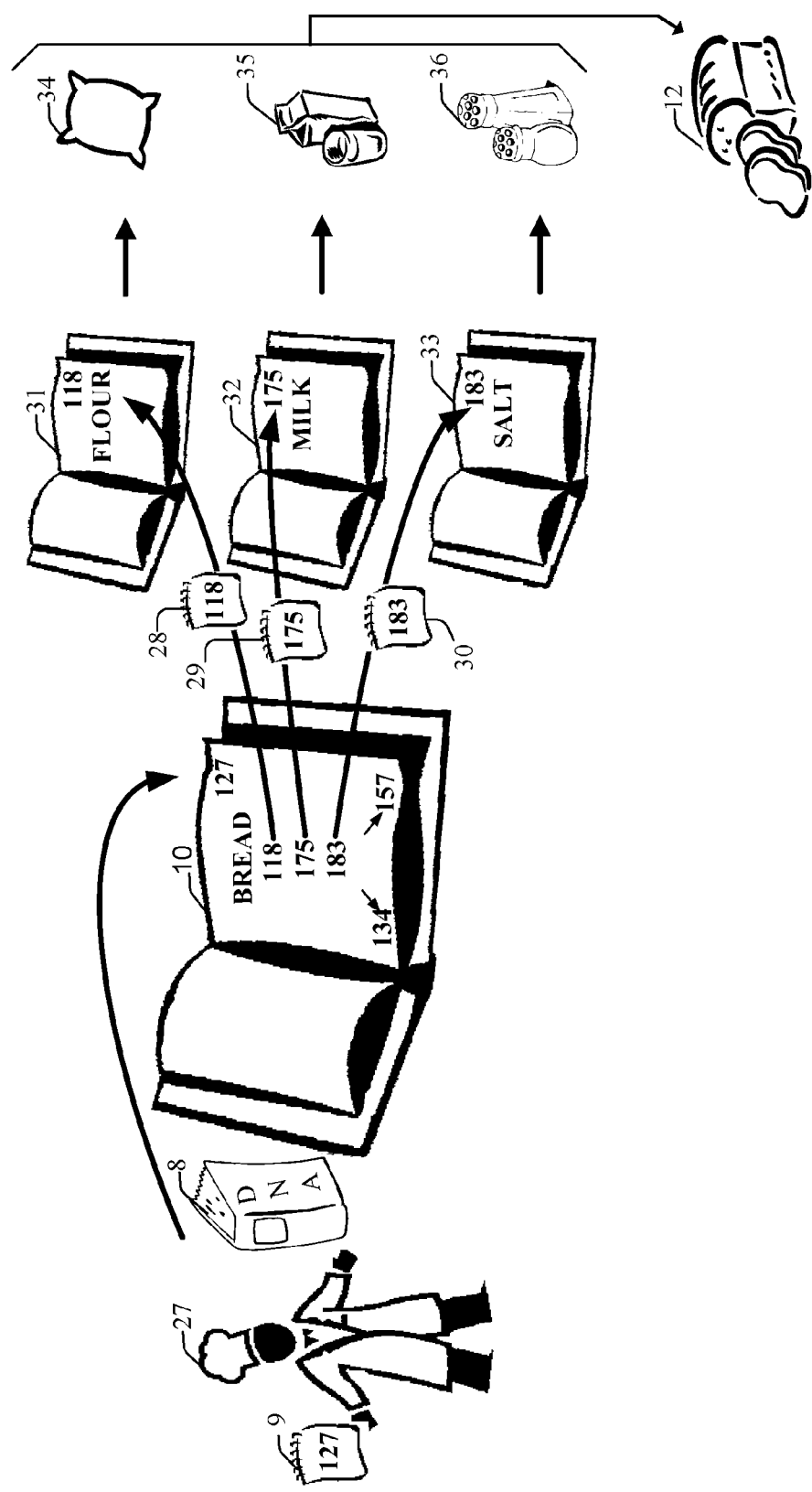

Reference is now made to FIG. 4, which illustrates a mode by which a chef can prepare a meal based on instructions written in a shorthand format: The main meal-page to which a chef is directed by a small note he is given, merely contains a list of numbers which further direct him to other pages, each specifying how to prepare an ingredient of that meal.

To illustrate this shorthand format FIG. 4 shows a chef, designated by reference numeral 27, holding the recipe book 8 and the note 9 which bears the number 127. The chef 27 accordingly opens the recipe book 8 to page 127, as designated by reference numeral 10, and based on instructions on this page prepares bread 12. This is similar to chefs 7, 13 and 21 of FIGS. 2A, 2B and 3 respectively.

However, FIG. 4 also further elaborates some of the additional information 11 (FIGS. 2A and 2B) found in page 10. FIG. 4 shows the cooking "instructions" found on page 10 for making bread 12 written in a shorthand format, comprising only three numbers, 118, 175 and 183. The chef 27 writes these numbers on three respective notes designated by reference numerals 28-30. The notes 28-30 are then used to turn to corresponding pages 31-33 of the book 8, which pages provide instructions for preparation of ingredients required for making bread 12: flour 34, milk 35 and salt 36.

The analogy provided by FIGS. 2A-4 illustrates the conceptual model of the present invention addressing the genomic differentiation enigma, and may be explained as follows: The chefs and duplicate chefs 7, 13, 14, 21-23 and 27 (FIGS. 2A-4) in the given analogy represents cells. The thick recipe book 8 represents the DNA 5 (FIG. 1). Preparing meals such as bread 12, pie 17 or rice 16 (all of FIG. 3) represent the cell manifesting itself as a specific cell-type, such as cartilage cell 1, liver cell 2, fibroblast cell 3, and bone cell 4 (all of FIG. 1). Ingredients of a meal, such as flour 34, milk 35 and salt 36 (all of FIG. 4), represent proteins typically expressed by a cell of a certain cell-type, such as 1-4. Like the different chefs of the analogy, having the same thick recipe book 8 yet preparing different meals, so do different cells in an organism contain the same DNA 5 yet manifest themselves as different cell types, such as 1-4, expressing proteins typical of these respective cell types. Application of analogy of FIGS. 2A-4 to cell-biology is further described hereinbelow with reference to FIGS. 5A-7.

Figure 5A:
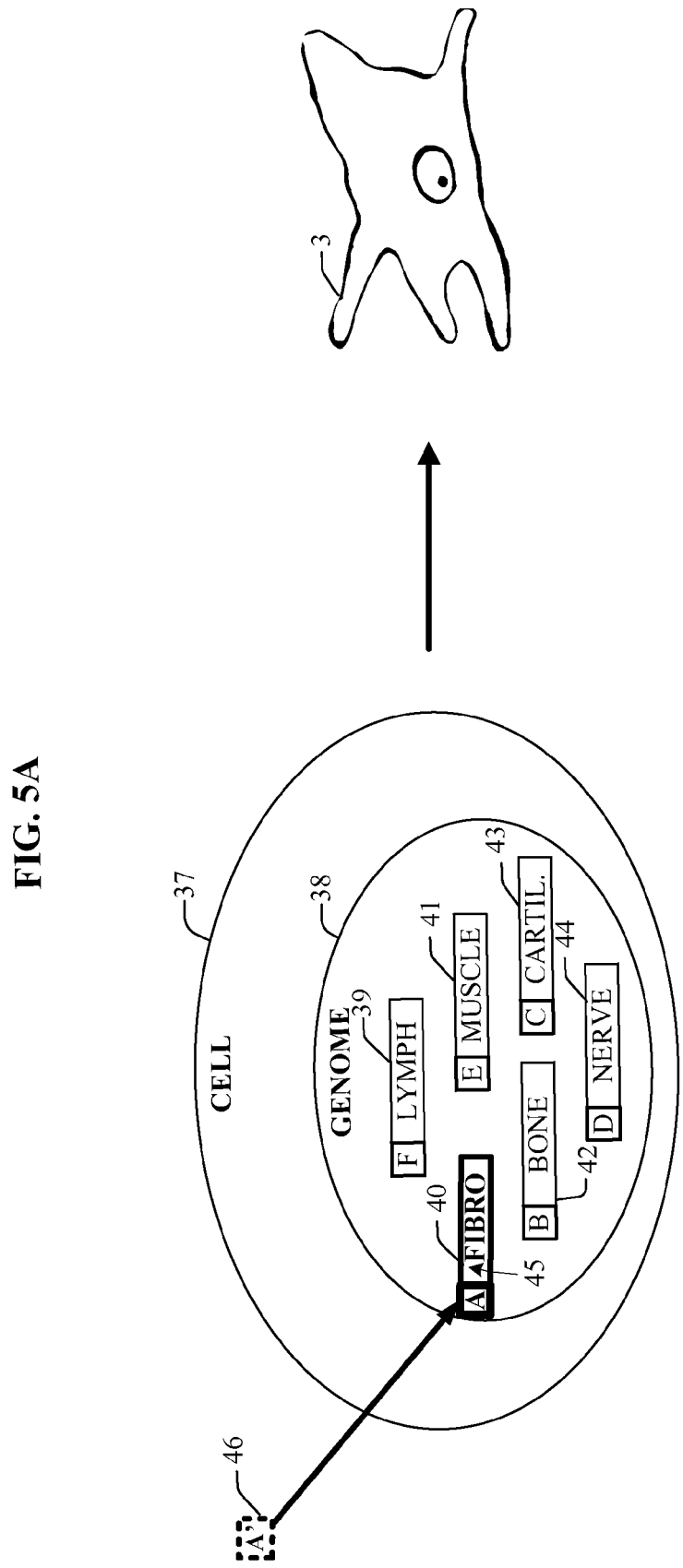
FIGS. 5A and 5B are schematic diagrams, which when taken together, illustrate a 'genomic records' concept of the conceptual model of the present invention, addressing the genomic differentiation enigma.
Figure 5B:
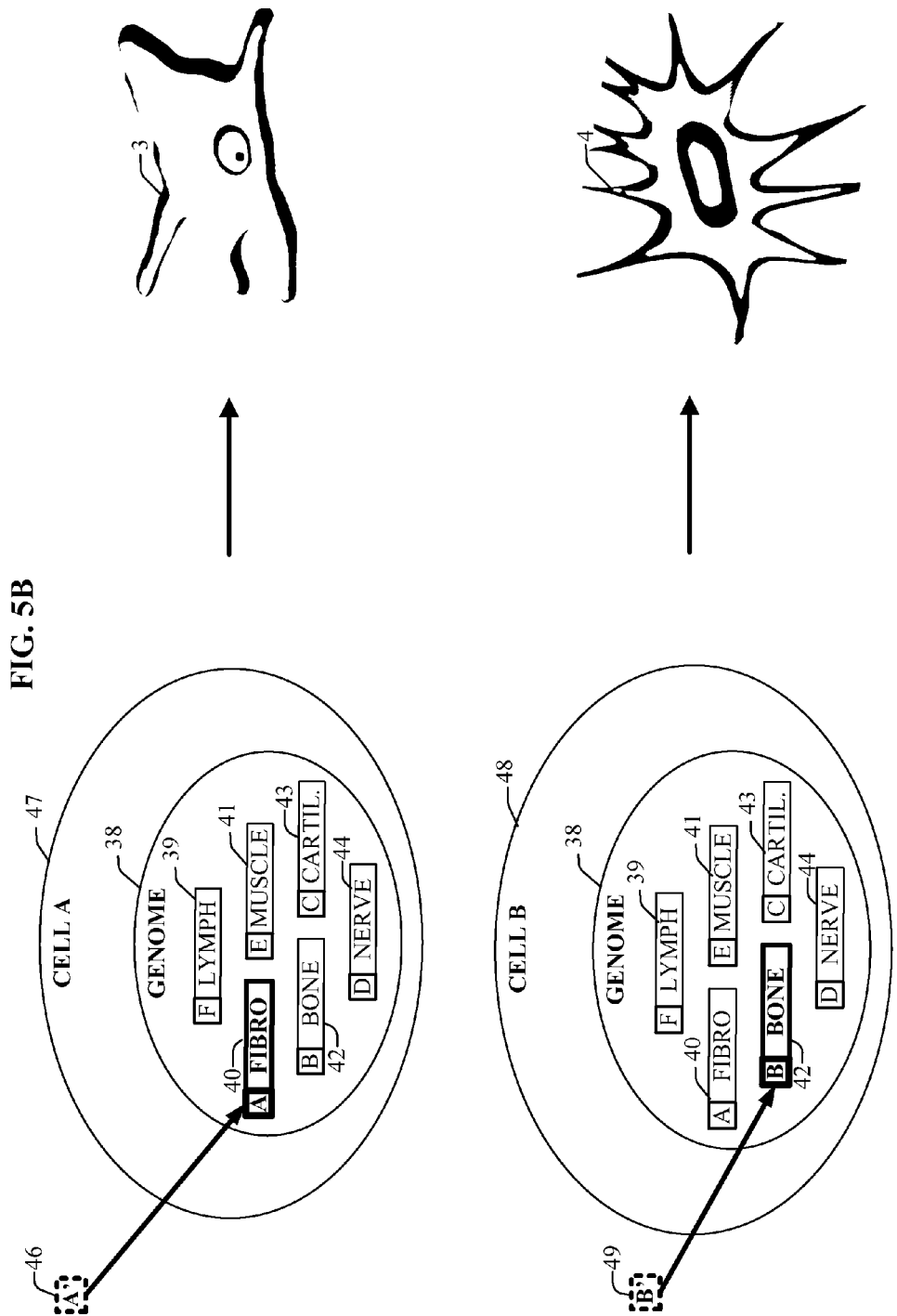

Reference is now made to FIGS. 5A and 5B which are schematic diagrams, which when taken together illustrate a Genomic Records concept of the present invention, addressing the genomic differentiation enigma. FIGS. 5A and 5B correspond to FIGS. 2A and 2B of the chef analogy described hereinabove.

An important aspect of the present invention is the Genomic Records concept. According to a preferred embodiment of the present invention the DNA (the thick recipe book 8 in the illustration) comprises a very large number of Genomic Records (analogous to pages, such as 10, 16 and 25, in the recipe book) containing the instructions for differentiation of a different cell-type, or developmental process. Each Genomic Record comprises by a very short genomic sequence which functions as a "Genomic Address" of that Genomic Record (analogous to a page number, such as the numbers 127, 134 and 157 appearing in FIG. 3, in the recipe book). At its inception, in addition to the DNA, each cell also receives a short RNA segment (the scribbled short note, such as 9, 15, 24 of FIG. 3 in the illustration). This short RNA segment binds complementarily to a "Genomic Address" sequence of one of the Genomic Records, thereby modulating expression of that Genomic Record, and accordingly determining the cell's-fate (analogous to opening the recipe book 8 to a page corresponding to a number on the scribbled note, thereby determining the meal to be prepared). A Genomic Record may also comprise multiple short RNA segments each of which binds complementarily to a target protein coding gene, thus modulating expression of this target gene (analogous to the shorthand format whereby a page, such as 10, points to other pages, such as 31-33, encoding various ingredient, such as 34, 35 and 36, all of FIG. 4).

Reference is now made to FIG. 5A. FIG. 5A illustrates a cell 37, having a genome 38. The genome 38 comprises a plurality of Genomic Records, some of which Genomic Records correlate to specific cell-types. As an example, 6 such genomic records are shown, corresponding to 6 cell-types: LYMPH genomic record 39, FIBROBLAST genomic record 40, MUSCLE genomic record 41, BONE genomic record 42, CARTILAGE genomic record 43 and NERVE genomic record 44. Each genomic record comprises genomic instructions on differentiation into a specific cell-type, as further elaborated hereinbelow with reference to FIG. 7. At cell inception, the cell 37 receives a maternal short RNA segment 46, which activates one of the genomic records, causing the cell to differentiate according to the instructions this genomic record comprises. As an example FIG. 5A illustrates reception of a maternal short RNA segment designated 46 having a nucleotide sequence herein symbolically represented by A'.

The FIBROBLAST genomic record 40 contains a binding site having a nucleotide sequence symbolically represented by A, which is complementary to the nucleotide sequence of A', and therefore the short RNA segment 46 binds to the FIBROBLAST genomic record 40. This binding activates the FIBROBLAST genomic record, causing the cell 37 to differentiate into a fibroblast cell-type 3 (FIG. 1). Other genomic records, designated by reference numerals 39 and 41-44, comprise binding sites having nucleotide sequences that are symbolically represented by F, E, B, C and D, which are not complementary of the nucleotide sequence of the short RNA segment 46, and are therefore not activated thereby. Genomic Records, such as the FIBROBLAST genomic record 40 contain additional information, designated by reference numeral 45, which is further elaborated hereinbelow with reference to FIGS. 6 and 7.

Reference is now made to FIG. 5B, which is a simplified schematic diagram, illustrating cellular differentiation mediated by the "Genomic Records" concept. FIG. 5B depicts 2 cells in an organism, CELL A designated by reference numeral 47 and CELL B designated by reference numeral 48, each having a genome 38. It is appreciated that since CELL A 47 and CELL B 48 are cells in the same organism, the genome 38 of cells 47 and 48 is identical. Despite having an identical genome 38, CELL A 47 differentiates differently from CELL B 48, due to activation of different genomic records in these two cells. In CELL A 47 the FIBRO GENOMIC RECORD 40 is activated, causing CELL A 47 to differentiate into a FIBROBLAST CELL 3, whereas in CELL B 48 the BONE GENOMIC RECORD 42 is activated, causing the CELL B 48 to differentiate into a BONE CELL 4 (FIG. 1). The cause for activation of different genomic records in these two cells is the different maternal short RNA which they both received: CELL A 47 received a maternal short RNA segment designated 46 bearing a nucleotide sequence represented by A' activating genomic record FIBRO 40, whereas CELL B 48 received a maternal short RNA segment designated 49 bearing a nucleotide sequence represented by B' activating genomic record BONE 42.

Reference is now made to FIG. 6 which is a schematic diagram illustrating a "genomically programmed cell differentiation" concept of the conceptual model of the present invention, addressing the genomic differentiation enigma.

A cell designated CELL A 50 divides into 2 cells designated CELL B 51 and CELL C 52. CELL A 50, CELL B 51 and CELL C 52 each comprise a GENOME 38, which GENOME 38 comprises a plurality of GENOMIC RECORDS, herein exemplified by reference numerals 40, 42 and 43. It is appreciated that since CELL A 50, CELL B 51 and CELL C 52 are cells in the same organism, the GENOME 38 of these cells, and the GENOMIC RECORDS, exemplified by 40, 42 and 43, the genome of these cells comprises, are identical in these cells.

As described above with reference to FIG. 5B, at its inception, CELL A 50 receives a maternal short RNA segment, designated by reference numeral 46, having a nucleotide sequence represented by A' and outlined by a broken line, which activates the FIBRO genomic record 40, thereby causing CELL A 50 to differentiate into a FIBROBLAST CELL 3. However, FIG. 6 elaborates some of the additional information 45 (FIG. 5A) of the genomic records: Genomic record may also comprise two short genomic sequences, referred to here as Daughter Cell Genomic Addresses. Blocks designated B and C are Daughter Cell Genomic Addresses of the FIBRO Genomic Record. At cell division, each parent cell transcribes two short RNA segments, corresponding to the two Daughter Cell Genomic Addresses of the Genomic Record of that parent cell, and transfers one to each of its two daughter cells. CELL A 50 transcribes and transfers to its two daughter cells 51 and 52, two short RNA segments, designated by reference numerals 49 and 53, outlined by a broken line and designated B' and C', corresponding to daughter cell genomic addresses designated B and C comprised in the FIBRO genomic record 40.

CELL B 51 therefore receives the above mentioned maternal short RNA segment designated 49 having a nucleotide sequence represented by B', which binds complementarily to genomic address designated B of the BONE genomic record 42, thereby activating this genomic record, which in turn causes CELL B 51 to differentiate into a BONE CELL 4. Similarly, CELL C 52 receives the above mentioned maternal short RNA segment designated 53 having a nucleotide sequence represented by C', which binds complementarily to genomic address designated C of a CARTILAGE genomic record 43, thereby activating this genomic record, which in turn causes CELL C 52 to differentiate into a CARTILAGE CELL 1 (FIG. 1).

It is appreciated that the mechanism illustrated by FIG. 6 enables an unlimited lineage of cells to divide into daughter cells containing the same DNA 5 (FIG. 1), and to determine the cell-fate of these daughter cells. For example, when CELL B 51 and CELL C 52 divide into their respective daughter cells (not shown), they will transfer short RNA segments designated by reference numerals 54-57, to their respective daughter cells. The cell fate of each of these daughter cells is effected by the identity of the maternal short RNA segments 54-57 they each receive, which in turn determine the genomic record activated.

Figure 7:
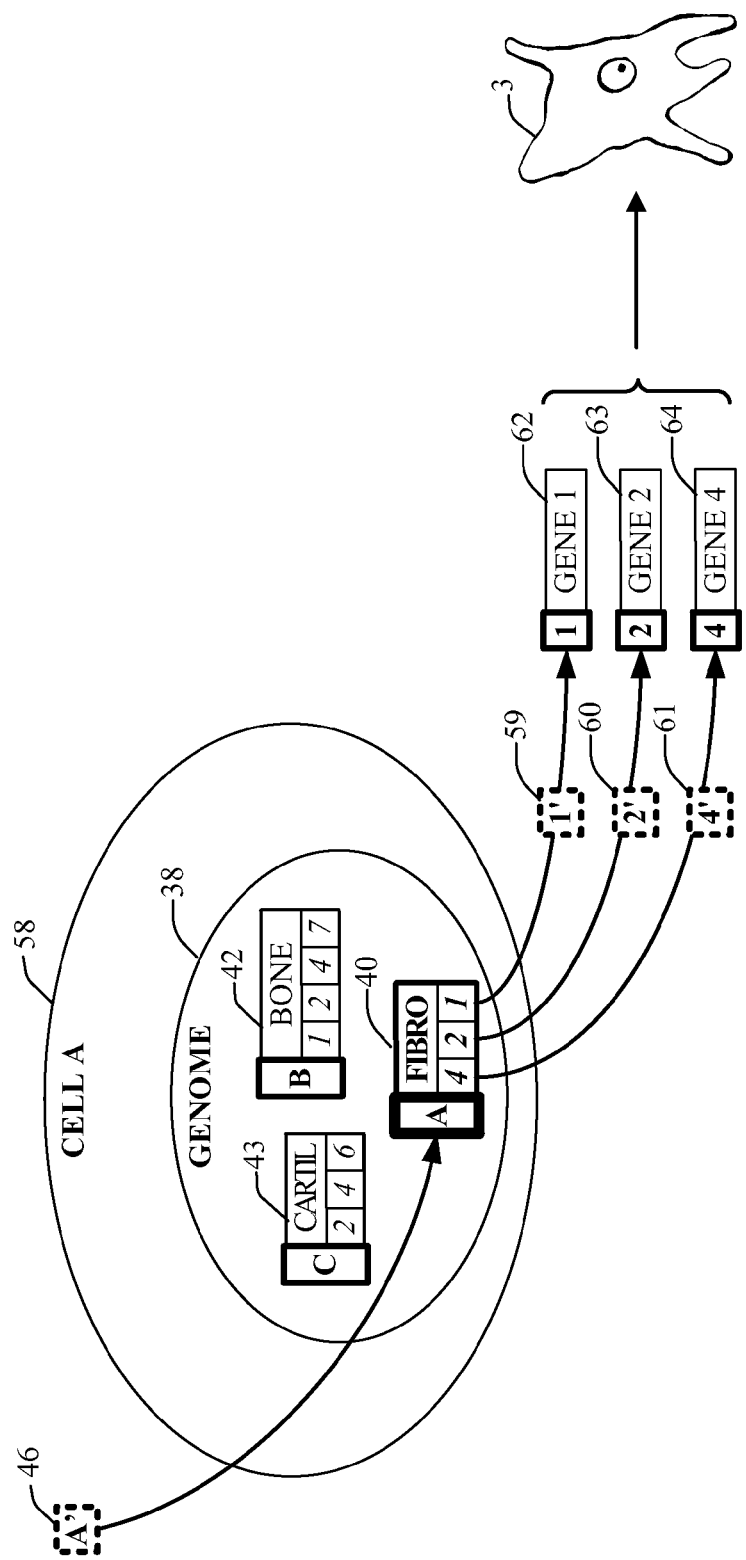
FIG. 7 is a schematic diagram illustrating a 'genomically programmed cell-specific protein expression modulation' concept of the conceptual model of the present invention, addressing the genomic differentiation enigma.

Reference is now made to FIG. 7 which is a schematic diagram illustrating a "genomically programmed cell-specific protein expression modulation" concept of the conceptual model of the present invention, addressing the genomic differentiation enigma.

Cell A 58 receives a maternal short RNA segment designated 46 having a nucleotide sequence represented by A', which activates the FIBROBLAST genomic record 40, by complementarily binding to a binding site this genomic record comprises, the nucleotide sequence of which binding site is designated A. This is similar to the process shown in FIG. 5A. However, FIG. 7 further elaborates some of the additional information 45 (FIG. 1). The FIBROBLAST genomic record 40 comprises 3 short nucleotide segments, having nucleotide sequences symbolically represented by 1, 2 and 4 respectively, which encode 3 respective short RNA oligonucleotides, designated by reference numerals 59-61. Each of these short RNA oligonucleotides modulates expression of a respective one of the target genes GENE 1, GENE 2 and GENE 4, designated by reference numerals 62-64 respectively, by complementarily binding to a binding site sequence associated with that target gene. In a preferred embodiment of the present invention, the modulation of expression of target genes such as 62-64 comprises translation inhibition of target genes by complementarily binding to binding sites located in untranslated regions of the target genes. Modulation of expression of these genes results in CELL A 58 differentiating into a FIBROBLAST cell-type 3 (FIG. 1).

It is appreciated that the concept of genomic records each comprising a cluster of short RNA segments, which segments modulate expression of target genes thereby modulating differentiation, is compatible with the clusters of miRNA oligonucleotides of the present invention, and their translational inhibition of respective target genes by means of complementarily binding to binding sites located in the untranslated regions of mRNA of these target genes.

Figure 8:
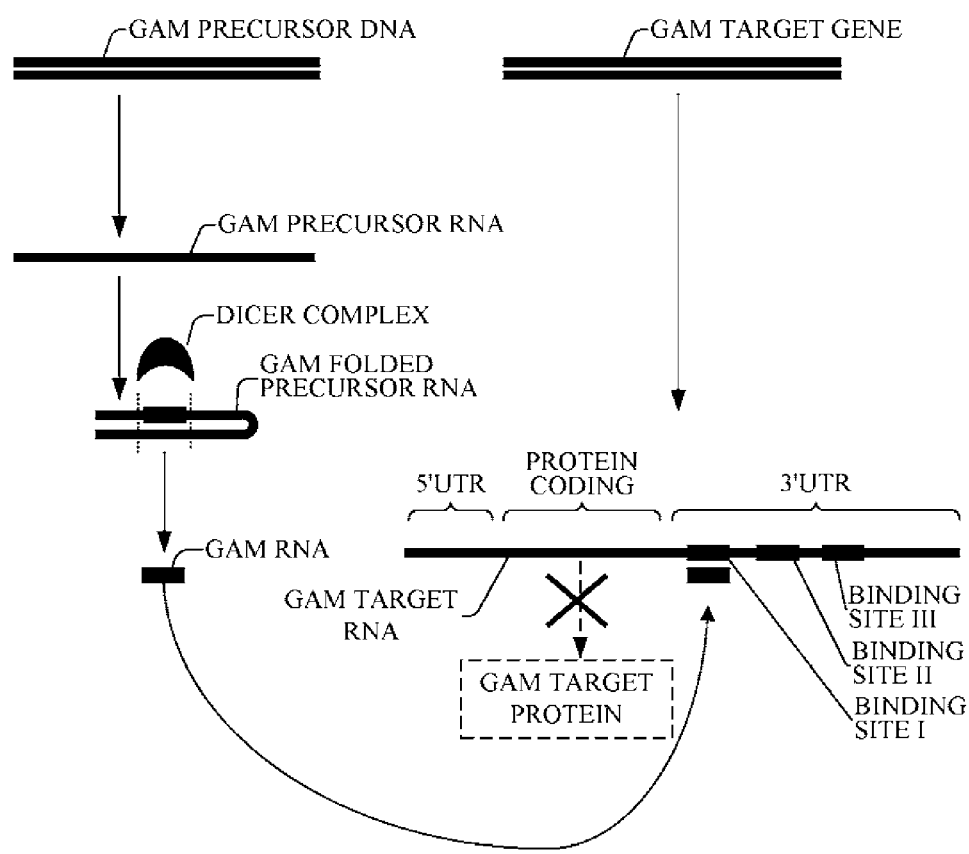
FIG. 8 is a simplified diagram illustrating a mode by which an oligonucleotide of a novel group of oligonucleotides of the present invention, modulates expression of known target genes.

Reference is now made to FIG. 8, which is a simplified diagram describing how a plurality of novel bioinformatically detectable oligonucleotides of the present invention, referred to here as Genomic Address Messenger (GAM) oligonucleotides, modulate expression of respective target genes.

GAM oligonucleotides are novel, bioinformatically detectable, regulatory, non protein coding, micro RNA (miRNA)-like oligonucleotides. The method by which GAMs are detected is described hereinbelow with additional reference to FIGS. 9-15.

GAM PRECURSOR DNA is encoded by the human genome. GAM TARGET GENE is a human gene encoded by the human genome.

GAM PRECURSOR DNA encodes a GAM PRECURSOR RNA. Similar to miRNA oligonucleotides, GAM PRECURSOR RNA does not encode a protein. GAM PRECURSOR RNA folds onto itself, forming GAM FOLDED PRECURSOR RNA, which has a two-dimensional 'hairpin structure'. As is well known in the art, this 'hairpin structure', is typical of by miRNA precursor oligonucleotides, and is due to the fact that the nucleotide sequence of the first half of the miRNA precursor oligonucleotide is a fully or partially complementary sequence of the nucleotide sequence of the second half thereof. By complementary is meant a sequence which is reversed and wherein each nucleotide is replaced by a complementary nucleotide, as is well known in the art (e.g. ATGGC is the complementary sequence of GCCAT).

An enzyme complex comprising an enzyme called Dicer together with other necessary proteins, herein designated as the DICER COMPLEX, 'dices' the GAM FOLDED PRECURSOR RNA yielding a GAM RNA, in the form of a single stranded ~22 nt long RNA segment. The DICER COMPLEX is known in the art to dice a hairpin structured miRNA precursor, thereby yielding diced miRNA in the form of a short ~22 nt RNA segment.

GAM TARGET GENE encodes a corresponding messenger RNA, designated GAM TARGET RNA. GAM TARGET RNA comprises three regions, as is typical of mRNA of a protein coding gene: a 5' untranslated region, a protein coding region and a 3' untranslated region, designated 5'UTR, PROTEIN CODING and 3'UTR respectively.

GAM RNA binds complementarily (i.e. hybridizes) to one or more target binding sites located in untranslated regions of GAM TARGET RNA. This complementary binding is due to the fact that the nucleotide sequence of GAM RNA is a partial or fully complementary sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is only illustrative and that any suitable number of target binding sites may be present. It is further appreciated that although FIG. 8 shows target binding sites only in the 3'UTR region, these target binding sites may be located instead in the 5'UTR region or in both 3'UTR and 5'UTR regions.

The complementary binding of GAM RNA to target binding sites on GAM TARGET RNA, such as BINDING SITE I, BINDING SITE II and BINDING SITE III, inhibits translation of GAM TARGET RNA into GAM TARGET PROTEIN, which is shown surrounded by a broken line.

It is appreciated that GAM TARGET GENE in fact represents a plurality of GAM target genes. The mRNA of each one of this plurality of GAM target genes comprises one or more target binding sites, each having a nucleotide sequence which is at least partly complementary to GAM RNA, and which when bound by GAM RNA causes inhibition of translation of the GAM target mRNA into a corresponding GAM target protein.

The mechanism of the translational inhibition exerted by GAM RNA on one or more GAM TARGET GENE, may be similar or identical to the known mechanism of translational inhibition exerted by known miRNA oligonucleotides.

Nucleotide sequences of each of a plurality of GAM oligonucleotides described by FIG. 8 and their respective genomic sources and chromosomal locations are set forth in Tables 1-3, hereby incorporated herein.

Nucleotide sequences of GAM PRECURSOR RNAs, and a schematic representation of a predicted secondary folding of GAM FOLDED PRECURSOR RNAs, of each of a plurality of GAM oligonucleotides described by FIG. 8 are set forth in Table 4, hereby incorporated herein.

Nucleotide sequences of a 'diced' GAM RNA of each of a plurality of GAM oligonucleotides described by FIG. 8 are set forth in Table 5, hereby incorporated herein.

Nucleotide sequences of target binding sites, such as BINDING SITE I, BINDING SITE II and BINDING SITE III found on GAM TARGET RNA, of each of a plurality of GAM oligonucleotides described by FIG. 8, and a schematic representation of the complementarity of each of these target binding sites to each of a plurality of GAM RNAs described by FIG. 8 are set forth in Tables 6 and 7, hereby incorporated herein.

It is appreciated that specific functions and accordingly utilities of each of a plurality of GAM oligonucleotides described by FIG. 8 correlate with, and may be deduced from, the identity of the GAM TARGET GENEs inhibited thereby, whose . functions are set forth in Table 8, hereby incorporated herein.

Studies documenting well known correlations between each of a plurality of GAM TARGET GENEs of the GAM oligonucleotides of FIG. 8, and known functions and diseases are listed in Table 9, hereby incorporated herein.

The present invention discloses a novel group of oligonucleotides, belonging to the miRNA-like oligonucleotides group, here termed GAM oligonucleotides, for which a specific complementary binding has been determined bioinformatically.

Figure 9:
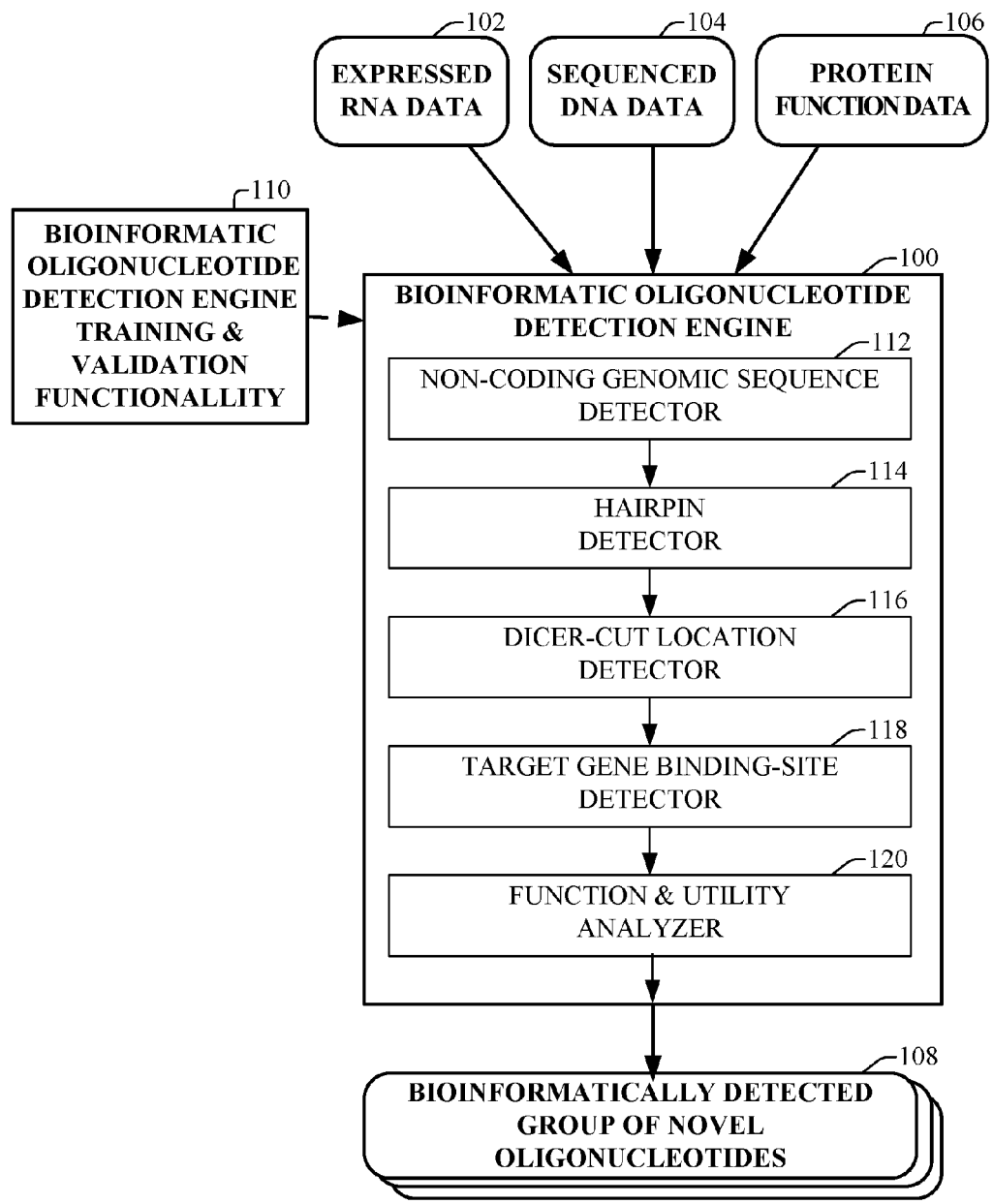
FIG. 9 is a simplified block diagram illustrating a bioinformatic oligonucleotide detection system capable of detecting oligonucleotides of the novel group of oligonucleotides of the present invention, which system is constructed and operative in accordance with a preferred embodiment of the present invention.

Reference is now made to FIG. 9 which is a simplified block diagram illustrating a bioinformatic oligonucleotide detection system and method constructed and operative in accordance with a preferred embodiment of the present invention.

An important feature of the present invention is a BIOINFORMATIC OLIGONUCLEOTIDE DETECTION ENGINE 100, which is capable of bioinformatically detecting oligonucleotides of the present invention.

The functionality of the BIOINFORMATIC OLIGONUCLEOTIDE DETECTION ENGINE 100 includes receiving EXPRESSED RNA DATA 102, SEQUENCED DNA DATA 104, and PROTEIN FUNCTION DATA 106; performing a complex process of analysis of this data as elaborated hereinbelow, and based on this analysis provides information, designated by reference numeral 108, identifying and describing features of novel oligonucleotides.

EXPRESSED RNA DATA 102 comprises published expressed sequence tags (EST) data, published mRNA data, as well as other published RNA data. SEQUENCED DNA DATA 104 comprises alphanumeric data representing genomic sequences and preferably including annotations such as information indicating the location of known protein coding regions relative to the genomic sequences.

PROTEIN FUNCTION DATA 106 comprises information from scientific publications e.g. physiological functions of known proteins and their connection, involvement and possible utility in treatment and diagnosis of various diseases.

EXPRESSED RNA DATA 102 and SEQUENCED DNA DATA 104 may preferably be obtained from data published by the National Center for Biotechnology Informatiion (NCBI) at the National Institute of Health (NIH) (Jenuth, J. P. (2000). Methods Mol. Biol. 132:301-312 (2000), herein incorporated by reference), as well as from various other published data sources.

PROTEIN FUNCTION DATA 106 may preferably be obtained from any one of numerous relevant published data sources, such as the Online Mendelian Inherited Disease In Man (OMIM(™), Hamosh et al., Nucleic Acids Res. 30: 52-55 (2002)) database developed by John Hopkins University, and also published by NCBI (2000).

Prior to or during actual detection of BIOINFORMATICALLY DETECTED GROUP OF NOVEL OLIGONUCLEOTIDES 108 by the BIOINFORMATIC OLIGONUCLEOTIDE DETECTION ENGINE 100, BIOINFORMATIC OLIGONUCLEOTIDE DETECTION ENGINE TRAINING & VALIDATION FUNCTIONALITY 110 is operative. This functionality uses one or more known miRNA oligonucleotides as a training set to train the BIOINFORMATIC OLIGONUCLEOTIDE DETECTION ENGINE 100 to bioinformatically recognize miRNA-like oligonucleotides, and their respective potential target binding sites. BIOINFORMATIC OLIGONUCLEOTIDE DETECTION ENGINE TRAINING & VALIDATION FUNCTIONALITY 110 is further described hereinbelow with reference to FIG. 10.

The BIOINFORMATIC OLIGONUCLEOTIDE DETECTION ENGINE 100 preferably comprises several modules which are preferably activated sequentially, and are described as follows:

A NON-CODING GENOMIC SEQUENCE DETECTOR 112 operative to bioinformatically detect non-protein coding genomic sequences. The NON-CODING GENOMIC SEQUENCE DETECTOR 112 is further described herein below with reference to FIGS. 11A and 11B.

A HAIRPIN DETECTOR 114 operative to bioinformatically detect genomic 'hairpin-shaped' sequences, similar to GAM FOLDED PRECURSOR RNA (FIG. 8). The HAIRPIN DETECTOR 114 is further described herein below with reference to FIGS. 12A and 12B.

A DICER-CUT LOCATION DETECTOR 116 operative to bioinformatically detect the location on a GAM FOLDED PRECURSOR RNA which is enzymatically cut by DICER COMPLEX (FIG. 8), yielding diced GAM RNA. The DICER-CUT LOCATION DETECTOR 116 is further described herein below with reference to FIGS. 13A-13C.

A TARGET GENE BINDING-SITE DETECTOR 118 operative to bioinformatically detect target genes having binding sites, the nucleotide sequence of which is partially complementary to that of a given genomic sequence, such as a nucleotide sequence cut by DICER COMPLEX. The TARGET GENE BINDING-SITE DETECTOR 118 is further described hereinbelow with reference to FIGS. 14A and 14B.

A FUNCTION & UTILITY ANALYZER 120 operative to analyze function and utility of target genes, in order to identify target genes which have a significant clinical function and utility. The FUNCTION & UTILITY ANALYZER 120 is further described hereinbelow with reference to FIG. 15.

According to a preferred embodiment of the present invention the engine 100 may employ a cluster of 40 PCs (XEON (R), 2.8 GHz, with 80 GB storage each), connected by Ethernet to 8 servers (2-CPU, XEON(™) 1.2-2.2 GHz, with ~200 GB storage each), combined with an 8-processor server (8-CPU, Xeon 550 Mhz w/8 GB RAM) connected via 2 HBA fiber-channels to an EMC CLARIION (™) 100-disks, 3.6 Terabyte storage device. A preferred embodiment of the present invention may also preferably comprise software which utilizes a commercial database software program, such as MICROSOFT(™) SQL Server 2000. It is appreciated that the above mentioned hardware configuration is not meant to be limiting, and is given as an illustration only. The present invention may be implemented in a wide variety of hardware and software configurations.

The present invention discloses 2147 novel oligonucleotides of the GAM group of oligonucleotides, which have been detected bioinformatically, as set forth in Tables 1-4, and 313 novel polynucleotides of the GR group of polynucleotides, which have been detected bioinformatically. Laboratory confirmation of 43 bioinformatically predicted oligonucleotides of the GAM group of oligonucleotides, and several bioinformatically predicted polynucleotides of the GR group of polynucleotides, is described hereinbelow with reference to FIGS. 21-24D.

Figure 10:
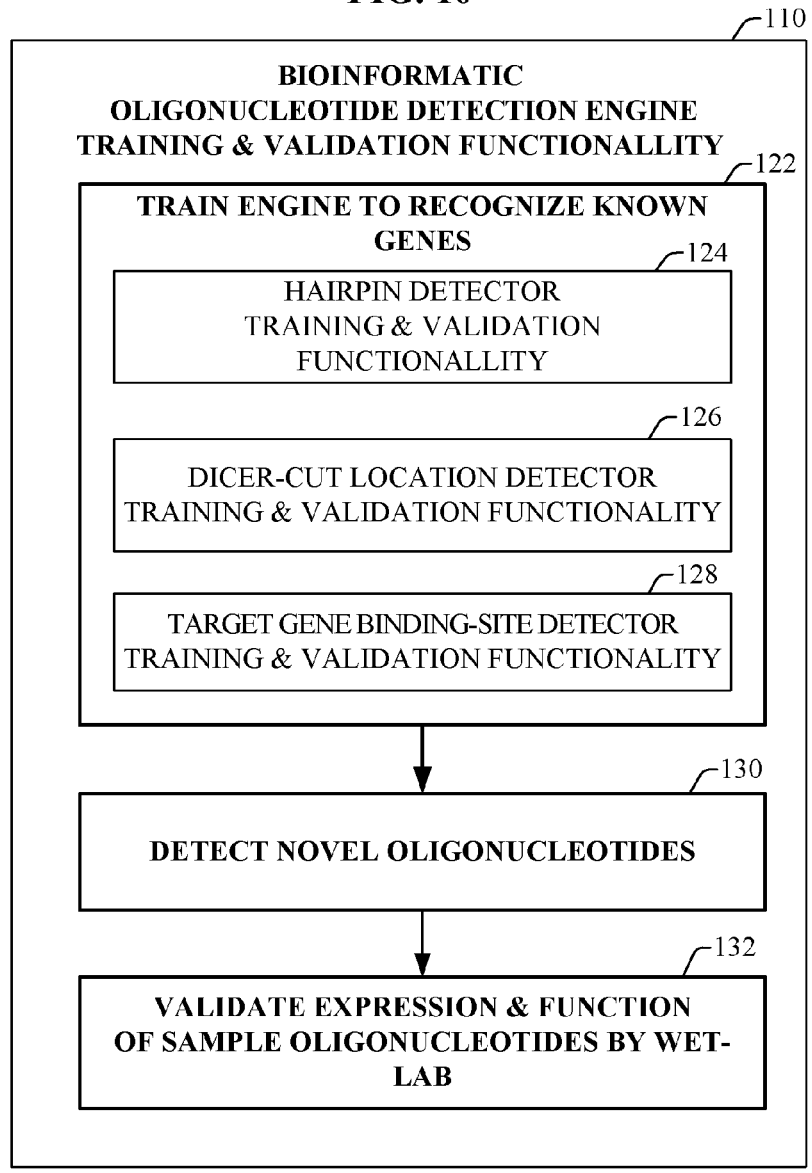
FIG. 10 is a simplified flowchart illustrating operation of a mechanism for training of a computer system to recognize the novel oligonucleotides of the present invention, which mechanism is constructed and operative in accordance with a preferred embodiment of the present invention.

Reference is now made to FIG. 10 which is a simplified flowchart illustrating operation of a preferred embodiment of the BIOINFORMATIC OLIGONUCLEOTIDE DETECTION ENGINE TRAINING & VALIDATION FUNCTIONALITY 110 described hereinabove with reference to FIG. 9.

BIOINFORMATIC OLIGONUCLEOTIDE DETECTION ENGINE TRAINING & VALIDATION FUNCTIONALITY 110 begins by training the BIOINFORMATIC OLIGONUCLEOTIDE DETECTION ENGINE 100 (FIG. 9) to recognize one or more known miRNA oligonucleotides, as designated by reference numeral 122. This training step comprises HAIRPIN DETECTOR TRAINING & VALIDATION FUNCTIONALITY 124, further described hereinbelow with reference to FIG. 12A, DICER-CUT LOCATION DETECTOR TRAINING & VALIDATION FUNCTIONALITY 126, further described hereinbelow with reference to FIGS. 13A and 13B, and TARGET GENE BINDING-SITE DETECTOR TRAINING & VALIDATION FUNCTIONALITY 128, further described hereinbelow with reference to FIG. 14A.

Next, the BIOINFORMATIC OLIGONUCLEOTIDE DETECTION ENGINE TRAINING & VALIDATION FUNCITONALITY 110 is operative bioinformatically detect novel oligonucleotides, using BIOINFORMATIC OLIGONUCLEOTIDE DETECTION ENGINE 100 (FIG. 9), as designated by reference numeral 130. Wet lab experiments are preferably conducted in order to validate expression and preferably function of some samples of the novel oligonucleotides detected by the BIOINFORMATIC OLIGONUCLEOTIDE DETECTION ENGINE 100, as designated by reference numeral 132. FIGS. 22A-24D illustrate examples of wet-lab validation of the above mentioned sample novel oligonucleotides bioinformatically detected in accordance with a preferred embodiment of the present invention.

Figure 11A:
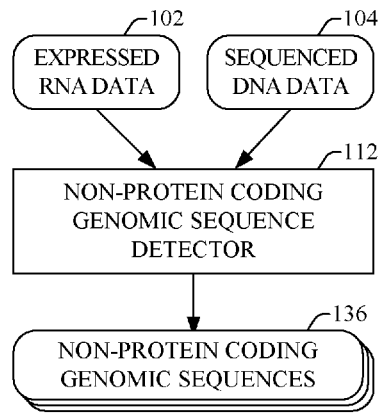
FIG. 11A is a simplified block diagram of a non-coding genomic sequence detector constructed and operative in accordance with a preferred embodiment of the present invention.
Figure 11B:
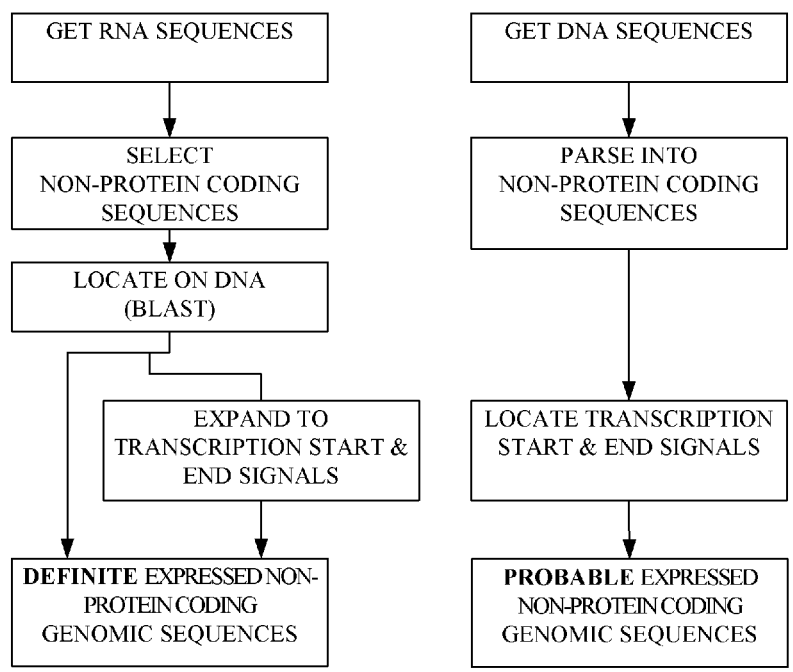
FIG. 11B is a simplified flowchart illustrating operation of a non-coding genomic sequence detector constructed and operative in accordance with a preferred embodiment of the present invention.

Reference is now made to FIG. 11A which is a simplified block diagram of a preferred implementation of the NON-CODING GENOMIC SEQUENCE DETECTOR 112 described hereinabove with reference to FIG. 9. The NON-PROTEIN CODING GENOMIC SEQUENCE DETECTOR 112 preferably receives at least two types of published genomic data: EXPRESSED RNA DATA 102 and SEQUENCED DNA DATA 104. The EXPRESSED RNA DATA 102 may include, inter alia, EST data, EST clusters data, EST genome alignment data and mRNA data. Sources for EXPRESSED RNA DATA 102 include NCBI dbEST, NCBI UniGene clusters and mapping data, and TIGR (Kirkness F. and Kerlavage, A. R., Methods Mol. Biol. 69:261-268 (1997))

gene indices. SEQUENCED DNA DATA 104 may include sequence data (FASTA format files), and feature annotations (GenBank file format) mainly from NCBI databases. Based on the above mentioned input data, the NON-PROTEIN CODING GENOMIC SEQUENCE DETECTOR 112 produces a plurality of NON-PROTEIN CODING GENOMIC SEQUENCES 136. Preferred operation of the NON-PROTEIN CODING GENOMIC SEQUENCE DETECTOR 112 is described hereinbelow with reference to FIG. 11B Reference is now made to FIG. 11B which is a simplified flowchart illustrating a preferred operation of the NON-CODING GENOMIC SEQUENCE DETECTOR 112 of FIG. 9. Detection of NON-PROTEIN CODING GENOMIC SEQUENCES 136, generally preferably progresses along one of the following two paths:

A first path for detecting NON-PROTEIN CODING GENOMIC SEQUENCES 136 (FIG. 11A) begins with receipt of a plurality of known RNA sequences, such as EST data. Each RNA sequence is first compared with known protein-coding DNA sequences, in order to select only those RNA sequences which are non-protein coding, i.e. intergenic or intronic sequences. This can preferably be performed by using one of many alignment algorithms known in the art, such as BLAST (Altschul et al., J. Mol. Biol. 215:403-410 (1990)). This sequence comparison preferably also provides localization of the RNA sequence on the DNA sequences.

Alternatively, selection of non-protein coding RNA sequences and their localization on the DNA sequences can be performed by using publicly available EST cluster data and genomic mapping databases, such as the UNIGENE database published by NCBI or the TIGR database. Such databases, map expressed RNA sequences to DNA sequences encoding them, find the correct orientation of EST sequences, and indicate mapping of ESTs to protein coding DNA regions, as is well known in the art. Public databases, such as TIGR, may also be used to map an EST to a cluster of ESTs, known in the art as Tentative Human Consensus and assumed to be expressed as one segment. Publicly available genome annotation databases, such as NCBIs GenBank, may also be used to deduce expressed intronic sequences.

Optionally, an attempt may be made to "expand" the non-protein RNA sequences thus found, by searching for transcription start and end signals, respectively upstream and downstream of the location of the RNA on the DNA, as is well known in the art.

A second path for detecting NON-PROTEIN CODING GENOMIC SEQUENCES 136 (FIG. 11A) begins with receipt of DNA sequences. The DNA sequences are parsed into non protein coding sequences, using published DNA annotation data, by extracting those DNA sequences which are between known protein coding sequences. Next, transcription start and end signals are sought. If such signals are found, and depending on their robustness, probable expressed non-protein coding genomic sequences are obtained. Such approach is especially useful for identifying novel GAM oligonucleotides which are found in proximity to other known miRNA oligonucleotides, or other wet-lab validated GAM oligonucleotides. Since, as described hereinbelow with reference to FIG. 16, GAM oligonucleotides are frequently found in clusters, sequences located near known miRNA oligonucleotides are more likely to contain novel GAM oligonucleotides. Optionally, sequence orthology, i.e. sequence conservation in an evolutionary related species, may be used to select genomic sequences having a relatively high probability of containing expressed novel GAM oligonucleotides.

Figure 12A:
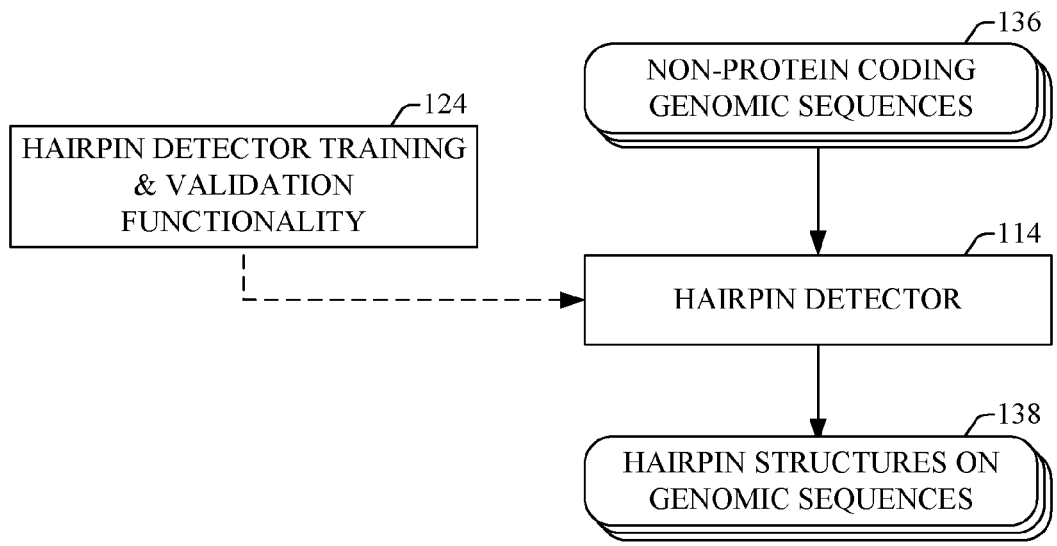
FIG. 12A is a simplified block diagram of a hairpin detector constructed and operative in accordance with a preferred embodiment of the present invention.

Reference is now made to FIG. 12A which is a simplified block diagram of a preferred implementation of the HAIRPIN DETECTOR 114 described hereinabove with reference to FIG. 9.

The goal of the HAIRPIN DETECTOR 114 is to detect hairpin-shaped genomic sequences, similar to those of known miRNA oligonucleotides. A hairpin-shaped genomic sequence is a genomic sequence, having a first half which is at least partially complementary to a second half thereof, which causes the halves to folds onto themselves, thereby forming a hairpin structure, as mentioned hereinabove with reference to FIG. 8.

The HAIRPIN DETECTOR 114 (FIG. 9) receives a plurality of NON-PROTEIN CODING GENOMIC SEQUENCES 136 (FIG. 11A). Following operation of HAIRPIN DETECTOR TRAINING & VALIDATION FUNCTIONALITY 124 (FIG. 10), the HAIRPIN DETECTOR 114 is operative to detect and output hairpin-shaped sequences, which are found in the NON-PROTEIN CODING GENOMIC SEQUENCES 136. The hairpin-shaped sequences detected by the HAIRPIN DETECTOR 114 are designated HAIRPINS STRUCTURES ON GENOMIC SEQUENCES 138. A preferred mode of operation of the HAIRPIN DETECTOR 114 is described hereinbelow with reference to FIG. 12B.

HAIRPIN DETECTOR TRAINING & VALIDATION FUNCTIONALITY 124 includes an iterative process of applying the HAIRPIN DETECTOR 114 to known hairpin shaped miRNA precursor sequences, calibrating the HAIRPIN DETECTOR 114 such that it identifies a training set of known hairpin-shaped miRNA precursor sequences, as well as other similarly hairpin-shaped sequences. In a preferred embodiment of the present invention, the HAIRPIN DETECTOR TRAINING & VALIDATION FUNCTIONALITY 124 trains the HAIRPIN DETECTOR 114 and validates each of the steps of operation thereof described hereinbelow with reference to FIG. 12B.

The HAIRPIN DETECTOR TRAINING & VALIDATION FUNCTIONALITY 124 preferably uses two sets of data: the aforesaid training set of known hairpin-shaped miRNA precursor sequences, such as hairpin-shaped miRNA precursor sequences of 440 miRNA oligonucleotides of *H. sapiens, M. musculus, C. elegans, C. Brigssae* and *D. Melanogaster*, annotated in the RFAM database (Griffiths-Jones 2003), and a large background set of about 350,000 hairpin-shaped sequences found in expressed non-protein coding genomic sequences. The background set is expected to comprise some valid, previously undetected hairpin-shaped miRNA-like precursor sequences, and many hairpin-shaped sequences which are not hairpin-shaped miRNA-like precursors.

In order to validate the performance of the HAIRPIN DETECTOR 114 (FIG. 9), preferably a variation of the k-fold cross validation method (Tom M. Mitchell, Machine Learning, McGraw Hill (1997)), is employed. This preferred validation method is well adapted to deal with the training set, which includes large numbers of similar or identical miRNAs. The training set is therefore preferably initially divided into groups of miRNAs such that any two miRNAs that belong to different groups have an Edit Distance score of at least D=3, i.e. they differ by at least 3 editing steps (Dan Gusfield, Algorithms on strings, trees, and sequences: computer science and computational biology, Cambridge University Press, 1997). Next, the groups are preferably classified into k sets of groups. Standard k-fold cross validation is preferably performed on these sets, preferably using k=5, such that the training set and the test set include at least one sequence from each of the groups. It is appreciated that without the prior grouping, standard cross validation methods incorrectly indicate much higher performance results for the predictors due to the redundancy of training examples within the genome of a species and across genomes of different species.

In a preferred embodiment of the present invention, using the abovementioned validation methodology, the efficacy of the HAIRPIN DETECTOR 114 (FIG. 9) is confirmed. For example, when a similarity threshold is chosen such that 90% of the known hairpin-shaped miRNA precursors are successfully predicted, only 11% of the approximately 342,880 background set of hairpin-shaped sequences are predicted to be hairpin-shaped miRNA-like precursors.

Figure 12B:
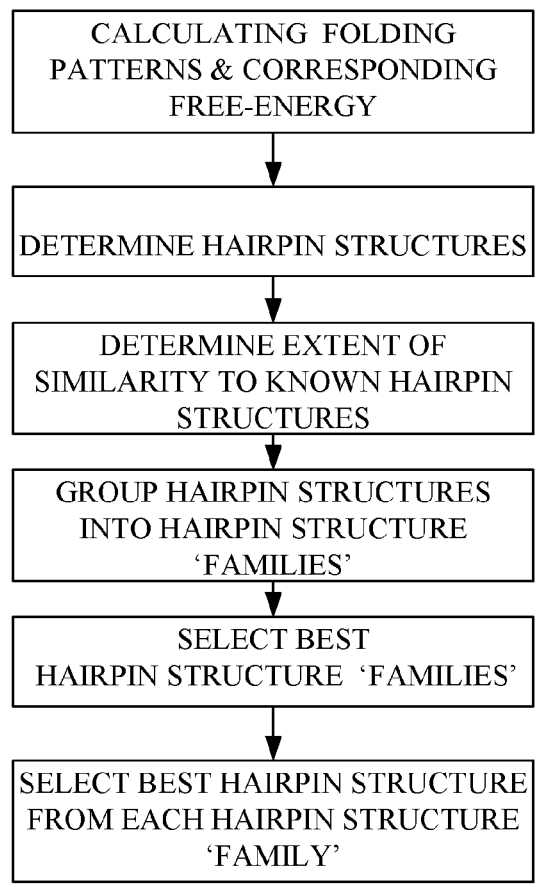
FIG. 12B is a simplified flowchart illustrating operation of a hairpin detector constructed and operative in accordance with a preferred embodiment of the present invention.

Reference is now made to FIG. 12B which is a simplified flowchart illustrating preferred operation of the HAIRPIN DETECTOR 114 of FIG. 9. The HAIRPIN DETECTOR 114 preferably initially uses a secondary structure folding algorithm based on free-energy minimization, such as the MFOLD algorithm, described in Mathews et al. J. Mol. Biol. 288:911-940 (1999) and Zuker, M. Nucleic Acids Res. 31: 3406-3415. (2003), the disclosure of which is hereby incorporated by reference. This algorithm is operative to calculate probable secondary structure folding patterns of the NON-PROTEIN CODING GENOMIC SEQUENCES 136 (FIG. 11A) as well as the free-energy of each of these probable secondary folding patterns. The secondary structure folding algorithm, such as the MFOLD algorithm (Mathews, 1997; Zuker 2003), typically provides a listing of the base-pairing of the folded shape, i.e. a listing of each pair of connected nucleotides in the sequence.

Next, the HAIRPIN DETECTOR 114 analyzes the results of the secondary structure folding patterns, in order to determine the presence and location of hairpin folding structures. The goal of this second step is to assess the base-pairing listing provided by the secondary structure folding algorithm, in order to determine whether the base-pairing listing describes one or more hairpin type bonding pattern. Preferably, sequence segment corresponding to a hairpin structure is then separately analyzed by the secondary structure folding algorithm in order to determine its exact folding pattern and free-energy.

The HAIRPIN DETECTOR 114 then assesses the hairpin structures found by the previous step, comparing them to hairpin structures of known miRNA precursors, using various characteristic hairpin structure features such as length of the hairpin structure, length of the loop of mismatched nucleotides at its center, its free-energy and its thermodynamic stability, the amount and type of mismatched nucleotides and the existence of sequence repeat-elements. Only hairpins that bear statistically significant resemblance to the training set of hairpin structures of known miRNA precursors, according to the abovementioned parameters, are accepted.

In a preferred embodiment of the present invention, similarity to the training set of hairpin structures of known miRNA precursors is determined using a "similarity score" which is calculated using a weighted sum of terms, where each term is a function of one of the abovementioned hairpin structure features. The parameters of each function are learned from the set of hairpin structures of known miRNA precursors, as described hereinabove with reference to HAIRPIN DETECTOR TRAINING & VALIDATION FUNCTIONALITY 124 (FIG. 10). The weight of each term in the similarity score is optimized so as to achieve maximized separation between the distribution peaks of similarity scores validated miRNA-precursor hairpin structures, and the distribution of similarity scores of hairpin structures detected in the background set mentioned hereinabove with reference to FIG. 12B.

In an alternative preferred embodiment of the present invention, the step described in the preceding paragraph may be split into two stages. A first stage implements a simplified scoring method, typically based on thresholding a subset of the hairpin structure features described hereinabove, and may employ a minimum threshold for hairpin structure length and a maximum threshold for free energy. A second stage is preferably more stringent, and preferably employs a full calculation of the weighted sum of terms described hereinabove. The second stage preferably is performed only on the subset of hairpin structures that survived the first stage.

The HAIRPIN DETECTOR 114 also attempts to select hairpin structures whose thermodynamic stability is similar to that of hairpin structures of known miRNA precursors. This may be achieved in various ways. A preferred embodiment of the present invention utilizes the following methodology, preferably comprising three logical steps:

First, the HAIRPIN DETECTOR 114 attempts to group hairpin structures into "families" of closely related hairpin structures. As is known in the art, a secondary structure folding algorithm typically provides multiple alternative folding patterns, for a given genomic sequence and indicates the free energy of each alternative folding pattern. It is a particular feature of the present invention that the HAIRPIN DETECTOR 114 preferably assesses the various hairpin structures appearing in the various alternative folding patterns and groups hairpin structures which appear at identical or similar sequence locations in various alternative folding patterns into common sequence location based "families" of hairpins. For example, all hairpin structures whose center is within 7 nucleotides of each other may be grouped into a family". Hairpin structures may also be grouped into a family" if their nucleotide sequences are identical or overlap to a predetermined degree.

It is also a particular feature of the present invention that the hairpin structure "families" are assessed in order to select only those families which represent hairpin structures that are as thermodynamically stable as those of hairpin structures of known miRNA precursors. Preferably only families which are represented in at least a selected majority of the alternative secondary structure folding patterns, typically 65%, 80% or 100% are considered to be sufficiently stable.

It is an additional particular feature of the present invention that the most suitable hairpin structure is selected from each selected family. For example, a hairpin structure which has the greatest similarity to the hairpin structures appearing in alternative folding patterns of the family may be preferred. Alternatively or additionally, the hairpin structures having relatively low free energy may be preferred.

Alternatively or additionally considerations of homology to hairpin structures of other organisms and the existence of clusters of thermodynamically stable hairpin structures located adjacent to each other along a sequence may be important in selection of hairpin structures. The tightness of the clusters in terms of their location and the occurrence of both homology and clusters may be of significance.

Figure 13A:
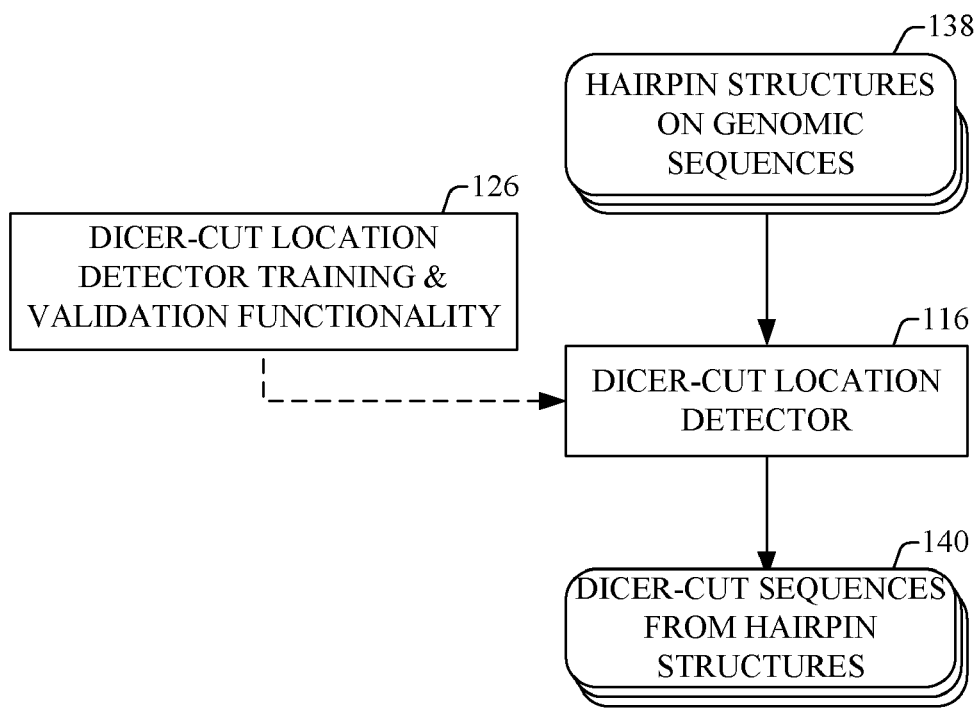
FIG. 13A is a simplified block diagram of a dicer-cut location detector constructed and operative in accordance with a preferred embodiment of the present invention.
Figure 13B:
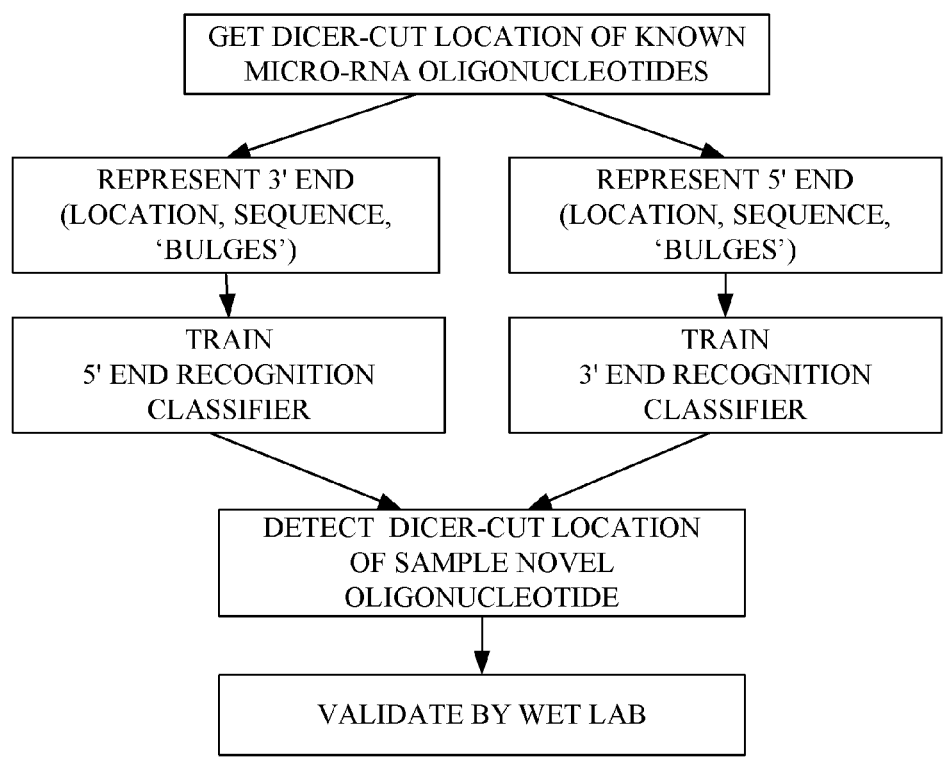
FIG. 13B is a simplified flowchart illustrating training of a dicer-cut location detector constructed and operative in accordance with a preferred embodiment of the present invention.
Figure 13C:
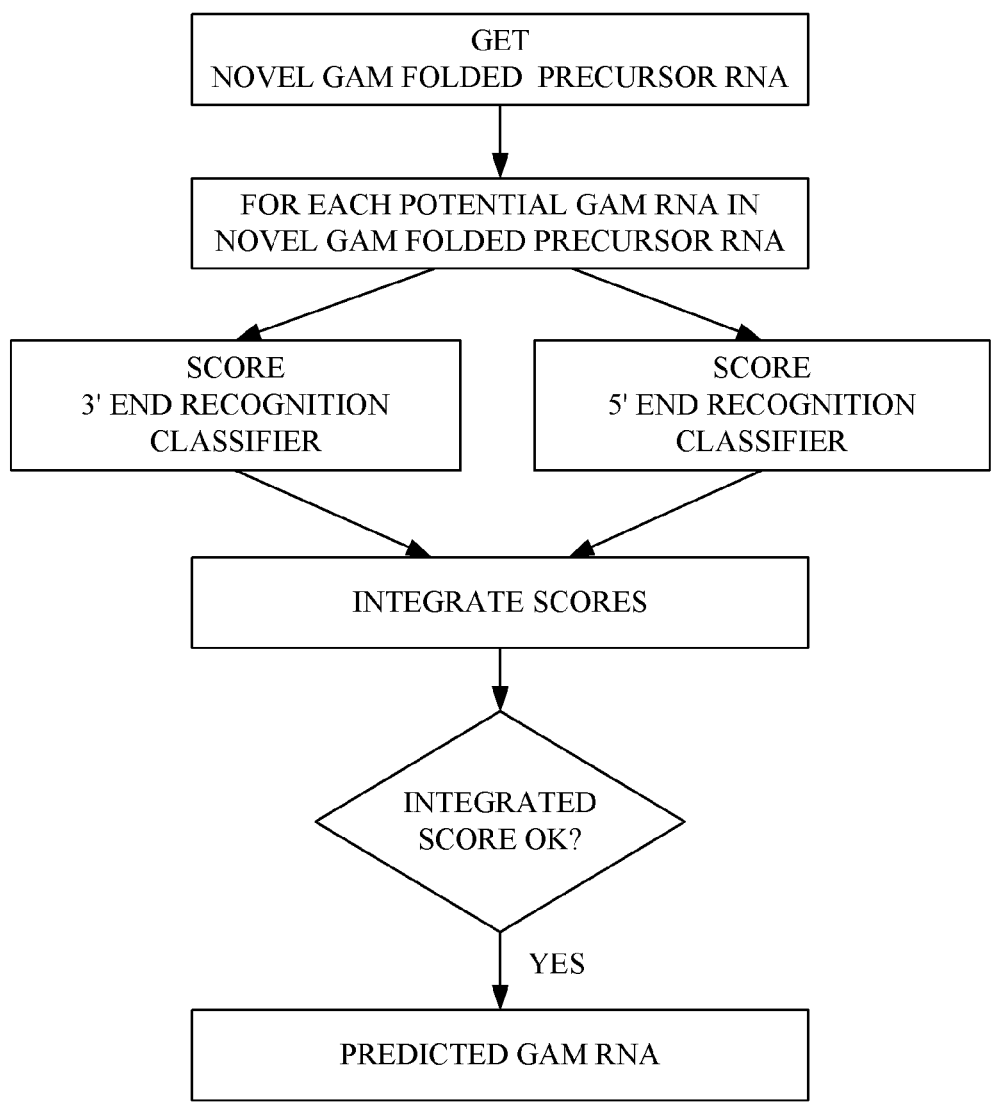
FIG. 13C is a simplified flowchart illustrating operation of a dicer-cut location detector constructed and operative in accordance with a preferred embodiment of the present invention.

Reference is now made to FIGS. 13A-13C which together describe the structure and operation of the DICER-CUT LOCATION DETECTOR 116, described hereinabove with FIG. 9.

FIG. 13A is a simplified block diagram of a preferred implementation of the DICER-CUT LOCATION DETECTOR 116. The goal of the DICER-CUT LOCATION DETECTOR 116 is to detect the location in which the DICER COMPLEX, described hereinabove with reference to FIG. 8, dices GAM FOLDED PRECURSOR RNA, yielding GAM RNA.

The DICER-CUT LOCATION DETECTOR 116 therefore receives a plurality of HAIRPIN STRUCTURES ON GENOMIC SEQUENCES 138 (FIG. 12A), and, following operation of DICER-CUT LOCATION DETECTOR TRAINING & VALIDATION FUNCTIONALITY 126 (FIG. 10), is operative to detect a plurality of DICER-CUT SEQUENCES FROM HAIRPIN STRUCTURES 140.

Reference is now made to FIG. 13B which is a simplified flowchart illustrating a preferred implementation of DICER-CUT LOCATION DETECTOR TRAINING & VALIDATION FUNCTIONALITY 126.

A general goal of the DICER-CUT LOCATION DETECTOR TRAINING & VALIDATION FUNCTIONALITY 126 is to analyze the dicer-cut locations of known diced miRNA on respective hairpin shaped miRNA precursors in order to determine a common pattern in these locations, which can be used to predict dicer cut locations on GAM folded precursor RNAs.

The dicer-cut locations of known miRNA precursors are obtained and studied. Locations of the 5' and/or 3' ends of the known diced miRNAs are preferably represented by their respective distances from the 5' end of the corresponding hairpin shaped miRNA precursor. Additionally or alternatively, the 5' and/or 3' ends of the known diced miRNAs are preferably represented by the relationship between their locations and the locations of one or more nucleotides along the hairpin shaped miRNA precursor. Additionally or alternatively, the 5' and/or 3' ends of the known diced miRNAs are preferably represented by the relationship between their locations and the locations of one or more bound nucleotide pairs along the hairpin shaped miRNA precursor. Additionally or alternatively, the 5' and/or 3' ends of the known diced miRNAs are preferably represented by the relationship between their locations and the locations of one or more mismatched nucleotide pairs along the hairpin shaped miRNA precursor. Additionally or alternatively, the 5' and/or 3' ends of the known diced miRNAs are preferably represented by the relationship between their locations and the locations of one or more unmatched nucleotides along the hairpin shaped miRNA precursor. Additionally or alternatively, locations of the 5' and/or 3' ends of the known diced miRNAs are preferably represented by their respective distances from the loop located at the center of the corresponding hairpin shaped miRNA precursor.

One or more of the foregoing location metrics may be employed in the training and validation functionality. Additionally, metrics related to the nucleotide content of the diced miRNA and/or of the hairpin shaped miRNA precursor may be employed.

In a preferred embodiment of the present invention, DICER-CUT LOCATION DETECTOR TRAINING & VALIDATION FUNCTIONALITY 126 preferably employs standard machine learning techniques known in the art of machine learning for analysis of existing patterns in a given "training set" of examples. These techniques are capable, to a certain degree, of detecting similar patterns in other, previously unseen examples. Such machine learning techniques include, but are not limited to neural networks, Bayesian networks, Support Vector Machines (SVM), Genetic Algorithms, Markovian modeling, Maximum Likelihood modeling, Nearest Neighbor algorithms, Decision trees and other techniques, as is well known in the art.

In accordance with one embodiment of the present invention, machine learning predictors, such as a Support Vector Machine (SVM) predictor, are applied to the aforementioned training set and are operative, for example to test every possible nucleotide on a hairpin as a candidate for being the 5' end or the 3' end of a diced GAM RNA. More preferred machine learning predictors include predictors based on Nearest Neighbor, Bayesian modeling, and K-nearest-neighbor algorithms. A training set of the known miRNA precursor sequences is preferably used for training multiple separate classifiers or predictors, each of which produces a model for the 5' and/or 3' end locations of a diced miRNA with respect to its hairpin precursor. The models take into account one or more of the various miRNA location metrics described above.

Performance of the resulting predictors, evaluated on the abovementioned validation set of 440 published miRNAs using k-fold cross validation (Mitchell, 1997) with k=3, is found to be as follows: in 70% of known miRNAs 5'-end location is correctly determined by an SVM predictor within up to 2 nucleotides; a Nearest Neighbor (EDIT DISTANCE) predictor achieves 56% accuracy (247/440); a Two-Phased predictor that uses Bayesian modeling (TWO PHASED) achieves 80% accuracy (352/440), when only the first phase is used. When the second phase (strand choice) is implemented by a nave Bayesian model the accuracy is 55% (244/440), and when the K-nearest-neighbor modeling is used for the second phase, 374/440 decision are made and the accuracy is 65% (242/374). A K-nearest-neighbor predictor (FIRST-K) achieves 61% accuracy (268/440). The accuracies of all predictors are considerably higher on top scoring subsets of published miRNA.

Finally, in order to validate the efficacy and accuracy of the DICER-CUT LOCATION DETECTOR 116, a sample of novel oligonucleotides detected thereby is preferably selected, and validated by wet lab. Laboratory results validating the efficacy of the DICER-CUT LOCATION DETECTOR 116 are described hereinbelow with reference to FIGS. 21-24D.

Reference is now made to FIG. 13C which is a simplified flowchart illustrating operation of DICER-CUT LOCATION DETECTOR 116 (FIG. 9), constructed and operative in accordance with a preferred embodiment of the present invention. The DICER CUT LOCATION DETECTOR 116 preferably comprises a machine learning computer program module, which is trained to recognize dicer-cut locations on known hairpin-shaped miRNA precursors, and based on this training, is operable to detect dicer-cut locations of novel GAM RNAs (FIG. 8) on GAM FOLDED PRECURSOR RNAs (FIG. 8). In a preferred embodiment of the present invention, the dicer-cut location module preferably utilizes machine learning algorithms, such as known Support Vector Machine (SVM) and more preferably: known Bayesian modeling, Nearest Neighbors, and K-nearest-neighbor algorithms.

When initially assessing a novel GAM FOLDED PRECURSOR RNA, all 19-24 nucleotides long segments thereof are initially considered as "potential GAM RNAs", since the dicer-cut location is initially unknown.

For each such potential GAM RNA, the location of its 5' end or the locations of its 5' and 3' ends are scored by at least one recognition classifier or predictor.

In a preferred embodiment of the present invention, the DICER-CUT LOCATION DETECTOR 116 (FIG. 9) may use a Support Vector Machine predictor trained on and operating on features such as the following:

Locations of the 5' and/or 3' ends of the known diced miRNAs, which are preferably represented by their respective distances from the 5' end of the corresponding hairpin shaped miRNA precursor. Additionally or alternatively, the 5' and/or 3' ends of the known diced miRNAs are preferably represented by the relationship between their locations and the locations of one or more nucleotides along the hairpin shaped miRNA precursor. Additionally or alternatively, the 5' and/or 3' ends of the known diced miRNAs are preferably represented by the relationship between their locations and the locations of one or more bound nucleotide pairs along the hairpin shaped miRNA precursor. Additionally or alternatively, the 5' and/or 3' ends of the known diced miRNAs are preferably represented by the relationship between their locations and the locations of one or more mismatched nucleotide pairs along the hairpin shaped miRNA precursor. Additionally or alternatively, the 5' and/or 3' ends of the known diced miRNAs are preferably represented by the relationship between their locations and the locations of one or more unmatched nucleotides along the hairpin shaped miRNA precursor. Additionally or alternatively, locations of the 5' and/or 3' ends of the known diced miRNAs are preferably represented by their respective distances from the loop located at the center of the corresponding hairpin shaped miRNA precursor; and secondarily Metrics related to the nucleotide content of the diced miRNA and/or of the hairpin shaped miRNA precursor.

In another preferred embodiment of the present invention, the DICER-CUT LOCATION DETECTOR 116 (FIG. 9) preferably employs an "EDIT DISTANCE" predictor, which seeks sequences that are similar to those of known miRNAs, utilizing a Nearest Neighbor algorithm, where a similarity metric between two sequences is a variant of the Edit Distance algorithm (Gusfield, 1997). The EDIT DISTANCE predictor is based on an observation that miRNA oligonucleotides tend to form clusters, the members of which show marked sequence similarity.

In yet another preferred embodiment of the present invention, the DICER-CUT LOCATION DETECTOR 116 (FIG. 9) preferably uses a "TWO PHASE" predictor, which predicts the dicer-cut location in two distinct phases: (a) selecting a double-stranded segment of the GAM FOLDED PRECURSOR RNA (FIG. 8) comprising the GAM RNA by nave Bayesian modeling and (b) detecting which strand of the double-stranded segment contains GAM RNA (FIG. 8) by employing either nave or by K-nearest-neighbor modeling. K-nearest-neighbor modeling is a variant of the 'FIRST-K' predictor described hereinbelow, with parameters optimized for this specific task. The 'TWO PHASE' predictor may be operated in two modes: either utilizing only the first phase and thereby producing two alternative dicer-cut location predictions, or utilizing both phases and thereby producing only one final dicer-cut location.

In still another preferred embodiment of the present invention, the DICER-CUT LOCATION DETECTOR 116 preferably uses a "FIRST-K" predictor, which utilizes a K-nearest-neighbor algorithm. The similarity metric between any two sequences is $1-E/L$, where L is a parameter, preferably 8-10 and E is the edit distance between the two sequences, taking into account only the first L nucleotides of each sequence. If the K-nearest-neighbor scores of two or more locations on the GAM FOLDED PRECURSOR RNA (FIG. 8) are not significantly different, these locations are further ranked by a Bayesian model, similar to the one described hereinabove.

The TWO PHASE and FIRST-K predictors preferably are trained on and operate on features such as the following:

Locations of the 5' and/or 3' ends of the the known diced miRNAs, which are preferably represented by their respective distances from the 5' end of the corresponding hairpin shaped miRNA precursor. Additionally or alternatively, the 5' and/or 3' ends of the known diced miRNAs are preferably represented by the relationship between their locations and the locations of one or more nucleotides along the hairpin shaped miRNA precursor. Additionally or alternatively, the 5' and/or 3' ends of the known diced miRNAs are preferably represented by the relationship between their locations and the locations of one or more bound nucleotide pairs along the hairpin shaped miRNA precursor. Additionally or alternatively, the 5' and/or 3' ends of the known diced miRNAs are preferably represented by the relationship between their locations and the locations of one or more mismatched nucleotide pairs along the hairpin shaped miRNA precursor. Additionally or alternatively, the 5' and/or 3' ends of the known diced miRNAs are preferably represented by the relationship between their locations and the locations of one or more unmatched nucleotides along the hairpin shaped miRNA precursor. Additionally or alternatively, locations of the 5' and/or 3' ends of the the known diced miRNAs are preferably represented by their respective distances from the loop located at the center of the corresponding hairpin shaped miRNA precursor; and secondarily Metrics related to the nucleotide content of the diced miRNA and/or of the hairpin shaped miRNA precursor.

In accordance with an embodiment of the present invention scores of two or more of the abovementioned classifiers or predictors are integrated, yielding an integrated score for each "potential GAM RNA". As an example, FIG. 13C illustrates integration of scores from two classifiers, a 3' end recognition classifier and a 5' end recognition classifier, the scores of which are integrated to yield an integrated score. Most preferably, the INTEGRATED SCORE of FIG. 13C preferably implements a "best-of-breed" approach employing a pair of classifiers and accepting only "potential GAM RNAs" that score highly on one of the above mentioned "EDIT DISTANCE", or "TWO-PHASE" predictors. In this context, "high scores" means scores which have been demonstrated to have low false positive value when scoring known miRNA oligonucleotides. Alternatively, the INTEGRATED SCORE may be derived from operation of more or less than two classifiers.

The INTEGRATED SCORE is evaluated as follows: (a) the "potential GAM RNA" having the highest score is preferably taken to be the most probable GAM RNA, and (b) if the integrated score of this most probable GAM RNA is higher than a pre-defined threshold, then the most probable GAM RNA is accepted as a PREDICTED GAM RNA. Preferably, this evaluation technique is not limited to the highest scoring potential GAM RNA.

Figure 14A:
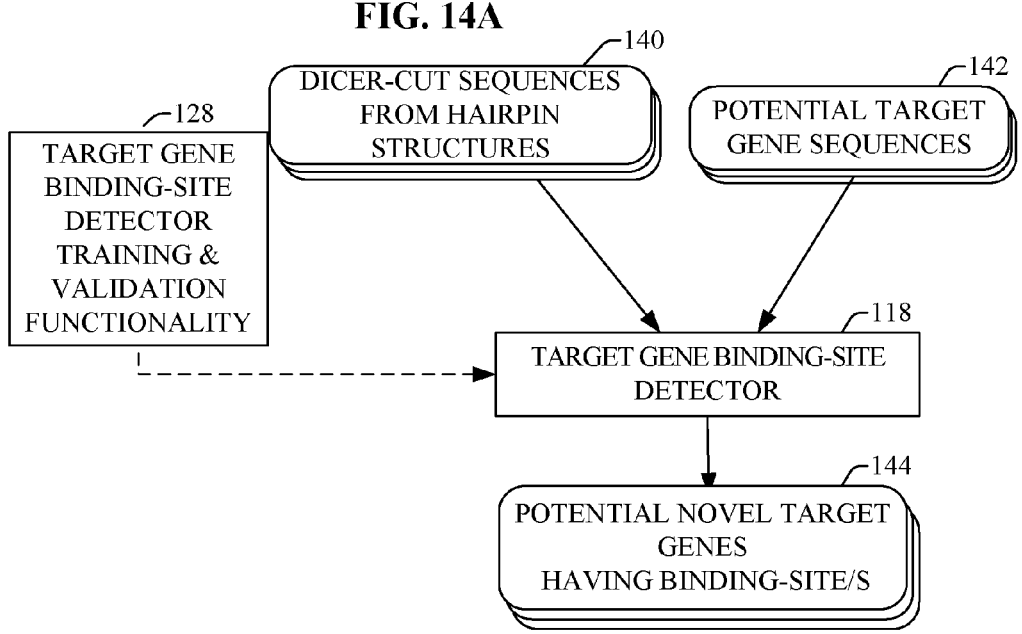
FIG. 14A is a simplified block diagram of a target gene binding-site detector constructed and operative in accordance with a preferred embodiment of the present invention.

Reference is now made to FIG. 14A which is a simplified block diagram of a preferred implementation of the TARGET GENE BINDING-SITE DETECTOR 118 described hereinabove with reference to FIG. 9. The goal of the TARGET GENE BINDING-SITE DETECTOR 118 is to detect one or more binding sites such as BINDING SITE I, BINDING SITE II and BINDING SITE III (FIG. 8) located in untranslated regions of the mRNA of a known gene, the nucleotide sequence of which binding sites is partially or fully complementary to a GAM RNA, thereby determining that the above mentioned known gene is a target gene thereof.

The TARGET GENE BINDING-SITE DETECTOR 118 (FIG. 9) receives a plurality of DICER-CUT SEQUENCES FROM HAIRPIN STRUCTURES 140 (FIG. 13A), and a plurality of POTENTIAL TARGET GENE SEQUENCES 142 which are derived from SEQUENCED DNA DATA 104 (FIG. 9).

TARGET GENE BINDING-SITE DETECTOR TRAINING & VALIDATION FUNCTIONALITY 128 (FIG. 10) is operative to train the TARGET GENE BINDING-SITE DETECTOR on known miRNAs and their respective target genes. A sequence comparison of sequences of known miRNA oligonucleotides to sequences of known binding sites of known target thereof is performed by utilizing BLAST or other algorithms such as EDIT DISTANCE.

The results are preferably employed to define a threshold based on scoring distinctions between known miRNA binding sites and sequences which are known not to be miRNA binding sites. This threshold is used during operation of TARGET GENE BINDING-SITE DETECTOR 118 to distinguish between miRNA-like binding sites of potential GAM RNA and other sequences.

Next, the binding sites are expanded, and determinations are made whether if nucleotide sequences immediately adjacent to the binding sites found by the sequence comparison algorithm (e.g. BLAST or EDIT DISTANCE), may improve the match. Free-energy and spatial structure are computed for the resulting binding sites. Binding sites which are clustered are strongly preferred and binding sites found in evolutionarily conserved sequences may also be preferred. Free energy, spatial structure and the above preferences are reflected in scoring.

The resulting scores, characteristic of known binding sites (e.g. binding sites of known miRNA oligonucleotides Lin-4 and Let-7 to target genes Lin-14, Lin-41, Lin 28 etc.), may be employed for detection of binding-sites of novel GAM RNAs.

Following operation of TARGET GENE BINDING-SITE DETECTOR TRAINING & VALIDATION FUNCTIONALITY 128 (FIG. 10), the TARGET GENE BINDING-SITE DETECTOR 118 is operative to detect a plurality of POTENTIAL NOVEL TARGET GENES HAVING BINDING-SITE/S 144 the nucleotide sequence of which is partially or fully complementary to that of each of the plurality of DICER-CUT SEQUENCES FROM HAIRPIN STRUCTURES 140. Preferred operation of the TARGET GENE BINDING-SITE DETECTOR 118 is further described hereinbelow with reference to FIG. 14B.

Figure 14B:
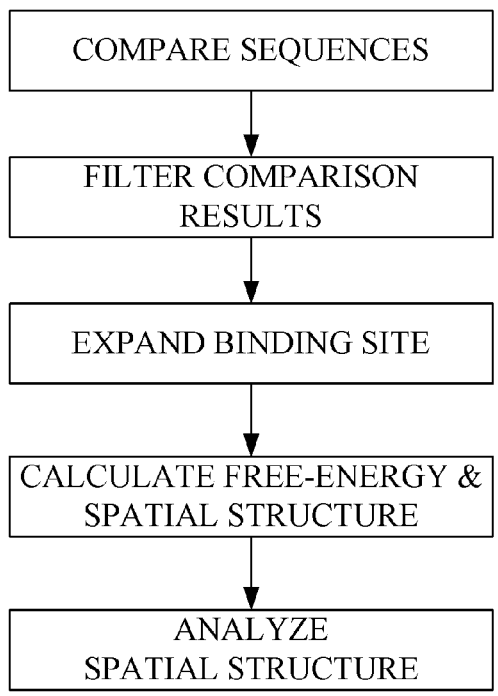
FIG. 14B is a simplified flowchart illustrating operation of a target gene binding-site detector constructed and operative in accordance with a preferred embodiment of the present invention.

Reference is now made to FIG. 14B which is a simplified flowchart illustrating a preferred operation of the TARGET GENE BINDING-SITE DETECTOR 118 of FIG. 9. In a preferred embodiment of the present invention, the TARGET GENE BINDING-SITE DETECTOR 118 employs a sequence comparison algorithm such as BLAST in order to compare the nucleotide sequence of each of the plurality of DICER-CUT SEQUENCES FROM HAIRPIN STRUCTURES 140 (FIG. 13A), to the POTENTIAL TARGET GENE SEQUENCES 142 (FIG. 14A), such as untranslated regions of known mRNAs, in order to find crude potential matches. Alternatively, the sequence comparison may be performed using a sequence match search tool that is essentially a variant of the EDIT DISTANCE algorithm described hereinabove with reference to FIG. 13C, and the Nearest Neighbor algorithm.

A sequence comparison of DICER-CUT SEQUENCES FROM HAIRPIN STRUCTURES 140 (FIG. 14A) are compared to POTENTIAL TARGET GENE SEQUENCES 142 (FIG. 14A) by utilizing BLAST or other algorithms such as EDIT DISTANCE.

The results are preferably filtered according to a threshold determined in accordance with the scoring resulting from the sequence comparison carried out by the TARGET GENE BINDING-SITE DETECTOR TRAINING & VALIDATION FUNCTIONALITY 128.

Next the binding sites are expanded, and determinations are made whether if nucleotide sequences immediately adjacent to the binding sites found by the sequence comparison algorithm (e.g. BLAST or EDIT DISTANCE), may improve the match.

Free-energy and spatial structure are computed for the resulting binding sites. Binding sites which are clustered are strongly preferred and binding sites found in evolutionarily conserved sequences may also be preferred. Free energy, spatial structure and the above preferences are reflected in scoring.

The resulting scores are compared with scores characteristic of known binding sites (e.g. binding sites of known miRNA oligonucleotides Lin-4 and Let-7 to target genes Lin-14, Lin-41, Lin 28 etc.).

For each candidate binding site a score, here termed Binding Site Prediction Accuracy, is calculated which estimates its similarity to known binding sites. This score is based on GAM binding site characteristics including, but not limited to:

The free energy of binding of the GAM RNA-GAM RNA binding site complex;

Additionally or alternatively, the 5' and/or 3' ends of the GAM RNA, preferably represented by the relationship between their locations and the locations of one or more nucleotides along the GAM RNA; Additionally or alternatively, the 5' and/or 3' ends of the GAM RNA, preferably represented by the relationship between their locations and the locations of one or more bound nucleotide pairs along the GAM RNA binding site complex; Additionally or alternatively, the 5' and/or 3' ends of the GAM RNA, preferably represented by the relationship between their locations and the locations of one or more mismatched nucleotide pairs along the GAM RNA binding-site complex; Additionally or alternatively, the 5' and/or 3' ends of the GAM RNA, preferably represented by the relationship between their locations and the locations of one or more unmatched nucleotides along the GAM RNA binding-site complex.

In accordance with another preferred embodiment of the present invention, binding sites are searched by a reversed process. Sequences of K (preferably 22) nucleotides of a untranslated regions of a target gene are assessed as potential binding sites. A sequence comparison algorithm, such as BLAST or EDIT DISTANCE, is then used to search elsewhere in the genome for partially or fully complementary sequences which are found in known miRNA oligonucleotides or computationally predicted GAM oligonucleotides. Only complementary sequences, which meet predetermined spatial structure and free energy criteria as described hereinabove are accepted. Clustered binding sites are strongly preferred and potential binding sites and potential GAM oligonucleotides which occur in evolutionarily conserved genomic sequences are also preferred. Scoring of candidate binding sites takes into account free energy and spatial structure of the binding site complexes, as well as the aforesaid preferences.

Target binding sites identified by the TARGET GENE BINDING-SITE DETECTOR 118 (FIG. 9), are preferably divided into four groups:

a) binding sites which are exactly complementary to the predicted GAM RNA. (1 nt. mismatch is allowed)

b) binding sites which are not exactly complementary to the predicted GAM RNA and having 0.8=<Binding Site Prediction Accuracy<1;

c) binding sites which are not exactly complementary to the predicted GAM RNA and having 0.7=<Binding Site Prediction Accuracy<0.8; and d) binding sites which are not exactly complementary to the predicted GAM RNA and having 0.6=<Binding Site Prediction Accuracy<0.7.

The average number of mismatched nucleotides in the alignment of predicted GAM RNA and a corresponding target gene binding-site is smallest in category a and largest in category d.

In accordance with a preferred embodiment of the present invention there is provided a binding site specific ranking, indicative of the degree of similarity of characteristics of the binding of a GAM to a target gene binding site, to binding characteristic of known miRNAs. This ranking preferably utilizes the evaluation criteria described hereinabove.

In accordance with another preferred embodiment of the present invention, there is provided a UTR specific ranking of GAM to target gene binding, indicative of the degree of similarity of characteristics of the binding of a GAM to a cluster of target gene binding sites on a UTR, to binding characteristics of known miRNAs to UTRs of corresponding miRNA target genes. This ranking preferably is a weighted sum of the binding site specific rankings of various clustered binding sites.

Figure 15:
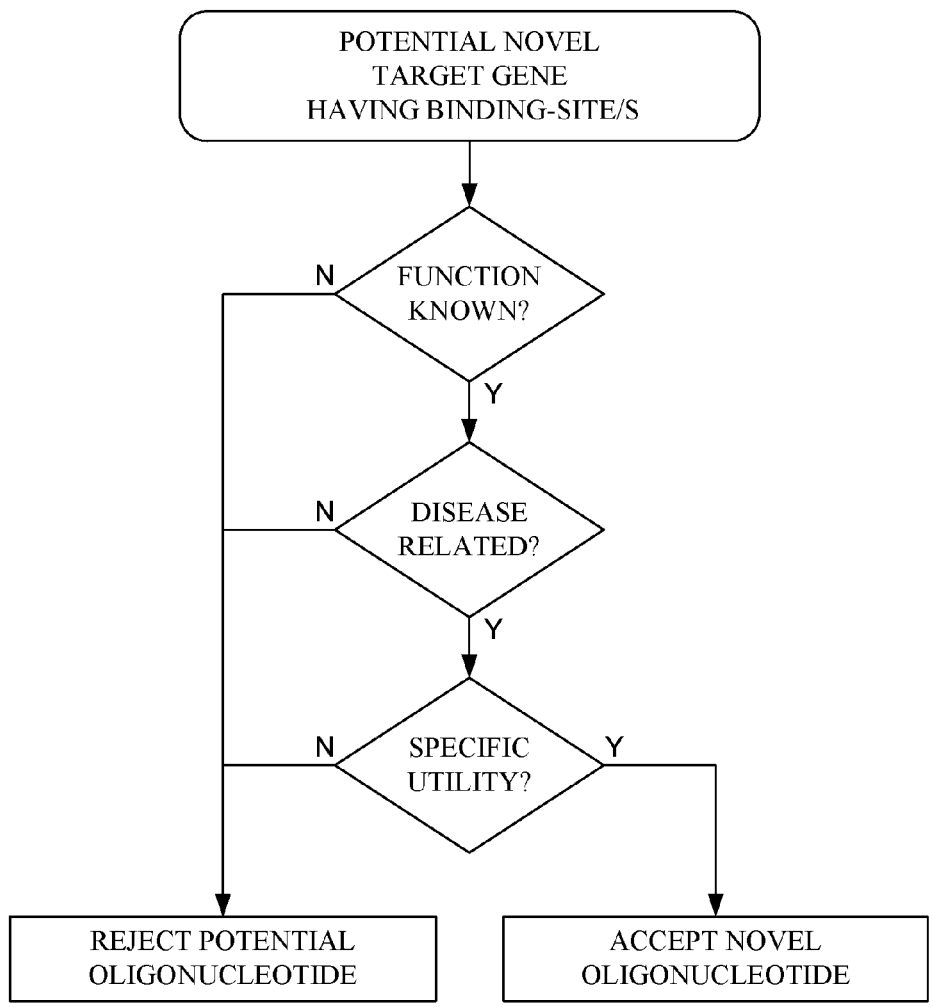
FIG. 15 is a simplified flowchart illustrating operation of a function & utility analyzer constructed and operative in accordance with a preferred embodiment of the present invention.

Reference is now made to FIG. 15 which is a simplified flowchart illustrating a preferred operation of the FUNCTION & UTILITY ANALYZER 120 described hereinabove with reference to FIG. 9. The goal of the FUNCTION & UTILITY ANALYZER 120 is to determine if a potential target gene is in fact a valid clinically useful target gene. Since a potential novel GAM oligonucleotide binding a binding site in the UTR of a target gene is understood to inhibit expression of that target gene, and if that target gene is shown to have a valid clinical utility, then in such a case it follows that the potential novel oligonucleotide itself also has a valid useful function which is the opposite of that of the target gene.

The FUNCTION & UTILITY ANALYZER 120 preferably receives as input a plurality of POTENTIAL NOVEL TARGET GENES HAVING BINDING-SITE/S 144 (FIG. 14A), generated by the TARGET GENE BINDING-SITE DETECTOR 118 (FIG. 9). Each potential oligonucleotide is evaluated as follows: First, the system checks to see if the function of the potential target gene is scientifically well established. Preferably, this can be achieved bioinformatically by searching various published data sources presenting information on known function of proteins. Many such data sources exist and are published as is well known in the art. Next, for those target genes the function of which is scientifically known and is well documented, the system then checks if scientific research data exists which links them to known diseases. For example, a preferred embodiment of the present invention utilizes the OMIM(™) (Hamosh et al, 2002) database published by NCBI, which summarizes research publications relating to genes which have been shown to be associated with diseases. Finally, the specific possible utility of the target gene is evaluated. While this process too may be facilitated by bioinformatic means, it might require manual evaluation of published scientific research regarding the target gene, in order to determine the utility of the target gene to the diagnosis and or treatment of specific disease. Only potential novel oligonucleotides, the target genes of which have passed all three examinations, are accepted as novel oligonucleotide.

Figure 16:
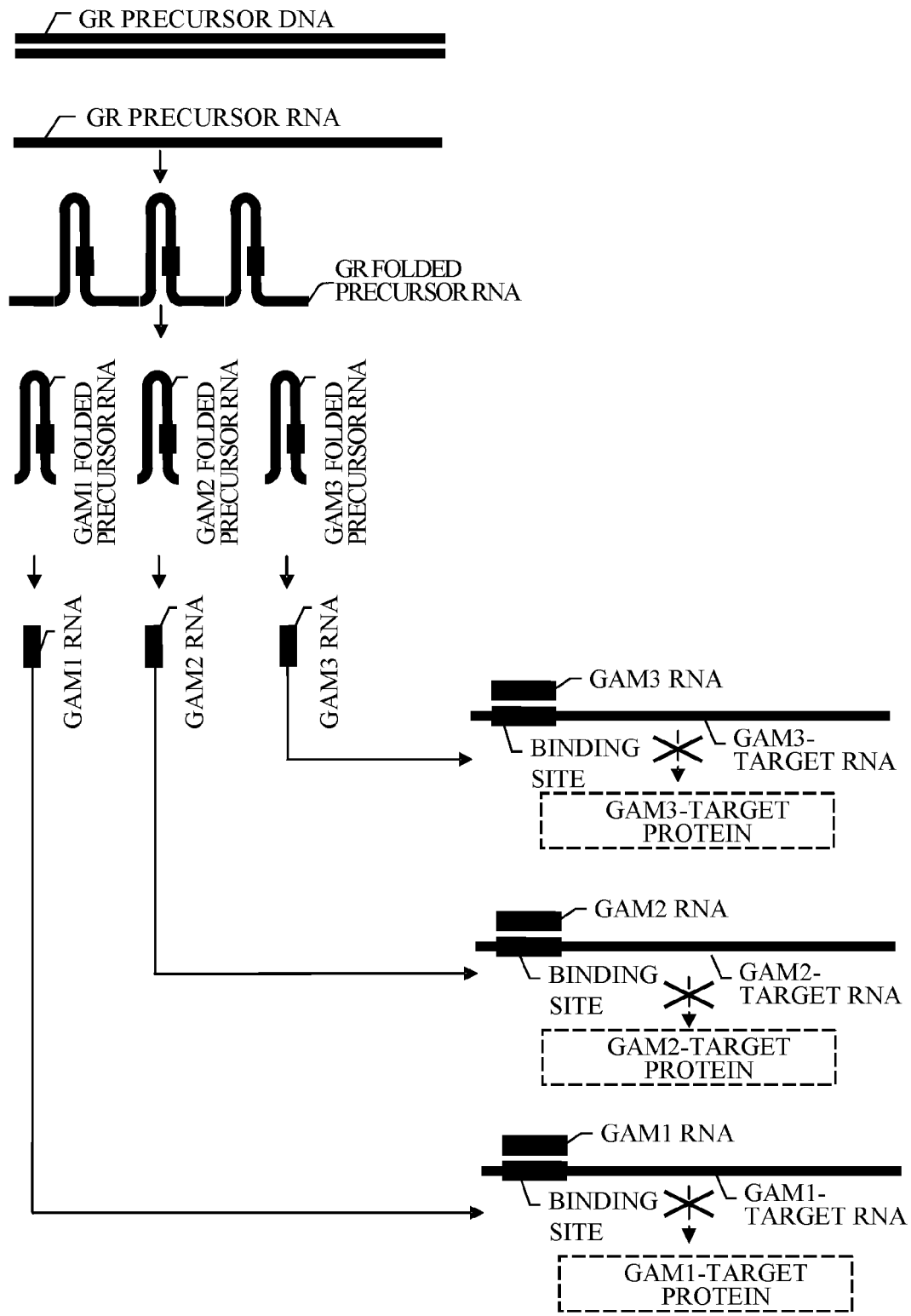
FIG. 16 is a simplified diagram describing a novel bioinformatically detected group of regulatory polynucleotides referred to here as Genomic Record (GR) polynucleotide, each of which encodes an 'operon-like' cluster of novel miRNA-like oligonucleotides, which in turn modulates expression of one or more target genes.

Reference is now made to FIG. 16, which is a simplified diagram describing each of a plurality of novel bioinformatically detected regulatory polynucleotide, referred to here as Genomic Record (GR) polynucleotide which encodes an 'operon-like' cluster of novel micro RNA-like oligonucleotides each of which in turn modulates expression of at least one target gene, the function and utility of which at least one target gene is known in the art. GR GPRECURSOR DNA is a novel bioinformatically detected regulatory, non protein coding, polynucleotide. The method by which GR polynucleotide as detected is described hereinabove with additional reference to FIGS. 9-18. GR GPRECURSOR DNA encodes GR PRECURSOR RNA, an RNA molecule, typically several hundreds to several thousands nucleotides long. GR PRECURSOR RNA folds spatially, forming GR FOLDED PRECURSOR RNA. It is appreciated that GR FOLDED PRECURSOR RNA comprises a plurality of what is known in the art as 'hairpin' structures. These 'hairpin' structures are due to the fact that the nucleotide sequence of GR PRECURSOR RNA comprises a plurality of segments, the first half of each such segment having a nucleotide sequence which is at least a partial or accurate complementary sequence of the second half thereof, as is well known in the art. GR FOLDED PRECURSOR RNA is naturally processed by cellular enzymatic activity into separate GAM precursor RNAs, herein schematically represented by GAM1 FOLDED PRECURSOR RNA through GAM3 FOLDED PRECURSOR RNA, each of which GAM precursor RNAs being a hairpin shaped RNA segment, corresponding to GAM FOLDED PRECURSOR RNA of FIG. 8. The above mentioned GAM precursor RNAs are diced by DICER COMPLEX of FIG. 8, yielding respective short RNA segments of about 22 nucleotides in length, schematically represented by GAM1 RNA through GAM3 RNA, each of which GAM RNAs corresponding to GAM RNA of FIG. 8. GAM1 RNA, GAM2 RNA and GAM3 RNA, each bind complementarily to binding sites located in untranslated regions of respective target genes, designated GAM1-TARGET RNA, GAM2-TARGET RNA and GAM3-TARGET RNA, respectively, which target binding site corresponds to a target binding site such as BINDING SITE I, BINDING SITE II or BINDING SITE III of FIG. 8. This binding inhibits translation of the respective target proteins designated GAM1-TARGET PROTEIN, GAM2-TARGET PROTEIN and GAM3-TARGET PROTEIN respectively. It is appreciated that specific functions, and accordingly utilities, of each GR polynucleotides of the present invention, correlates with, and may be deduced from, the identity of the target genes, which are inhibited by GAM RNAs comprised in the 'operon-like' cluster of said GR polynucleotide schematically represented by GAM1 TARGET PROTEIN through GAM3 TARGET PROTEIN.

A listing of GAM oligonucleotide comprised in each of a plurality of GR polynucleotide of FIG. 16 is provided in Table 10, hereby incorporated herein. Nucleotide sequences of each said GAM oligonucleotide and their respective genomic source and chromosomal location are further described hereinbelow with reference to Table 3 hereby incorporated herein. GAM TARGET GENEs of each of said GAM oligonucleotides are elaborated hereinbelow with reference to Table 7, hereby incorporated herein. The functions of each of said GAM TARGET GENEs and their association with various diseases, and accordingly the utilities of said each of GAM oligonucleotides and hence the functions and utilities of each of said GR polynucleotides are elaborated hereinbelow with reference to Table 8, hereby incorporated herein. Studies establishing known functions of each of said GAM TARGET GENEs, and correlation of each of said GAM TARGET GENEs to known diseases are listed in Table 9, and are hereby incorporated herein.

The present invention discloses 313 novel genes of the GR group of polynucleotides, which have been detected bioinformatically. Laboratory confirmation of 2 polynucleotides of the GR group of polynucleotides is described hereinbelow with reference to FIGS. 23A-24D.

In summary, the current invention discloses a very large number of novel GR polynucleotides each of which encodes a plurality of GAM oligonucleotides, which in turn may modulate expression of a plurality of target proteins. It is appreciated therefore that the function of GR polynucleotides is in fact similar to that of the Genomic Records concept of the present invention addressing the differentiation enigma, described hereinabove with reference to FIG. 7.

Figure 17:
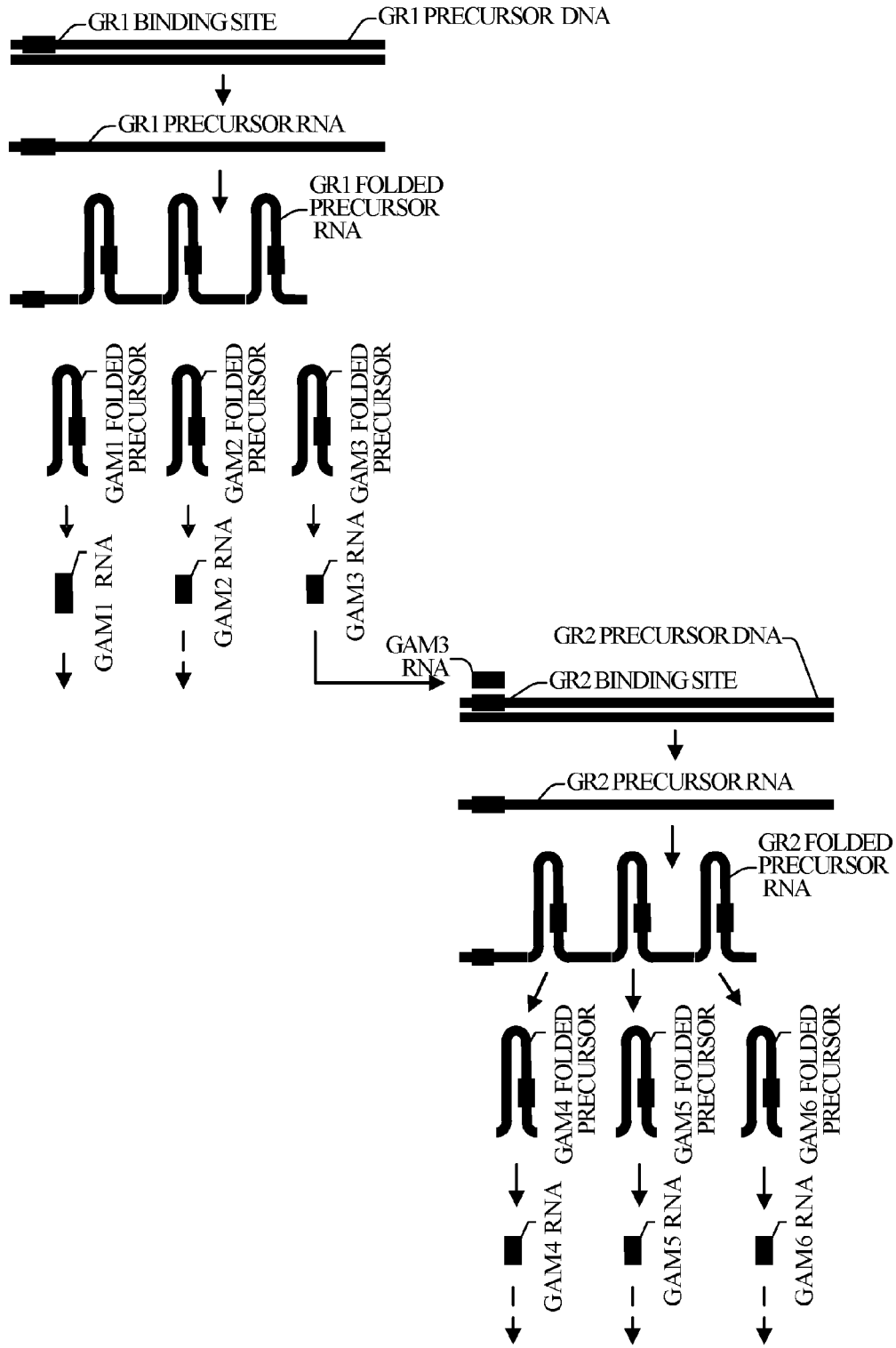
FIG. 17 is a simplified diagram illustrating a mode by which oligonucleotides of a novel group of operon-like polynucleotide of the present invention, modulate expression of other such polyonucleotides, in a cascading manner.

Reference is now made to FIG. 17 which is a simplified diagram illustrating a mode by which oligonucleotides of a novel group of operon-like polynucleotide described hereinabove with reference to FIG. 16 of the present invention, modulate expression of other such polynucleotide, in a cascading manner. GR1 PRECURSOR DNA and GR2 PRECURSOR DNA are two polynucleotides of the novel group of operon-like polynucleotides designated GR PRECURSOR DNA (FIG. 16). As is typical of polynucleotides of the GR group of polynucleotides GR1 PRECURSOR DNA and GR2 PRECURSOR DNA, each encode a long RNA precursor, which in turn folds into a folded RNA precursor comprising multiple hairpin shapes, and is cut into respective separate hairpin shaped RNA segments, each of which RNA segments being diced to yield a n oligonucleotide of a group of oligonucleotide designated GAM RNA. In this manner GR1 yields GAM1 RNA, GAM2 RNA and GAM3 RNA, and GR2 yields GAM4 RNA, GAM5 RNA and GAM6 RNA. As FIG. 17 shows, GAM3 RNA, which derives from GR1, binds a binding site located adjacent to GR2 GPRECURSOR DNA thus modulating expression of GR2, thereby invoking expression of GAM4 RNA, GAM5 RNA and GAM6 RNA which derive from GR2. It is appreciated that the mode of modulation of expression presented by FIG. 17 enables an unlimited 'cascading effect' in which a GR polynucleotide comprises multiple GAM oligonucleotides each of which may modulate expression of other GR polynucleotides each such GR polynucleotides comprising additional GAM oligonucleotide etc., whereby eventually certain GAM oligonucleotides modulate expression of target proteins. This mechanism is in accord with the conceptual model of the present invention addressing the differentiation enigma, described hereinabove with specific reference to FIGS. 6-7.

Figure 18:
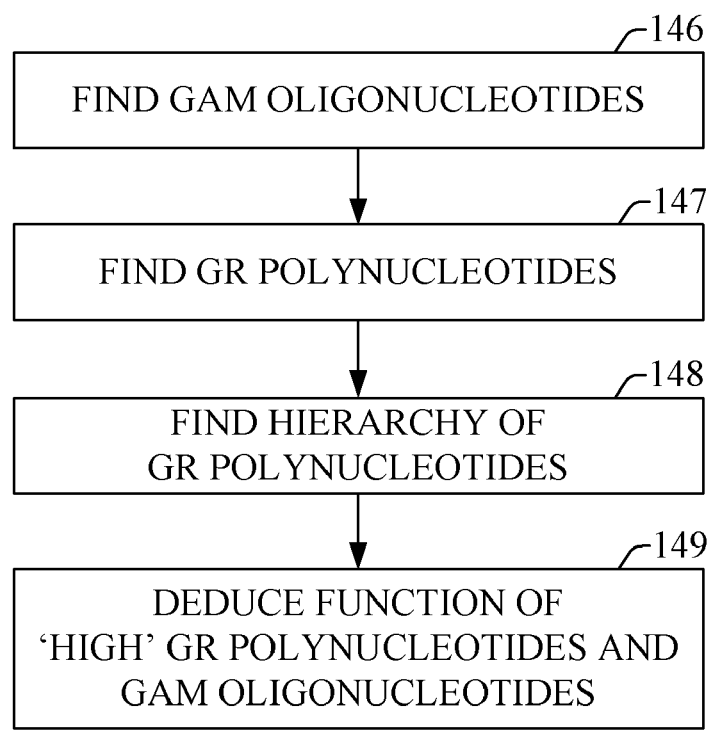
FIG. 18 is a block diagram illustrating an overview of a methodology for finding novel oligonucleotides and novel operon-like polynucleotides of the present invention, and their respective functions.

Reference is now made to FIG. 18 which is a block diagram illustrating an overview of a methodology for finding novel oligonucleotides and operon-like polynucleotides of the present invention, and their respective functions. According to a preferred embodiment of the present invention, the methodology to finding novel oligonucleotides of the present invention and their function comprises of the following major steps: First, FIND GAM OLIGONUCLEOTIDES 146 is used to detect, oligonucleotide of the novel group of oligonucleotide of the present invention, referred to here as GAM oligonucleotide. GAM oligonucleotides are located and their function elicited by detecting target proteins they bind and the function of those target proteins, as described hereinabove with reference to FIGS. 9-15. Next, FIND GR POLYNUCLEOTIDES 147 is used to detect polynucleotide of a novel group of operon-like polynucleotide of the present invention, referred to here as GR polynucleotide. GR polynucleotides are located, by locating clusters of proximally located GAM oligonucleotide, based on the previous step. Consequently, FIND HIERARCHY OF GR POLYNUCLEOTIDES 148 elicits the hierarchy of GR and GAM: binding sites for non-protein-binding GAM oligonucleotide comprised in each GR polynucleotide found are sought adjacent to other GR polynucleotides. When found, such a binding site indicates that the connection between the GAM and the GR the expression of which it modulates, and thus the hierarchy of the GR polynucleotides and the GAM oligonucleotides they comprise. Lastly, DEDUCE FUNCTION OF HIGH GR POLYNUCLEOTIDES AND GAM OLIGONUCLEOTIDES 149 is used to deduce the function of GR polynucleotides and GAM oligonucleotides which are 'high' in the hierarchy, i.e. GAM oligonucleotides which modulate expression of other GR polynucleotides rather than directly modulating expression of target proteins. A preferred approach is as follows: The function of protein-modulating GAM oligonucleotides is deducible from the proteins which they modulate, provided that the function of these target proteins is known. The function of higher GAM oligonucleotides may be deduced by comparing the function of protein-modulating GAM oligonucleotides with the hierarchical relationships by which the higher GAM oligonucleotides are connected to the protein-modulating GAM oligonucleotides. For example, given a group of several protein-modulating GAM oligonucleotides which collectively cause a protein expression pattern typical of a certain cell-type, then a 'higher' GAM oligonucleotide is sought which modulates expression of GR polynucleotides which perhaps modulate expression of other GR polynucleotides which eventually modulate expression of the given group of protein-modulating GAM oligonucleotide. The 'higher' GAM oligonucleotide found in this manner is taken to be responsible for differentiation of that cell-type, as per the conceptual model of the invention described hereinabove with reference to FIG. 6.

Figure 19:
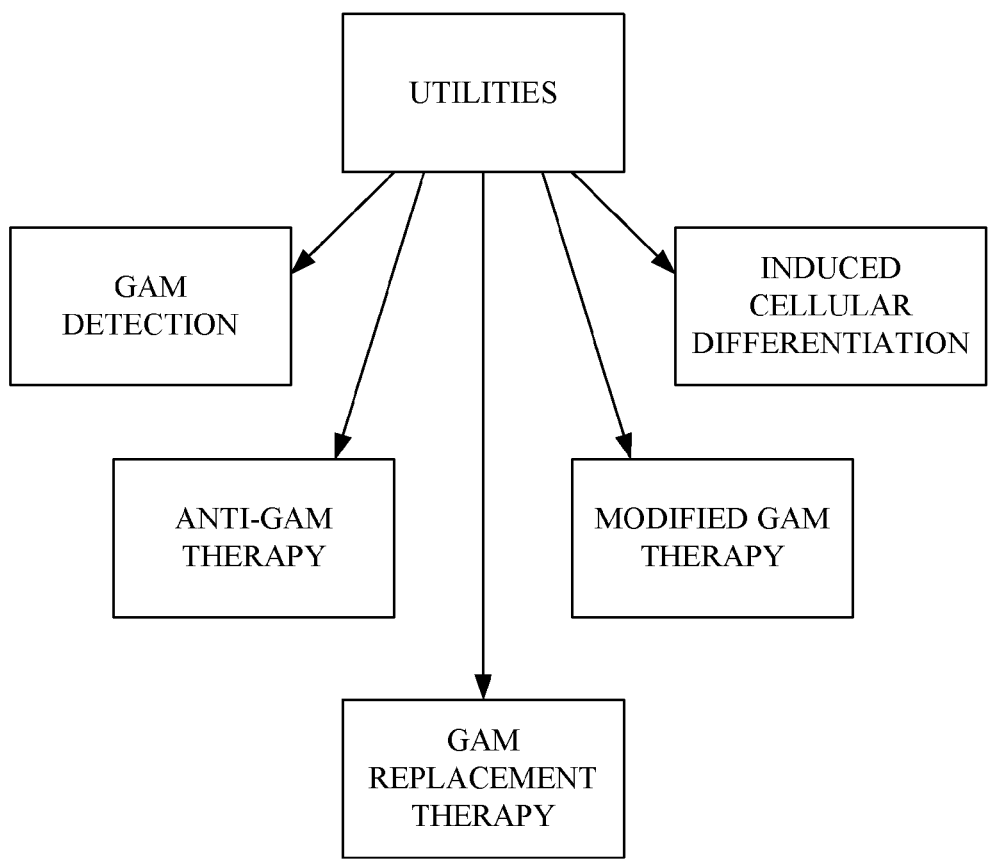
FIG. 19 is a block diagram illustrating different utilities of novel oligonucleotides and novel operon-like polynucleotides, both of the present invention.

Reference is now made to FIG. 19 which is a block diagram illustrating different utilities of oligonucleotide of the novel group of oligonucleotides of the present invention referred to here as GAM oligonucleotides and GR polynucleotides. The present invention discloses a first plurality of novel oligonucleotides referred to here as GAM oligonucleotides and a second plurality of operon-like polynucleotides referred to here as GR polynucleotides each of the GR polynucleotide encoding a plurality of GAM oligonucleotides The present invention further discloses a very large number of known target genes, which are bound by, and the expression of which is modulated by each of the novel oligonucleotides of the present invention. Published scientific data referenced by the present invention provides specific, substantial, and credible evidence that the above mentioned target genes modulated by novel oligonucleotides of the present invention, are associated with various diseases. Specific novel oligonucleotides of the present invention, target genes thereof and diseases associated therewith, are described hereinbelow with reference to Tables 1 through 11. It is therefore appreciated that a function of GAM oligonucleotides and GR polynucleotides of the present invention is modulation of expression of target genes related to known diseases, and that therefore utilities of novel oligonucleotides of the present invention include diagnosis and treatment of the above mentioned diseases. FIG. 19 describes various types of diagnostic and therapeutic utilities of novel oligonucleotides of the present invention. A utility of novel oligonucleotides of the present invention is detection of GAM oligonucleotides and of GR polynucleotides. It is appreciated that since GAM oligonucleotides and polynucleotides modulate expression of disease related target genes, that detection of expression of GAM oligonucleotides in clinical scenarios associated with said diseases is a specific, substantial and credible utility. Diagnosis of novel oligonucleotides of the present invention may preferably be implemented by RNA expression detection techniques, including but not limited to biochips, as is well known in the art. Diagnosis of expression of oligonucleotides of the present invention may be useful for research purposes, in order to further understand the connection between the novel oligonucleotides of the present invention and the above mentioned related diseases, for disease diagnosis and prevention purposes, and for monitoring disease progress. Another utility of novel oligonucleotides of the present invention is anti-GAM therapy, a mode of therapy which allows up regulation of a disease related target gene of a novel GAM oligonucleotide of the present invention, by lowering levels of the novel GAM oligonucleotide which naturally inhibits expression of that target gene. This mode of therapy is particularly useful with respect to target genes which have been shown to be under-expressed in association with a specific disease. Anti-GAM therapy is further discussed hereinbelow with reference to FIGS. 20A and 20B. A further utility of novel oligonucleotides of the present invention is GAM replacement therapy, a mode of therapy which achieves down regulation of a disease related target gene of a novel GAM oligonucleotide of the present invention, by raising levels of the GAM which naturally inhibits expression of that target gene. This mode of therapy is particularly useful with respect to target genes which have been shown to be over-expressed in association with a specific disease. GAM replacement therapy involves introduction of supplementary GAM products into a cell, or stimulation of a cell to produce excess GAM products. GAM replacement therapy may preferably be achieved by transfecting cells with an artificial DNA molecule encoding a GAM which causes the cells to produce the GAM product, as is well known in the art. Yet a further utility of novel oligonucleotides of the present invention is modified GAM therapy. Disease conditions are likely to exist, in which a mutation in a binding site of a GAM RNA prevents natural GAM RNA to effectively bind inhibit a disease related target gene, causing up regulation of that target gene, and thereby contributing to the disease pathology. In such conditions, a modified GAM oligonucleotides is designed which effectively binds the mutated GAM binding site, i.e. is an effective anti-sense of the mutated GAM binding site, and is introduced in disease effected cells. Modified GAM therapy is preferably achieved by transfecting cells with an artificial DNA molecule encoding the modified GAM which causes the cells to produce the modified GAM product, as is well known in the art. An additional utility of novel GAM of the present invention is induced cellular differentiation therapy. As aspect of the present invention is finding oligonucleotides which determine cellular differentiation, as described hereinabove with reference to FIG. 18. Induced cellular differentiation therapy comprises transfection of cell with such GAM oligonucleotides thereby determining their differentiation as desired. It is appreciated that this approach may be widely applicable, inter alia as a means for auto transplantation harvesting cells of one cell-type from a patient, modifying their differentiation as desired, and then transplanting them back into the patient. It is further appreciated that this approach may also be utilized to modify cell differentiation in vivo, by transfecting cells in a genetically diseased tissue with a cell-differentiation determining GAM thus stimulating these cells to differentiate appropriately.

Reference is now made to FIGS. 20A and 20B, simplified diagrams which when taken together illustrate anti-GAM therapy mentioned hereinabove with reference to FIG. 19. A utility of novel GAMs of the present invention is anti-GAM therapy, a mode of therapy which allows up regulation of a disease related target gene of a novel GAM of the present invention, by lowering levels of the novel GAM which naturally inhibits expression of that target gene. FIG. 20A shows a normal GAM inhibiting translation of a target gene of GAM RNA by binding to a BINDING SITE found in an untranslated region of GAM TARGET RNA, as described hereinabove with reference to FIG. 8.

FIG. 20B shows an example of anti-GAM therapy. ANTI-GAM RNA is short artificial RNA molecule the sequence of which is an anti-sense of GAM RNA. Anti-GAM treatment comprises transfecting diseased cells with ANTI-GAM RNA, or with a DNA encoding thereof. The ANTI-GAM RNA binds the natural GAM RNA, thereby preventing binding of natural GAM RNA to its BINDING SITE. This prevents natural translation inhibition of GAM TARGET RNA by GAM RNA, thereby up regulating expression of GAM TARGET PROTEIN.

It is appreciated that anti-GAM therapy is particularly useful with respect to target genes which have been shown to be under-expressed in association with a specific disease. Furthermore, anti-GAM therapy is particularly useful, since it may be used in situations in which technologies known in the art as RNAi and siRNA can not be utilized. As in known in the art, RNAi and siRNA are technologies which offer means for artificially inhibiting expression of a target protein, by artificially designed short RNA segments which bind complementarily to mRNA of said target protein. However, RNAi and siRNA can not be used to directly up regulate translation of target proteins.

Figure 21A:
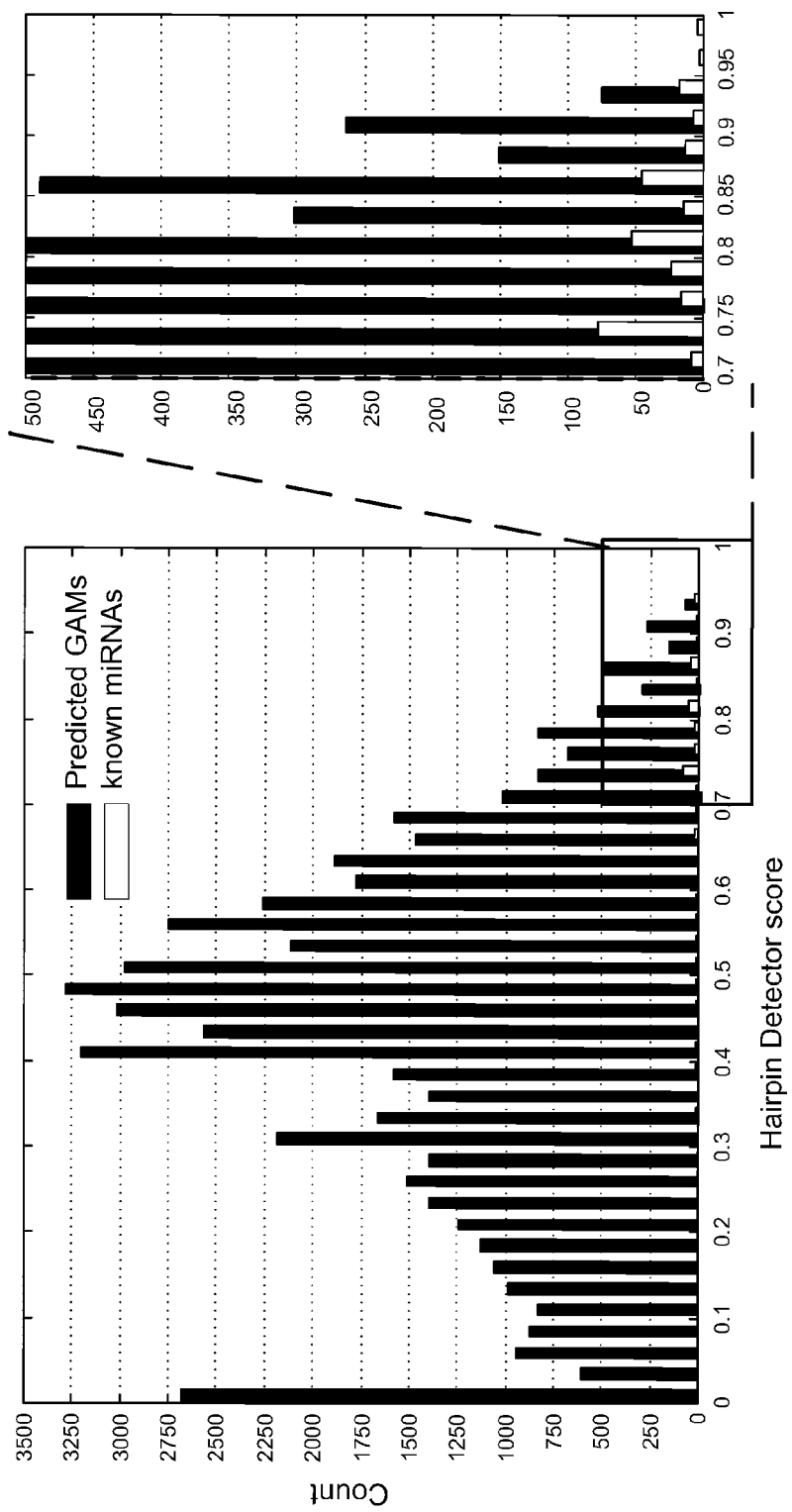
FIG. 21A is a histogram representing the distribution of known miRNA oligonucleotides, and that of miRNA-like hairpin-shaped oligonucleotides, predicted by the bioinformatics detection engine of the present invention, extracted from expressed genome sequences with respect to their hairpin detector score.

Reference is now made to FIG. 21A, which is a histogram representing the distribution of known miRNA oligonucleotides and that of hairpin structures extracted from expressed genome sequences with respect to their HAIRPIN DETECTOR score. The known miRNA oligonucleotides set is taken from RFAM database, Release2.1 and include 440 miRNA oligonucleotides from *H. sapienas, M. musculus, C. elegans, C. brigassae* and *D. melanogaster*. Folding of expressed genome sequences taken from public databases of ESTs (Unigene-NCBI and TIGR) identified 342,882 hairpin structures. ~154,000 out of the 342,882 hairpin structures did not pass the filter of being identified as hairpins in several secondary structure folding versions of the given genomic sequence, as described hereinabove with reference to FIG. 12B, and hence did not receive a Hairpin detector score. Furthermore, ~133,000 hairpin structures did not pass the filter of minimum score of the DICER-CUT LOCATION DETECTOR 116 (FIG. 9) (those ~287,000 hairpin structures are not represented in the histogram). Hairpin structures are considered as miRNA-like precursor oligonucleotides here referred to as GAM oligonucleotide, if their Hairpin detector score is above 0.3. Thus, the GAM oligonucleotides set is comprised of 40,000 hairpin structures, of those ~5100 received a high Hairpin detector score (>=0.7). These are much higher numbers than those of the known miRNA oligonucleotides and of the upper bound of ~255 human miRNA oligonucleotides, estimated by Bartel et al (Science, 299, 1540, March 2003). Of the reference set that pass the above filter (408/440), 284 (69%) received a high Hairpin detector score (>=0.7).

Reference is now made to FIG. 21B, which is a table summarizing laboratory validation results that validate efficacy of the BIOINFORMATIC OLIGONUCLEOTIDE DETECTION ENGINE 100 (FIG. 9). In order to assess efficacy of the BIOINFORMATIC OLIGONUCLEOTIDE DETECTION ENGINE 100, novel oligonucleotides predicted thereby are preferably divided into 4 detection accuracy groups (first column), designated A through D, ranking GAMS from the most probable GAMs to the least probable GAMs, using the scores of HAIRPIN DETECTOR 114 (FIG. 9) and DICER-CUT LOCATION DETECTOR 116 (FIG. 9) as follows:

Group A: The score of the HAIRPIN-DETECTOR is above 0.7, the overall score of the two-phased predictor is above 0.55, and the score of the second phase of the two-phased predictor is above 0.75, or the score of the EDIT-DISTANCE predictor is equal or above 17. In this group, one Dicer cut location is predicted for each hairpin. Group B: The score of the HAIRPIN-DETECTOR is above 0.5, the overall score of the two-phased predictor is above 0.55, and the hairpin is not in group A. Group C: The score of the HAIRPIN-DETECTOR is between 0.4 and 0.5, and the overall score of the two-phased predictor is above 0.55. Group D: The score of the HAIRPIN-DETECTOR is between 0.3 and 0.4, and the overall score of the two-phased predictor is above 0.55. In groups B, C and D, if the score of the second phase of the two-phased predictor is above 0.75, one Dicer cut location is predicted for each hairpin, otherwise both sides of the double stranded window are given as output, and are examined in the lab or used for binding site search. The groups are mutually exclusive, i.e. in groups A, C and D all hairpins score less than 17 in the EDIT-DISTANCE predictor.

It is appreciated that the division into groups is not exhaustive: 410 of the 440 published hairpins (second column), and 1891 of the 2147 novel GAMs, belong to one of the groups. An indication of the real performance of the two-phased predictor in the presence of background hairpins is given by the column 'precision on hairpin mixture' (third column). The precision on hairpin mixture is computed by mixing the published miRNA hairpins with background hairpins in a ratio of 1:4 and taking as a working assumption that they are hairpins not carrying a 'diced' miRNA.-like oligonucleotide This is a strict assumption, since some of these background hairpins may indeed contain 'diced' miRNAs-like oligonucleotide, while in this column they are all counted as failures Sample novel bioinformatically predicted human GAMs of each of these groups are sent to the laboratory for validation (fourth column), and the number (fifth column) and percent (sixth column) of successful validation of predicted human GAM is noted for each of the groups, as well as overall (bottom line). The number of novel VAM genes explicitly specified by present invention belonging to each of the four groups is noted (seventh column).

It is appreciated that the present invention comprises 1891 novel GAM oligonucleotides, which fall into one of these four detection accuracy groups, and that the BIOINFORMATIC OLIGONUCLEOTIDE DETECTION ENGINE 100 (FIG. 9) is substantiated by a group of 52 novel human GAM oligonucleotides validated by laboratory means, out of 168 human GAM oligonucleotides which were tested in the lab, resulting in validation of an overall 31% accuracy. The top group demonstrated 37% accuracy. Pictures of test-results of specific human GAM oligonucleotides in the abovementioned four groups, as well as the methodology used for validating the expression of predicted oligonucleotides are elaborated hereinbelow with reference to FIG. 22.

It is further appreciated that failure to detect a predicted GAM oligonucleotide in the lab does not necessarily indicate a mistaken bioinformatic prediction. Rather, it may be due to technical sensitivity limitation of the lab test, or because the GAM oligonucleotides not expressed in the tissue examined, or at the development phase tested.

It is still further appreciated that in general these findings are in agreement with the expected bioinformatic accuracy, as describe hereinabove with reference to FIG. 13B: assuming 80% accuracy of the HAIRPIN DETECTOR 114 and 80% accuracy of the DICER-CUT LOCATION DETECTOR 116 and 80% accuracy of the lab validation, this would result in 50% overall accuracy of the GAM oligonucleotide validated in the lab.

Figure 22A:

Reference is now made to FIG. 22A which is a picture of laboratory results validating the expression of 43 novel genes detected by the BIOINFORMATIC OLIGONUCLEOTIDE DETECTION ENGINE 100 (FIG. 9).

Reference is now made to FIG. 22A and FIG. 22B which are pictures and a summary table of laboratory results validating the expression of 43 novel human GAM oligonucleotides detected by the BIOINFORMATIC OLIGONUCLEOTIDE DETECTION ENGINE 100. In each row in FIG. 22A, pictures of several oligonucleotides validated by hybridization of Polymerase Chain Reaction (PCR)-product southern-blots, are provided, each corresponding to a specific GAM oligonucleotides, as elaborated hereinbelow. To test our validation method, we used a reference set of 8 known human miRNA oligonucleotides, as blind test to our laboratory. These PCR-product hybridization pictures are designated 1 through 8 for the reference set known miRNA oligonucleotides; and 9 through 51 for predicted GAM oligonucleotides.

In each PCR hybridization picture, 2 lanes are seen: the test lane, designated "+" and the control lane, designated "−". For convenience of viewing the results, all PCR-product hybridization pictures of FIG. 22A have been shrunk ×4 vertically. It is appreciated that for each of the tested GAM oligonucleotides a clear hybridization band appears in the test ("+") lane, but not in the control ("−") lane.

Specifically, FIG. 22A shows pictures of PCR-product hybridization validation by southern-blot, the methodology of which is described hereinbelow, to the following novel human GAM oligonucleotides (RosettaGenomics Ltd. Nomenclature, 'A' and 'B' referred to the Dicer Cut Location as described hereinabove with reference to the description of large tables:

(1) hsa-MIR-21; (2) hsa-MIR-27b; (3) hsa-MIR-186; (4) hsa-MIR-93; (5) hsa-MIR-26a; (6) hsa-MIR-191; (7) hsa-MIR-31; (8) hsa-MIR-92; (9) GAM3418-A (later published by other researchers as hsa-MIR23); (10) GAM4426-A; (11) GAM281-A; (12) GAM7553-A; (13) GAM5385-A; (14) GAM2608-A; (15) GAM1032-A; (16) GAM3431-A; (17) GAM7933-A; (18) GAM3298-A.; (19) GAM7080-A; (20) GAM895-A.; (21) GAM3770.1; (22) GAM337162-A; (23) GAM 8678-A; (24) GAM2033-A; (25) GAM7776-A; (26) GAM8145-A; (27) GAM25-A; (28) GAM7352.1; (29) GAM337624-A; (30) GAM1479-A; (31) GAM2270-A; (32) GAM7591-A; (33) GAM8285-A; (34) GAM6773-A; (35) GAM336818-A; (36) GAM336487-A; (37) GAM337620-A; (38) GAM336809-A; (39) GAM5346-A; (40) GAM8554-A; (41) GAM2071-A; (42) GAM7957-A; (43) GAM391-A; (44) GAM6633-A; (45) GAM19; (46) GAM8358-A; (47) GAM3229-A; an) GAM 7052-A; (49) GAM3027-A; (50) GAM21 and (51) GAM oligonucleotide similar to mmu-MIR-30e.

The next validated GAM oligonucleotides are highly similar or highly identical to known mouse-miRNA oligonucleotides: GAM3027-A, similar to mmu-MIR-29c; GAM21, similar to mmu-MIR-130b; and GAM oligonucleotide which is highly similar to mmu-MIR-30e (picture number 51). In addition to the PCR-product hybridization detection, the following GAMs were cloned and sequenced: GAM3418-A, GAM5385-A, GAM1032-A, GAM3298-A, GAM7080-A, GAM1338-A, GAM7776-A, GAM25-A, GAM337624-A, GAM1479-A, GAM6773-A, GAM336818-A, GAM336487-A, GAM337620-A, GAM336809-A, GAM3027-A, GAM21, and GAM oligonucleotide similar to mmu-MIR-30e (picture number 51). Furthermore, the following GAM oligonucleotides were sequenced directly from the ligation reaction by the method described hereinbelow under LIGATION-PCR DIAGNOSTIC METHOD: GAM4426-A, GAM7553-A, GAM2270-A, and GAM7591-A.

In order to validate the expression of predicted novel GAM and assuming that these novel GAM oligonucleotides are probably expressed at low concentrations, a PCR product cloning approach was set up through the following strategy: two types of cDNA libraries designated "One tailed" and "Ligation" were prepared from frozen HeLa S100 extract (4c Biotech, Belgium) size fractionated RNA. Essentially, Total S100 RNA was prepared through an SDSProteinase K incubation followed by an acid Phenol-Chloroform purification and Isopropanol precipitation. Alternatively, total HeLa RNA was also used as starting material for these libraries.

Fractionation was done by loading up to 500 g per YM100 Amicon Microcon column (Millipore) followed by a 500 g centrifugation for 40 minutes at 4C. Flow through "YM100"RNA consisting of about of the total RNA was used for library preparation or fractionated further by loading onto a YM30 Amicon Microcon column (Millipore) followed by a 13,500 g centrifugation for 25 minutes at 4C. Flow-through "YM30" was used for library preparation as is and consists of less than 0.5% of total RNA. For the both the "ligation" and the "One-tailed" libraries, RNA was dephosphorylated and ligated to an RNA (lowercase)-DNA (UPPERCASE) hybrid 5"-phosphorylated, 3" idT blocked 3"-adapter (5"-P-uuuAACCGCATCCTTCTC-idT-3" (SEQ ID NO: 142673) Dharmacon # P-002045-01-05) (as elaborated in Elbashir et al., Genes Dev. 15:188-200 (2001)) resulting in ligation only of RNase III type cleavage products. 3"-Ligated RNA was excised and purified from a half 6%, half 13% polyacrylamide gel to remove excess adapter with a Nanosep 0.2M centrifugal device (Pall) according to instructions, and precipitated with glycogen and 3 volumes of Ethanol. Pellet was resuspended in a minimal volume of water.

For the "ligation" library a DNA (UPPERCASE)-RNA (lowercase) hybrid 5"-adapter (5"-TACTAATACGACT-CACTaaa-3" (SEQ ID NO: 142674) Dharmacon # P-002046-01-05) was ligated to the 3"-adapted RNA, reverse transcribed with "EcoRI-RT": (5"-GACTAGCTGGAATTCAAGGATGCGGTTAAA-3") (SEQ ID NO: 142675), PCR amplified with two external primers essentially as in Elbashir et al 2001 except that primers were "EcoRI-RT" and "PstI Fwd" (5"-CAGCCAACGCT-GCAGATA CGACTCACTAAA-3") (SEQ ID NO: 142676). This PCR product was used as a template for a second round of PCR with one hemispecific and one external primer or with two hemispecific primers.

For the "One tailed" library the 3"-Adapted RNA was annealed to 20 pmol primer "EcoRI RT" by heating to 70C and cooling 0.1C/sec to 30C and then reverse transcribed with Superscript II RT (According to instructions, Invitrogen) in a 20 l volume for 10 alternating 5 minute cycles of 37C and 45C. Subsequently, RNA was digested with 1 1 2M NaOH, 2 mM EDTA at 65C for 10 minutes. cDNA was loaded on a polyacrylamide gel, excised and gel-purified from excess primer as above (invisible, judged by primer run alongside)

and resuspended in 13 l of water. Purified cDNA was then oligo-dC tailed with 400 U of recombinant terminal transferase (Roche molecular biochemicals), 1 l 100M dCTP, 1 l 15 mM CoCl2, and 4 l reaction buffer, to a final volume of 20 l for 15 minutes at 37C. Reaction was stopped with 2 l 0.2M EDTA and 15 l 3M NaOAc pH 5.2. Volume was adjusted to 150 l with water, Phenol:Bromochloropropane 10:1 extracted and subsequently precipitated with glycogen and 3 volumes of Ethanol. C-tailed cDNA was used as a template for PCR with the external primers "T3-PstBsg(G/I)18"(5"-AAT-TAACCCTCACTAAAG GCTGCAGGTGCAGGTGGGT-TGGGTTGGGTTGN-3" (SEQ ID NO: 142677) where I stands for Inosine and N for any of the 4 possible deoxynucleotides), and with "EcoRI Nested" (5"-GGAATTCAAGGAT-GCGGTTA-3") (SEQ ID NO: 142678). This PCR product was used as a template for a second round of PCR with one hemispecific and one external primer or with two hemispecific primers.

Hemispecific primers were constructed for each predicted GAM RNA oligonucleotide by an in-house program designed to choose about half of the 5" or 3" sequence of the GAM RNA corresponding to a TM of about 30-34C constrained by an optimized 3" clamp, appended to the cloning adapter sequence (for "One-tailed" libraries 5"-GGN-NGGGNNG (SEQ ID NO: 142679) on the 5" end of the GAM RNA, or TTTAACCGCATC-3" SEQ ID NO: 142680) on the 3" end of the GAM RNA. For "Ligation" libraries the same 3" adapter and 5"-CGACTCACTAAA (SEQ ID NO: 142681) on the 5" end). Consequently, a fully complementary primer of a TM higher than 60C was created covering only one half of the GAM RNA sequence permitting the unbiased elucidation by sequencing of the other half.

CONFIRMATION OF GAM OLIGONUCLEOTIDE SEQUENCE AUTHENTICITY OF PCR PRODUCTS

SOUTHERN BLOT: PCR-product sequences were confirmed by southern blot (Southern E.M., Biotechnology, 1992,24:122-39 (1975)) and hybridization with DNA oligonucleotide probes synthesized against predicted GAM RNAs oligonucleotides. Gels were transferred onto a Biodyne PLUS 0.45 m, (Pall) positively charged nylon membrane and UV cross-linked. Hybridization was performed overnight with DIG-labeled probes at 420C in DIG Easy-Hyb buffer (Roche). Membranes were washed twice with 2×SSC and 0.1% SDS for 10 min. at 420C and then washed twice with 0.5×SSC and 0.1% SDS for 5 min at 420C. The membrane was then developed by using a DIG luminescent detection kit (Roche) using anti-DIG and CSPD reaction, according to the manufacturer's protocol. All probes were prepared according to the manufacturers (Roche Molecular Biochemicals) protocols: Digoxigenin (DIG) labeled antisense transcripts was prepared from purified PCR products using a DIG RNA labeling kit with T3 RNA polymerase. DIG labeled PCR was prepared by using a DIG PCR labeling kit. 3"-DIG-tailed oligo ssDNA antisense probes, containing DIG-dUTP and dATP at an average tail length of 50 nucleotides were prepared from 100 pmole oligonucleotides with the DIG Oligonucleotide Labeling Kit.

CLONE-SEQUENCING: PCR products were inserted into pGEM-T (Promega) or pTZ57 (MBI Fermentas), transformed into competent JM109 E. coli (Promega) and sown on LB-Amp plates with IPTG/Xgal. White and light-blue colonies were transferred to duplicate gridded plates, one of which was blotted onto a membrane (Biodyne Plus, Pall) for hybridization with DIG tailed oligo probes (according to instructions, Roche) corresponding to the expected GAM. Plasmid DNA from positive colonies was sequenced.

LIGATION-PCR DIAGNOSTIC METHOD: To further validate predicted GAM PCR product sequence derived from hemi-primers, a PCR based diagnostic technique was devised to amplify only those products containing also at least two additional nucleotides of the non hemi-primer defined part of the predicted GAM RNA oligonucleotide. In essence, a diagnostic primer was designed so that its 3" end, which is the specificity determining side, was identical to the desired GAM RNA oligonucleotide, 2-10 nucleotides (typically 4-7, chosen for maximum specificity) further into its 3" end than the nucleotide stretch primed by the hemi-primer. The hemi-primer PCR product was first ligated into a T-cloning vector (pTZ57/T or pGEM-T) as described herinabove. The ligation reaction mixture was used as template for the diagnostic PCR under strict annealing conditions with the new diagnostic primer in conjunction with a general plasmid-homologous primer, resulting in a distinct ~200 base-pair product. This PCR product can be directly sequenced, permitting the elucidation of the remaining nucleotides up to the 3" of the mature GAM RNA oligonucleotide adjacent to the 3" adapter. Alternatively, following analysis of the diagnostic PCR reaction on an agarose gel, positive ligation reactions (containing a band of the expected size) were transformed into E. coli. Using this same diagnostic technique and as an alternative to screening by Southern-blot colony-hybridization, transformed bacterial colonies were screened by colony-PCR (Gussow, D. and Clackson, T, Nucleic Acids Res. 17: 4000 (1989)) prior to plasmid purification and sequencing.

Reference is now made to FIG. 22B which is a table summarizing laboratory results which validate the expression of 8 known human miRNA oligonucleotides and 43 novel GAM oligonucleotides detected by the BIOINFORMATIC OLIGONUCLEOTIDE DETECTION ENGINE 100. The table gives additional information on the above GAM oligonucleotides and contains the following fields:: NUMBER: refer to the hybridization picture number of FIG. 22A; NAME: indicate the known MIR name for the reference set or GAM's name as given by RosettaGenomices nomenclature method; SEQUENCE: 5' to 3' sequence of the mature, 'diced' oligonucleotide; SEQUENCED: '+' indicates a validation of the GAM RNA sequence by sequencing procedure as described hereinabove with reference to FIG. 22A.

Figures 23A, 23B, 23C:
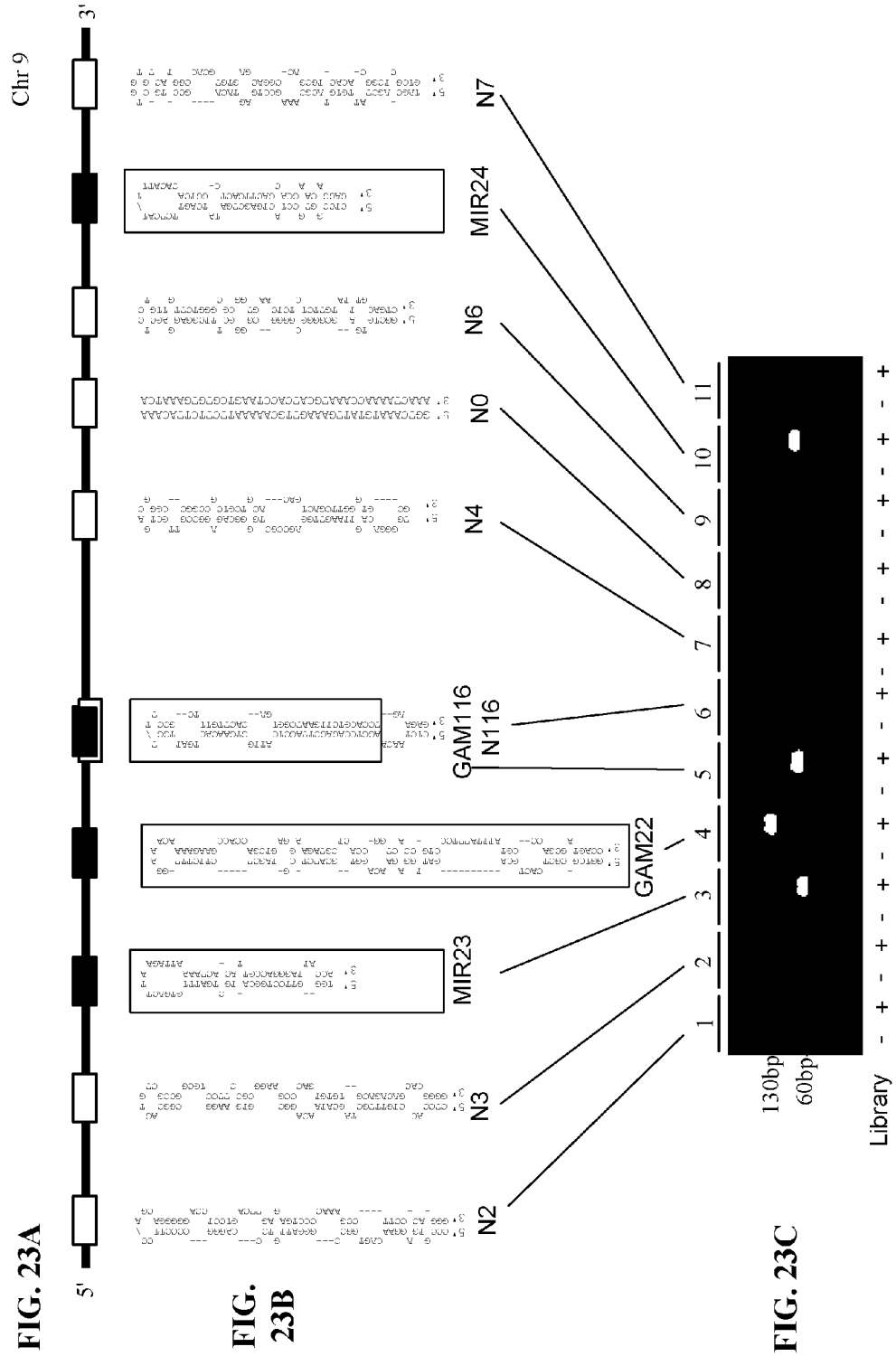
FIG. 23A is a schematic representation of an "operon-like" cluster of novel hairpin sequences detected bioinformatically by a bioinformatic oligonucleotide detection engine constructed and operative in accordance with a preferred embodiment of the present invention, and non-GAM hairpin useful as negative controls thereto.
FIG. 23B is a schematic representation of secondary folding of hairpins of the operon-like cluster of FIG. 23A.
FIG. 23C is a picture of laboratory results demonstrating expression of novel oligonucleotides of FIGS. 23A and 23B, and lack of expression of the negative controls, thereby validating efficacy of bioinformatic detection of GAM oligonucleotides and GR polynucleotides of the present invention, by a bioinformatic oligonucleotide detection engine constructed and operative in accordance with a preferred embodiment of the present invention.

Reference is now made to FIG. 23A, which is a schematic representation of a novel human GR polynucleotide herein designated GR12731 (RosettaGenomics Ltd. nomenclature), located on chromosome 9, comprising 2 known human MIR genes—MIR24 and MIR23, and 2 novel GAM oligonucleotides, herein designated GAM22 and GAM116, all marked by solid black boxes. FIG. 23A also schematically illustrates 6 non-GAM hairpin sequences, and one non-hairpin sequence, all marked by white boxes, and serving as negative controls. By "non-GAM hairpin sequences" is meant sequences of a similar length to known MIR PRECURSOR sequences, which form hairpin secondary folding pattern similar to MIR PRECURSOR hairpins, and yet which are assessed by the BIOINFORMATIC OLIGONUCLEOTIDE DETECTION ENGINE 100 not to be valid GAM PRECURSOR hairpins. It is appreciated that FIG. 23A is a simplified schematic representation, reflecting only the order in which the segments of interest appear relative to one another, and not a proportional distance between the segments.

Reference is now made to FIG. 23B, which is a schematic representation of secondary folding of each of the MIRs and GAMS of GR GR12731 MIR24 (SEQ ID NO: 142697), MIR23 (SEQ ID NO: 142690), GAM22 (SEQ ID NO:

142691) and GAM116 (SEQ ID NO: 142692), and of the negative control non-GAM hairpins, herein designated N2 (SEQ ID NO: 142688), N3 (SEQ ID NO: 142689), N116 (SEQ ID NO: 142693), N4 (SEQ ID NO: 142694), N6 (SEQ ID NO: 142696) and N7 (SEQ ID NO: 142698). N0 (SEQ ID NO: 142695) is a non-hairpin control, of a similar length to that of known MIR PRECURSOR hairpins. It is appreciated that the negative controls are situated adjacent to and in between real MIR genes and GAM predicted oligonucleotide and demonstrates similar secondary folding patterns to that of known MIRs and GAMS.

Reference is now made to FIG. 23C, which is a picture of laboratory results of a PCR test upon a YM100 "ligation"-library, utilizing specific primer sets directly inside the boundaries of the hairpins. Due to the nature of the library the only PCR amplifiable products can result from RNaseIII type enzyme cleaved RNA, as expected for legitimate hairpin precursors presumed to be produced by DROSHA (Lee et al, Nature 425 415-419, 2003). FIG. 23C demonstrates expression of hairpin precursors of known MIR genes—MIRhsa-23 and MIRhsa-24, and of novel bioinformatically detected GAM22 and GAM 116 hairpins predicted bioinformatically by a system constructed and operative in accordance with a preferred embodiment of the present invention. FIG. 23C also shows that none of the 7 controls (6 hairpins designated N2, N3, N23, N4, N6 and N7 and 1 non-hairpin sequence designated N0) were expressed. N116 is a negative control sequence partially overlapping GAM116.

In the picture, test lanes including template are designated "+" and the control lane is designated "−". It is appreciated that for each of the tested hairpins, a clear PCR band appears in the test ("+") lane, but not in the control ("−") lane.

FIGS. 23A through 23C, when taken together validate the efficacy of the bioinformatic oligonucleotide detection engine in: (a) detecting known MIR genes; (b) detecting novel GAM PRECURSOR hairpins which are found adjacent to these MIR genes, and which despite exhaustive prior biological efforts and bioinformatic detection efforts, went undetected; (c) discerning between GAM (or MIR) PRECURSOR hairpins, and non-GAM hairpins.

It is appreciated that the ability to discern GAM-hairpins from non-GAM-hairpins is very significant in detecting GAM oligonucleotide since hairpins in general are highly abundant in the genome. Other MIR prediction programs have not been able to address this challenge successfully.

Reference is now made to FIG. 24A which is an annotated sequence of an EST comprising a novel GAM oligonucleotides detected by the oligonucleotide detection system of the present invention. FIG. 24A shows the nucleotide sequence of a known human non-protein coding EST (Expressed Sequence Tag), identified as EST72223 (SEQ ID NO: 142699). The EST72223 clone obtained from TIGR database (Kirkness and Kerlavage, 1997) was sequenced to yield the above 705 bp transcript with a polyadenyl tail. It is appreciated that the sequence of this EST comprises sequences of one known miRNA oligonucleotide, identified as hsa-MIR98, and of one novel GAM oligonucleotide referred to here as GAM25, detected by the BIOINFORMATIC OLIGONUCLEOTIDE DETECTION ENGINE 100 (FIG. 9) of the present invention.

The sequences of the precursors of the known MIR98 and of the predicted GAM25 are precursor in bold, the sequences of the established miRNA 98 and of the predicted miRNA-like oligonucleotide GAM25 are underlined.

Figures 24C, 24D:
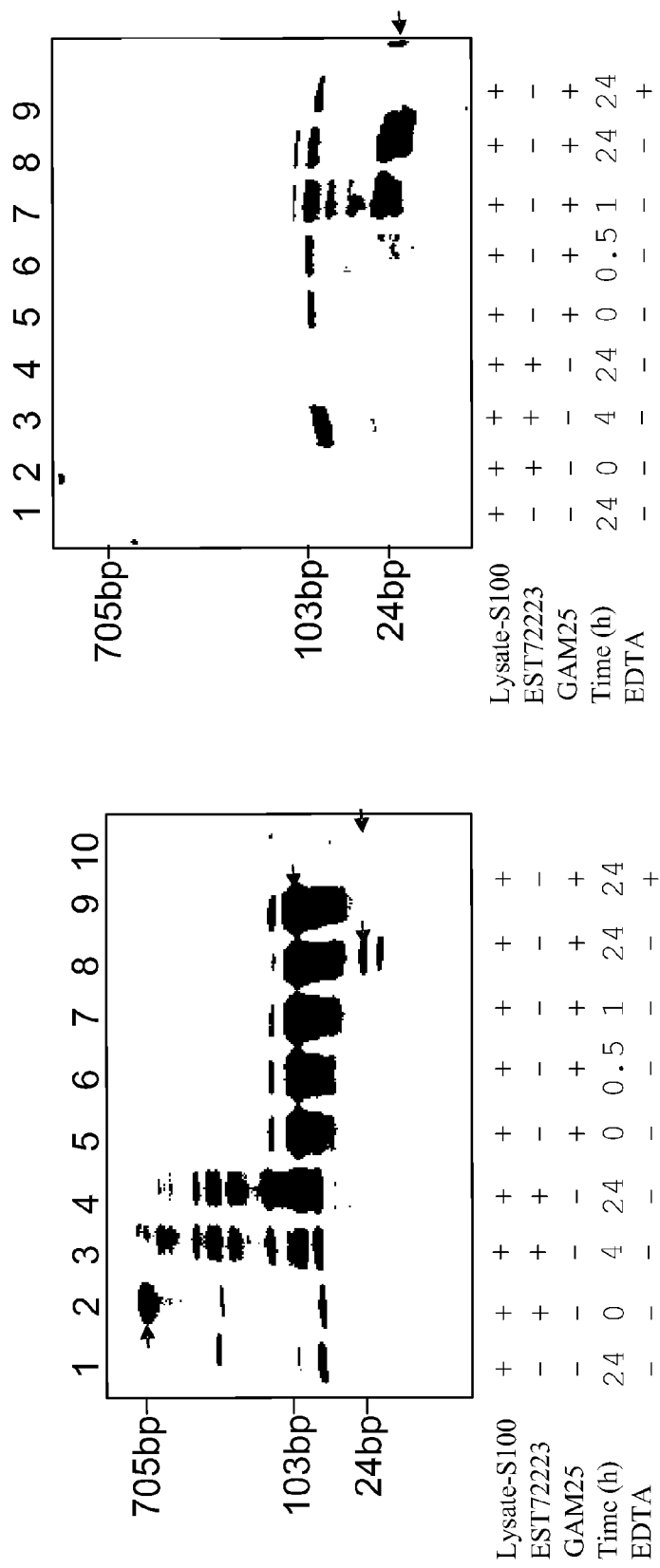

Reference is now made to FIGS. 24B, 24C and 24D that are pictures of laboratory results, which when taken together demonstrate laboratory confirmation of expression of the bioinformatically detected novel oligonucleotide of FIG. 24A. In two parallel experiments, an enzymatically synthesized capped, EST72223 RNA transcript, was incubated with Hela S100 lysate for 0 minutes, 4 hours and 24 hours. RNA was subsequently harvested, run on a denaturing polyacrylamide gel, and reacted with a 102 nt and a 145 nt antisense MIR98 and GAM25 precursor transcript probes respectively. The Northern blot results of these experiments demonstrated processing of EST72223 RNA by Hela lysate (lanes 2-4, in 24B and 24C), into ~80 bp and ~22 bp segments, which reacted with the MIR98 precursor probe (24B), and into ~100 bp and ~24 bp segments, which reacted with the GAM25 precursor probe (24C). These results demonstrate the processing of EST72223 by Hela lysate into MIR98 precursor and GAM25 precursor. It is also appreciated from FIG. 24C (lane 1) that Hela lysate itself reacted with the GAM25 precursor probe, in a number of bands, including a ~100 bp band, indicating that GAM25-precursor is endogenously expressed in Hela cells. The presence of additional bands, higher than 100 bp in lanes 5-9 probably corresponds to the presence of nucleotide sequences in Hela lysate, which contain the GAM25 sequence.

In addition, in order to demonstrate the kinetics and specificity of the processing of MIR98 and GAM25 precursors into their respective mature, 'diced' segments, transcripts of MIR98 and of the bioinformatically predicted GAM25 precursors were similarly incubated with Hela S100 lysate, for 0 minutes, 30 minutes, 1 hour and 24 hours, and for 24 hours with the addition of EDTA, added to inhibit Dicer activity, following which RNA was harvested, run on a polyacrylamide gel and reacted with MIR98 and GAM25 precursor probes. Capped transcripts were prepared for in-vitro RNA cleavage assays with T7 RNA polymerase including a m7G (5')ppp(5')G-capping reaction the Message Machine kit (Ambion). Purified PCR products were used as template for the reaction. These were amplified for each assay with specific primers containing a T7 promoter at the 5" end and a T3 RNA polymerase promoter at the 3" end. Capped RNA transcripts were incubated at 30C in supplemented, dialysis concentrated, Hela S100 cytoplasmic extract (4C Biotech, Seneffe, Belgium). The Hela S100 was supplemented by dialysis to a final concentration of 20 mM Hepes, 100 mM KCl, 2.5 mM MgCl2, 0.5 mM DTT, 20% glycerol and protease inhibitor cocktail tablets (Complete mini Roche Molecular Biochemicals). After addition of all components, final concentrations were 100 mM capped target RNA, 2 mM ATP, 0.2 mM GTP, 500 U/ml RNasin, 25 g/ml creatine kinase, 25 mM creatine phosphate, 2.5 mM DTT and 50% S100 extract. Proteinase K, used to enhance Dicer activity (Zhang et al., EMBO J. 21, 5875-5885 (2002)) was dissolved in 50 mM Tris-HCl pH 8, 5 mM CaCl2, and 50% glycerol, was added to a final concentration of 0.6 mg/ml. Cleavage reactions were stopped by the addition of 8 volumes of proteinase K buffer (200 Mm Tris-Hcl, pH 7.5, 25 m M EDTA, 300 mM NaCl, and 2% SDS) and incubated at 65C for 15 min at different time points (0, 0.5, 1, 4, 24 h) and subjected to phenol/chloroform extraction. Pellets were dissolved in water and kept frozen. Samples were analyzed on a segmented half 6%, half 13% polyacrylamide 1XTBE-7M Urea gel.

The Northern blot results of these experiments demonstrated an accumulation of a ~22 bp segment which reacted with the MIR98 precursor probe, and of a ~24 bp segment which reacted with the GAM25 precursor probe, over time (lanes 5-8). Absence of these segments when incubated with EDTA (lane 9), which is known to inhibit Dicer enzyme (Zhang et al., 2002), supports the notion that the processing of MIR98 and GAM25 precursors into their 'diced' segments is mediated by Dicer enzyme, found in Hela lysate. The molecular sizes of EST72223, MIR-98 and GAM25 and their corresponding precursors are indicated by arrows.

FIG. 24D present Northern blot results of same above experiments with GAM25 probe (24 nt). The results clearly demonstrated the accumulation of mature GAM25 oligonucleotide after 24 h.

To validate the identity of the band shown by the lower arrow in FIGS. 24C and 24D, a RNA band parallel to a marker of 24 base was excised from the gel and cloned as in Elbashir et al (2001) and sequenced. 90 clones corresponded to the sequence of mature GAM25 oligonucleotide, three corresponded to GAM25* (the opposite arm of the hairpin with a 1-3 nucleotide 3" overhang) and two to the hairpin-loop.

GAM25 was also validated endogenously by sequencing from both sides from a HeLa YM100 total-RNA "ligation" libraries, utilizing hemispecific primers as described in FIG. 22.

Taken together, these results validate the presence and processing of a novel MIR-like oligonucleotide, GAM25, which was predicted bioinformatically. The processing of this novel GAM oligonucleotide product, by Hela lysate from EST72223, through its precursor, to its final form was similar to that observed for known miRNA oligonucleotide, MIR98.

Transcript products were 705 nt (EST72223), 102 nt (MIR98 precursor), 125 nt (GAM25 precursor) long. EST72223 was PCR amplified with T7-EST 72223 forward primer: 5"-TAATACGACTCACTATAGGCCCTTATTA-GAGGATTCTGCT-3" (SEQ ID NO: 142682) and T3-EST72223 reverse primer: "-AATTAACCCTCAC-TAAAGGTTTTTTTTTCCTGAGACAGAGT-3" (SEQ ID NO: 142683). MIR98 was PCR amplified using EST72223 as a template with T7MIR98 forward primer: 5-"TAATAC-GACTCACTATAGGGTGAGGTAGTAAGTTGTATTGTT-3" (SEQ ID NO: 142684) and T3MIR98 reverse primer: 5"-AATTAACCCTCACTAAAGGGAAAGTAG-TAAGTTGTATAGTT-3" (SEQ ID NO: 142685). GAM25 was PCR amplified using EST72223 as a template with GAM25 forward primer: 5"-GAGGCAGGAGAATTGCT-TGA-3" (SEQ ID NO: 142686) and T3-EST72223 reverse primer: 5"-AATTAACCCTCACTAAAGGCCTGAGACA-GAGTCTTGCTC-3" (SEQ ID NO: 142687).

It is appreciated that the data presented in FIGS. 24A, 24B, 24C and 24D when taken together validate the function of the bioinformatic oligonucleotide detection engine 100 of FIG. 9. FIG. 24A shows a novel GAM oligonucleotide bioinformatically detected by the BIOINFORMATIC OLIGONUCLE-OTIDE DETECTION ENGINE 100, and FIGS. 24C and 24D show laboratory confirmation of the expression of this novel oligonucleotide. This is in accord with the engine training and validation methodology described hereinabove with reference to FIG. 10.

DETAILED DESCRIPTION OF LARGE TABLES

Table 1 comprises data relating the SEQ ID NO of GAM RNA oligonucleotides of the present invention to their corresponding GAM NAME, and contains the following fields: GAM SEQ-ID: GAM SEQ ID NO, as in the Sequence Listing; GAM NAME: Rosetta Genomics Ltd. nomenclature (see below); GAM RNA SEQUENCE: Sequence (5' to 3') of the mature, 'diced' GAM RNA; GAM POS: Dicer cut location (see below); and Table 2 comprises detailed textual description according to the description of FIG. 8 of each of a plurality of novel GAM oligonucleotide of the present invention, and contains the following fields: GAM NAME: Rosetta Genomics Ltd. nomenclature (see below); PRECUR SEQ-ID:GAM precursor Seq-ID, as in the Sequence Listing; PRECURSOR SEQUENCE: Sequence (5' to 3') of the GAM precursor; GAM DESCRIPTION: Detailed description of GAM oligonucleotide with reference to FIG. 8; and Table 3 comprises data relating to the source and location of novel GAM oligonucleotides of the present invention, and contains the following fields: GAM NAME: Rosetta Genomics Ltd. nomenclature (see below); PRECUR SEQ-ID: GAM precursor SEQ ID NO, as in the Sequence Listing; ORGANISM: Abbreviated (hsa=Homo sapiens); CHR: Chromosome encoding the GAM oligonucleotide; STRAND: Orientation on the chromosome, '+' for the plus strand, '−' for the minus strand; CHR-START OFFSET Start offset of GAM precursor sequence on the chromosome; CHR-END OFFSET: End offset of GAM precursor sequence on the chromosome; SOURCE_REF-ID: Accession number of source sequence; and Table 4 comprises data relating to GAM precursors of novel GAM oligonucleotides of the present invention, and contains the following fields: GAM NAME: Rosetta Genomics Ltd. nomenclature (see below); PRECUR SEQ-ID: GAM precursor Seq-ID, as in the Sequence Listing; PRECURSOR-SEQUENCE: Sequence (5' to 3') of the GAM precursor; GAM FOLDED PRECURSOR RNA: Schematic representation of the GAM folded precursor, beginning 5' end (beginning of upper row) to 3' end (beginning of lower row), where the hairpin loop is positioned at the right part of the draw; and Table 5 comprises data relating to GAM oligonucleotides of the present invention, and contains the following fields: GAM NAME: Rosetta Genomics Ltd. nomenclature (see below); GAM RNA SEQUENCE: Sequence (5' to 3') of the mature, 'diced' GAM RNA; PRECUR SEQ-ID: GAM precursor Seq-ID, as in the Sequence Listing; SOURCE_REF-ID: accession number of the source sequence; GAM POS: Dicer cut location (see below); and Table 6 comprises data relating SEQ ID NO of the GAM target gene binding site sequence to TARGET gene name and target binding site sequence, and contains the following fields: TARGET BINDING SITE SEQ-ID: Target binding site SEQ ID NO, as in the Sequence Listing; TARGET: GAM target gene name; TARGET BINDING SITE SEQUENCE: Nucleotide sequence (5' to 3') of the target binding site; and Table 7 comprises data relating to target genes and binding sites of GAM oligonucleotides of the present invention, and contains the following fields: GAM NAME: Rosetta Genomics Ltd. nomenclature (see below); GAM RNA SEQUENCE: Sequence (5' to 3') of the mature, 'diced' GAM RNA; TARGET: GAM target gene name; TARGET REF-ID: Target accession number (GenBank); UTR: Untranslated region of binding site/s (3' or 5'); TARGET BS-SEQ: Nucleotide sequence (5' to 3') of the target binding site; BINDING-SITE-DRAW: Schematic representation of the binding site, upper row represent 5' to 3' sequence of the GAM RNA, lower row represent 3' to 5' sequence of the target binding site; GAM POS: Dicer cut location (see below); and Table 8 comprises data relating to functions and utilities of novel GAM oligonucleotides of the present invention, and contains the following fields: GAM NAME: Rosetta Genomics Ltd. nomenclature (see below); TARGET: GAM target gene name; GAM RNA SEQUENCE: Sequence (5' to 3') of the mature, 'diced' GAM RNA; GAM FUNCTION: Description of the GAM functions and utilities; GAM POS: Dicer cut location (see below); TAR DIS: Target Disease Relation Group (see below); and Table 9 comprises data of GAM target gene function references—Bibliography and contains the following fields:

GAM NAME: Rosetta Genomics Ltd. nomenclature (see below); GAM RNA SEQUENCE: Sequence (5' to 3') of the mature, 'diced' GAM RNA; TARGET: GAM target gene name; REFERENCES: list of references relating to the target gene; GAM POS: Dicer cut location (see below); and Table 10 comprises data relating to novel GR (Genomic Record) polynucleotides of the present invention, and contains the following fields: GR NAME: Rosetta Genomics Ltd. nomenclature (see below); GR DESCRIPTION: Detailed description of a GR polynucleotide cluster, with reference to FIG. 16; and Table 11 comprises data relating to Diseases that GAM oligonucleotides are predicted to regulate the disease-associated genes. Each row is referred to a specific disease, and list the GAM target genes related to the disease. The first row is a summary of ALL target genes associated in all diseases containing in the present invention. The table contains the following fields: ROW#: index of the row number; DISEASE NAME: name of the disease; TARGET GENES ASSOCIATED WITH DISEASE: list of GAM target genes that are associated with the specified disease; and The following conventions and abbreviations are used in the tables: The nucleotide 'U' is represented as 'T' in the tables, and GAM NAME or GR NAME are names for nucleotide sequences of the present invention given by RosettaGenomics Ltd. nomenclature method. All GAMs/GRs are designated by GAMx/GRx where x is a unique ID.

SOURCE REF-ID: The accession number of expressed sequences on which novel oligonucleotides were detected. The sequences are taken from the following published databases: (1) TIGR—"Tentative Human Consensus" (THC) (2) EST database-UNIGENE, NCBI.

GAM POS is a position of the GAM RNA on the GAM PRECURSOR RNA sequence. This position is the Dicer cut location, 'A' indicates a probable Dicer cut location, 'B' indicates an alternative Dicer cut location.

TAR DIS (Target Disease Relation Group) 'A' indicates if the target gene is known to have a specific causative relation to a specific known disease, based on the OMIM database (Hamosh et al, 2002). It is appreciated that this is a partial classification emphasizing genes which are associated with "single gene" diseases etc. All genes of the present invention ARE associated with various diseases, although not all are in 'A' status.

All genomic sequences of the present invention as well as their chromosomal location and strand orientation are derived from sequences records of NCBI, Build33 database (April, 2003).

It is appreciated by persons skilled in the art that the present invention is not limited by what has been particularly shown and described hereinabove. Rather the scope of the present invention includes both combinations and subcombinations of the various features described hereinabove as well as variations and modifications which would occur to persons skilled in the art upon reading the specifications and which are not in the prior art.

SEQUENCE LISTING (142700 sequences)

SEQ ID NO: 1 - RNA, 22 nt, Human
aaaaugcuuacaggcaguagcc

SEQ ID NO: 2 - RNA, 22 nt, Human
aaagugcucauagugcagguag

SEQ ID NO: 3 - RNA, 22 nt, Human
acaugaucuccucacucuagga

SEQ ID NO: 4 - RNA, 22 nt, Human
acugcacuccagccugggcaac

SEQ ID NO: 5 - RNA, 22 nt, Human
agggcuguggguguggcugugc

SEQ ID NO: 6 - RNA, 22 nt, Human
aucacagaggcuuaagugcuga

SEQ ID NO: 7 - RNA, 22 nt, Human
aucacauugccagugauuaccc

SEQ ID NO: 8 - RNA, 22 nt, Human
cauugcacuccagccugggcaa

SEQ ID NO: 9 - RNA, 22 nt, Human
uaaggugcaucuagugcaguua

SEQ ID NO: 10 - RNA, 22 nt, Human
uaauacugccggguaaugaugg

SEQ ID NO: 11 - RNA, 22 nt, Human
uagcagcacauaaugguuugaa

SEQ ID NO: 12 - RNA, 22 nt, Human
uagguaguuuccuguuguuggg

SEQ ID NO: 13 - RNA, 22 nt, Human
ucaagcucauuccucuaaccuc

SEQ ID NO: 14 - RNA, 22 nt, Human
ucggcagggaacaggaaguagg

SEQ ID NO: 15 - RNA, 22 nt, Human
uucagagugguuaagaucaugg

SEQ ID NO: 16 - RNA, 22 nt, Human
uuccucugccacgucuuucccu

SEQ ID NO: 17 - RNA, 22 nt, Human
uuuccacagcggccaauucuuc

SEQ ID NO: 18 - RNA, 22 nt, Human
aaggcacuugcccagagcugca

SEQ ID NO: 19 - RNA, 23 nt, Human
aaucaucauuauuuugaaguuua

SEQ ID NO: 20 - RNA, 22 nt, Human
aauugcuugaacccaggaagug

SEQ ID NO: 21 - RNA, 22 nt, Human
aguagacaguggcaacauaguc

SEQ ID NO: 22 - RNA, 22 nt, Human
agugggauggagucagcagaag

SEQ ID NO: 23 - RNA, 22 nt, Human
cacugcacuccagccugggcaa

SEQ ID NO: 24 - RNA, 22 nt, Human
cuagacugaagcuccuugagga

SEQ ID NO: 25 - RNA, 22 nt, Human
cuagccuguuuguccucacccc

SEQ ID NO: 26 - RNA, 22 nt, Human
gaaggcaguagguuguauaguu

SEQ ID NO: 27 - RNA, 22 nt, Human
gaaguuugaagccuguuguuca

SEQ ID NO: 28 - RNA, 22 nt, Human
guguuccaggaagucgucuuga

SEQ ID NO: 29 - RNA, 17 nt, Human
uaaggcauuuuuauggu

SEQ ID NO: 30 - RNA, 22 nt, Human
ucacagugaaccggucucuuuc

SEQ ID NO: 31 - RNA, 22 nt, Human
ucacugcaaccucugcugccug

SEQ ID NO: 32 - RNA, 22 nt, Human
ucuaagagaaaggaaguucaga

SEQ ID NO: 33 - RNA, 22 nt, Human
ucuugugaaaucuguggacccu

SEQ ID NO: 34 - RNA, 20 nt, Human
ugaggugggaucccgaggcc

SEQ ID NO: 35 - RNA, 17 nt, Human
uggcuagguaagggaag

SEQ ID NO: 36 - RNA, 22 nt, Human
uuggaguaauucaguauagguu

SEQ ID NO: 37 - RNA, 22 nt, Human
aaaagcuagaaggagacugggu

SEQ ID NO: 38 - RNA, 22 nt, Human
aaaagugccugcugcugcuucu

SEQ ID NO: 39 - RNA, 22 nt, Human
aaacuuuuggcuguggggaccc

SEQ ID NO: 40 - RNA, 22 nt, Human
aaagagguucugauucuggccu

SEQ ID NO: 41 - RNA, 22 nt, Human
aaaguggcuggaguggagucuu

SEQ ID NO: 42 - RNA, 22 nt, Human
aaaguguguuaucuagguaguc

SEQ ID NO: 43 - RNA, 22 nt, Human
aaauccagaaucuagacugaau

SEQ ID NO: 44 - RNA, 22 nt, Human
aacacagucaugcguugcuuaa

SEQ ID NO: 45 - RNA, 22 nt, Human
aacccuggaggcagagguugcg

SEQ ID NO: 46 - RNA, 22 nt, Human
aaccugcugguaaagcacuggc

SEQ ID NO: 47 - RNA, 22 nt, Human
aacugcuuuuguugugcaggga

SEQ ID NO: 48 - RNA, 22 nt, Human
aagaaugugcccucaccaaagg

SEQ ID NO: 49 - RNA, 22 nt, Human
aagacacauaagcaaaagucua

SEQ ID NO: 50 - RNA, 22 nt, Human
aagagaucuuaggucucuucgu

SEQ ID NO: 51 - RNA, 22 nt, Human
aagagcugaguaauugggggca

SEQ ID NO: 52 - RNA, 22 nt, Human
aagagguaguguaaggaauugu

SEQ ID NO: 53 - RNA, 22 nt, Human
aagcagaacuguuuuguuuucu

SEQ ID NO: 54 - RNA, 22 nt, Human
aagcagccuuggaccaggaggg

SEQ ID NO: 55 - RNA, 22 nt, Human
aagcgcaugucaagagcuuuuu

SEQ ID NO: 56 - RNA, 22 nt, Human
aagcugccauugaagaucuggg

SEQ ID NO: 57 - RNA, 22 nt, Human
aaggcuguguaggcagaauucu

SEQ ID NO: 58 - RNA, 22 nt, Human
aaggugaaugaccuuguugggg

SEQ ID NO: 59 - RNA, 22 nt, Human
aagucaccugaaaacucaacua

SEQ ID NO: 60 - RNA, 22 nt, Human
aagugcugggauuacaggccug

SEQ ID NO: 61 - RNA, 22 nt, Human
aagugcugguauuacaagugug

SEQ ID NO: 62 - RNA, 22 nt, Human
aaguggcuuuugucuggcagau

SEQ ID NO: 63 - RNA, 22 nt, Human
aauacagugucaaugacugaau

SEQ ID NO: 64 - RNA, 22 nt, Human
aauaucuuucuuaggggacugu

SEQ ID NO: 65 - RNA, 22 nt, Human
aaucacaguuuggguuccugcu

SEQ ID NO: 66 - RNA, 22 nt, Human
aaucacuggcuccucacggcaa

SEQ ID NO: 67 - RNA, 22 nt, Human
aaucccagcuacucgggaggcu

SEQ ID NO: 68 - RNA, 22 nt, Human
aaugcugugccagagcugcacc

SEQ ID NO: 69 - RNA, 22 nt, Human
aauggcagucccuggagcagga

SEQ ID NO: 70 - RNA, 22 nt, Human
aaugugaauguuguaugcagug

SEQ ID NO: 71 - RNA, 22 nt, Human
aaugugugggagaacagucuuu

SEQ ID NO: 72 - RNA, 22 nt, Human
aauuuagaaucguuucugauag

SEQ ID NO: 73 - RNA, 22 nt, Human
acaaaaaauacgaaaauuagcu

SEQ ID NO: 74 - RNA, 22 nt, Human
acacaauugcagggagagccau

SEQ ID NO: 75 - RNA, 22 nt, Human
acacaggcccagagaggcagug

SEQ ID NO: 76 - RNA, 22 nt, Human
acacaucuaauggcugugcuga

SEQ ID NO: 77 - RNA, 22 nt, Human
acagcucacuacagccuggauu

SEQ ID NO: 78 - RNA, 22 nt, Human
acagggcuaaggauguuugcug

SEQ ID NO: 79 - RNA, 22 nt, Human
acaguacuccuggcagcccugc

SEQ ID NO: 80 - RNA, 22 nt, Human
acaguccucuacuccagcuccc

SEQ ID NO: 81 - RNA, 22 nt, Human
acauuuccaauguuuggggaca

SEQ ID NO: 82 - RNA, 22 nt, Human
accacagugucacagaguccau

SEQ ID NO: 83 - RNA, 22 nt, Human
accagcugcauccugcaaacuu

SEQ ID NO: 84 - RNA, 22 nt, Human
accagcugugugaacuuaggaa

SEQ ID NO: 85 - RNA, 22 nt, Human
accaucuucccuuucucgagua

SEQ ID NO: 86 - RNA, 22 nt, Human
acccgagagguggagguugcag

SEQ ID NO: 87 - RNA, 22 nt, Human
acccuguuuacagggagguuac

SEQ ID NO: 88 - RNA, 22 nt, Human
acccuugagacucagggcagug

SEQ ID NO: 89 - RNA, 22 nt, Human
accuucuugccaauauaggaau

SEQ ID NO: 90 - RNA, 22 nt, Human
acucuguaauucugaagcaccu

SEQ ID NO: 91 - RNA, 22 nt, Human
acugcacuccaaccaggcugac

SEQ ID NO: 92 - RNA, 22 nt, Human
acugcacuccagccuggcgaca

SEQ ID NO: 93 - RNA, 22 nt, Human
acugcacuccagccugggugac

SEQ ID NO: 94 - RNA, 22 nt, Human
acugcacuccagccugggugau

SEQ ID NO: 95 - RNA, 22 nt, Human
acugcacuccagucuaggugac

SEQ ID NO: 96 - RNA, 22 nt, Human
acugcacuccagucugggugac

SEQ ID NO: 97 - RNA, 22 nt, Human
acugcacuccauccugagugac

SEQ ID NO: 98 - RNA, 22 nt, Human
acugcacuccugccuaggugac

SEQ ID NO: 99 - RNA, 22 nt, Human
acugcacuccugccugggugac

SEQ ID NO: 100 - RNA, 22 nt, Human
acugcacucuagccuaggugau

SEQ ID NO: 101 - RNA, 22 nt, Human
acugcacucuagccugggcaac

SEQ ID NO: 102 - RNA, 22 nt, Human
acugcacuucagccugggcaau

SEQ ID NO: 103 - RNA, 22 nt, Human
acugcagcuucagggacuugug

SEQ ID NO: 104 - RNA, 22 nt, Human
acuggaguuuguucaagaaaua

SEQ ID NO: 105 - RNA, 22 nt, Human
acuggcacagacaucugucaag

SEQ ID NO: 106 - RNA, 22 nt, Human
acuguacuccagccuaggcaac

SEQ ID NO: 107 - RNA, 22 nt, Human
acuguacuccagccugggcaac

SEQ ID NO: 108 - RNA, 22 nt, Human
acuguacuccagccugggugac

SEQ ID NO: 109 - RNA, 22 nt, Human
acuguacuucagccuggguaac

SEQ ID NO: 110 - RNA, 22 nt, Human
agaaccacagcucgaugucccc

SEQ ID NO: 111 - RNA, 22 nt, Human
agaaggcucgcucucucagggg

SEQ ID NO: 112 - RNA, 22 nt, Human
agaagguuggggcuggaggucu

SEQ ID NO: 113 - RNA, 22 nt, Human
agaaguaguaguagcaguagua

SEQ ID NO: 114 - RNA, 22 nt, Human
agaaguguaaauaaguauguau

SEQ ID NO: 115 - RNA, 22 nt, Human
agaaugaaaggcaguuccuagc

SEQ ID NO: 116 - RNA, 22 nt, Human
agacauuuggagccaacuuucc

SEQ ID NO: 117 - RNA, 22 nt, Human
agacuguuccgucagacucagu

SEQ ID NO: 118 - RNA, 22 nt, Human
agagacacagacacaugggaga

SEQ ID NO: 119 - RNA, 22 nt, Human
agagagaguagaagcaugcaag

SEQ ID NO: 120 - RNA, 22 nt, Human
agaggcacagauuaauggaguu

SEQ ID NO: 121 - RNA, 22 nt, Human
agaggcagagguuacaguagug

SEQ ID NO: 122 - RNA, 22 nt, Human
agauggaguugcaggugguccu

SEQ ID NO: 123 - RNA, 22 nt, Human
agauggugauaaaugugguacc

SEQ ID NO: 124 - RNA, 22 nt, Human
agauugcucaugauucuagccu

SEQ ID NO: 125 - RNA, 22 nt, Human
agcaagaugguagcauuggaga

SEQ ID NO: 126 - RNA, 22 nt, Human
agcaccacaacagggacugggc

SEQ ID NO: 127 - RNA, 22 nt, Human
agcagagccaccaaauuuagug

SEQ ID NO: 128 - RNA, 22 nt, Human
agcagguagagauagcguuuua

SEQ ID NO: 129 - RNA, 22 nt, Human
agcggagaccugagcuaugagu

SEQ ID NO: 130 - RNA, 22 nt, Human
agcuacauugucugcuggguuu

SEQ ID NO: 131 - RNA, 22 nt, Human
agcuauuuuguggcuucaucaa

SEQ ID NO: 132 - RNA, 22 nt, Human
agcuccaggagcuggcaggagg

SEQ ID NO: 133 - RNA, 22 nt, Human
agcugagaaagcgaagaggugg

SEQ ID NO: 134 - RNA, 22 nt, Human
agcugcauucaugagguagcaa

SEQ ID NO: 135 - RNA, 22 nt, Human
agcugccaguugaagaacauuu

SEQ ID NO: 136 - RNA, 22 nt, Human
agcuggccuagcaccaaccuga

SEQ ID NO: 137 - RNA, 22 nt, Human
agcugguguguagcggguaccu

SEQ ID NO: 138 - RNA, 22 nt, Human
aggaauauaauuaaaacuuugc

SEQ ID NO: 139 - RNA, 22 nt, Human
aggagcuugggacuuccaagcc

SEQ ID NO: 140 - RNA, 22 nt, Human
aggcacugugcaggaugauggg

SEQ ID NO: 141 - RNA, 22 nt, Human
aggcagaaaacaauuccaagca

SEQ ID NO: 142 - RNA, 22 nt, Human
aggcaguaagggagaguuuugc

SEQ ID NO: 143 - RNA, 22 nt, Human
aggccugagacucugcauuuau

SEQ ID NO: 144 - RNA, 22 nt, Human
aggcugagugacugggaguuag

SEQ ID NO: 145 - RNA, 22 nt, Human
aggcugagugcaguggugugau

SEQ ID NO: 146 - RNA, 22 nt, Human
aggcugcaguguaguggcauga

SEQ ID NO: 147 - RNA, 22 nt, Human
agggacugugcugauaauuggc

SEQ ID NO: 148 - RNA, 22 nt, Human
agggagugucagaaugccagca

SEQ ID NO: 149 - RNA, 22 nt, Human
agggaguuuacauguuuucuaa

SEQ ID NO: 150 - RNA, 22 nt, Human
agguagcuaaguaauacuagag

SEQ ID NO: 151 - RNA, 22 nt, Human
agguagggaggguagaugcucu

SEQ ID NO: 152 - RNA, 22 nt, Human
aggugagaaaacugaggcucag

SEQ ID NO: 153 - RNA, 22 nt, Human
aguagaacagaauauuuuagcu

SEQ ID NO: 154 - RNA, 22 nt, Human
aguauuacagcagguacugguu

SEQ ID NO: 155 - RNA, 22 nt, Human
aguauuucuuguuuuauugaga

SEQ ID NO: 156 - RNA, 22 nt, Human
agucagacguuuggcaacagca

SEQ ID NO: 157 - RNA, 22 nt, Human
agucagggagacugucaguaaa

SEQ ID NO: 158 - RNA, 22 nt, Human
agugaagcgaguugggccagag

SEQ ID NO: 159 - RNA, 22 nt, Human
agugagccgagauacauacaua

SEQ ID NO: 160 - RNA, 22 nt, Human
agugcagguucacaggcugggc

SEQ ID NO: 161 - RNA, 22 nt, Human
agugcuuugauuaugagaaagu

SEQ ID NO: 162 - RNA, 22 nt, Human
agugggaugucagaacuaauua

SEQ ID NO: 163 - RNA, 22 nt, Human
agugguuucagggacuucugua

SEQ ID NO: 164 - RNA, 22 nt, Human
aguguuccccucacacaugcua

SEQ ID NO: 165 - RNA, 22 nt, Human
aguuccauggaaaacaacaaag

SEQ ID NO: 166 - RNA, 22 nt, Human
auaaagcagguuaacaaagcug

SEQ ID NO: 167 - RNA, 22 nt, Human
auaacugugaagaggcaauugu

SEQ ID NO: 168 - RNA, 22 nt, Human
auaagcacagggagguucuguc

SEQ ID NO: 169 - RNA, 22 nt, Human
auacaacagcaggacccuugcc

SEQ ID NO: 170 - RNA, 22 nt, Human
auacagcucucucuggggacuu

SEQ ID NO: 171 - RNA, 22 nt, Human
auacagugacugacaaaugcug

SEQ ID NO: 172 - RNA, 22 nt, Human
auaccggguucaagguguugag

SEQ ID NO: 173 - RNA, 22 nt, Human
auagaagagcagugggguagaa

SEQ ID NO: 174 - RNA, 22 nt, Human
auaguacagaccaaguucuggc

SEQ ID NO: 175 - RNA, 22 nt, Human
aucacuauuaaugugugcuagu

SEQ ID NO: 176 - RNA, 22 nt, Human
aucacuuugcagggauuacuaa

SEQ ID NO: 177 - RNA, 22 nt, Human
aucuacagucagugugaucaca

SEQ ID NO: 178 - RNA, 22 nt, Human
aucuucuguugcgggaagucag

SEQ ID NO: 179 - RNA, 22 nt, Human
augaccaggaauugagagacug

SEQ ID NO: 180 - RNA, 22 nt, Human
augacccuucuggaacugcuuc

SEQ ID NO: 181 - RNA, 22 nt, Human
augaccugcagucagggcccag

SEQ ID NO: 182 - RNA, 22 nt, Human
aaaaugcacaggggccaggcau

SEQ ID NO: 183 - RNA, 22 nt, Human
aaacacaaugcaguaggaagag

SEQ ID NO: 184 - RNA, 22 nt, Human
aaacacacugcugugagagaau

SEQ ID NO: 185 - RNA, 22 nt, Human
aaacgaaaacacuccuauauuu

SEQ ID NO: 186 - RNA, 22 nt, Human
aaacggaaccacuagugacuug

SEQ ID NO: 187 - RNA, 22 nt, Human
aaacugcgccuguaaacuucgu

SEQ ID NO: 188 - RNA, 22 nt, Human
aaagaacugaacaaaggcagac

SEQ ID NO: 189 - RNA, 22 nt, Human
aaagacaguucagugacaaguu

SEQ ID NO: 190 - RNA, 22 nt, Human
aaagacuuggcugucagcccug

SEQ ID NO: 191 - RNA, 22 nt, Human
aaagcuuuguucauuguaucug

SEQ ID NO: 192 - RNA, 22 nt, Human
aaaggaguuugugacauugaca

SEQ ID NO: 193 - RNA, 22 nt, Human
aaaggcagacggugaaugccuu

SEQ ID NO: 194 - RNA, 22 nt, Human
aaauccuggggaucuggaggga

SEQ ID NO: 195 - RNA, 22 nt, Human
aaaugccaucucuguggucuca

SEQ ID NO: 196 - RNA, 22 nt, Human
aaauugccgagaugauguuugg

SEQ ID NO: 197 - RNA, 22 nt, Human
aacacguaguagguguucgaua

SEQ ID NO: 198 - RNA, 22 nt, Human
aacacguugcaucugugucucu

SEQ ID NO: 199 - RNA, 22 nt, Human
aaccugucauuccaaggacagu

SEQ ID NO: 200 - RNA, 22 nt, Human
aacgaugggcuggauuguuuug

SEQ ID NO: 201 - RNA, 22 nt, Human
aacuuguggcuguuuuugccac

SEQ ID NO: 202 - RNA, 22 nt, Human
aagacacuuucuaaauagaagu

SEQ ID NO: 203 - RNA, 22 nt, Human
aagacuguguguggaaugaagg

SEQ ID NO: 204 - RNA, 22 nt, Human
aagagagucauggagucagaca

SEQ ID NO: 205 - RNA, 22 nt, Human
aagcuggccuguaccugcugag

SEQ ID NO: 206 - RNA, 22 nt, Human
aaggaacuacuucuccagacau

SEQ ID NO: 207 - RNA, 22 nt, Human
aaggaagugucucuuggcuggc

SEQ ID NO: 208 - RNA, 22 nt, Human
aaggcuuuucugggaagagcug

SEQ ID NO: 209 - RNA, 22 nt, Human
aagguagauaaaggcuucacgu

SEQ ID NO: 210 - RNA, 22 nt, Human
aagguggugucauguuuugggg

SEQ ID NO: 211 - RNA, 22 nt, Human
aaguuuuuuuaaauuagcuagg

SEQ ID NO: 212 - RNA, 22 nt, Human
aaucaauguucccaggggaaaa

SEQ ID NO: 213 - RNA, 22 nt, Human
aaucaugucuucuuuguuuaga

SEQ ID NO: 214 - RNA, 22 nt, Human
aaucuccauuuguaaaugugac

SEQ ID NO: 215 - RNA, 22 nt, Human
aaucuucacuaaaauggacaag

SEQ ID NO: 216 - RNA, 22 nt, Human
aaugaagccacagagauuugcu

SEQ ID NO: 217 - RNA, 22 nt, Human
aaugaauuguguuuacccugag

SEQ ID NO: 218 - RNA, 22 nt, Human
aaugguuuucuagaacaugaaa

SEQ ID NO: 219 - RNA, 22 nt, Human
aaugugcaucuauacugagaua

SEQ ID NO: 220 - RNA, 22 nt, Human
aaugugcauggaucgcucagaa

SEQ ID NO: 221 - RNA, 22 nt, Human
aaugugccuacagugggcuguu

SEQ ID NO: 222 - RNA, 22 nt, Human
aauguguguuuucccccaaaaa

SEQ ID NO: 223 - RNA, 22 nt, Human
aauuuaacagacagccacagcc

SEQ ID NO: 224 - RNA, 22 nt, Human
acaaaaaauuagccagacuggu

SEQ ID NO: 225 - RNA, 22 nt, Human
acaaccucugccuccuggguuc

SEQ ID NO: 226 - RNA, 22 nt, Human
acaaggcagggcaggugucugu

SEQ ID NO: 227 - RNA, 22 nt, Human
acacuugucugcuuucuacacu

SEQ ID NO: 228 - RNA, 22 nt, Human
acagcaagucuuugucaaagcu

SEQ ID NO: 229 - RNA, 22 nt, Human
acagcaguccagccugggugac

SEQ ID NO: 230 - RNA, 20 nt, Human
acaggagcauggagaggcua

SEQ ID NO: 231 - RNA, 22 nt, Human
acaguguuacccaggcuggucu

SEQ ID NO: 232 - RNA, 22 nt, Human
acaguguucucaccaaaggaua

SEQ ID NO: 233 - RNA, 22 nt, Human
accagaauucauuuauaaagca

SEQ ID NO: 234 - RNA, 22 nt, Human
accaguuaaagaauaugaggcc

SEQ ID NO: 235 - RNA, 22 nt, Human
acccacccucugugaggaggau

SEQ ID NO: 236 - RNA, 22 nt, Human
acccucugcuucucaaccuuuc

SEQ ID NO: 237 - RNA, 22 nt, Human
accugcauuccagccugcugac

SEQ ID NO: 238 - RNA, 22 nt, Human
accuggccuguaggcaagucuu

SEQ ID NO: 239 - RNA, 22 nt, Human
acgccgcugugggaaagcacuu

SEQ ID NO: 240 - RNA, 22 nt, Human
acucagagccauuccgcucagg

SEQ ID NO: 241 - RNA, 22 nt, Human
acugaccuucugugucauggca

SEQ ID NO: 242 - RNA, 22 nt, Human
acugcacuccagccuaugggau

SEQ ID NO: 243 - RNA, 22 nt, Human
acugcacuccagccuggcaaca

SEQ ID NO: 244 - RNA, 22 nt, Human
acugcacuccagccugggcgau

SEQ ID NO: 245 - RNA, 22 nt, Human
acugcacuccagccuggguggc

SEQ ID NO: 246 - RNA, 22 nt, Human
acugcacuccagccuguugaca

SEQ ID NO: 247 - RNA, 22 nt, Human
acugcacuccauccugggacag

SEQ ID NO: 248 - RNA, 22 nt, Human
acugcacuccauccuggggagc

SEQ ID NO: 249 - RNA, 22 nt, Human
acugcacucuagccugagcaac

SEQ ID NO: 250 - RNA, 22 nt, Human
acuggcccacuccauuuagggu

SEQ ID NO: 251 - RNA, 22 nt, Human
acugggauaugaagacugugug

SEQ ID NO: 252 - RNA, 22 nt, Human
acuguacuccacccugggcgac

SEQ ID NO: 253 - RNA, 22 nt, Human
acuguacuucagccugggcaac

SEQ ID NO: 254 - RNA, 22 nt, Human
acuuugguuucuccugaguuug

SEQ ID NO: 255 - RNA, 22 nt, Human
agaagaucccugcucugaguca

SEQ ID NO: 256 - RNA, 22 nt, Human
agacuggccucaagcucccaga

SEQ ID NO: 257 - RNA, 22 nt, Human
agagagcugugauaaucccugc

SEQ ID NO: 258 - RNA, 22 nt, Human
agagauaaagagguuuaggcag

SEQ ID NO: 259 - RNA, 22 nt, Human
agagcuaggaagauacaggguu

SEQ ID NO: 260 - RNA, 22 nt, Human
agaggauagaaugaguacccau

SEQ ID NO: 261 - RNA, 22 nt, Human
agagugugucuauggaaggggu

SEQ ID NO: 262 - RNA, 22 nt, Human
agauaguucucuguuguugggg

SEQ ID NO: 263 - RNA, 22 nt, Human
agauauggugaacagacagaug

SEQ ID NO: 264 - RNA, 22 nt, Human
agaugacacagagcucaggaaa

SEQ ID NO: 265 - RNA, 22 nt, Human
agaugauguuggagucugugcu

SEQ ID NO: 266 - RNA, 22 nt, Human
agauggagaaguguuuucagau

SEQ ID NO: 267 - RNA, 22 nt, Human
agauggaguuugagagggaaua

SEQ ID NO: 268 - RNA, 22 nt, Human
agcaaaagccaugcccaggaga

SEQ ID NO: 269 - RNA, 22 nt, Human
agcaacagaacgccacuauuug

SEQ ID NO: 270 - RNA, 22 nt, Human
agcaaguguugaaacagcuggu

SEQ ID NO: 271 - RNA, 22 nt, Human
agcacauaugcuaauuggucug

SEQ ID NO: 272 - RNA, 22 nt, Human
agcagcacagaaauauuggcac

SEQ ID NO: 273 - RNA, 22 nt, Human
agcagcacucaauauuccacag

SEQ ID NO: 274 - RNA, 22 nt, Human
agcagcgcagguagauggggcu

SEQ ID NO: 275 - RNA, 22 nt, Human
agcagcucaagucuucuccaga

SEQ ID NO: 276 - RNA, 22 nt, Human
agcaggcagagaaaugugaacu

SEQ ID NO: 277 - RNA, 21 nt, Human
agcaucugaggcaguuuccua

SEQ ID NO: 278 - RNA, 22 nt, Human
agcccugaccguucugcauaug

SEQ ID NO: 279 - RNA, 22 nt, Human
agcuggauuguuuaccuggggc

SEQ ID NO: 280 - RNA, 22 nt, Human
agcugugagccugccuuccagu

SEQ ID NO: 281 - RNA, 22 nt, Human
aggaaacauccucccccuuguu

SEQ ID NO: 282 - RNA, 22 nt, Human
aggagccagauauacucuuaag

SEQ ID NO: 283 - RNA, 22 nt, Human
aggaggacagaacaaaccagug

SEQ ID NO: 284 - RNA, 22 nt, Human
aggauaguaaugauagagaggc

SEQ ID NO: 285 - RNA, 22 nt, Human
aggcaagagguugcagugagcu

SEQ ID NO: 286 - RNA, 22 nt, Human
aggcagaaugcaauggcaucca

SEQ ID NO: 287 - RNA, 22 nt, Human
aggcagagagguauuuaggcau

SEQ ID NO: 288 - RNA, 22 nt, Human
aggcagguggguguaugggucu

SEQ ID NO: 289 - RNA, 22 nt, Human
aggcagucuugauuagcuucua

SEQ ID NO: 290 - RNA, 22 nt, Human
aggcaguguuguuccugauugc

SEQ ID NO: 291 - RNA, 22 nt, Human
aggccagagaggacucucuuuu

SEQ ID NO: 292 - RNA, 22 nt, Human
aggccuuuuugggaagagacag

SEQ ID NO: 293 - RNA, 22 nt, Human
aggcuuuuggagaagcauaugc

SEQ ID NO: 294 - RNA, 22 nt, Human
agggaugaaguaaaaacaucug

SEQ ID NO: 295 - RNA, 22 nt, Human
agggcacacgucucucugaauu

SEQ ID NO: 296 - RNA, 22 nt, Human
agggcaguggaucucugcaaag

SEQ ID NO: 297 - RNA, 22 nt, Human
aggggguuuagcuccacagggu

SEQ ID NO: 298 - RNA, 22 nt, Human
aggguuguuaguuuuuugguug

SEQ ID NO: 299 - RNA, 22 nt, Human
aggucacugauuuuuuuaauga

SEQ ID NO: 300 - RNA, 22 nt, Human
agguccucacacacagcucugc

SEQ ID NO: 301 - RNA, 22 nt, Human
agguggaguuuugcuuucccau

SEQ ID NO: 302 - RNA, 22 nt, Human
agguggcacugugugggguggg

SEQ ID NO: 303 - RNA, 22 nt, Human
aggugggguuucaccauguugg

SEQ ID NO: 304 - RNA, 22 nt, Human
aguaagcaaacucaguuuaauc

SEQ ID NO: 305 - RNA, 22 nt, Human
aguccaguguucucugcucugu

SEQ ID NO: 306 - RNA, 22 nt, Human
agugagcuaugaucaugccggu

SEQ ID NO: 307 - RNA, 22 nt, Human
agugaguuuuccacaucugaua

SEQ ID NO: 308 - RNA, 22 nt, Human
agugauuuuccugccucagccu

SEQ ID NO: 309 - RNA, 22 nt, Human
agugcagauuggacgguuaauu

SEQ ID NO: 310 - RNA, 22 nt, Human
aguggcauaugcgacggccaug

SEQ ID NO: 311 - RNA, 22 nt, Human
aguggcccuggcccuggggcau

SEQ ID NO: 312 - RNA, 22 nt, Human
aguggcuuugaaacuguaauga

SEQ ID NO: 313 - RNA, 22 nt, Human
aguuaugugaugcuuugaagca

SEQ ID NO: 314 - RNA, 22 nt, Human
auaaagcuagacguucauugac

SEQ ID NO: 315 - RNA, 22 nt, Human
auaaauucauuguaagaugaag

SEQ ID NO: 316 - RNA, 22 nt, Human
auacaugugccauguuggugug

SEQ ID NO: 317 - RNA, 22 nt, Human
auaccagcacaguggaugggga

SEQ ID NO: 318 - RNA, 22 nt, Human
auacugagagaaaaagcuuguc

SEQ ID NO: 319 - RNA, 22 nt, Human
auagcaguaauaccagcauaau

SEQ ID NO: 320 - RNA, 22 nt, Human
auaguauagugguuaagagcaa

SEQ ID NO: 321 - RNA, 22 nt, Human
auauuggugaaaugcuagcaaa

SEQ ID NO: 322 - RNA, 22 nt, Human
auauuguguauucaggauagca

SEQ ID NO: 323 - RNA, 22 nt, Human
aucacguuacuucaccuauguc

SEQ ID NO: 324 - RNA, 22 nt, Human
auccuuugucugggagucucgc

SEQ ID NO: 325 - RNA, 22 nt, Human
aucuagagaggcagucuggcca

SEQ ID NO: 326 - RNA, 22 nt, Human
aucucauaggcccccagugggg

SEQ ID NO: 327 - RNA, 22 nt, Human
augagaguaggaguuugggcuc

SEQ ID NO: 328 - RNA, 22 nt, Human
augagccaaggagccagaggac

SEQ ID NO: 329 - RNA, 22 nt, Human
augaugagucuuagugaucugg

SEQ ID NO: 330 - RNA, 22 nt, Human
augaugcuggaacuggacaaca

SEQ ID NO: 331 - RNA, 22 nt, Human
augccacagcacuucagccuga

SEQ ID NO: 332 - RNA, 22 nt, Human
augccuguaaucccagcacuuu

SEQ ID NO: 333 - RNA, 22 nt, Human
auggaacucccucuaggaacua

SEQ ID NO: 334 - RNA, 22 nt, Human
auggcucauguuuguagucuca

SEQ ID NO: 335 - RNA, 22 nt, Human
augggcaaauacugggagcugg

SEQ ID NO: 336 - RNA, 22 nt, Human
augggcaguuucuucccuuucc

SEQ ID NO: 337 - RNA, 22 nt, Human
augguaacacacgccuguaguc

SEQ ID NO: 338 - RNA, 22 nt, Human
augguuagauggaugagaugug

SEQ ID NO: 339 - RNA, 22 nt, Human
augguuuuaccaccaccuuuaa

SEQ ID NO: 340 - RNA, 22 nt, Human
auuaaaguagcacugcuuguca

SEQ ID NO: 341 - RNA, 22 nt, Human
auuacaaccuuugcccauacua

SEQ ID NO: 342 - RNA, 22 nt, Human
auuaccuugcuguuaagugguc

SEQ ID NO: 343 - RNA, 22 nt, Human
auucccuuuagcucugauggca

SEQ ID NO: 344 - RNA, 22 nt, Human
auugcacaccaaccugggcaac

SEQ ID NO: 345 - RNA, 22 nt, Human
auugcacuccagccugggcaau

SEQ ID NO: 346 - RNA, 22 nt, Human
auugcacuccagccugggugac

SEQ ID NO: 347 - RNA, 22 nt, Human
auugcacuccagcuugggcaac

SEQ ID NO: 348 - RNA, 22 nt, Human
auugcacuucagccugggugac

SEQ ID NO: 349 - RNA, 22 nt, Human
auugccuuucccuauguuugaa

SEQ ID NO: 350 - RNA, 22 nt, Human
auugcuugagcccaggaguuca

SEQ ID NO: 351 - RNA, 22 nt, Human
auuguaaauuaacaauuugcuc

SEQ ID NO: 352 - RNA, 22 nt, Human
auuguguugaguaacggugaua

SEQ ID NO: 353 - RNA, 22 nt, Human
auuugaggaggcuuuacagcca

SEQ ID NO: 354 - RNA, 22 nt, Human
auuuuucugcauuuguauugga

SEQ ID NO: 355 - RNA, 22 nt, Human
caaaaagaauguugcauguguu

SEQ ID NO: 356 - RNA, 22 nt, Human
caaaagucagugcgguuuuugc

SEQ ID NO: 357 - RNA, 22 nt, Human
caaagcucuccuaucagcuggg

SEQ ID NO: 358 - RNA, 22 nt, Human
caagcuccaggaacuuacauuc

SEQ ID NO: 359 - RNA, 22 nt, Human
caagugcuugaacauggcagag

SEQ ID NO: 360 - RNA, 22 nt, Human
cacaauauagcaaauagagggu

SEQ ID NO: 361 - RNA, 22 nt, Human
cacagcauuggucaugagguca

SEQ ID NO: 362 - RNA, 22 nt, Human
cacccaggcuggagugcagugg

SEQ ID NO: 363 - RNA, 22 nt, Human
cacccucugccugugguugucu

SEQ ID NO: 364 - RNA, 22 nt, Human
cacccucugcuucucaaccuuu

SEQ ID NO: 365 - RNA, 22 nt, Human
cacugcaacccccgccucccag

SEQ ID NO: 366 - RNA, 22 nt, Human
cacugcaaccuccaccuccugg

SEQ ID NO: 367 - RNA, 22 nt, Human
cacugcaagcuccaccucccgg

SEQ ID NO: 368 - RNA, 22 nt, Human
cacugcaaugacugucagaaca

SEQ ID NO: 369 - RNA, 22 nt, Human
cacugcacuccagccugggcga

SEQ ID NO: 370 - RNA, 22 nt, Human
cacugcacuccagccuggguaa

SEQ ID NO: 371 - RNA, 22 nt, Human
cacugcacuccagccuggguga

SEQ ID NO: 372 - RNA, 22 nt, Human
cacugcacuguagccuccuggg

SEQ ID NO: 373 - RNA, 22 nt, Human
cacugcgaccucuaucucuugg

SEQ ID NO: 374 - RNA, 22 nt, Human
cacugcuguaauggacggugag

SEQ ID NO: 375 - RNA, 22 nt, Human
cacugcugugguuggaauaggu

SEQ ID NO: 376 - RNA, 22 nt, Human
cagaaucuuuugucucugagaa

SEQ ID NO: 377 - RNA, 22 nt, Human
cagagcauuugugaggaguguu

SEQ ID NO: 378 - RNA, 22 nt, Human
cagagcugccuuucccuuccug

SEQ ID NO: 379 - RNA, 22 nt, Human
cagaguacugugauagacucag

SEQ ID NO: 380 - RNA, 22 nt, Human
cagaucugggauacagcugugg

SEQ ID NO: 381 - RNA, 22 nt, Human
cagcaccaucagaugacuguau

SEQ ID NO: 382 - RNA, 22 nt, Human
cagcagagcccauguguucaug

SEQ ID NO: 383 - RNA, 22 nt, Human
cagcaguguugcgaaucaucac

SEQ ID NO: 384 - RNA, 22 nt, Human
cagcgugcugucucugaguggc

SEQ ID NO: 385 - RNA, 22 nt, Human
cagguacuuuuugguuuacaug

SEQ ID NO: 386 - RNA, 22 nt, Human
caggugcaaguguuaaagggua

SEQ ID NO: 387 - RNA, 22 nt, Human
cagugauggugaugccaccagc

SEQ ID NO: 388 - RNA, 22 nt, Human
cagugggaaaaguuugucucau

SEQ ID NO: 389 - RNA, 22 nt, Human
cauaaaaucagaaaguauuacu

SEQ ID NO: 390 - RNA, 22 nt, Human
cauaaaguagaaagcacuacua

SEQ ID NO: 391 - RNA, 22 nt, Human
cauccauauuggacuuagacaa

SEQ ID NO: 392 - RNA, 22 nt, Human
caucccuucccuaagcacuagc

SEQ ID NO: 393 - RNA, 22 nt, Human
caugaggaggaaucagggucuu

SEQ ID NO: 394 - RNA, 22 nt, Human
cauugcacuccagccuaggcaa

SEQ ID NO: 395 - RNA, 22 nt, Human
cauugcacuccagccuggguga

SEQ ID NO: 396 - RNA, 22 nt, Human
cauuggguaucaccuauacaga

SEQ ID NO: 397 - RNA, 22 nt, Human
ccaaagugcuaggauuacagcc

SEQ ID NO: 398 - RNA, 22 nt, Human
ccaaagugcuggcguuacaggu

SEQ ID NO: 399 - RNA, 22 nt, Human
ccacccuuccauucuuccucuu

SEQ ID NO: 400 - RNA, 22 nt, Human
ccagccugagguuccuggaggg

SEQ ID NO: 401 - RNA, 22 nt, Human
ccaggcaacuguguuuuuuaag

SEQ ID NO: 402 - RNA, 22 nt, Human
ccaggguacucugggaucacuu

SEQ ID NO: 403 - RNA, 22 nt, Human
cccacacuuggaaucagccauu

SEQ ID NO: 404 - RNA, 22 nt, Human
cccaggagguggagguuacagu

SEQ ID NO: 405 - RNA, 22 nt, Human
cccaggcuggagugcaguggug

SEQ ID NO: 406 - RNA, 22 nt, Human
ccccaguucaauccgaccaugc

SEQ ID NO: 407 - RNA, 22 nt, Human
cccugggcugguguuugacuug

SEQ ID NO: 408 - RNA, 22 nt, Human
ccucccuuguaccauugucuca

SEQ ID NO: 409 - RNA, 22 nt, Human
ccucuccauguacccauucccc

SEQ ID NO: 410 - RNA, 22 nt, Human
ccuggagugacagguguagccu

SEQ ID NO: 411 - RNA, 22 nt, Human
ccuggcuuaggaagcucacaag

SEQ ID NO: 412 - RNA, 22 nt, Human
ccuuggcacuuaaucuucaagc

SEQ ID NO: 413 - RNA, 22 nt, Human
ccuuguguuuuccagauucuga

SEQ ID NO: 414 - RNA, 22 nt, Human
cgccagaugcuccuggacuugc

SEQ ID NO: 415 - RNA, 22 nt, Human
cggguccaggaaucaagggaua

SEQ ID NO: 416 - RNA, 22 nt, Human
cguguaaucccagcuacuuggg

SEQ ID NO: 417 - RNA, 22 nt, Human
cuacuuguuccucucaccucaa

SEQ ID NO: 418 - RNA, 22 nt, Human
cuagacugaagcuuuaugagga

SEQ ID NO: 419 - RNA, 22 nt, Human
cuaggaguugacaagcuaagaa

SEQ ID NO: 420 - RNA, 22 nt, Human
cuauucucuaaucccggggucc

SEQ ID NO: 421 - RNA, 22 nt, Human
cucacgugauggggacugagcu

SEQ ID NO: 422 - RNA, 22 nt, Human
cucagugguucagacacuguuu

SEQ ID NO: 423 - RNA, 22 nt, Human
cuccuaggcuggagugcagugg

SEQ ID NO: 424 - RNA, 22 nt, Human
cucuagcuccacagcuggcauu

SEQ ID NO: 425 - RNA, 22 nt, Human
cucucagugcgccagugagggg

SEQ ID NO: 426 - RNA, 22 nt, Human
cucugccucccgggucuaggcu

SEQ ID NO: 427 - RNA, 22 nt, Human
cucugguagggguagccuucug

SEQ ID NO: 428 - RNA, 22 nt, Human
cucuugaaggaguauuuguguu

SEQ ID NO: 429 - RNA, 22 nt, Human
cucuugcuucacgauguuacaa

SEQ ID NO: 430 - RNA, 22 nt, Human
cugaaaagaaguugcccauguu

SEQ ID NO: 431 - RNA, 22 nt, Human
cugaauguaaucuuaguuguaa

SEQ ID NO: 432 - RNA, 22 nt, Human
cugaccucugcccuacuguaua

SEQ ID NO: 433 - RNA, 22 nt, Human
cugagcagaugugagcugguua

SEQ ID NO: 434 - RNA, 22 nt, Human
cugaggucaggaguucgagacc

SEQ ID NO: 435 - RNA, 22 nt, Human
cugagucaguuacaacaggucc

SEQ ID NO: 436 - RNA, 22 nt, Human
cugagucugugggucaucuagc

SEQ ID NO: 437 - RNA, 22 nt, Human
cugauugaaccauucacuuuau

SEQ ID NO: 438 - RNA, 22 nt, Human
cugcagauuuugggguccacag

SEQ ID NO: 439 - RNA, 22 nt, Human
cugccuccuggguucaagcaau

SEQ ID NO: 440 - RNA, 21 nt, Human
cugcuaaacauccuacacugc

SEQ ID NO: 441 - RNA, 22 nt, Human
cugcugccuuucucucagagau

SEQ ID NO: 442 - RNA, 22 nt, Human
cuggaagacaugguagagcuga

SEQ ID NO: 443 - RNA, 22 nt, Human
cuggagaggagcggucacuggu

SEQ ID NO: 444 - RNA, 22 nt, Human
cuggaguucagugguaugauca

SEQ ID NO: 445 - RNA, 22 nt, Human
cuggcaauaaacccacgcggag

SEQ ID NO: 446 - RNA, 22 nt, Human
cuggcagcccauagaccagacg

SEQ ID NO: 447 - RNA, 22 nt, Human
cuggcucccaggaggccucucu

SEQ ID NO: 448 - RNA, 22 nt, Human
cuggcucuaauaaccugagcuu

SEQ ID NO: 449 - RNA, 22 nt, Human
cuggcugcauuuaggaacaagg

SEQ ID NO: 450 - RNA, 22 nt, Human
cuggcuugaaguuaugcaccag

SEQ ID NO: 451 - RNA, 22 nt, Human
cugggauccuuugaugcgggcg

SEQ ID NO: 452 - RNA, 22 nt, Human
cugggauggaggagaauuagag

SEQ ID NO: 453 - RNA, 22 nt, Human
cugggcaguaauguaguugaga

SEQ ID NO: 454 - RNA, 22 nt, Human
cugggcucuggucuguagguuu

SEQ ID NO: 455 - RNA, 22 nt, Human
cuggucccugugucagucuuaa

SEQ ID NO: 456 - RNA, 22 nt, Human
cuguccugugucagccugaaau

SEQ ID NO: 457 - RNA, 22 nt, Human
cugugcauguugauauccuggc

SEQ ID NO: 458 - RNA, 22 nt, Human
cugugccugugacgagggauga

SEQ ID NO: 459 - RNA, 22 nt, Human
cugugggugagagagugggaga

SEQ ID NO: 460 - RNA, 22 nt, Human
cuuccuggguucauauccuggu

SEQ ID NO: 461 - RNA, 22 nt, Human
cuugcacuccacagccugggug

SEQ ID NO: 462 - RNA, 22 nt, Human
cuugcccuuugaaaacagauga

SEQ ID NO: 463 - RNA, 22 nt, Human
cuuggcccugugaggcuucacc

SEQ ID NO: 464 - RNA, 22 nt, Human
cuuggcucuuugaccgagaugc

SEQ ID NO: 465 - RNA, 21 nt, Human
cuuuggcaagggagaagucac

SEQ ID NO: 466 - RNA, 22 nt, Human
cuuugguuggguggguauuugg

SEQ ID NO: 467 - RNA, 22 nt, Human
cuuuuccugggucugggcugug

SEQ ID NO: 468 - RNA, 22 nt, Human
cuuuuugggguuuggggcuugg

SEQ ID NO: 469 - RNA, 22 nt, Human
gaaacuaguguugggacaaagg

SEQ ID NO: 470 - RNA, 22 nt, Human
gaaagacugaucagcauagaau

SEQ ID NO: 471 - RNA, 22 nt, Human
gaaccuucaacugcuuagccug

SEQ ID NO: 472 - RNA, 22 nt, Human
aucugcugucuuuuagaagugg

SEQ ID NO: 473 - RNA, 22 nt, Human
aucugugcacgagcaugcacac

SEQ ID NO: 474 - RNA, 22 nt, Human
aucuuucuuaauuccaggacuc

SEQ ID NO: 475 - RNA, 22 nt, Human
augacacaguggggccaguugg

SEQ ID NO: 476 - RNA, 22 nt, Human
augagaaugacacaggaacuag

SEQ ID NO: 477 - RNA, 22 nt, Human
augaucauguaugauacugcaa

SEQ ID NO: 478 - RNA, 22 nt, Human
augcauagagauacauuaaaca

SEQ ID NO: 479 - RNA, 22 nt, Human
augcccuuccucuucugccaug

SEQ ID NO: 480 - RNA, 22 nt, Human
augccuguaaucccagcauuuu

SEQ ID NO: 481 - RNA, 22 nt, Human
auggagcuguuuucuucagagc

SEQ ID NO: 482 - RNA, 22 nt, Human
auggauauuuuugaugcccaga

SEQ ID NO: 483 - RNA, 22 nt, Human
auggccuuuucucuuauccugg

SEQ ID NO: 484 - RNA, 22 nt, Human
auggcuuauuccauggccauca

SEQ ID NO: 485 - RNA, 22 nt, Human
augggagacugaggggcggacg

SEQ ID NO: 486 - RNA, 22 nt, Human
augguguaggugaagagaacau

SEQ ID NO: 487 - RNA, 22 nt, Human
augucagugaagaggucuggca

SEQ ID NO: 488 - RNA, 22 nt, Human
augugucugggacucuaugcca

SEQ ID NO: 489 - RNA, 22 nt, Human
auuagcuauagcaaaaggcuua

SEQ ID NO: 490 - RNA, 22 nt, Human
auucaagauaagggucugggag

SEQ ID NO: 491 - RNA, 22 nt, Human
auucacuuccugaaacgugcac

SEQ ID NO: 492 - RNA, 22 nt, Human
auucuaguaguuagccuaguac

SEQ ID NO: 493 - RNA, 22 nt, Human
auuggcuuuugaaagucugcga

SEQ ID NO: 494 - RNA, 22 nt, Human
auuguaccacauguacagcuuu

SEQ ID NO: 495 - RNA, 22 nt, Human
auuguucuccagccugggcgac

SEQ ID NO: 496 - RNA, 22 nt, Human
auuuaggcagggcgauuccaaa

SEQ ID NO: 497 - RNA, 22 nt, Human
auuuauuuucccucaaguaccu

SEQ ID NO: 498 - RNA, 22 nt, Human
auuuggggaaauguguuucugg

SEQ ID NO: 499 - RNA, 22 nt, Human
auuugguaauggggugugugca

SEQ ID NO: 500 - RNA, 22 nt, Human
auuuuugguaucuguggguugg

SEQ ID NO: 501 - RNA, 22 nt, Human
caaagugcugagauuacaggca

SEQ ID NO: 502 - RNA, 22 nt, Human
caaccucacuagcacagauccc

SEQ ID NO: 503 - RNA, 22 nt, Human
cacacagucguguaguuuugcg

SEQ ID NO: 504 - RNA, 22 nt, Human
cacccccaggaccaccuugcga

SEQ ID NO: 505 - RNA, 22 nt, Human
cacugcaaccucugccaccugg

SEQ ID NO: 506 - RNA, 22 nt, Human
cacugcaaccucugccuccugg

SEQ ID NO: 507 - RNA, 22 nt, Human
cacugcacucagccugggugac

SEQ ID NO: 508 - RNA, 22 nt, Human
cacugcacuccaaccuggacaa

SEQ ID NO: 509 - RNA, 22 nt, Human
cacugcacuccacccugggcaa

SEQ ID NO: 510 - RNA, 22 nt, Human
cacugcacuccagcccggcaac

SEQ ID NO: 511 - RNA, 22 nt, Human
cacugcacuccagccuaggcaa

SEQ ID NO: 512 - RNA, 22 nt, Human
cacugcacucuagccucgguga

SEQ ID NO: 513 - RNA, 22 nt, Human
cacugggauuacagaugugagc

SEQ ID NO: 514 - RNA, 22 nt, Human
cacuuucagagaugcccugagu

SEQ ID NO: 515 - RNA, 22 nt, Human
cagaaaguagaaagcagauucg

SEQ ID NO: 516 - RNA, 22 nt, Human
cagagaauggcacagcuguccu

SEQ ID NO: 517 - RNA, 22 nt, Human
cagagagggacuagggcuucaa

SEQ ID NO: 518 - RNA, 22 nt, Human
cagagagguucaaugucuuacu

SEQ ID NO: 519 - RNA, 22 nt, Human
cagagcaguggagaguaggucu

SEQ ID NO: 520 - RNA, 22 nt, Human
cagaggaugcggcugggaacgg

SEQ ID NO: 521 - RNA, 22 nt, Human
cagaugaagaagaugaagcccg

SEQ ID NO: 522 - RNA, 22 nt, Human
cagcuauucaggagcuugaggu

SEQ ID NO: 523 - RNA, 22 nt, Human
caggaacacaaugagucucaaa

SEQ ID NO: 524 - RNA, 22 nt, Human
caggguuagaugacugcgggaa

SEQ ID NO: 525 - RNA, 22 nt, Human
cagguggugcuguuaagaagca

SEQ ID NO: 526 - RNA, 22 nt, Human
caguagaugucuguacuaucau

SEQ ID NO: 527 - RNA, 22 nt, Human
caguccaguguugaagagaggc

SEQ ID NO: 528 - RNA, 22 nt, Human
cagugcugaguaugaaaggccc

SEQ ID NO: 529 - RNA, 22 nt, Human
caguggaugauguuuucugugg

SEQ ID NO: 530 - RNA, 22 nt, Human
cagugucuugucaaaucuagcu

SEQ ID NO: 531 - RNA, 22 nt, Human
cauaucuccagguucugcugga

SEQ ID NO: 532 - RNA, 22 nt, Human
caucacagucuagcuucuuguc

SEQ ID NO: 533 - RNA, 22 nt, Human
caucucagucuauguccuugcu

SEQ ID NO: 534 - RNA, 22 nt, Human
caugguacugccacagaagagu

SEQ ID NO: 535 - RNA, 22 nt, Human
cauucacuucgugagccuuugu

SEQ ID NO: 536 - RNA, 22 nt, Human
cauugcacuccacccuaggcaa

SEQ ID NO: 537 - RNA, 22 nt, Human
cauuucaacuuuguuguucuuu

SEQ ID NO: 538 - RNA, 22 nt, Human
cauuucaguuugcaguuucucu

SEQ ID NO: 539 - RNA, 22 nt, Human
ccaaagugcuaggaauacaggu

SEQ ID NO: 540 - RNA, 22 nt, Human
ccaaagugcugggauuacaggc

SEQ ID NO: 541 - RNA, 22 nt, Human
ccacugcacuccagcacuccag

SEQ ID NO: 542 - RNA, 22 nt, Human
ccacugcacuccagccugggug

SEQ ID NO: 543 - RNA, 22 nt, Human
ccagaggugagucuugauuuug

SEQ ID NO: 544 - RNA, 22 nt, Human
ccaguacugucuugaugccugc

SEQ ID NO: 545 - RNA, 22 nt, Human
ccagugaaacggccaaggaaga

SEQ ID NO: 546 - RNA, 22 nt, Human
cccaggaggcggagguugcagu

SEQ ID NO: 547 - RNA, 22 nt, Human
ccccaccccaguggagcucacc

SEQ ID NO: 548 - RNA, 22 nt, Human
ccccacuggucaguaaggaagc

SEQ ID NO: 549 - RNA, 22 nt, Human
ccccagucaaugcuucucucca

SEQ ID NO: 550 - RNA, 22 nt, Human
cccuuuaguaacuugcaggguc

SEQ ID NO: 551 - RNA, 22 nt, Human
ccguaaaauguucaaauguuuu

SEQ ID NO: 552 - RNA, 22 nt, Human
ccuccauucacagcuggcugag

SEQ ID NO: 553 - RNA, 22 nt, Human
ccuccuuucaucaaauucgagu

SEQ ID NO: 554 - RNA, 22 nt, Human
ccugcccauccugccuccacca

SEQ ID NO: 555 - RNA, 22 nt, Human
ccuggccuaauuuuucaauuuu

SEQ ID NO: 556 - RNA, 22 nt, Human
ccugggggccacuuugcacagg

SEQ ID NO: 557 - RNA, 22 nt, Human
cgacucuugaccauggcugggg

SEQ ID NO: 558 - RNA, 22 nt, Human
cgcuauguuggccaggcugguc

SEQ ID NO: 559 - RNA, 22 nt, Human
cgcucgaggauugcuguuuuca

SEQ ID NO: 560 - RNA, 22 nt, Human
cggcaagaugccggagugcugg

SEQ ID NO: 561 - RNA, 22 nt, Human
cggugcuguucaacagguccug

SEQ ID NO: 562 - RNA, 22 nt, Human
cguguucaguauggugggagau

SEQ ID NO: 563 - RNA, 22 nt, Human
cuaacauuguuguguagauaau

SEQ ID NO: 564 - RNA, 22 nt, Human
cuaauuguuccugcagguagua

SEQ ID NO: 565 - RNA, 22 nt, Human
cuagcacagugcuuggcacaca

SEQ ID NO: 566 - RNA, 22 nt, Human
cuauuggauuuuaagcauuggg

SEQ ID NO: 567 - RNA, 22 nt, Human
cuauuuuacauggucacuauca

SEQ ID NO: 568 - RNA, 22 nt, Human
cucaccaguuacucuccaguug

SEQ ID NO: 569 - RNA, 22 nt, Human
cucacugcaaccuccgccuccc

SEQ ID NO: 570 - RNA, 22 nt, Human
cucagauacuugggagguugag

SEQ ID NO: 571 - RNA, 22 nt, Human
cucagugugaagaacuacgggu

SEQ ID NO: 572 - RNA, 22 nt, Human
cucccuccacuucugaggacgu

SEQ ID NO: 573 - RNA, 22 nt, Human
cuccuacaacugacucucugga

SEQ ID NO: 574 - RNA, 22 nt, Human
cucugagucugagagaguaggu

SEQ ID NO: 575 - RNA, 22 nt, Human
cucuuuaguaggaacucuggau

SEQ ID NO: 576 - RNA, 22 nt, Human
cugaaaugcuguugauuuuagu

SEQ ID NO: 577 - RNA, 22 nt, Human
cugaauagaacagaagagcagc

SEQ ID NO: 578 - RNA, 22 nt, Human
cugaggcaggagggcucaggag

SEQ ID NO: 579 - RNA, 22 nt, Human
cugcacuagaaggcacuauguu

SEQ ID NO: 580 - RNA, 22 nt, Human
cugcauggagguggucuaugag

SEQ ID NO: 581 - RNA, 22 nt, Human
cugccauuuccaggagaucacc

SEQ ID NO: 582 - RNA, 22 nt, Human
cugcccugaacucuggccaucc

SEQ ID NO: 583 - RNA, 22 nt, Human
cuggaggauaacaaugauaaug

SEQ ID NO: 584 - RNA, 22 nt, Human
cuggcuaauuuucuugaguuuu

SEQ ID NO: 585 - RNA, 22 nt, Human
cuggcucccucucuucucuccc

SEQ ID NO: 586 - RNA, 22 nt, Human
cuggcucuacccucucacuuca

SEQ ID NO: 587 - RNA, 22 nt, Human
cugggauuacaggugugaacca

SEQ ID NO: 588 - RNA, 22 nt, Human
cugggcgugugaggcggcugug

SEQ ID NO: 589 - RNA, 22 nt, Human
cuggguggccuucaguccauga

SEQ ID NO: 590 - RNA, 22 nt, Human
cuggugaggaaggagcagaguu

SEQ ID NO: 591 - RNA, 22 nt, Human
cugugagcuauuuguuuugguu

SEQ ID NO: 592 - RNA, 22 nt, Human
cugugcccagccagggcugugu

SEQ ID NO: 593 - RNA, 22 nt, Human
cugugcuggugaaacccacaga

SEQ ID NO: 594 - RNA, 22 nt, Human
cuguggauacugagagaugacu

SEQ ID NO: 595 - RNA, 22 nt, Human
cuguucagaucugugugcauuu

SEQ ID NO: 596 - RNA, 22 nt, Human
cuucaaugcuugagaagucgua

SEQ ID NO: 597 - RNA, 22 nt, Human
cuucagccaugaagacaaggac

SEQ ID NO: 598 - RNA, 22 nt, Human
cuucuuuggggugggcuugcuc

SEQ ID NO: 599 - RNA, 22 nt, Human
cuuugaauuucacacgggggca

SEQ ID NO: 600 - RNA, 22 nt, Human
cuuuggccacggggauaugaau

SEQ ID NO: 601 - RNA, 22 nt, Human
gaaaccuacacaucccacuaac

SEQ ID NO: 602 - RNA, 22 nt, Human
gaaaguaguaaguuguauaguu

SEQ ID NO: 603 - RNA, 22 nt, Human
gaacagcuccagucuacagccc

SEQ ID NO: 604 - RNA, 22 nt, Human
gaacuguacuggacccauaguu

SEQ ID NO: 605 - RNA, 22 nt, Human
gaagauguuuaacaaaucauuu

SEQ ID NO: 606 - RNA, 22 nt, Human
gacaagagaaccucaugcuggg

SEQ ID NO: 607 - RNA, 22 nt, Human
gacaugauguagcagaugaugg

SEQ ID NO: 608 - RNA, 22 nt, Human
gacauggagacaacagccaaau

SEQ ID NO: 609 - RNA, 22 nt, Human
gaccagccauccugguuuacau

SEQ ID NO: 610 - RNA, 22 nt, Human
gacccuguguucaagguuaggg

SEQ ID NO: 611 - RNA, 22 nt, Human
gacuggcuaauuuauaaaggaa

SEQ ID NO: 612 - RNA, 22 nt, Human
gagaaguaggaauaucaggagu

SEQ ID NO: 613 - RNA, 22 nt, Human
gagagagguagaggggagcaga

SEQ ID NO: 614 - RNA, 22 nt, Human
gagagugcuuuggguguaggcc

SEQ ID NO: 615 - RNA, 22 nt, Human
gagauccuuucacaguuguggu

SEQ ID NO: 616 - RNA, 22 nt, Human
gagccacacuguccugaugcca

SEQ ID NO: 617 - RNA, 22 nt, Human
gaagagcugugugcugugaugu

SEQ ID NO: 618 - RNA, 22 nt, Human
gaagcauugugagaaacagguu

SEQ ID NO: 619 - RNA, 22 nt, Human
gaaggcaucuguguccccuguu

SEQ ID NO: 620 - RNA, 22 nt, Human
gaauaaugucccacugggaggc

SEQ ID NO: 621 - RNA, 22 nt, Human
gacaagaggcacagacagcagg

SEQ ID NO: 622 - RNA, 21 nt, Human
gacacaggcccagagaggcag

SEQ ID NO: 623 - RNA, 22 nt, Human
gaccccuugcccguggcuccca

SEQ ID NO: 624 - RNA, 22 nt, Human
gagaggugaagccaggcuucug

SEQ ID NO: 625 - RNA, 22 nt, Human
gagaucgugcuuuuuguggacu

SEQ ID NO: 626 - RNA, 22 nt, Human
gagaugacugguggcugggggc

SEQ ID NO: 627 - RNA, 22 nt, Human
gagauggaguuuuacuauguug

SEQ ID NO: 628 - RNA, 22 nt, Human
gagcagguuuggaauggcucca

SEQ ID NO: 629 - RNA, 22 nt, Human
gaggaagguaaugaucuugauc

SEQ ID NO: 630 - RNA, 22 nt, Human
gaggacccuuaggucagacaga

SEQ ID NO: 631 - RNA, 22 nt, Human
gaggagguggggcagcagcagg

SEQ ID NO: 632 - RNA, 22 nt, Human
gaggcuaguagguuuuuaagac

SEQ ID NO: 633 - RNA, 22 nt, Human
gagguagagguugcagugaguc

SEQ ID NO: 634 - RNA, 22 nt, Human
gagguagagguugcagugagug

SEQ ID NO: 635 - RNA, 22 nt, Human
gaggucaccugacucugcuugu

SEQ ID NO: 636 - RNA, 22 nt, Human
gaggucacuguuggaugucaga

SEQ ID NO: 637 - RNA, 22 nt, Human
gaggugaagaauaacguacaag

SEQ ID NO: 638 - RNA, 22 nt, Human
gaggugaagaucuuggagucug

SEQ ID NO: 639 - RNA, 22 nt, Human
gagguuugagccuucuccugcu

SEQ ID NO: 640 - RNA, 22 nt, Human
gaguaacagcacucacuggagu

SEQ ID NO: 641 - RNA, 22 nt, Human
gaucagauuuccuuauuuaucu

SEQ ID NO: 642 - RNA, 22 nt, Human
gauggcagcuggagguggagca

SEQ ID NO: 643 - RNA, 22 nt, Human
gauuccuccucuuuaaaauggu

SEQ ID NO: 644 - RNA, 22 nt, Human
gauucugagaaacacaccagga

SEQ ID NO: 645 - RNA, 22 nt, Human
gauugcuugagcccuggagguu

SEQ ID NO: 646 - RNA, 22 nt, Human
gauuuucauaggagcagaaacc

SEQ ID NO: 647 - RNA, 22 nt, Human
gcaacacugauuauggcuagca

SEQ ID NO: 648 - RNA, 22 nt, Human
gcaagugcugucauauggaaga

SEQ ID NO: 649 - RNA, 22 nt, Human
gcacacaccuccuugcaguggc

SEQ ID NO: 650 - RNA, 22 nt, Human
gcacagaaaugucuacacaugu

SEQ ID NO: 651 - RNA, 22 nt, Human
gcacauucccgcaggguguaag

SEQ ID NO: 652 - RNA, 22 nt, Human
gcacucaagccuggguuacaga

SEQ ID NO: 653 - RNA, 22 nt, Human
gcagagaggaaggcuaugaaac

SEQ ID NO: 654 - RNA, 22 nt, Human
gcagcaggcagggccaggcagg

SEQ ID NO: 655 - RNA, 22 nt, Human
gcagcgcugagaugauuuguug

SEQ ID NO: 656 - RNA, 22 nt, Human
gcagcuguuuauuuagaaccug

SEQ ID NO: 657 - RNA, 22 nt, Human
gcaggaugguuggacugaaggg

SEQ ID NO: 658 - RNA, 22 nt, Human
gcaggcugguuggugaggcaaa

SEQ ID NO: 659 - RNA, 22 nt, Human
gcaggugugcaaaucacaacuu

SEQ ID NO: 660 - RNA, 22 nt, Human
gcagugaaggaggcaugugauc

SEQ ID NO: 661 - RNA, 22 nt, Human
gccaggaugaagaggaggagaa

SEQ ID NO: 662 - RNA, 22 nt, Human
gccauugcacuccagccuggac

SEQ ID NO: 663 - RNA, 22 nt, Human
gcccaggagucugaggcuggag

SEQ ID NO: 664 - RNA, 22 nt, Human
gccuggaugugaccacccucac

SEQ ID NO: 665 - RNA, 22 nt, Human
gccuguaaucccagcuacuugg

SEQ ID NO: 666 - RNA, 22 nt, Human
gccuuuccuccagaacugcucc

SEQ ID NO: 667 - RNA, 22 nt, Human
gcguccaaucaggagggagcuc

SEQ ID NO: 668 - RNA, 22 nt, Human
gcucccuugucuagggcgugga

SEQ ID NO: 669 - RNA, 22 nt, Human
gcugaauuuugacuccaucucc

SEQ ID NO: 670 - RNA, 22 nt, Human
gcugagaccacccuugccugcc

SEQ ID NO: 671 - RNA, 22 nt, Human
gcugcuccugcucucccucucc

SEQ ID NO: 672 - RNA, 22 nt, Human
gcugcugccucaacauuuuagg

SEQ ID NO: 673 - RNA, 22 nt, Human
gcugugguucugcaugaagaca

SEQ ID NO: 674 - RNA, 22 nt, Human
gcuguguuaacuguucaaacuc

SEQ ID NO: 675 - RNA, 22 nt, Human
ggaaaacaaguaccccuggaac

SEQ ID NO: 676 - RNA, 22 nt, Human
ggaaaguuaaagauguauguau

SEQ ID NO: 677 - RNA, 22 nt, Human
ggaagcauguaagaaugcguuu

SEQ ID NO: 678 - RNA, 22 nt, Human
ggaauggauggaagugugugag

SEQ ID NO: 679 - RNA, 22 nt, Human
ggacugagacaugauuaacuug

SEQ ID NO: 680 - RNA, 22 nt, Human
ggacugcagucacacucuaaga

SEQ ID NO: 681 - RNA, 22 nt, Human
ggagcuguaacagaucuguucu

SEQ ID NO: 682 - RNA, 22 nt, Human
ggaggaggugugaagaaaugaa

SEQ ID NO: 683 - RNA, 22 nt, Human
ggaguaugagagagaaugggac

SEQ ID NO: 684 - RNA, 22 nt, Human
ggaguguaaagaaggauguuac

SEQ ID NO: 685 - RNA, 22 nt, Human
ggaucaauccaccguugaucac

SEQ ID NO: 686 - RNA, 22 nt, Human
ggcaaaaaaauagagcagaggg

SEQ ID NO: 687 - RNA, 22 nt, Human
ggcaaggaagaaagcagaaguu

SEQ ID NO: 688 - RNA, 22 nt, Human
ggcacagugaagcuguguuugg

SEQ ID NO: 689 - RNA, 22 nt, Human
ggcacugagaagcaaacaggau

SEQ ID NO: 690 - RNA, 22 nt, Human
ggcagcacauaauguaucauga

SEQ ID NO: 691 - RNA, 22 nt, Human
ggcagcugugcagagugggggu

SEQ ID NO: 692 - RNA, 22 nt, Human
ggcaggauggagcagggcuaaa

SEQ ID NO: 693 - RNA, 22 nt, Human
ggcaguguaguuagcugauugc

SEQ ID NO: 694 - RNA, 22 nt, Human
ggcaugauucagcagaggagag

SEQ ID NO: 695 - RNA, 22 nt, Human
ggccagaacaggagcaguuauu

SEQ ID NO: 696 - RNA, 22 nt, Human
ggccaggacucuugcagaacug

SEQ ID NO: 697 - RNA, 22 nt, Human
ggccccuuugugaggcacgcuu

SEQ ID NO: 698 - RNA, 22 nt, Human
ggccucagaagcugaggggaga

SEQ ID NO: 699 - RNA, 22 nt, Human
ggcgugaucuuggcucaccaca

SEQ ID NO: 700 - RNA, 22 nt, Human
ggcuagaaagccagagagacag

SEQ ID NO: 701 - RNA, 22 nt, Human
ggcugacuucaccaucuacuga

SEQ ID NO: 702 - RNA, 22 nt, Human
ggcugcagugaacuaugaucgu

SEQ ID NO: 703 - RNA, 22 nt, Human
ggcugcagugcaacucuuucua

SEQ ID NO: 704 - RNA, 22 nt, Human
ggcugggcaugguggcucacgc

SEQ ID NO: 705 - RNA, 22 nt, Human
gggaaaucugcuuccuagggcu

SEQ ID NO: 706 - RNA, 22 nt, Human
gggagaaaaggaggggauacag

SEQ ID NO: 707 - RNA, 22 nt, Human
gggcaugaugauggcacuagcg

SEQ ID NO: 708 - RNA, 22 nt, Human
gggccaugacagggagauaggc

SEQ ID NO: 709 - RNA, 22 nt, Human
gggggaucauuauaaaaauacu

SEQ ID NO: 710 - RNA, 22 nt, Human
gggucucaaaugagggacauuu

SEQ ID NO: 711 - RNA, 22 nt, Human
gguccagacuggaguauagugc

SEQ ID NO: 712 - RNA, 22 nt, Human
ggugacagagacucugccucga

SEQ ID NO: 713 - RNA, 22 nt, Human
ggugaugcauuuaaaagggcag

SEQ ID NO: 714 - RNA, 22 nt, Human
gguggguuuccuuaauggcauc

SEQ ID NO: 715 - RNA, 22 nt, Human
guaaagaaaucauaaaagucca

SEQ ID NO: 716 - RNA, 22 nt, Human
guaacaaaaugaauaauaccug

SEQ ID NO: 717 - RNA, 22 nt, Human
guacuccagccugccuggguaa

SEQ ID NO: 718 - RNA, 22 nt, Human
guauguguggguuucucagccu

SEQ ID NO: 719 - RNA, 22 nt, Human
gucaccaggcagaauucagaua

SEQ ID NO: 720 - RNA, 22 nt, Human
gucagcaaggagggguggacaa

SEQ ID NO: 721 - RNA, 22 nt, Human
gucuggaggcuggaaccuggug

SEQ ID NO: 722 - RNA, 22 nt, Human
gucuuccagccuccaucuuucu

SEQ ID NO: 723 - RNA, 22 nt, Human
gugaagaaguugcuucauccuu

SEQ ID NO: 724 - RNA, 22 nt, Human
gugaagguagguuucagguuug

SEQ ID NO: 725 - RNA, 22 nt, Human
gugaauagcgagagggcccucu

SEQ ID NO: 726 - RNA, 22 nt, Human
gugagugugaaugggugugcgc

SEQ ID NO: 727 - RNA, 22 nt, Human
gugauuaaauuaaggcucuuga

SEQ ID NO: 728 - RNA, 22 nt, Human
gugcauuuguaguuaaaugugu

SEQ ID NO: 729 - RNA, 22 nt, Human
gugcucaucuucuguaacuguu

SEQ ID NO: 730 - RNA, 22 nt, Human
gugcuggugcucuuggaguaug

SEQ ID NO: 731 - RNA, 22 nt, Human
guggcaagugaccagaugucac

SEQ ID NO: 732 - RNA, 22 nt, Human
guggcaccauuggagucuaagg

SEQ ID NO: 733 - RNA, 22 nt, Human
guggcauuggugguggcauugg

SEQ ID NO: 734 - RNA, 22 nt, Human
gugggcaaaacacugcuuccaa

SEQ ID NO: 735 - RNA, 22 nt, Human
gugggcugagaaaggcugccca

SEQ ID NO: 736 - RNA, 22 nt, Human
guguauggaagugaaggauugg

SEQ ID NO: 737 - RNA, 22 nt, Human
guguauguguguaugucugugu

SEQ ID NO: 738 - RNA, 22 nt, Human
gugucucuguuguggcagucau

SEQ ID NO: 739 - RNA, 22 nt, Human
gugugcacaacagaguguggug

SEQ ID NO: 740 - RNA, 22 nt, Human
gugugggcagggccgugcuccc

SEQ ID NO: 741 - RNA, 22 nt, Human
guguuuuuccaaaugacaucca

SEQ ID NO: 742 - RNA, 22 nt, Human
guuaggaaaugugcuuacuggg

SEQ ID NO: 743 - RNA, 22 nt, Human
guuauugucagggucucccuuu

SEQ ID NO: 744 - RNA, 22 nt, Human
guucaguaauaugccagggguu

SEQ ID NO: 745 - RNA, 22 nt, Human
guucaguuguuuuaaaggccac

SEQ ID NO: 746 - RNA, 22 nt, Human
guuccagcugguuaucggagug

SEQ ID NO: 747 - RNA, 22 nt, Human
guucuggagcccauacucacca

SEQ ID NO: 748 - RNA, 22 nt, Human
guugggguuucaguggcaguca

SEQ ID NO: 749 - RNA, 22 nt, Human
guuguguggaagaugcuuugcc

SEQ ID NO: 750 - RNA, 22 nt, Human
guuuuaggcaacauaggaagac

SEQ ID NO: 751 - RNA, 22 nt, Human
guuuugagacagagucucgcuc

SEQ ID NO: 752 - RNA, 22 nt, Human
uaaagaauggguggcugggcug

SEQ ID NO: 753 - RNA, 22 nt, Human
uaacuggccuuggaaccuguag

SEQ ID NO: 754 - RNA, 22 nt, Human
uaagaagagaaagaagaggcug

SEQ ID NO: 755 - RNA, 22 nt, Human
uaagaguagaggcuuugagaua

SEQ ID NO: 756 - RNA, 22 nt, Human
uaagauguuugcauuucagcac

SEQ ID NO: 757 - RNA, 22 nt, Human
uaagccauguccuguugugggc

SEQ ID NO: 758 - RNA, 22 nt, Human
uaagcuacuacuuucaggcugu

SEQ ID NO: 759 - RNA, 22 nt, Human
uaaggacgcaaagagggcaagg

SEQ ID NO: 760 - RNA, 22 nt, Human
uaaggagcacacaaccuagauu

SEQ ID NO: 761 - RNA, 22 nt, Human
uaaggcacugcuucuaaguagg

SEQ ID NO: 762 - RNA, 22 nt, Human
uaaggcuauuccucguccuugu

SEQ ID NO: 763 - RNA, 22 nt, Human
uaagggagguuugcagucccua

SEQ ID NO: 764 - RNA, 22 nt, Human
uaaguaaagagagaagccagaa

SEQ ID NO: 765 - RNA, 21 nt, Human
uaagugaguaggcauuguucu

SEQ ID NO: 766 - RNA, 22 nt, Human
uaauauuuaagcuauaguucca

SEQ ID NO: 767 - RNA, 22 nt, Human
uacaaauguuucuucuccuuuu

SEQ ID NO: 768 - RNA, 22 nt, Human
uacaaauuccugggucuccugg

SEQ ID NO: 769 - RNA, 21 nt, Human
uacaagugcuccaguacggcc

SEQ ID NO: 770 - RNA, 22 nt, Human
uacaggcaggcacagaggcagu

SEQ ID NO: 771 - RNA, 22 nt, Human
uacagguccuaucucuggucaa

SEQ ID NO: 772 - RNA, 22 nt, Human
uacaguaucuguaaaaacuguc

SEQ ID NO: 773 - RNA, 22 nt, Human
uacaguucugguuucuucuuua

SEQ ID NO: 774 - RNA, 22 nt, Human
uaccagugucagcuuccugugu

SEQ ID NO: 775 - RNA, 22 nt, Human
uacccauucuugauuuagauga

SEQ ID NO: 776 - RNA, 22 nt, Human
uacgcugugcugugacauggua

SEQ ID NO: 777 - RNA, 22 nt, Human
uacucagaaauuacugacggca

SEQ ID NO: 778 - RNA, 22 nt, Human
uacucauuuaugcauuguuuug

SEQ ID NO: 779 - RNA, 22 nt, Human
uacugaguauguauuugcuaug

SEQ ID NO: 780 - RNA, 22 nt, Human
uacugcauuuuacgaagaagau

SEQ ID NO: 781 - RNA, 22 nt, Human
uagaaagcuaacaagcuagaga

SEQ ID NO: 782 - RNA, 22 nt, Human
uagaaagugucucauuuuaaua

SEQ ID NO: 783 - RNA, 22 nt, Human
uagacugaggcuuccugcaggg

SEQ ID NO: 784 - RNA, 22 nt, Human
uagagcaccuguugugugugca

SEQ ID NO: 785 - RNA, 22 nt, Human
uagauggguuacucagaugacu

SEQ ID NO: 786 - RNA, 22 nt, Human
uagcaaccuuaauauuuuacag

SEQ ID NO: 787 - RNA, 22 nt, Human
uagcaccaauugagaaccacug

SEQ ID NO: 788 - RNA, 22 nt, Human
uagcaccuucugaaauaacgug

SEQ ID NO: 789 - RNA, 22 nt, Human
uagcagaucugugacuccuaug

SEQ ID NO: 790 - RNA, 22 nt, Human
uaggaaguauuuuuuaaaaaca

SEQ ID NO: 791 - RNA, 22 nt, Human
uaggagugaaaauaaacucugu

SEQ ID NO: 792 - RNA, 22 nt, Human
uagggaaugaacaaauagaggc

SEQ ID NO: 793 - RNA, 22 nt, Human
uagguugugcgcuccuuaugag

SEQ ID NO: 794 - RNA, 22 nt, Human
uaguaguuagaggcugcaguga

SEQ ID NO: 795 - RNA, 22 nt, Human
uagugcaagguuuugccaacuu

SEQ ID NO: 796 - RNA, 22 nt, Human
uagugcaguugaaugaacauuu

SEQ ID NO: 797 - RNA, 22 nt, Human
uaguuguuugggauugguagug

SEQ ID NO: 798 - RNA, 22 nt, Human
uaucgcuugagcccaggaguuu

SEQ ID NO: 799 - RNA, 22 nt, Human
uaucucuugccuugaccuccua

SEQ ID NO: 800 - RNA, 22 nt, Human
uaucuggucuuaacucugauug

SEQ ID NO: 801 - RNA, 22 nt, Human
uaugaauguaaggaauguggga

SEQ ID NO: 802 - RNA, 22 nt, Human
uaugacaauuggaagaguagau

SEQ ID NO: 803 - RNA, 22 nt, Human
uaugguaggcuguaucaucuag

SEQ ID NO: 804 - RNA, 22 nt, Human
uaugucacuccuuugcccagac

SEQ ID NO: 805 - RNA, 22 nt, Human
uaugugaauuuucuuccuggca

SEQ ID NO: 806 - RNA, 22 nt, Human
uauuagacaucuuguggcuuga

SEQ ID NO: 807 - RNA, 22 nt, Human
uauuuguuuuuaaugcugggug

SEQ ID NO: 808 - RNA, 22 nt, Human
ucaaagcugcagauugccugug

SEQ ID NO: 809 - RNA, 22 nt, Human
ucaacuaugauuaccaaagcag

SEQ ID NO: 810 - RNA, 22 nt, Human
ucaacugcucucccuccuucau

SEQ ID NO: 811 - RNA, 22 nt, Human
ucaagcaauucucgugccucag

SEQ ID NO: 812 - RNA, 22 nt, Human
ucaagcgauucucaugccuuag

SEQ ID NO: 813 - RNA, 22 nt, Human
ucaaguaauccaggauaggcug

SEQ ID NO: 814 - RNA, 22 nt, Human
ucacacggcucaaagagggucc

SEQ ID NO: 815 - RNA, 22 nt, Human
ucacacuggugaguauaaaugu

SEQ ID NO: 816 - RNA, 22 nt, Human
ucacagugauggguucaggaau

SEQ ID NO: 817 - RNA, 22 nt, Human
ucacaguugagagaagguucug

SEQ ID NO: 818 - RNA, 22 nt, Human
ucacauccucccacuucaagug

SEQ ID NO: 819 - RNA, 22 nt, Human
ucaccuguucaacagcaauaau

SEQ ID NO: 820 - RNA, 22 nt, Human
ucacggucauuagcucauggug

SEQ ID NO: 821 - RNA, 22 nt, Human
ucacugcaaccuccgccugccg

SEQ ID NO: 822 - RNA, 22 nt, Human
ucacuguaaacucaaacuccug

SEQ ID NO: 823 - RNA, 22 nt, Human
ucacuugccuagggucacacag

SEQ ID NO: 824 - RNA, 22 nt, Human
ucagagcagugccgaagcccag

SEQ ID NO: 825 - RNA, 22 nt, Human
ucagaguaggcuugauguaauc

SEQ ID NO: 826 - RNA, 22 nt, Human
ucagccuaauacaggaaaagcu

SEQ ID NO: 827 - RNA, 22 nt, Human
ucaggcaauucacauuccuuca

SEQ ID NO: 828 - RNA, 22 nt, Human
ucaggcugaggucaucugcauc

SEQ ID NO: 829 - RNA, 22 nt, Human
ucagguuccugauuggaguucu

SEQ ID NO: 830 - RNA, 22 nt, Human
ucaguagcugucaaaacuggag

SEQ ID NO: 831 - RNA, 22 nt, Human
ucagucguuucucucucccagc

SEQ ID NO: 832 - RNA, 22 nt, Human
ucagugcaaacuaagcagggca

SEQ ID NO: 833 - RNA, 22 nt, Human
ucauauugagccuccuacugaa

SEQ ID NO: 834 - RNA, 22 nt, Human
ucauccuuuucugcaaccuguu

SEQ ID NO: 835 - RNA, 22 nt, Human
ucauugcaaccuccaccuccug

SEQ ID NO: 836 - RNA, 22 nt, Human
ucauugguugcauaauuugauc

SEQ ID NO: 837 - RNA, 22 nt, Human
uccaaaauuaaagguuguagaa

SEQ ID NO: 838 - RNA, 22 nt, Human
uccaguacaggucucucauuuc

SEQ ID NO: 839 - RNA, 22 nt, Human
uccagucuggugagaguguuaa

SEQ ID NO: 840 - RNA, 22 nt, Human
uccagugaaacaggucucuuug

SEQ ID NO: 841 - RNA, 22 nt, Human
uccagugauucucgagggcaga

SEQ ID NO: 842 - RNA, 22 nt, Human
uccaugugaccaaccuccagua

SEQ ID NO: 843 - RNA, 22 nt, Human
uccauugcacuccagucugggc

SEQ ID NO: 844 - RNA, 22 nt, Human
ucccaucauucucuuaacaucu

SEQ ID NO: 845 - RNA, 22 nt, Human
uccccaagccuuguaccagcgu

SEQ ID NO: 846 - RNA, 22 nt, Human
ucccgugugaaaauuuguaugc

SEQ ID NO: 847 - RNA, 22 nt, Human
ucccugagcccugaaggguguu

SEQ ID NO: 848 - RNA, 22 nt, Human
ucccugggacaacuuucuuauu

SEQ ID NO: 849 - RNA, 22 nt, Human
ucccuuugaagccagguuccag

SEQ ID NO: 850 - RNA, 22 nt, Human
uccucaucuuugagucccagcg

SEQ ID NO: 851 - RNA, 22 nt, Human
uccuuaggaccuagagguagua

SEQ ID NO: 852 - RNA, 22 nt, Human
uccuuuggacaugggcaagggu

SEQ ID NO: 853 - RNA, 22 nt, Human
ucgggcuuuuacgaaaggcaug

SEQ ID NO: 854 - RNA, 22 nt, Human
ucuaacacugacuucuauucca

SEQ ID NO: 855 - RNA, 22 nt, Human
ucuagcucccaguguccuaagu

SEQ ID NO: 856 - RNA, 22 nt, Human
ucuagugcacacagaacuugaa

SEQ ID NO: 857 - RNA, 22 nt, Human
ucucacacucugauuucuugcu

SEQ ID NO: 858 - RNA, 22 nt, Human
ucucaguuuccucugcaaacag

SEQ ID NO: 859 - RNA, 22 nt, Human
ucucauauagcuggguugcagc

SEQ ID NO: 860 - RNA, 22 nt, Human
ucucuaagacaaaggagaaguc

SEQ ID NO: 861 - RNA, 22 nt, Human
ucugagcccaggaguuugaggc

SEQ ID NO: 862 - RNA, 22 nt, Human
ucugagugggaacucucaugac

SEQ ID NO: 863 - RNA, 22 nt, Human
ucugcugugauggacacuugua

SEQ ID NO: 864 - RNA, 22 nt, Human
ucuggcccugcuaggcccaaag

SEQ ID NO: 865 - RNA, 22 nt, Human
ucuggcuccugaguccuagcuc

SEQ ID NO: 866 - RNA, 22 nt, Human
ucugguuuuaauccugaaggca

SEQ ID NO: 867 - RNA, 22 nt, Human
ucugucauuuuucucuuuccau

SEQ ID NO: 868 - RNA, 22 nt, Human
ucugugcuagagagugguaacc

SEQ ID NO: 869 - RNA, 22 nt, Human
ucuuccauuccccuccuacgcc

SEQ ID NO: 870 - RNA, 22 nt, Human
ucuugggauagugucucauggc

SEQ ID NO: 871 - RNA, 22 nt, Human
ucuuggugcuuuugcuggauga

SEQ ID NO: 872 - RNA, 22 nt, Human
ucuuucuuaaauggaugcauga

SEQ ID NO: 873 - RNA, 22 nt, Human
ucuuugaucucuuccggggcuu

SEQ ID NO: 874 - RNA, 22 nt, Human
ucuuuuuugggagacggagucg

SEQ ID NO: 875 - RNA, 22 nt, Human
ugaaauauuuucaagcugauua

SEQ ID NO: 876 - RNA, 22 nt, Human
ugaaggcauucuuguaucaagg

SEQ ID NO: 877 - RNA, 22 nt, Human
ugaaguaguuagguuguagcuc

SEQ ID NO: 878 - RNA, 22 nt, Human
ugacagagguacauaggaggcu

SEQ ID NO: 879 - RNA, 22 nt, Human
ugacaucgugauccgcuguccu

SEQ ID NO: 880 - RNA, 22 nt, Human
ugacccuuaggagaaucuaaug

SEQ ID NO: 881 - RNA, 22 nt, Human
ugaccucaggugauacgcccgc

SEQ ID NO: 882 - RNA, 22 nt, Human
ugacuauuuggagccaguacuc

SEQ ID NO: 883 - RNA, 22 nt, Human
ugacucaguggaagauccagag

SEQ ID NO: 884 - RNA, 22 nt, Human
ugacuggaggaagggagguaag

SEQ ID NO: 885 - RNA, 22 nt, Human
ugacuguucucaaaguuugaag

SEQ ID NO: 886 - RNA, 22 nt, Human
ugacuugucugguuuggcaucu

SEQ ID NO: 887 - RNA, 22 nt, Human
ugacuuugaacagggaauuucu

SEQ ID NO: 888 - RNA, 22 nt, Human
ugagaucaucguuacaagcagc

SEQ ID NO: 889 - RNA, 22 nt, Human
ugagcucugaucuugccaccac

SEQ ID NO: 890 - RNA, 22 nt, Human
ugaggacaggagguugugaguu

SEQ ID NO: 891 - RNA, 22 nt, Human
ugaggaggugcuaccagcgucu

SEQ ID NO: 892 - RNA, 22 nt, Human
ugaggagugugaaagagagccu

SEQ ID NO: 893 - RNA, 22 nt, Human
ugaggcaggaguuggcaagagg

SEQ ID NO: 894 - RNA, 22 nt, Human
ugagggggaaggugugugugug

SEQ ID NO: 895 - RNA, 22 nt, Human
ugaggugaucagcaagguggag

SEQ ID NO: 896 - RNA, 22 nt, Human
ugagguuaguaguuugagacca

SEQ ID NO: 897 - RNA, 22 nt, Human
ugaguauucaccaggugcuggg

SEQ ID NO: 898 - RNA, 22 nt, Human
ugauacguuacaauuccccugu

SEQ ID NO: 899 - RNA, 22 nt, Human
ugauauauaaucagcccaugau

SEQ ID NO: 900 - RNA, 22 nt, Human
ugauauguguuugacauccccc

SEQ ID NO: 901 - RNA, 22 nt, Human
ugaucuaguagguggaauaguc

SEQ ID NO: 902 - RNA, 22 nt, Human
ugaugcuugagcacaguaccuc

SEQ ID NO: 903 - RNA, 22 nt, Human
ugauggaggaaauggugguauc

SEQ ID NO: 904 - RNA, 22 nt, Human
ugauggaggaaggaggggaaug

SEQ ID NO: 905 - RNA, 22 nt, Human
ugauuggcaaugguuaugacgg

SEQ ID NO: 906 - RNA, 22 nt, Human
ugauuguccaaacgcaauucuu

SEQ ID NO: 907 - RNA, 22 nt, Human
ugcaccaaugcacuccagccug

SEQ ID NO: 908 - RNA, 22 nt, Human
ugcaccacuacacuccuaggca

SEQ ID NO: 909 - RNA, 22 nt, Human
ugcaccacugcacuccagccug

SEQ ID NO: 910 - RNA, 22 nt, Human
ugcaccacugcacucuaaccug

SEQ ID NO: 911 - RNA, 22 nt, Human
ugcagauacauguguaacugaa

SEQ ID NO: 912 - RNA, 22 nt, Human
ugcagccuugaacucuuucugg

SEQ ID NO: 913 - RNA, 22 nt, Human
ugcaugaugcugagguuuggga

SEQ ID NO: 914 - RNA, 22 nt, Human
ugcaugcucuucaugagaaucu

SEQ ID NO: 915 - RNA, 22 nt, Human
ugccuaggcaggacggaaugca

SEQ ID NO: 916 - RNA, 22 nt, Human
ugcgccccuguacucugggcaa

SEQ ID NO: 917 - RNA, 22 nt, Human
ugcuagguuuuuuccuuucccc

SEQ ID NO: 918 - RNA, 22 nt, Human
ugcucuugcucuuucuucugga

SEQ ID NO: 919 - RNA, 22 nt, Human
ugcugugcuaaaggaaggauua

SEQ ID NO: 920 - RNA, 22 nt, Human
uggaaagcuugaucugacgcuc

SEQ ID NO: 921 - RNA, 22 nt, Human
uggaagaauaggcaguauugga

SEQ ID NO: 922 - RNA, 22 nt, Human
uggaaugacagaagaugagagc

SEQ ID NO: 923 - RNA, 22 nt, Human
uggaaugaggaagggugugguc

SEQ ID NO: 924 - RNA, 22 nt, Human
uggaaugauauguacacuguag

SEQ ID NO: 925 - RNA, 22 nt, Human
uggaauggcugaagacugugaa

SEQ ID NO: 926 - RNA, 22 nt, Human
uggacaaugaaacccugaccuu

SEQ ID NO: 927 - RNA, 22 nt, Human
uggagaaauuauauuuuacuaa

SEQ ID NO: 928 - RNA, 22 nt, Human
uggagaauuaaaaaggguagug

SEQ ID NO: 929 - RNA, 22 nt, Human
uggagaccugugugguuugugg

SEQ ID NO: 930 - RNA, 22 nt, Human
uggagagaaagcgaagauguag

SEQ ID NO: 931 - RNA, 22 nt, Human
uggagagauaagccaaguaucc

SEQ ID NO: 932 - RNA, 22 nt, Human
uggagagauagugauuuagcuc

SEQ ID NO: 933 - RNA, 22 nt, Human
uggagcagaaaggcaggagucc

SEQ ID NO: 934 - RNA, 22 nt, Human
uggaggcaggugcagauggagg

SEQ ID NO: 935 - RNA, 22 nt, Human
uggaguaaaaugucagguguuu

SEQ ID NO: 936 - RNA, 22 nt, Human
uggcaaggugugggcuagagau

SEQ ID NO: 937 - RNA, 22 nt, Human
uggcacagaucagcagaacagg

SEQ ID NO: 938 - RNA, 22 nt, Human
uggcacauaguaaguguucagu

SEQ ID NO: 939 - RNA, 20 nt, Human
uggcaccugcccucacagag

SEQ ID NO: 940 - RNA, 22 nt, Human
uggcaggauuccugggauuuca

SEQ ID NO: 941 - RNA, 22 nt, Human
uggcagguaagccaccagcauc

SEQ ID NO: 942 - RNA, 22 nt, Human
uggcaucauccacauagaauga

SEQ ID NO: 943 - RNA, 22 nt, Human
uggcucugucuauugggaugug

SEQ ID NO: 944 - RNA, 22 nt, Human
uggcucugugcuucuaguaucu

SEQ ID NO: 945 - RNA, 22 nt, Human
ugggaugauguuaaacguacuc

SEQ ID NO: 946 - RNA, 22 nt, Human
ugggguuucuccauguugguca

SEQ ID NO: 947 - RNA, 22 nt, Human
uggguuagugguugaauaguuu

SEQ ID NO: 948 - RNA, 22 nt, Human
uggucucuugaaagaggcucuu

SEQ ID NO: 949 - RNA, 22 nt, Human
ugguuuggugacagaaagguaa

SEQ ID NO: 950 - RNA, 22 nt, Human
uguaaacaucccacacacucag

SEQ ID NO: 951 - RNA, 22 nt, Human
uguaggugguugagagaaugaa

SEQ ID NO: 952 - RNA, 22 nt, Human
ugucacacuuggugguuuuggu

SEQ ID NO: 953 - RNA, 22 nt, Human
ugucaguuugucaaauacccca

SEQ ID NO: 954 - RNA, 22 nt, Human
ugucaguuuuuuaaauacucag

SEQ ID NO: 955 - RNA, 22 nt, Human
ugucauauagaauguucuauga

SEQ ID NO: 956 - RNA, 22 nt, Human
ugucuggaaaaccauaaggcua

SEQ ID NO: 957 - RNA, 22 nt, Human
ugucuucauccaggaaccacau

SEQ ID NO: 958 - RNA, 22 nt, Human
ugucuugcacugcaaacauagc

SEQ ID NO: 959 - RNA, 22 nt, Human
ugugaaggaggaagggaggagc

SEQ ID NO: 960 - RNA, 22 nt, Human
ugugacacguucauucugcaag

SEQ ID NO: 961 - RNA, 22 nt, Human
ugugacugagacaccagagggc

SEQ ID NO: 962 - RNA, 22 nt, Human
ugugagagaaauggcaaguugg

SEQ ID NO: 963 - RNA, 21 nt, Human
ugugauaguucuuuuggaggc

SEQ ID NO: 964 - RNA, 22 nt, Human
ugugcacaacaugcagguuugu

SEQ ID NO: 965 - RNA, 22 nt, Human
ugugcauagcucugggucacuu

SEQ ID NO: 966 - RNA, 22 nt, Human
ugugcugguugcccccgagggg

SEQ ID NO: 967 - RNA, 22 nt, Human
uguggcuaguuugaacugagau

SEQ ID NO: 968 - RNA, 22 nt, Human
uguggcuuaggugagcauguga

SEQ ID NO: 969 - RNA, 22 nt, Human
uguguacuugucuuaguuugcu

SEQ ID NO: 970 - RNA, 22 nt, Human
uguguuggagcagaggcagggg

SEQ ID NO: 971 - RNA, 22 nt, Human
uguuaacauuuuggcuagauag

SEQ ID NO: 972 - RNA, 22 nt, Human
uguuauuuuguccaagagagag

SEQ ID NO: 973 - RNA, 22 nt, Human
uuaaacuucccugcugccccag

SEQ ID NO: 974 - RNA, 22 nt, Human
uuaaagaucacuugacauggac

SEQ ID NO: 975 - RNA, 22 nt, Human
uuaaagcgcggcacuuccucau

SEQ ID NO: 976 - RNA, 22 nt, Human
uuaaauacucaucagcugguca

SEQ ID NO: 977 - RNA, 22 nt, Human
uuaagcucaauguaacccagag

SEQ ID NO: 978 - RNA, 22 nt, Human
uuaccauguuggccaggcuggu

SEQ ID NO: 979 - RNA, 22 nt, Human
uuacugggcuccucucagugug

SEQ ID NO: 980 - RNA, 22 nt, Human
uuaguguucaggcucaaaugaa

SEQ ID NO: 981 - RNA, 22 nt, Human
uuauacuucugccagaggacaa

SEQ ID NO: 982 - RNA, 22 nt, Human
uuauuggucaggguagauagag

SEQ ID NO: 983 - RNA, 22 nt, Human
uucaagaaagccaagauggcug

SEQ ID NO: 984 - RNA, 22 nt, Human
uucaccuucucucgaauaguag

SEQ ID NO: 985 - RNA, 22 nt, Human
uucagcaaguuuuccugacauu

SEQ ID NO: 986 - RNA, 22 nt, Human
uucaggcaccaggcacuuugcc

SEQ ID NO: 987 - RNA, 22 nt, Human
uucaggugcaucaucaaucugg

SEQ ID NO: 988 - RNA, 22 nt, Human
uuccaagccuuccccgggauca

SEQ ID NO: 989 - RNA, 22 nt, Human
uucccagaaaccugugagugug

SEQ ID NO: 990 - RNA, 22 nt, Human
uucccauuggcuaccuuugggu

SEQ ID NO: 991 - RNA, 22 nt, Human
uucccugguuauuuacuucuga

SEQ ID NO: 992 - RNA, 22 nt, Human
uucccuuacuucugacccaagc

SEQ ID NO: 993 - RNA, 22 nt, Human
uuccugguggaggcauucggag

SEQ ID NO: 994 - RNA, 22 nt, Human
uuccuucaguucagggaacccu

SEQ ID NO: 995 - RNA, 22 nt, Human
uuccuucugcauugugagaaaa

SEQ ID NO: 996 - RNA, 22 nt, Human
uucuacuagugguugauggccu

SEQ ID NO: 997 - RNA, 22 nt, Human
uucucaauaaucuuagaggucu

SEQ ID NO: 998 - RNA, 22 nt, Human
uucucauuggcccacaggggua

SEQ ID NO: 999 - RNA, 22 nt, Human
uucuccaccaucauccaggggc

SEQ ID NO: 1000 - RNA, 22 nt, Human
uucucccugcccacacauccag

SEQ ID NO: 1001 - RNA, 22 nt, Human
uucugccacugcauuccagccu

SEQ ID NO: 1002 - RNA, 22 nt, Human
uugaaugccauacccaccagaa

SEQ ID NO: 1003 - RNA, 22 nt, Human
uugacagaaauguauuugcaug

SEQ ID NO: 1004 - RNA, 22 nt, Human
uugagcaaaauaucugguuuca

SEQ ID NO: 1005 - RNA, 22 nt, Human
uugagcacaguuugaggagugu

SEQ ID NO: 1006 - RNA, 22 nt, Human
uugaucacagcuacuuuugucc

SEQ ID NO: 1007 - RNA, 22 nt, Human
uugaugaaugggugcuccagga

SEQ ID NO: 1008 - RNA, 22 nt, Human
uugcaauagugaaaaaacugaa

SEQ ID NO: 1009 - RNA, 22 nt, Human
uugcacuccagccuggguaaca

SEQ ID NO: 1010 - RNA, 22 nt, Human
uugcacuccagucugggugaca

SEQ ID NO: 1011 - RNA, 22 nt, Human
uugcccaggcuagagugcagug

SEQ ID NO: 1012 - RNA, 22 nt, Human
uugccuaggcuggagugcagug

SEQ ID NO: 1013 - RNA, 22 nt, Human
uugcucaggcuggagugcagug

SEQ ID NO: 1014 - RNA, 22 nt, Human
uugcuugguuguauaucuuaga

SEQ ID NO: 1015 - RNA, 22 nt, Human
uuggugcaaauggcauuuccau

SEQ ID NO: 1016 - RNA, 22 nt, Human
uugguugcugaugagcuuugag

SEQ ID NO: 1017 - RNA, 22 nt, Human
uugucaugaucugaccaugguu

SEQ ID NO: 1018 - RNA, 22 nt, Human
uugugguuuucccaggugguag

SEQ ID NO: 1019 - RNA, 22 nt, Human
uuguugcggguggggagaggau

SEQ ID NO: 1020 - RNA, 22 nt, Human
uuguuuuagaagaaggucagaa

SEQ ID NO: 1021 - RNA, 22 nt, Human
uuuaagcuauaguuccaggccc

SEQ ID NO: 1022 - RNA, 22 nt, Human
uuuacagauggcaaagaucugg

SEQ ID NO: 1023 - RNA, 22 nt, Human
uuuagagagugaguccauguga

SEQ ID NO: 1024 - RNA, 22 nt, Human
uuucauucauuucuuucaugga

SEQ ID NO: 1025 - RNA, 22 nt, Human
uuugaaguggguccucgaaaug

SEQ ID NO: 1026 - RNA, 22 nt, Human
uuugaugcaugugaccugggau

SEQ ID NO: 1027 - RNA, 22 nt, Human
uuugcaccugagacagauagcc

SEQ ID NO: 1028 - RNA, 22 nt, Human
uuugcacuguaauaccucgguc

SEQ ID NO: 1029 - RNA, 22 nt, Human
uuugggagugaccagucaaaua

SEQ ID NO: 1030 - RNA, 22 nt, Human
uuuggggucuccccagcaugca

SEQ ID NO: 1031 - RNA, 22 nt, Human
uuuggucuaaucuucaagagga

SEQ ID NO: 1032 - RNA, 22 nt, Human
uuuguauauuugaucauuugug

SEQ ID NO: 1033 - RNA, 22 nt, Human
uuuguugucgugguucagauag

SEQ ID NO: 1034 - RNA, 22 nt, Human
uuuucaauggcugacacugucu

SEQ ID NO: 1035 - RNA, 22 nt, Human
uuuucugggcucccuuuucugc

SEQ ID NO: 1036 - RNA, 22 nt, Human
uuuugcaaauuacuaaauuucu

SEQ ID NO: 1037 - RNA, 22 nt, Human
gagcuaaggauagaggugagga

SEQ ID NO: 1038 - RNA, 22 nt, Human
gaggagggcuuucccugacuuu

SEQ ID NO: 1039 - RNA, 22 nt, Human
gaggcagcaacuggugaggcac

SEQ ID NO: 1040 - RNA, 22 nt, Human
gaggcgggaagcccacuaggag

SEQ ID NO: 1041 - RNA, 22 nt, Human
gagggaagcaugggaccaugau

SEQ ID NO: 1042 - RNA, 22 nt, Human
gaggucuguuguucagaaaaau

SEQ ID NO: 1043 - RNA, 22 nt, Human
gaggugaaggaacaaaugcuga

SEQ ID NO: 1044 - RNA, 22 nt, Human
gagguugguugcacguuguuag

SEQ ID NO: 1045 - RNA, 22 nt, Human
gaguacaaaugaagucuguggg

SEQ ID NO: 1046 - RNA, 22 nt, Human
gaguauuaccuauaucaccgug

SEQ ID NO: 1047 - RNA, 22 nt, Human
gagugagugugaucuuggcuca

SEQ ID NO: 1048 - RNA, 22 nt, Human
gaguuaagcaaagagaggaaga

SEQ ID NO: 1049 - RNA, 22 nt, Human
gauaucaugggaagguguacuu

SEQ ID NO: 1050 - RNA, 22 nt, Human
gauauguaaugcggggucugga

SEQ ID NO: 1051 - RNA, 22 nt, Human
gauggcuuucacaccgauggaa

SEQ ID NO: 1052 - RNA, 22 nt, Human
gaugugacucaggaauuccaca

SEQ ID NO: 1053 - RNA, 22 nt, Human
gauguguauuauaagggggagu

SEQ ID NO: 1054 - RNA, 22 nt, Human
gauguugaugagcuugugugca

SEQ ID NO: 1055 - RNA, 22 nt, Human
gcaagagcugcgauuacuuuug

SEQ ID NO: 1056 - RNA, 22 nt, Human
gcagcucccuauuccaugacag

SEQ ID NO: 1057 - RNA, 22 nt, Human
gcagugucagaacugaggauuc

SEQ ID NO: 1058 - RNA, 22 nt, Human
gcauuucaccaggcauucuuua

SEQ ID NO: 1059 - RNA, 22 nt, Human
gccauugcacuccagccugggc

SEQ ID NO: 1060 - RNA, 22 nt, Human
gcccuguugaccagaauuuguu

SEQ ID NO: 1061 - RNA, 22 nt, Human
gccucaguuguggccagggauu

SEQ ID NO: 1062 - RNA, 21 nt, Human
gccuccauuucuacaucucua

SEQ ID NO: 1063 - RNA, 22 nt, Human
gccuggccuuccuguguuuuac

SEQ ID NO: 1064 - RNA, 22 nt, Human
gcugagaaaaccagguuaaugg

SEQ ID NO: 1065 - RNA, 22 nt, Human
gcuggguugagcugggcugaga

SEQ ID NO: 1066 - RNA, 22 nt, Human
gcuucuccuguccccucccuac

SEQ ID NO: 1067 - RNA, 19 nt, Human
gcuugguugagagcuucca

SEQ ID NO: 1068 - RNA, 22 nt, Human
ggaagaaugugcuuuuguuguu

SEQ ID NO: 1069 - RNA, 22 nt, Human
ggacggugacucuugugucagu

SEQ ID NO: 1070 - RNA, 22 nt, Human
ggagcuguaguuuuucccacau

SEQ ID NO: 1071 - RNA, 22 nt, Human
ggaggaggaggcuggugcuggu

SEQ ID NO: 1072 - RNA, 22 nt, Human
ggaggcagugguugcagugagc

SEQ ID NO: 1073 - RNA, 22 nt, Human
ggaggugacuguuacagaucgg

SEQ ID NO: 1074 - RNA, 22 nt, Human
ggaguauaaugguaugaucuug

SEQ ID NO: 1075 - RNA, 22 nt, Human
ggaguuaugauagcaguggagg

SEQ ID NO: 1076 - RNA, 22 nt, Human
ggcaacaugcugaaaccccagc

SEQ ID NO: 1077 - RNA, 22 nt, Human
ggcaauauuccaggauaggcug

SEQ ID NO: 1078 - RNA, 22 nt, Human
ggcaccauaucugucaguggaa

SEQ ID NO: 1079 - RNA, 22 nt, Human
ggcaccaucucagcucacugga

SEQ ID NO: 1080 - RNA, 22 nt, Human
ggcagaugggacucugugccca

SEQ ID NO: 1081 - RNA, 22 nt, Human
ggcaggaucauagcucacugca

SEQ ID NO: 1082 - RNA, 22 nt, Human
ggcagugucauuagcugauugu

SEQ ID NO: 1083 - RNA, 22 nt, Human
ggcaugauggagaggguggaga

SEQ ID NO: 1084 - RNA, 22 nt, Human
ggcaugugugagcagcugcagg

SEQ ID NO: 1085 - RNA, 22 nt, Human
ggcccaggagggggagaaaggc

SEQ ID NO: 1086 - RNA, 22 nt, Human
ggccugaggucagcaguagagg

SEQ ID NO: 1087 - RNA, 22 nt, Human
ggccugguggcuguuguuuugg

SEQ ID NO: 1088 - RNA, 22 nt, Human
ggcuggagaguaaaucaggucu

SEQ ID NO: 1089 - RNA, 22 nt, Human
gggaggauccuugcucaacuua

SEQ ID NO: 1090 - RNA, 22 nt, Human
gggcgugaugucagccagaguc

SEQ ID NO: 1091 - RNA, 19 nt, Human
gggggaugauagcagccag

SEQ ID NO: 1092 - RNA, 22 nt, Human
gggguuucuguaggcacuuuau

SEQ ID NO: 1093 - RNA, 22 nt, Human
gggucaguagccuuguaaagaa

SEQ ID NO: 1094 - RNA, 22 nt, Human
ggguccaccucugucaaaggaa

SEQ ID NO: 1095 - RNA, 22 nt, Human
gguagcuagaggggagauagca

SEQ ID NO: 1096 - RNA, 22 nt, Human
gguagcuuauuaaagaaacucc

SEQ ID NO: 1097 - RNA, 22 nt, Human
gguccacaaggggagagcaggg

SEQ ID NO: 1098 - RNA, 22 nt, Human
ggugcagaucauggauagagcu

SEQ ID NO: 1099 - RNA, 22 nt, Human
gguuaugcacuacuuaugagaa

SEQ ID NO: 1100 - RNA, 22 nt, Human
gguucaauucaccggagucuca

SEQ ID NO: 1101 - RNA, 22 nt, Human
gguucucaaaugagggacauuu

SEQ ID NO: 1102 - RNA, 22 nt, Human
guaaggcuggcauuagggugag

SEQ ID NO: 1103 - RNA, 22 nt, Human
guacacauuuucauguuaccau

SEQ ID NO: 1104 - RNA, 22 nt, Human
guacaguggguguagggaccag

SEQ ID NO: 1105 - RNA, 22 nt, Human
guagacagcaagaaaaugaaga

SEQ ID NO: 1106 - RNA, 22 nt, Human
guaugcacaauuccaugacaau

SEQ ID NO: 1107 - RNA, 22 nt, Human
guauggagaucucugcccuugu

SEQ ID NO: 1108 - RNA, 22 nt, Human
guauguauuuauagauguucuu

SEQ ID NO: 1109 - RNA, 22 nt, Human
gucaagaugcuggacuagccgc

SEQ ID NO: 1110 - RNA, 22 nt, Human
gucacugcaaucaacaauacuc

SEQ ID NO: 1111 - RNA, 22 nt, Human
guccagugcucacugccgacau

SEQ ID NO: 1112 - RNA, 22 nt, Human
gucccagugagauaagccgggu

SEQ ID NO: 1113 - RNA, 22 nt, Human
guccugagaacugcuccaguua

SEQ ID NO: 1114 - RNA, 22 nt, Human
guccuggagcuguuggagaaau

SEQ ID NO: 1115 - RNA, 22 nt, Human
gucgggaggaaaagaaagaaga

SEQ ID NO: 1116 - RNA, 22 nt, Human
gucugcugucuacacuacacac

SEQ ID NO: 1117 - RNA, 22 nt, Human
gucuuccuccguccccaccucc

SEQ ID NO: 1118 - RNA, 22 nt, Human
gucuugaucuccugaccuugug

SEQ ID NO: 1119 - RNA, 22 nt, Human
gucuuguuccaguuucucagcc

SEQ ID NO: 1120 - RNA, 22 nt, Human
gugaauguuauuagguccaacc

SEQ ID NO: 1121 - RNA, 22 nt, Human
gugagaauggaggaagaacagu

SEQ ID NO: 1122 - RNA, 22 nt, Human
gugaggaagucccacugaugcu

SEQ ID NO: 1123 - RNA, 22 nt, Human
gugaggcaggaaccccaaagcc

SEQ ID NO: 1124 - RNA, 22 nt, Human
gugaucauugcuguaguuacga

SEQ ID NO: 1125 - RNA, 22 nt, Human
gugcaucaggaucugaccagau

SEQ ID NO: 1126 - RNA, 22 nt, Human
gugccacugcuccaaggcucag

SEQ ID NO: 1127 - RNA, 22 nt, Human
gugcuuccauuuccccaucugu

SEQ ID NO: 1128 - RNA, 22 nt, Human
gugcuugaccaugugguggcag

SEQ ID NO: 1129 - RNA, 22 nt, Human
gugcuuguaguugcagcuuagu

SEQ ID NO: 1130 - RNA, 22 nt, Human
guggaguucucugcuaguccua

SEQ ID NO: 1131 - RNA, 22 nt, Human
guggaucucgccauguggcucu

SEQ ID NO: 1132 - RNA, 22 nt, Human
guggccuuucuggucuguguau

SEQ ID NO: 1133 - RNA, 22 nt, Human
gugucacagauggccggaagag

SEQ ID NO: 1134 - RNA, 22 nt, Human
gugucacuuucaggagcucuaa

SEQ ID NO: 1135 - RNA, 22 nt, Human
gugugugauaaggacacagaua

SEQ ID NO: 1136 - RNA, 22 nt, Human
guguguggaaaugcagaugacc

SEQ ID NO: 1137 - RNA, 22 nt, Human
guguuauuaauaaacucuuuuu

SEQ ID NO: 1138 - RNA, 22 nt, Human
guuacagcucucaaagaagaca

SEQ ID NO: 1139 - RNA, 22 nt, Human
guucacaguucagccuguaaca

SEQ ID NO: 1140 - RNA, 22 nt, Human
guucugcugagauacgugcucu

SEQ ID NO: 1141 - RNA, 22 nt, Human
guucuucugggagaaaaauggc

SEQ ID NO: 1142 - RNA, 22 nt, Human
guugggugugagggggguccca

SEQ ID NO: 1143 - RNA, 22 nt, Human
guuuggcacugaaucauauaca

SEQ ID NO: 1144 - RNA, 22 nt, Human
guuuuguugucucuguguugua

SEQ ID NO: 1145 - RNA, 22 nt, Human
uaaaguguguaugggcaggugu

SEQ ID NO: 1146 - RNA, 22 nt, Human
uaaauacagugauucuaagauc

SEQ ID NO: 1147 - RNA, 22 nt, Human
uaagcagucuuucuucuucuuc

SEQ ID NO: 1148 - RNA, 22 nt, Human
uaaggagugguuccaauuuggg

SEQ ID NO: 1149 - RNA, 22 nt, Human
uaagggacgcccccuucucucu

SEQ ID NO: 1150 - RNA, 22 nt, Human
uaaguagcuaagcuaggauuca

SEQ ID NO: 1151 - RNA, 22 nt, Human
uaagugcugcugauuuuggaaa

SEQ ID NO: 1152 - RNA, 22 nt, Human
uaaugcucagcuggaccagugu

SEQ ID NO: 1153 - RNA, 22 nt, Human
uaauuuccugguagugaugaca

SEQ ID NO: 1154 - RNA, 22 nt, Human
uacagcucugcuucuggcucac

SEQ ID NO: 1155 - RNA, 22 nt, Human
uacaugugcccaguggcugcug

SEQ ID NO: 1156 - RNA, 22 nt, Human
uaccccgauagggagggugggg

SEQ ID NO: 1157 - RNA, 22 nt, Human
uacccugugacagucauucauc

SEQ ID NO: 1158 - RNA, 22 nt, Human
uacccugugaucaucugugugc

SEQ ID NO: 1159 - RNA, 22 nt, Human
uacuuacagaaggaagcaauug

SEQ ID NO: 1160 - RNA, 22 nt, Human
uagaguuauaugaugugcuagu

SEQ ID NO: 1161 - RNA, 22 nt, Human
uagcagcaggagcagguaacau

SEQ ID NO: 1162 - RNA, 22 nt, Human
uagcucauuuuugaaaucaguu

SEQ ID NO: 1163 - RNA, 22 nt, Human
uagcugccaggcaacaaguacg

SEQ ID NO: 1164 - RNA, 22 nt, Human
uaggcagucucaguuguugggu

SEQ ID NO: 1165 - RNA, 22 nt, Human
uaggcccauuaauaguguacau

SEQ ID NO: 1166 - RNA, 22 nt, Human
uagggggucaccuaugugggag

SEQ ID NO: 1167 - RNA, 22 nt, Human
uagggugcaugacaagaucccu

SEQ ID NO: 1168 - RNA, 22 nt, Human
uagucucaguuacucuugaggc

SEQ ID NO: 1169 - RNA, 22 nt, Human
uagugcaauggcgcgaucucgg

SEQ ID NO: 1170 - RNA, 22 nt, Human
uauaacagccagcuuggauuca

SEQ ID NO: 1171 - RNA, 22 nt, Human
uauacacaucuauccgcauaug

SEQ ID NO: 1172 - RNA, 22 nt, Human
uauaugucugguauucuugggg

SEQ ID NO: 1173 - RNA, 22 nt, Human
uaucacgugcagcuuugcugac

SEQ ID NO: 1174 - RNA, 22 nt, Human
uaugagugugaugguguuugag

SEQ ID NO: 1175 - RNA, 22 nt, Human
uaugauuguuucauuuguugga

SEQ ID NO: 1176 - RNA, 22 nt, Human
uauggaagcuguagcauuucug

SEQ ID NO: 1177 - RNA, 22 nt, Human
uauggcaaagucacugauuucc

SEQ ID NO: 1178 - RNA, 22 nt, Human
uaugugagacacuguccuaggc

SEQ ID NO: 1179 - RNA, 22 nt, Human
uauuacauucauuuugaugguu

SEQ ID NO: 1180 - RNA, 22 nt, Human
uauuaguugauuccaagggacc

SEQ ID NO: 1181 - RNA, 22 nt, Human
uauugaucugucccagccugug

SEQ ID NO: 1182 - RNA, 22 nt, Human
uauugcacuccagccugggcaa

SEQ ID NO: 1183 - RNA, 22 nt, Human
uauugcuaagaauucagguagu

SEQ ID NO: 1184 - RNA, 22 nt, Human
uauuggguuuaaagucaccguu

SEQ ID NO: 1185 - RNA, 22 nt, Human
uauuucuuguuggcuuaguuug

SEQ ID NO: 1186 - RNA, 22 nt, Human
ucacagagacuugggccucaaa

SEQ ID NO: 1187 - RNA, 22 nt, Human
ucacccaggcuggagugcagug

SEQ ID NO: 1188 - RNA, 22 nt, Human
ucacccaguguaaacagcauga

SEQ ID NO: 1189 - RNA, 22 nt, Human
ucacugcaaccuccaccucccg

SEQ ID NO: 1190 - RNA, 22 nt, Human
ucacugcaaccucugccuuccg

SEQ ID NO: 1191 - RNA, 22 nt, Human
ucacugcaaccucugcuucugg

SEQ ID NO: 1192 - RNA, 22 nt, Human
ucacuguuccuuuuuguugaga

SEQ ID NO: 1193 - RNA, 22 nt, Human
ucagagugagucccugggacua

SEQ ID NO: 1194 - RNA, 22 nt, Human
ucagucuuuuugucuauuccug

SEQ ID NO: 1195 - RNA, 22 nt, Human
ucagugcacuucaaacuuuuug

SEQ ID NO: 1196 - RNA, 22 nt, Human
ucaguugauagcagaugcuguu

SEQ ID NO: 1197 - RNA, 22 nt, Human
ucauaaacuggcaagcacuacc

SEQ ID NO: 1198 - RNA, 22 nt, Human
ucauaucauuuugaaagcugag

SEQ ID NO: 1199 - RNA, 22 nt, Human
ucaucaguggaacuuugauuag

SEQ ID NO: 1200 - RNA, 22 nt, Human
ucaucuauuaaagugggagaac

SEQ ID NO: 1201 - RNA, 22 nt, Human
uccaaaaguggagaggaauaug

SEQ ID NO: 1202 - RNA, 22 nt, Human
uccaaagacucaacaguuagac

SEQ ID NO: 1203 - RNA, 22 nt, Human
uccaaugcaccaugggugaauu

SEQ ID NO: 1204 - RNA, 22 nt, Human
uccagggugggccucagacccu

SEQ ID NO: 1205 - RNA, 22 nt, Human
uccagugauucauuugguuguu

SEQ ID NO: 1206 - RNA, 22 nt, Human
uccaguucuaccacuaccuggu

SEQ ID NO: 1207 - RNA, 22 nt, Human
uccauugucguacagcuccaaa

SEQ ID NO: 1208 - RNA, 22 nt, Human
ucccacagcuuccuagccacag

SEQ ID NO: 1209 - RNA, 22 nt, Human
ucccagucaagaucaucugaga

SEQ ID NO: 1210 - RNA, 22 nt, Human
ucccagucaucugggaugugca

SEQ ID NO: 1211 - RNA, 22 nt, Human
uccccagguucuaguccugagu

SEQ ID NO: 1212 - RNA, 22 nt, Human
uccccuggacauguuagggaca

SEQ ID NO: 1213 - RNA, 22 nt, Human
ucccucugccugcaguccugcu

SEQ ID NO: 1214 - RNA, 22 nt, Human
ucccugagacucuuuaacuucu

SEQ ID NO: 1215 - RNA, 22 nt, Human
ucccuucagagcccauggguuu

SEQ ID NO: 1216 - RNA, 22 nt, Human
uccgucauuaaugaacugcagg

SEQ ID NO: 1217 - RNA, 22 nt, Human
uccugcaugcaugccgagauga

SEQ ID NO: 1218 - RNA, 22 nt, Human
uccuucacucugcacuuaagua

SEQ ID NO: 1219 - RNA, 22 nt, Human
ucgaguugaugcuagaaugggu

SEQ ID NO: 1220 - RNA, 22 nt, Human
ucgaugagaccguaacccccag

SEQ ID NO: 1221 - RNA, 22 nt, Human
ucgugucauugccaccugggaa

SEQ ID NO: 1222 - RNA, 22 nt, Human
ucuagcucugauuuuaagggau

SEQ ID NO: 1223 - RNA, 22 nt, Human
ucucauggagggccuucagaug

SEQ ID NO: 1224 - RNA, 22 nt, Human
ucucccaaccuuuucagaucuu

SEQ ID NO: 1225 - RNA, 22 nt, Human
ucugccucccugucucacucuc

SEQ ID NO: 1226 - RNA, 21 nt, Human
ucugcugugauggacacuugu

SEQ ID NO: 1227 - RNA, 22 nt, Human
ucugcuuggacugaucauugaa

SEQ ID NO: 1228 - RNA, 22 nt, Human
ucuggauuugagaggcuuuacu

SEQ ID NO: 1229 - RNA, 22 nt, Human
ucugguuugagagacaaugaca

SEQ ID NO: 1230 - RNA, 22 nt, Human
ucugugacuguauuuucccaaa

SEQ ID NO: 1231 - RNA, 22 nt, Human
ucuuagauugagaagauguggc

SEQ ID NO: 1232 - RNA, 22 nt, Human
ucuuccccaccuucggcuugca

SEQ ID NO: 1233 - RNA, 22 nt, Human
ucuuggcaaucaauggggucuc

SEQ ID NO: 1234 - RNA, 22 nt, Human
ucuuucuacaccucugccagug

SEQ ID NO: 1235 - RNA, 22 nt, Human
ucuuucugaugggaagggucaa

SEQ ID NO: 1236 - RNA, 22 nt, Human
ucuuugcuggaaggugccuccc

SEQ ID NO: 1237 - RNA, 22 nt, Human
ucuuuuuguuguagcuguaugg

SEQ ID NO: 1238 - RNA, 22 nt, Human
ugaaaagaaugugaccugggaa

SEQ ID NO: 1239 - RNA, 22 nt, Human
ugaaaagccuuuggguagugau

SEQ ID NO: 1240 - RNA, 22 nt, Human
ugaaagagaugggacagugacu

SEQ ID NO: 1241 - RNA, 22 nt, Human
ugaaagagauguggugugugaa

SEQ ID NO: 1242 - RNA, 22 nt, Human
ugaaaguacauguucuuccucu

SEQ ID NO: 1243 - RNA, 22 nt, Human
ugaaaugcuuuuaggacacugc

SEQ ID NO: 1244 - RNA, 22 nt, Human
ugaagcaaaggauggggggccc

SEQ ID NO: 1245 - RNA, 22 nt, Human
ugacaagauacaggguagugaa

SEQ ID NO: 1246 - RNA, 22 nt, Human
ugacagagcaagaucuagauaa

SEQ ID NO: 1247 - RNA, 22 nt, Human
ugagaagagaacacagugccca

SEQ ID NO: 1248 - RNA, 22 nt, Human
ugagaagggaguagccucugau

SEQ ID NO: 1249 - RNA, 22 nt, Human
ugagacccucuuguaaauaugg

SEQ ID NO: 1250 - RNA, 22 nt, Human
ugagagagcaagugaauuuccc

SEQ ID NO: 1251 - RNA, 22 nt, Human
ugagagaggaaggccguaggga

SEQ ID NO: 1252 - RNA, 22 nt, Human
ugagaugaaccagguaucucag

SEQ ID NO: 1253 - RNA, 22 nt, Human
ugagaugaacccgguaccucag

SEQ ID NO: 1254 - RNA, 22 nt, Human
ugagauggugucauauugcugg

SEQ ID NO: 1255 - RNA, 22 nt, Human
ugagaugucuacugagaguaua

SEQ ID NO: 1256 - RNA, 22 nt, Human
ugagauucucauugggaagauc

SEQ ID NO: 1257 - RNA, 22 nt, Human
ugagcagaaaauucaauuucug

SEQ ID NO: 1258 - RNA, 22 nt, Human
ugaggaaggugugagaaaugag

SEQ ID NO: 1259 - RNA, 22 nt, Human
ugaggacagaaaguuugugcug

SEQ ID NO: 1260 - RNA, 22 nt, Human
ugaggcagaaggauuacuugag

SEQ ID NO: 1261 - RNA, 22 nt, Human
ugagggaggaaguuugggauga

SEQ ID NO: 1262 - RNA, 22 nt, Human
ugagggcaggugugaaaaugcu

SEQ ID NO: 1263 - RNA, 22 nt, Human
ugagguaaguauguuauuggaa

SEQ ID NO: 1264 - RNA, 22 nt, Human
ugagguaggaugauugcuagcu

SEQ ID NO: 1265 - RNA, 21 nt, Human
ugagguaggugcugaaacugc

SEQ ID NO: 1266 - RNA, 22 nt, Human
ugagguaggugcugaaacugcu

SEQ ID NO: 1267 - RNA, 22 nt, Human
ugaggucauguucugucagguu

SEQ ID NO: 1268 - RNA, 22 nt, Human
ugagugacagagcaacacucug

SEQ ID NO: 1269 - RNA, 22 nt, Human
ugaguguaugugugagagagaa

SEQ ID NO: 1270 - RNA, 22 nt, Human
ugaguuuaagcuaagaagucug

SEQ ID NO: 1271 - RNA, 22 nt, Human
ugaucacaggcaaaggaauaaa

SEQ ID NO: 1272 - RNA, 22 nt, Human
ugauccucuggcuucagccucc

SEQ ID NO: 1273 - RNA, 22 nt, Human
ugaugacugaaguggccuggac

SEQ ID NO: 1274 - RNA, 22 nt, Human
ugauucauuucuaaacccagcu

SEQ ID NO: 1275 - RNA, 22 nt, Human
ugauuguaugauauaugaguuu

SEQ ID NO: 1276 - RNA, 22 nt, Human
ugcaagcaacagagguucauuu

SEQ ID NO: 1277 - RNA, 22 nt, Human
ugcaagucugugauuuuguguu

SEQ ID NO: 1278 - RNA, 22 nt, Human
ugcaaguugucuucuagggugu

SEQ ID NO: 1279 - RNA, 22 nt, Human
ugcacuugucuuuacccuagag

SEQ ID NO: 1280 - RNA, 22 nt, Human
ugcagcagaccuuuugccuucu

SEQ ID NO: 1281 - RNA, 22 nt, Human
ugccagagaccaccuggaggca

SEQ ID NO: 1282 - RNA, 22 nt, Human
ugccagugcaugugagacugcc

SEQ ID NO: 1283 - RNA, 22 nt, Human
ugccugugacaugcucuguuug

SEQ ID NO: 1284 - RNA, 22 nt, Human
ugcuacauuucuucauucuugg

SEQ ID NO: 1285 - RNA, 22 nt, Human
ugcuaggcuuauucucuuccuc

SEQ ID NO: 1286 - RNA, 22 nt, Human
ugcuauucucagagcacucuau

SEQ ID NO: 1287 - RNA, 22 nt, Human
ugcugcaguagaaauuagagca

SEQ ID NO: 1288 - RNA, 22 nt, Human
ugcuguaguauguauauaguau

SEQ ID NO: 1289 - RNA, 22 nt, Human
ugcuuuaguucuucugaagugu

SEQ ID NO: 1290 - RNA, 22 nt, Human
uggaaagcauguacauuuggag

SEQ ID NO: 1291 - RNA, 22 nt, Human
uggaaugcauaagaaauugcaa

SEQ ID NO: 1292 - RNA, 22 nt, Human
uggaauugaguucccuggguuu

SEQ ID NO: 1293 - RNA, 22 nt, Human
uggagagagcagguugcuaaga

SEQ ID NO: 1294 - RNA, 22 nt, Human
uggagccuuguuguuuguucac

SEQ ID NO: 1295 - RNA, 22 nt, Human
uggaggaaguaguggcuguguu

SEQ ID NO: 1296 - RNA, 22 nt, Human
uggagugucuggaggugucucu

SEQ ID NO: 1297 - RNA, 22 nt, Human
uggauccgguugacucugucug

SEQ ID NO: 1298 - RNA, 22 nt, Human
uggauuaguaaagaagaaugaa

SEQ ID NO: 1299 - RNA, 22 nt, Human
uggcaaagaaggcaguacaguu

SEQ ID NO: 1300 - RNA, 22 nt, Human
uggcaagugggcacuuuucagg

SEQ ID NO: 1301 - RNA, 22 nt, Human
uggcagaaaaggcccaaucgcc

SEQ ID NO: 1302 - RNA, 22 nt, Human
uggcagaguggcacaaucauuu

SEQ ID NO: 1303 - RNA, 22 nt, Human
uggcagauuugguugcuguugg

SEQ ID NO: 1304 - RNA, 22 nt, Human
uggccacuuuucagaugaaacc

SEQ ID NO: 1305 - RNA, 22 nt, Human
uggcggagaggguccaugguag

SEQ ID NO: 1306 - RNA, 22 nt, Human
uggcucaguuugcucagcagug

SEQ ID NO: 1307 - RNA, 22 nt, Human
uggcuguuugggguugccgugu

SEQ ID NO: 1308 - RNA, 22 nt, Human
ugggaaaaaaggcaguuuagaa

SEQ ID NO: 1309 - RNA, 22 nt, Human
ugggaaacauccagcacauacu

SEQ ID NO: 1310 - RNA, 22 nt, Human
ugggaagaugcuggcaaggugc

SEQ ID NO: 1311 - RNA, 22 nt, Human
ugggaggcuacacguuucucca

SEQ ID NO: 1312 - RNA, 22 nt, Human
ugggcacauacugcaucauuua

SEQ ID NO: 1313 - RNA, 22 nt, Human
ugggcucauuuugcagugauuu

SEQ ID NO: 1314 - RNA, 22 nt, Human
ugggcucgcucuucagucucgg

SEQ ID NO: 1315 - RNA, 22 nt, Human
uggggcacuguggaggugucau

SEQ ID NO: 1316 - RNA, 22 nt, Human
uggggucugacccuguaggucu

SEQ ID NO: 1317 - RNA, 22 nt, Human
ugguccagaggaggaaugaggg

SEQ ID NO: 1318 - RNA, 22 nt, Human
uggucuccuauccuggcucaca

SEQ ID NO: 1319 - RNA, 22 nt, Human
ugguggggagaggcuugggaag

SEQ ID NO: 1320 - RNA, 22 nt, Human
ugguguccuaagguuuauuaca

SEQ ID NO: 1321 - RNA, 22 nt, Human
ugguuaguuuuaugggccugga

SEQ ID NO: 1322 - RNA, 22 nt, Human
uguaaacauccccgacuggaag

SEQ ID NO: 1323 - RNA, 22 nt, Human
uguaaacuugucuugaauggaa

SEQ ID NO: 1324 - RNA, 22 nt, Human
uguacaaggggcucagccagcc

SEQ ID NO: 1325 - RNA, 22 nt, Human
uguacacaacgugcagguuugu

SEQ ID NO: 1326 - RNA, 22 nt, Human
uguagcagaacacuggguccag

SEQ ID NO: 1327 - RNA, 22 nt, Human
uguagugugaaaggcauagugu

SEQ ID NO: 1328 - RNA, 22 nt, Human
uguaguuugaugcuagaacacu

SEQ ID NO: 1329 - RNA, 22 nt, Human
uguaugaagaagggaguagggc

SEQ ID NO: 1330 - RNA, 22 nt, Human
uguaugcucugugaagcuuacu

SEQ ID NO: 1331 - RNA, 22 nt, Human
ugucccagcaauucccuccaca

SEQ ID NO: 1332 - RNA, 22 nt, Human
uguccccucaacuggaguucua

SEQ ID NO: 1333 - RNA, 22 nt, Human
uguccuuuguuuugagauggag

SEQ ID NO: 1334 - RNA, 22 nt, Human
ugucuacugcacccagcggaca

SEQ ID NO: 1335 - RNA, 22 nt, Human
ugucucaguguagagacccaga

SEQ ID NO: 1336 - RNA, 22 nt, Human
ugucuggaggcgcaguuuucag

SEQ ID NO: 1337 - RNA, 22 nt, Human
ugugacucguacuuguaauccu

SEQ ID NO: 1338 - RNA, 22 nt, Human
ugugacugaggugcgcauaaag

SEQ ID NO: 1339 - RNA, 22 nt, Human
ugugccacugcacuccaugggu

SEQ ID NO: 1340 - RNA, 22 nt, Human
uguggcagaaggcucuggauua

SEQ ID NO: 1341 - RNA, 22 nt, Human
uguguaaugcugagauuugggc

SEQ ID NO: 1342 - RNA, 22 nt, Human
ugugucuguggaacagaagcag

SEQ ID NO: 1343 - RNA, 22 nt, Human
uguguuugaacaccuuggucac

SEQ ID NO: 1344 - RNA, 22 nt, Human
uuaaacuagacaaccacugaag

SEQ ID NO: 1345 - RNA, 22 nt, Human
uuaaagucaccauuuguggguu

SEQ ID NO: 1346 - RNA, 22 nt, Human
uuaaaugcucugaucuucugua

SEQ ID NO: 1347 - RNA, 22 nt, Human
uuaacugagaggaucugaguag

SEQ ID NO: 1348 - RNA, 22 nt, Human
uuaaugcuaaucgugauagggg

SEQ ID NO: 1349 - RNA, 22 nt, Human
uuaaugcuuuuugucauacuca

SEQ ID NO: 1350 - RNA, 22 nt, Human
uuaaugugugcaaaccauggug

SEQ ID NO: 1351 - RNA, 22 nt, Human
uuacaaaauuuggagggauugu

SEQ ID NO: 1352 - RNA, 22 nt, Human
uuacuacugacauccaggguga

SEQ ID NO: 1353 - RNA, 22 nt, Human
uuagaaagaauauugccagucc

SEQ ID NO: 1354 - RNA, 22 nt, Human
uuagacaucuacuugacuggau

SEQ ID NO: 1355 - RNA, 22 nt, Human
uuagauauguccccuucuauaa

SEQ ID NO: 1356 - RNA, 22 nt, Human
uuagcaguugugagacccuaga

SEQ ID NO: 1357 - RNA, 22 nt, Human
uuagggcaggcaugagagaacu

SEQ ID NO: 1358 - RNA, 22 nt, Human
uuaucaugcuuguuggcuggug

SEQ ID NO: 1359 - RNA, 22 nt, Human
uuauccuaaauguguuuugaag

SEQ ID NO: 1360 - RNA, 22 nt, Human
uuauggcuauugaugacaauug

SEQ ID NO: 1361 - RNA, 22 nt, Human
uuauuguccauaacucaauuua

SEQ ID NO: 1362 - RNA, 22 nt, Human
uucaaguauccaggggaggcuu

SEQ ID NO: 1363 - RNA, 22 nt, Human
uucacaguggcugaagcuguuc

SEQ ID NO: 1364 - RNA, 22 nt, Human
uucacauguugcucaguuuugc

SEQ ID NO: 1365 - RNA, 22 nt, Human
uucaccaaccacuccaccagcu

SEQ ID NO: 1366 - RNA, 21 nt, Human
uucacccaucuuuccacccac

SEQ ID NO: 1367 - RNA, 22 nt, Human
uucacccaucuuuccacccacg

SEQ ID NO: 1368 - RNA, 22 nt, Human
uucacugagggagugagguucu

SEQ ID NO: 1369 - RNA, 22 nt, Human
uucagcauugccaguguuucca

SEQ ID NO: 1370 - RNA, 22 nt, Human
uucaggacugucuggauuuauu

SEQ ID NO: 1371 - RNA, 22 nt, Human
uucaggacuguggacugggcug

SEQ ID NO: 1372 - RNA, 22 nt, Human
uucaguucuugaccugccccag

SEQ ID NO: 1373 - RNA, 22 nt, Human
uucauuaggccaggugcggugg

SEQ ID NO: 1374 - RNA, 22 nt, Human
uucauuuuggugaagccuuaaa

SEQ ID NO: 1375 - RNA, 22 nt, Human
uuccagauggguaggaauaccu

SEQ ID NO: 1376 - RNA, 22 nt, Human
uuccaguaguuacuccucccug

SEQ ID NO: 1377 - RNA, 22 nt, Human
uuccaguucucagcacagcgcu

SEQ ID NO: 1378 - RNA, 22 nt, Human
uuccaguuuuuccuaccccuua

SEQ ID NO: 1379 - RNA, 22 nt, Human
uuccccaugugaugcuauugcu

SEQ ID NO: 1380 - RNA, 22 nt, Human
uucccucauucuccacccaguc

SEQ ID NO: 1381 - RNA, 22 nt, Human
uucccuuaggucuggaauggua

SEQ ID NO: 1382 - RNA, 22 nt, Human
uuccugucauccucuaacucac

SEQ ID NO: 1383 - RNA, 22 nt, Human
uuccuucagcccuagcugcuuu

SEQ ID NO: 1384 - RNA, 22 nt, Human
uuccuugguuugcaagacucac

SEQ ID NO: 1385 - RNA, 22 nt, Human
uucgaauuucaugcuucuaacc

SEQ ID NO: 1386 - RNA, 22 nt, Human
uucuaguaacuucaggguaguu

SEQ ID NO: 1387 - RNA, 22 nt, Human
uucuaugauucucuaaguagca

SEQ ID NO: 1388 - RNA, 22 nt, Human
uucucuccaauuugaaauaccu

SEQ ID NO: 1389 - RNA, 22 nt, Human
uucugaguggcuuucaacacug

SEQ ID NO: 1390 - RNA, 22 nt, Human
uucuggguuuuuguggguuugc

SEQ ID NO: 1391 - RNA, 22 nt, Human
uucuggugaauucaggauggua

SEQ ID NO: 1392 - RNA, 22 nt, Human
uucugugcagguuaacauuucu

SEQ ID NO: 1393 - RNA, 22 nt, Human
uucuugcaccgcauguugagug

SEQ ID NO: 1394 - RNA, 22 nt, Human
uucuuuuuccgcuuucugagcc

SEQ ID NO: 1395 - RNA, 22 nt, Human
uugacauaaucaaguaucugua

SEQ ID NO: 1396 - RNA, 22 nt, Human
uugagaacagcugguaauucug

SEQ ID NO: 1397 - RNA, 22 nt, Human
uugagaaugcuguaauuggagg

SEQ ID NO: 1398 - RNA, 22 nt, Human
uugagacuaguaggcauagaag

SEQ ID NO: 1399 - RNA, 22 nt, Human
uugagagcauagagccaggaag

SEQ ID NO: 1400 - RNA, 22 nt, Human
uugagcacugggagaugaucac

SEQ ID NO: 1401 - RNA, 22 nt, Human
uugaggucaucuaaugguguug

SEQ ID NO: 1402 - RNA, 22 nt, Human
uugauuuuucugguggcauggu

SEQ ID NO: 1403 - RNA, 22 nt, Human
uugcaaggaaggggaggaggcu

SEQ ID NO: 1404 - RNA, 22 nt, Human
uugcacuccagccugggugaca

SEQ ID NO: 1405 - RNA, 22 nt, Human
uugcaguaacaggugugagcau

SEQ ID NO: 1406 - RNA, 22 nt, Human
uugcauaugcauggguacacag

SEQ ID NO: 1407 - RNA, 22 nt, Human
uugcccaggcuggagugcagug

SEQ ID NO: 1408 - RNA, 22 nt, Human
uugccuaggccggagugcagug

SEQ ID NO: 1409 - RNA, 22 nt, Human
uugccuggagacauuucuacug

SEQ ID NO: 1410 - RNA, 22 nt, Human
uugcuucauuagggcaagcaag

SEQ ID NO: 1411 - RNA, 22 nt, Human
uugcuuugguucaaguuaggca

SEQ ID NO: 1412 - RNA, 22 nt, Human
uuggaggcauucauuccccuca

SEQ ID NO: 1413 - RNA, 22 nt, Human
uuggauugugaaaguauucucu

SEQ ID NO: 1414 - RNA, 22 nt, Human
uugguuggugaugagcauugaa

SEQ ID NO: 1415 - RNA, 22 nt, Human
uuguaaauaacauuuuuuagca

SEQ ID NO: 1416 - RNA, 22 nt, Human
uugucagaggcugguagggugu

SEQ ID NO: 1417 - RNA, 22 nt, Human
uugugcuuguacugaccaugua

SEQ ID NO: 1418 - RNA, 22 nt, Human
uuuauuaguuguccuugguuua

SEQ ID NO: 1419 - RNA, 22 nt, Human
uuucaaaacaaagcuuucccag

SEQ ID NO: 1420 - RNA, 22 nt, Human
uuucagcaguggaagagggauc

SEQ ID NO: 1421 - RNA, 22 nt, Human
uuuccaguuguucuagaaagcu

SEQ ID NO: 1422 - RNA, 22 nt, Human
uuuccuguuuugguuuggagag

SEQ ID NO: 1423 - RNA, 22 nt, Human
uuucucccacucuaauagauga

SEQ ID NO: 1424 - RNA, 22 nt, Human
uuucuggagggcaagugcaggg

SEQ ID NO: 1425 - RNA, 22 nt, Human
uuugaggaagguuauuugcaau

SEQ ID NO: 1426 - RNA, 22 nt, Human
uuugcacacuuuccaaguugcc

SEQ ID NO: 1427 - RNA, 22 nt, Human
uuugcagcuuccaaauuucuga

SEQ ID NO: 1428 - RNA, 22 nt, Human
uuugcaguguucaucaguauuu

SEQ ID NO: 1429 - RNA, 22 nt, Human
uuuggauuccugguuccuacag

SEQ ID NO: 1430 - RNA, 22 nt, Human
uuuggcuguuugucuugggcaa

SEQ ID NO: 1431 - RNA, 22 nt, Human
uuuguaauagcaaaauacugga

SEQ ID NO: 1432 - RNA, 22 nt, Human
uuuguacgucaacucagccuua

SEQ ID NO: 1433 - RNA, 22 nt, Human
uuuguguccugacccagaggac

SEQ ID NO: 1434 - RNA, 22 nt, Human
uuuuuaucuuuuucuccagaug

SEQ ID NO: 1435 - RNA, 22 nt, Human
uuuuuguggaauauuuuuuuaa

SEQ ID NO: 1436 - RNA, 22 nt, Human
uuuuuugugagaugugaaucuu

SEQ ID NO: 1437 - RNA, 22 nt, Human
acgccgcugugggaaagcacuu

SEQ ID NO: 1438 - RNA, 22 nt, Human
agaagguuggggcuggaggucu

SEQ ID NO: 1439 - RNA, 22 nt, Human
ggccaggacucuugcagaacug

SEQ ID NO: 1440 - RNA, 22 nt, Human
uggcaagugggcacuuuucagg

SEQ ID NO: 1441 - RNA, 22 nt, Human
uggcacagaucagcagaacagg

SEQ ID NO: 1442 - RNA, 22 nt, Human
uggagcagaaaggcaggagucc

SEQ ID NO: 1443 - RNA, 22 nt, Human
uuguugcggguggggagaggau

SEQ ID NO: 1444 - RNA, 22 nt, Human
aggcaguguuguuccugauugc

SEQ ID NO: 1445 - RNA, 22 nt, Human
guccagugcucacugccgacau

SEQ ID NO: 1446 - RNA, 22 nt, Human
guugggugugagggggguccca

SEQ ID NO: 1447 - RNA, 22 nt, Human
ucccugagacucuuuaacuucu

SEQ ID NO: 1448 - RNA, 22 nt, Human
ugaggcaggaguuggcaagagg

SEQ ID NO: 1449 - RNA, 22 nt, Human
ugaggucauguucugucagguu

SEQ ID NO: 1450 - RNA, 22 nt, Human
uggaggcaggugcagauggagg

SEQ ID NO: 1451 - RNA, 22 nt, Human
ccagccugagguuccuggaggg

SEQ ID NO: 1452 - RNA, 22 nt, Human
cugaggucaggaguucgagacc

SEQ ID NO: 1453 - RNA, 22 nt, Human
cuggcucccucucuucucuccc

SEQ ID NO: 1454 - RNA, 22 nt, Human
cuggcucccaggaggccucucu

SEQ ID NO: 1455 - RNA, 22 nt, Human
cuuuggccacggggauaugaau

SEQ ID NO: 1456 - RNA, 22 nt, Human
cuuuuugggguuuggggcuugg

SEQ ID NO: 1457 - RNA, 22 nt, Human
gccuggaugugaccacccucac

SEQ ID NO: 1458 - RNA, 22 nt, Human
ggcacugagaagcaaacaggau

SEQ ID NO: 1459 - RNA, 22 nt, Human
ggccugaggucagcaguagagg

SEQ ID NO: 1460 - RNA, 22 nt, Human
gguggguuuccuuaauggcauc

SEQ ID NO: 1461 - RNA, 22 nt, Human
ugugcugguugcccccgagggg

SEQ ID NO: 1462 - RNA, 22 nt, Human
uuccugguggaggcauucggag

SEQ ID NO: 1463 - RNA, 22 nt, Human
augaccugcagucagggcccag

SEQ ID NO: 1464 - RNA, 22 nt, Human
gcuucuccuguccccucccuac

SEQ ID NO: 1465 - RNA, 22 nt, Human
gcccaggagucugaggcuggag

SEQ ID NO: 1466 - RNA, 22 nt, Human
gcugcuccugcucucccucucc

SEQ ID NO: 1467 - RNA, 22 nt, Human
aggcagguggguguaugggucu

SEQ ID NO: 1468 - RNA, 22 nt, Human
aguggcccuggcccuggggcau

SEQ ID NO: 1469 - RNA, 22 nt, Human
aaauccuggggaucuggaggga

SEQ ID NO: 1470 - RNA, 22 nt, Human
aaauccagaaucuagacugaau

SEQ ID NO: 1471 - RNA, 22 nt, Human
aagguggugucauguuuugggg

SEQ ID NO: 1472 - RNA, 22 nt, Human
agacuggccucaagcucccaga

SEQ ID NO: 1473 - RNA, 22 nt, Human
agugguuucagggacuucugua

SEQ ID NO: 1474 - RNA, 22 nt, Human
aggcacugugcaggaugauggg

SEQ ID NO: 1475 - RNA, 22 nt, Human
aggcaguguuguuccugauugc

SEQ ID NO: 1476 - RNA, 22 nt, Human
agguggcacugugugggguggg

SEQ ID NO: 1477 - RNA, 22 nt, Human
acugcagcuucagggacuugug

SEQ ID NO: 1478 - RNA, 22 nt, Human
agaggcagagguuacaguagug

SEQ ID NO: 1479 - RNA, 22 nt, Human
agcagagccaccaaauuuagug

SEQ ID NO: 1480 - RNA, 22 nt, Human
ggaggaggaggcuggugcuggu

SEQ ID NO: 1481 - RNA, 22 nt, Human
ggcccaggagggggagaaaggc

SEQ ID NO: 1482 - RNA, 22 nt, Human
ggcagugucauuagcugauugu

SEQ ID NO: 1483 - RNA, 22 nt, Human
cccaggcuggagugcaguggug

SEQ ID NO: 1484 - RNA, 22 nt, Human
cccaggagguggagguuacagu

SEQ ID NO: 1485 - RNA, 22 nt, Human
cgcuauguuggccaggcugguc

SEQ ID NO: 1486 - RNA, 22 nt, Human
cucacugcaaccuccgccuccc

SEQ ID NO: 1487 - RNA, 22 nt, Human
cuccuaggcuggagugcagugg

SEQ ID NO: 1488 - RNA, 22 nt, Human
cugugcccagccagggcugugu

SEQ ID NO: 1489 - RNA, 22 nt, Human
gaacagcuccagucuacagccc

SEQ ID NO: 1490 - RNA, 22 nt, Human
gacaugauguagcagaugaugg

SEQ ID NO: 1491 - RNA, 22 nt, Human
gagcagguuuggaauggcucca

SEQ ID NO: 1492 - RNA, 22 nt, Human
agugauuuuccugccucagccu

SEQ ID NO: 1493 - RNA, 22 nt, Human
auugcuugagcccaggaguuca

SEQ ID NO: 1494 - RNA, 22 nt, Human
cacccaggcuggagugcagugg

SEQ ID NO: 1495 - RNA, 22 nt, Human
uucagcauugccaguguuucca

SEQ ID NO: 1496 - RNA, 22 nt, Human
uguguacuugucuuaguuugcu

SEQ ID NO: 1497 - RNA, 22 nt, Human
ugucucaguguagagacccaga

SEQ ID NO: 1498 - RNA, 22 nt, Human
ugggcucauuuugcagugauuu

SEQ ID NO: 1499 - RNA, 22 nt, Human
uugaugaaugggugcuccagga

SEQ ID NO: 1500 - RNA, 22 nt, Human
uugcccaggcuggagugcagug

SEQ ID NO: 1501 - RNA, 22 nt, Human
uugccuaggccggagugcagug

SEQ ID NO: 1502 - RNA, 22 nt, Human
uugucagaggcugguagggugu

SEQ ID NO: 1503 - RNA, 22 nt, Human
uuugaaguggguccucgaaaug

SEQ ID NO: 1504 - RNA, 22 nt, Human
ggcgugaucuuggcucaccaca

SEQ ID NO: 1505 - RNA, 22 nt, Human
gguccacaaggggagagcaggg

SEQ ID NO: 1506 - RNA, 22 nt, Human
ggcaggaucauagcucacugca

SEQ ID NO: 1507 - RNA, 22 nt, Human
ggcagcugugcagagugggggu

SEQ ID NO: 1508 - RNA, 22 nt, Human
gcaggaugguuggacugaaggg

SEQ ID NO: 1509 - RNA, 22 nt, Human
gaggucacuguuggaugucaga

SEQ ID NO: 1510 - RNA, 22 nt, Human
gagguuugagccuucuccugcu

SEQ ID NO: 1511 - RNA, 22 nt, Human
gagugagugugaucuuggcuca

SEQ ID NO: 1512 - RNA, 22 nt, Human
cugcauggagguggucuaugag

SEQ ID NO: 1513 - RNA, 22 nt, Human
cagcaccaucagaugacuguau

SEQ ID NO: 1514 - RNA, 22 nt, Human
uggaguaaaaugucagguguuu

SEQ ID NO: 1515 - RNA, 22 nt, Human
uggagccuuguuguuuguucac

SEQ ID NO: 1516 - RNA, 22 nt, Human
ugaguauucaccaggugcuggg

SEQ ID NO: 1517 - RNA, 22 nt, Human
uguccuuuguuuugagauggag

SEQ ID NO: 1518 - RNA, 22 nt, Human
ugugaaggaggaagggaggagc

SEQ ID NO: 1519 - RNA, 22 nt, Human
uuaccauguuggccaggcuggu

SEQ ID NO: 1520 - RNA, 22 nt, Human
uccagugauucucgagggcaga

SEQ ID NO: 1521 - RNA, 22 nt, Human
ucagucguuucucucucccagc

SEQ ID NO: 1522 - RNA, 22 nt, Human
ucacagugauggguucaggaau

SEQ ID NO: 1523 - RNA, 22 nt, Human
ucacugcaaccuccgccugccg

SEQ ID NO: 1524 - RNA, 22 nt, Human
ucacugcaaccucugcuucugg

SEQ ID NO: 1525 - RNA, 22 nt, Human
ucugucauuuuucucuuuccau

SEQ ID NO: 1526 - RNA, 22 nt, Human
gugcaucaggaucugaccagau

SEQ ID NO: 1527 - RNA, 22 nt, Human
gugaagaaguugcuucauccuu

SEQ ID NO: 1528 - RNA, 22 nt, Human
guuguguggaagaugcuuugcc

SEQ ID NO: 1529 - RNA, 22 nt, Human
uaaugcucagcuggaccagugu

SEQ ID NO: 1530 - RNA, 22 nt, Human
uagugcaauggcgcgaucucgg

SEQ ID NO: 1531 - RNA, 22 nt, Human
gugugggcagggccgugcuccc

SEQ ID NO: 1532 - RNA, 22 nt, Human
aggugagaaaacugaggcucag

SEQ ID NO: 1533 - RNA, 22 nt, Human
uagacugaggcuuccugcaggg

SEQ ID NO: 1534 - RNA, 22 nt, Human
uuuucugggcucccuuuucugc

SEQ ID NO: 1535 - RNA, 22 nt, Human
agcaccacaacagggacugggc

SEQ ID NO: 1536 - RNA, 22 nt, Human
uugccuaggcuggagugcagug

SEQ ID NO: 1537 - RNA, 22 nt, Human
uugcucaggcuggagugcagug

SEQ ID NO: 1538 - RNA, 22 nt, Human
uucuggugaauucaggauggua

SEQ ID NO: 1539 - RNA, 22 nt, Human
uugagcacaguuugaggagugu

SEQ ID NO: 1540 - RNA, 22 nt, Human
uugcaaggaaggggaggaggcu

SEQ ID NO: 1541 - RNA, 22 nt, Human
ugacucaguggaagauccagag

SEQ ID NO: 1542 - RNA, 22 nt, Human
ugacuugucugguuuggcaucu

SEQ ID NO: 1543 - RNA, 22 nt, Human
ugauccucuggcuucagccucc

SEQ ID NO: 1544 - RNA, 22 nt, Human
ucaagcaauucucgugccucag

SEQ ID NO: 1545 - RNA, 22 nt, Human
ucacccaggcuggagugcagug

SEQ ID NO: 1546 - RNA, 22 nt, Human
ucacugcaaccuccaccucccg

SEQ ID NO: 1547 - RNA, 22 nt, Human
ucacugcaaccucugccuuccg

SEQ ID NO: 1548 - RNA, 22 nt, Human
ucagagcagugccgaagcccag

SEQ ID NO: 1549 - RNA, 22 nt, Human
ucugagugggaacucucaugac

SEQ ID NO: 1550 - RNA, 22 nt, Human
ucuuccccaccuucggcuugca

SEQ ID NO: 1551 - RNA, 22 nt, Human
uuguugcggguggggagaggau

SEQ ID NO: 1552 - RNA, 22 nt, Human
uuuguaauagcaaaauacugga

SEQ ID NO: 1553 - RNA, 22 nt, Human
uagcaccuucugaaauaacgug

SEQ ID NO: 1554 - RNA, 22 nt, Human
guguguggaaaugcagaugacc

SEQ ID NO: 1555 - RNA, 22 nt, Human
ugacuggaggaagggagguaag

SEQ ID NO: 1556 - RNA, 22 nt, Human
ucccugagcccugaaggguguu

SEQ ID NO: 1557 - RNA, 22 nt, Human
uguguuggagcagaggcagggg

SEQ ID NO: 1558 - RNA, 22 nt, Human
cuggaagacaugguagagcuga

SEQ ID NO: 1559 - RNA, 22 nt, Human
ugugaaggaggaagggaggagc

SEQ ID NO: 1560 - RNA, 22 nt, Human
cugggcgugugaggcggcugug

SEQ ID NO: 1561 - RNA, 22 nt, Human
aguuccauggaaaacaacaaag

SEQ ID NO: 1562 - RNA, 22 nt, Human
augaccaggaauugagagacug

SEQ ID NO: 1563 - RNA, 22 nt, Human
agcaaguguugaaacagcuggu

SEQ ID NO: 1564 - RNA, 22 nt, Human
agauggaguuugagagggaaua

SEQ ID NO: 1565 - RNA, 22 nt, Human
cagaucugggauacagcugugg

SEQ ID NO: 1566 - RNA, 22 nt, Human
gccuggccuuccuguguuuuac

SEQ ID NO: 1567 - RNA, 22 nt, Human
gaggucuguuguucagaaaaau

SEQ ID NO: 1568 - RNA, 22 nt, Human
uggcagguaagccaccagcauc

SEQ ID NO: 1569 - RNA, 22 nt, Human
uugcucaggcuggagugcagug

SEQ ID NO: 1570 - RNA, 22 nt, Human
uuugcaguguucaucaguauuu

SEQ ID NO: 1571 - RNA, 22 nt, Human
cuugcacuccacagccugggug

SEQ ID NO: 1572 - RNA, 22 nt, Human
uucaggacuguggacugggcug

SEQ ID NO: 1573 - RNA, 22 nt, Human
ucugagcccaggaguuugaggc

SEQ ID NO: 1574 - RNA, 22 nt, Human
uauaugucugguauucuugggg

SEQ ID NO: 1575 - RNA, 22 nt, Human
uuuguacgucaacucagccuua

SEQ ID NO: 1576 - RNA, 22 nt, Human
uuugcaguguucaucaguauuu

SEQ ID NO: 1577 - RNA, 22 nt, Human
uacucauuuaugcauuguuuug

SEQ ID NO: 1578 - RNA, 22 nt, Human
uacaggcaggcacagaggcagu

SEQ ID NO: 1579 - RNA, 22 nt, Human
agggcacacgucucucugaauu

SEQ ID NO: 1580 - RNA, 22 nt, Human
guguuauuaauaaacucuuuuu

SEQ ID NO: 1581 - RNA, 22 nt, Human
ucugucauuuuucucuuuccau

SEQ ID NO: 1582 - RNA, 22 nt, Human
uggagagagcagguugcuaaga

SEQ ID NO: 1583 - RNA, 22 nt, Human
uggagagaaagcgaagauguag

SEQ ID NO: 1584 - RNA, 22 nt, Human
uaggagugaaaauaaacucugu

SEQ ID NO: 1585 - RNA, 22 nt, Human
uaggcagucucaguuguugggu

SEQ ID NO: 1586 - RNA, 22 nt, Human
ugaaagagauguggugugugaa

SEQ ID NO: 1587 - RNA, 22 nt, Human
uccaguacaggucucucauuuc

SEQ ID NO: 1588 - RNA, 22 nt, Human
ugugucuguggaacagaagcag

SEQ ID NO: 1589 - RNA, 22 nt, Human
uguggcuaguuugaacugagau

SEQ ID NO: 1590 - RNA, 22 nt, Human
uggguuagugguugaauaguuu

SEQ ID NO: 1591 - RNA, 22 nt, Human
uggagccuuguuguuuguucac

SEQ ID NO: 1592 - RNA, 22 nt, Human
uggcaggauuccugggauuuca

SEQ ID NO: 1593 - RNA, 22 nt, Human
cuggugaggaaggagcagaguu

SEQ ID NO: 1594 - RNA, 22 nt, Human
ggcaugugugagcagcugcagg

SEQ ID NO: 1595 - RNA, 22 nt, Human
gguccacaaggggagagcaggg

SEQ ID NO: 1596 - RNA, 22 nt, Human
guccugagaacugcuccaguua

SEQ ID NO: 1597 - RNA, 22 nt, Human
uuuguaauagcaaaauacugga

SEQ ID NO: 1598 - RNA, 22 nt, Human
ugugagagaaauggcaaguugg

SEQ ID NO: 1599 - RNA, 22 nt, Human
uucacauguugcucaguuuugc

SEQ ID NO: 1600 - RNA, 22 nt, Human
augaugagucuuagugaucugg

SEQ ID NO: 1601 - RNA, 22 nt, Human
aucacuuugcagggauuacuaa

SEQ ID NO: 1602 - RNA, 22 nt, Human
ggcaugauggagaggguggaga

SEQ ID NO: 1603 - RNA, 22 nt, Human
ggcccaggagggggagaaaggc

SEQ ID NO: 1604 - RNA, 22 nt, Human
gcuguguuaacuguucaaacuc

SEQ ID NO: 1605 - RNA, 22 nt, Human
cagcaguguugcgaaucaucac

SEQ ID NO: 1606 - RNA, 22 nt, Human
cugaaaugcuguugauuuuagu

SEQ ID NO: 1607 - RNA, 22 nt, Human
gacaugauguagcagaugaugg

SEQ ID NO: 1608 - RNA, 22 nt, Human
auggauauuuuugaugcccaga

SEQ ID NO: 1609 - RNA, 22 nt, Human
auucaagauaagggucugggag

SEQ ID NO: 1610 - RNA, 22 nt, Human
aaguuuuuuuaaauuagcuagg

SEQ ID NO: 1611 - RNA, 22 nt, Human
aaugugugggagaacagucuuu

SEQ ID NO: 1612 - RNA, 22 nt, Human
ccugcccauccugccuccacca

SEQ ID NO: 1613 - RNA, 22 nt, Human
ccaguacugucuugaugccugc

SEQ ID NO: 1614 - RNA, 22 nt, Human
uggcaaggugugggcuagagau

SEQ ID NO: 1615 - RNA, 22 nt, Human
ugggaagaugcuggcaaggugc

SEQ ID NO: 1616 - RNA, 22 nt, Human
ucacugcaaccuccgccugccg

SEQ ID NO: 1617 - RNA, 22 nt, Human
guuguguggaagaugcuuugcc

SEQ ID NO: 1618 - RNA, 22 nt, Human
ugaguuuaagcuaagaagucug

SEQ ID NO: 1619 - RNA, 22 nt, Human
guggcauuggugguggcauugg

SEQ ID NO: 1620 - RNA, 22 nt, Human
gguggguuuccuuaauggcauc

SEQ ID NO: 1621 - RNA, 22 nt, Human
guacuccagccugccuggguaa

SEQ ID NO: 1622 - RNA, 22 nt, Human
ggcaugauucagcagaggagag

SEQ ID NO: 1623 - RNA, 22 nt, Human
ggccucagaagcugaggggaga

SEQ ID NO: 1624 - RNA, 22 nt, Human
gagugagugugaucuuggcuca

SEQ ID NO: 1625 - RNA, 22 nt, Human
gaggcagcaacuggugaggcac

SEQ ID NO: 1626 - RNA, 22 nt, Human
ccugcccauccugccuccacca

SEQ ID NO: 1627 - RNA, 22 nt, Human
ccagccugagguuccuggaggg

SEQ ID NO: 1628 - RNA, 22 nt, Human
gcugcuccugcucucccucucc

SEQ ID NO: 1629 - RNA, 22 nt, Human
gggaggauccuugcucaacuua

SEQ ID NO: 1630 - RNA, 22 nt, Human
aaacacaaugcaguaggaagag

SEQ ID NO: 1631 - RNA, 22 nt, Human
agaaggcucgcucucucagggg

SEQ ID NO: 1632 - RNA, 22 nt, Human
acugcacuccauccuggggagc

SEQ ID NO: 1633 - RNA, 22 nt, Human
auggccuuuucucuuauccugg

SEQ ID NO: 1634 - RNA, 22 nt, Human
auagaagagcagugggguagaa

SEQ ID NO: 1635 - RNA, 22 nt, Human
agagauaaagagguuuaggcag

SEQ ID NO: 1636 - RNA, 22 nt, Human
acugcacuccagccuggguggc

SEQ ID NO: 1637 - RNA, 22 nt, Human
aaccugucauuccaaggacagu

SEQ ID NO: 1638 - RNA, 22 nt, Human
ggaggcagugguugcagugagc

SEQ ID NO: 1639 - RNA, 22 nt, Human
cagaaucuuuugucucugagaa

SEQ ID NO: 1640 - RNA, 21 nt, Human
gacacaggcccagagaggcag

SEQ ID NO: 1641 - RNA, 21 nt, Human
cuuuggcaagggagaagucac

SEQ ID NO: 1642 - RNA, 22 nt, Human
gagauggaguuuuacuauguug

SEQ ID NO: 1643 - RNA, 22 nt, Human
auuugaggaggcuuuacagcca

SEQ ID NO: 1644 - RNA, 22 nt, Human
uucaggacuguggacugggcug

SEQ ID NO: 1645 - RNA, 22 nt, Human
uaguuguuugggauugguagug

SEQ ID NO: 1646 - RNA, 22 nt, Human
ucugugacuguauuuucccaaa

SEQ ID NO: 1647 - RNA, 22 nt, Human
uuagcaguugugagacccuaga

SEQ ID NO: 1648 - RNA, 22 nt, Human
uacaggcaggcacagaggcagu

SEQ ID NO: 1649 - RNA, 22 nt, Human
gugucucuguuguggcagucau

SEQ ID NO: 1650 - RNA, 22 nt, Human
aggcagguggguguaugggucu

SEQ ID NO: 1651 - RNA, 22 nt, Human
ucugccucccugucucacucuc

SEQ ID NO: 1652 - RNA, 22 nt, Human
uggagcagaaaggcaggagucc

SEQ ID NO: 1653 - RNA, 22 nt, Human
gcugcuccugcucucccucucc

SEQ ID NO: 1654 - RNA, 22 nt, Human
gcuucuccuguccccucccuac

SEQ ID NO: 1655 - RNA, 22 nt, Human
ggccugaggucagcaguagagg

SEQ ID NO: 1656 - RNA, 22 nt, Human
cccuuuaguaacuugcaggguc

SEQ ID NO: 1657 - RNA, 22 nt, Human
cuccuaggcuggagugcagugg

SEQ ID NO: 1658 - RNA, 22 nt, Human
uguguuggagcagaggcagggg

SEQ ID NO: 1659 - RNA, 22 nt, Human
ggcccaggagggggagaaaggc

SEQ ID NO: 1660 - RNA, 22 nt, Human
aauggcagucccuggagcagga

SEQ ID NO: 1661 - RNA, 22 nt, Human
aucacuuugcagggauuacuaa

SEQ ID NO: 1662 - RNA, 22 nt, Human
augaugcuggaacuggacaaca

SEQ ID NO: 1663 - RNA, 22 nt, Human
agauaguucucuguuguugggg

SEQ ID NO: 1664 - RNA, 22 nt, Human
agguggcacugugugggguggg

SEQ ID NO: 1665 - RNA, 22 nt, Human
agucagggagacugucaguaaa

SEQ ID NO: 1666 - RNA, 22 nt, Human
agcuggauuguuuaccuggggc

SEQ ID NO: 1667 - RNA, 22 nt, Human
aaucuucacuaaaauggacaag

SEQ ID NO: 1668 - RNA, 22 nt, Human
aagguggugucauguuuugggg

SEQ ID NO: 1669 - RNA, 22 nt, Human
acagcaguccagccugggugac

SEQ ID NO: 1670 - RNA, 22 nt, Human
aaggcuguguaggcagaauucu

SEQ ID NO: 1671 - RNA, 22 nt, Human
ggcccaggagggggagaaaggc

SEQ ID NO: 1672 - RNA, 22 nt, Human
gauugcuugagcccuggagguu

SEQ ID NO: 1673 - RNA, 22 nt, Human
ggccugguggcuguuguuuugg

SEQ ID NO: 1674 - RNA, 22 nt, Human
ggcugggcaugguggcucacgc

SEQ ID NO: 1675 - RNA, 22 nt, Human
gagcuaaggauagaggugagga

SEQ ID NO: 1676 - RNA, 22 nt, Human
gaccagccauccugguuuacau

SEQ ID NO: 1677 - RNA, 22 nt, Human
cuggcucuacccucucacuuca

SEQ ID NO: 1678 - RNA, 22 nt, Human
cagugcugaguaugaaaggccc

SEQ ID NO: 1679 - RNA, 22 nt, Human
cauaaaaucagaaaguauuacu

SEQ ID NO: 1680 - RNA, 22 nt, Human
cuagcacagugcuuggcacaca

SEQ ID NO: 1681 - RNA, 22 nt, Human
cguguucaguauggugggagau

SEQ ID NO: 1682 - RNA, 22 nt, Human
uggggcacuguggaggugucau

SEQ ID NO: 1683 - RNA, 22 nt, Human
caagugcuugaacauggcagag

SEQ ID NO: 1684 - RNA, 22 nt, Human
augguguaggugaagagaacau

SEQ ID NO: 1685 - RNA, 22 nt, Human
gaauaaugucccacugggaggc

SEQ ID NO: 1686 - RNA, 22 nt, Human
cagaucugggauacagcugugg

SEQ ID NO: 1687 - RNA, 22 nt, Human
auuuuucugcauuuguauugga

SEQ ID NO: 1688 - RNA, 22 nt, Human
cagagcauuugugaggaguguu

SEQ ID NO: 1689 - RNA, 22 nt, Human
ggaggugacuguuacagaucgg

SEQ ID NO: 1690 - RNA, 22 nt, Human
ggcugcagugaacuaugaucgu

SEQ ID NO: 1691 - RNA, 22 nt, Human
gcuggguugagcugggcugaga

SEQ ID NO: 1692 - RNA, 22 nt, Human
gaggugaaggaacaaaugcuga

SEQ ID NO: 1693 - RNA, 22 nt, Human
gcagcgcugagaugauuuguug

SEQ ID NO: 1694 - RNA, 22 nt, Human
ugcagccuugaacucuuucugg

SEQ ID NO: 1695 - RNA, 22 nt, Human
ugagauggugucauauugcugg

SEQ ID NO: 1696 - RNA, 22 nt, Human
uucaggacuguggacugggcug

SEQ ID NO: 1697 - RNA, 22 nt, Human
uucuaugauucucuaaguagca

SEQ ID NO: 1698 - RNA, 22 nt, Human
uggcucugucuauugggaugug

SEQ ID NO: 1699 - RNA, 22 nt, Human
ucuugggauagugucucauggc

SEQ ID NO: 1700 - RNA, 22 nt, Human
ucaggcugaggucaucugcauc

SEQ ID NO: 1701 - RNA, 22 nt, Human
uaugauuguuucauuuguugga

SEQ ID NO: 1702 - RNA, 22 nt, Human
uauuaguugauuccaagggacc

SEQ ID NO: 1703 - RNA, 22 nt, Human
uccucaucuuugagucccagcg

SEQ ID NO: 1704 - RNA, 22 nt, Human
ucucuaagacaaaggagaaguc

SEQ ID NO: 1705 - RNA, 22 nt, Human
ucuuggugcuuuugcuggauga

SEQ ID NO: 1706 - RNA, 22 nt, Human
ugaugacugaaguggccuggac

SEQ ID NO: 1707 - RNA, 22 nt, Human
ugagggcaggugugaaaaugcu

SEQ ID NO: 1708 - RNA, 22 nt, Human
uugugguuuucccaggugguag

SEQ ID NO: 1709 - RNA, 22 nt, Human
uucuggguuuuuguggguuugc

SEQ ID NO: 1710 - RNA, 22 nt, Human
guuacagcucucaaagaagaca

SEQ ID NO: 1711 - RNA, 22 nt, Human
guuauugucagggucucccuuu

SEQ ID NO: 1712 - RNA, 22 nt, Human
uaagaagagaaagaagaggcug

SEQ ID NO: 1713 - RNA, 22 nt, Human
aggcacugugcaggaugauggg

SEQ ID NO: 1714 - RNA, 22 nt, Human
uguagcagaacacuggguccag

SEQ ID NO: 1715 - RNA, 22 nt, Human
ggcaaggaagaaagcagaaguu

SEQ ID NO: 1716 - RNA, 22 nt, Human
gacaugauguagcagaugaugg

SEQ ID NO: 1717 - RNA, 22 nt, Human
ggccugguggcuguuguuuugg

SEQ ID NO: 1718 - RNA, 22 nt, Human
gccaggaugaagaggaggagaa

SEQ ID NO: 1719 - RNA, 22 nt, Human
ggcaugauggagaggguggaga

SEQ ID NO: 1720 - RNA, 22 nt, Human
cugcugccuuucucucagagau

SEQ ID NO: 1721 - RNA, 22 nt, Human
ccacugcacuccagccugggug

SEQ ID NO: 1722 - RNA, 22 nt, Human
gagcuaaggauagaggugagga

SEQ ID NO: 1723 - RNA, 22 nt, Human
uuaaacuucccugcugccccag

SEQ ID NO: 1724 - RNA, 22 nt, Human
agcuccaggagcuggcaggagg

SEQ ID NO: 1725 - RNA, 22 nt, Human
ugagagagcaagugaauuuccc

SEQ ID NO: 1726 - RNA, 22 nt, Human
ugaggaggugcuaccagcgucu

SEQ ID NO: 1727 - RNA, 22 nt, Human
uccauugcacuccagucugggc

SEQ ID NO: 1728 - RNA, 22 nt, Human
acugcacuccagccuggguggc

SEQ ID NO: 1729 - RNA, 22 nt, Human
agaaguaguaguagcaguagua

SEQ ID NO: 1730 - RNA, 22 nt, Human
agacuguuccgucagacucagu

SEQ ID NO: 1731 - RNA, 22 nt, Human
aaccugcugguaaagcacuggc

SEQ ID NO: 1732 - RNA, 22 nt, Human
ugcuguaguauguauauaguau

SEQ ID NO: 1733 - RNA, 22 nt, Human
aggcaagagguugcagugagcu

SEQ ID NO: 1734 - RNA, 22 nt, Human
ugguccagaggaggaaugaggg

SEQ ID NO: 1735 - RNA, 22 nt, Human
ugagaucaucguuacaagcagc

SEQ ID NO: 1736 - RNA, 22 nt, Human
ugagaugaaccagguaucucag

SEQ ID NO: 1737 - RNA, 22 nt, Human
uggaauggcugaagacugugaa

SEQ ID NO: 1738 - RNA, 22 nt, Human
gucuuguuccaguuucucagcc

SEQ ID NO: 1739 - RNA, 22 nt, Human
gagguagagguugcagugaguc

SEQ ID NO: 1740 - RNA, 22 nt, Human
gaggagguggggcagcagcagg

SEQ ID NO: 1741 - RNA, 22 nt, Human
gaggucacuguuggaugucaga

SEQ ID NO: 1742 - RNA, 22 nt, Human
gcagcucccuauuccaugacag

SEQ ID NO: 1743 - RNA, 22 nt, Human
ggaggcagugguugcagugagc

SEQ ID NO: 1744 - RNA, 22 nt, Human
ggccugaggucagcaguagagg

SEQ ID NO: 1745 - RNA, 22 nt, Human
ggcccaggagggggagaaaggc

SEQ ID NO: 1746 - RNA, 22 nt, Human
gagguagagguugcagugagug

SEQ ID NO: 1747 - RNA, 22 nt, Human
ggcaugauggagaggguggaga

SEQ ID NO: 1748 - RNA, 22 nt, Human
ggcaugugugagcagcugcagg

SEQ ID NO: 1749 - RNA, 22 nt, Human
auacagcucucucuggggacuu

SEQ ID NO: 1750 - RNA, 22 nt, Human
uucacauguugcucaguuuugc

SEQ ID NO: 1751 - RNA, 22 nt, Human
uugagagcauagagccaggaag

SEQ ID NO: 1752 - RNA, 22 nt, Human
gaggucacuguuggaugucaga

SEQ ID NO: 1753 - RNA, 22 nt, Human
ccagccugagguuccuggaggg

SEQ ID NO: 1754 - RNA, 22 nt, Human
ucccuucagagcccauggguuu

SEQ ID NO: 1755 - RNA, 22 nt, Human
ucuuggugcuuuugcuggauga

SEQ ID NO: 1756 - RNA, 22 nt, Human
uuccaguucucagcacagcgcu

SEQ ID NO: 1757 - RNA, 22 nt, Human
ugugcacaacaugcagguuugu

SEQ ID NO: 1758 - RNA, 22 nt, Human
ugauauauaaucagcccaugau

SEQ ID NO: 1759 - RNA, 22 nt, Human
ucuuccccaccuucggcuugca

SEQ ID NO: 1760 - RNA, 22 nt, Human
ucugccucccugucucacucuc

SEQ ID NO: 1761 - RNA, 22 nt, Human
uaggcccauuaauaguguacau

SEQ ID NO: 1762 - RNA, 22 nt, Human
aggcaagagguugcagugagcu

SEQ ID NO: 1763 - RNA, 22 nt, Human
ggagcuguaguuuuucccacau

SEQ ID NO: 1764 - RNA, 22 nt, Human
cagguacuuuuugguuuacaug

SEQ ID NO: 1765 - RNA, 22 nt, Human
cagcagagcccauguguucaug

SEQ ID NO: 1766 - RNA, 22 nt, Human
cugggcaguaauguaguugaga

SEQ ID NO: 1767 - RNA, 22 nt, Human
uugcuuugguucaaguuaggca

SEQ ID NO: 1768 - RNA, 22 nt, Human
agaugacacagagcucaggaaa

SEQ ID NO: 1769 - RNA, 22 nt, Human
acuguacuccagccugggcaac

SEQ ID NO: 1770 - RNA, 22 nt, Human
aguagaacagaauauuuuagcu

SEQ ID NO: 1771 - RNA, 22 nt, Human
agguccucacacacagcucugc

SEQ ID NO: 1772 - RNA, 22 nt, Human
augccuguaaucccagcacuuu

SEQ ID NO: 1773 - RNA, 22 nt, Human
augccuguaaucccagcauuuu

SEQ ID NO: 1774 - RNA, 22 nt, Human
auggagcuguuuucuucagagc

SEQ ID NO: 1775 - RNA, 22 nt, Human
augggagacugaggggcggacg

SEQ ID NO: 1776 - RNA, 22 nt, Human
auugcacuccagccugggcaau

SEQ ID NO: 1777 - RNA, 22 nt, Human
auugcacuccagccugggugac

SEQ ID NO: 1778 - RNA, 22 nt, Human
auugcacuccagcuugggcaac

SEQ ID NO: 1779 - RNA, 22 nt, Human
auugcacuucagccugggugac

SEQ ID NO: 1780 - RNA, 22 nt, Human
aagcagaacuguuuuguuuucu

SEQ ID NO: 1781 - RNA, 22 nt, Human
aaauugccgagaugauguuugg

SEQ ID NO: 1782 - RNA, 22 nt, Human
aacccuggaggcagagguugcg

SEQ ID NO: 1783 - RNA, 22 nt, Human
acugcacuccagccugggcgau

SEQ ID NO: 1784 - RNA, 22 nt, Human
aaugaagccacagagauuugcu

SEQ ID NO: 1785 - RNA, 22 nt, Human
acaaaaaauuagccagacuggu

SEQ ID NO: 1786 - RNA, 22 nt, Human
acacaucuaauggcugugcuga

SEQ ID NO: 1787 - RNA, 22 nt, Human
acccgagagguggagguugcag

SEQ ID NO: 1788 - RNA, 22 nt, Human
acugcacuccagccuggcaaca

SEQ ID NO: 1789 - RNA, 22 nt, Human
acugcacuccagccuggcgaca

SEQ ID NO: 1790 - RNA, 22 nt, Human
aagguggugucauguuuugggg

SEQ ID NO: 1791 - RNA, 22 nt, Human
aaucccagcuacucgggaggcu

SEQ ID NO: 1792 - RNA, 22 nt, Human
acuguacuucagccuggguaac

SEQ ID NO: 1793 - RNA, 22 nt, Human
acuguacuucagccugggcaac

SEQ ID NO: 1794 - RNA, 22 nt, Human
acugcacucuagccugggcaac

SEQ ID NO: 1795 - RNA, 22 nt, Human
acugcacuucagccugggcaau

SEQ ID NO: 1796 - RNA, 22 nt, Human
uugguugcugaugagcuuugag

SEQ ID NO: 1797 - RNA, 22 nt, Human
uuuauuaguuguccuugguuua

SEQ ID NO: 1798 - RNA, 22 nt, Human
uugcacuccagccuggguaaca

SEQ ID NO: 1799 - RNA, 22 nt, Human
uuuggggucuccccagcaugca

SEQ ID NO: 1800 - RNA, 22 nt, Human
uuuuuguggaauauuuuuuuaa

SEQ ID NO: 1801 - RNA, 22 nt, Human
uucagcauugccaguguuucca

SEQ ID NO: 1802 - RNA, 22 nt, Human
uuccaguaguuacuccucccug

SEQ ID NO: 1803 - RNA, 22 nt, Human
uggcaggauuccugggauuuca

SEQ ID NO: 1804 - RNA, 22 nt, Human
uguaaacauccccgacuggaag

SEQ ID NO: 1805 - RNA, 22 nt, Human
auuguucuccagccugggcgac

SEQ ID NO: 1806 - RNA, 22 nt, Human
auugcacaccaaccugggcaac

SEQ ID NO: 1807 - RNA, 22 nt, Human
cacugcacuccagccuggguaa

SEQ ID NO: 1808 - RNA, 22 nt, Human
cugaggcaggagggcucaggag

SEQ ID NO: 1809 - RNA, 22 nt, Human
gagguagagguugcagugaguc

SEQ ID NO: 1810 - RNA, 22 nt, Human
cuugcacuccacagccugggug

SEQ ID NO: 1811 - RNA, 22 nt, Human
ccaaagugcuggcguuacaggu

SEQ ID NO: 1812 - RNA, 22 nt, Human
ccacugcacuccagccugggug

SEQ ID NO: 1813 - RNA, 22 nt, Human
cauugcacuccagccuggguga

SEQ ID NO: 1814 - RNA, 22 nt, Human
cucugccucccgggucuaggcu

SEQ ID NO: 1815 - RNA, 22 nt, Human
gaguauuaccuauaucaccgug

SEQ ID NO: 1816 - RNA, 22 nt, Human
gcacucaagccuggguuacaga

SEQ ID NO: 1817 - RNA, 22 nt, Human
gcaagugcugucauauggaaga

SEQ ID NO: 1818 - RNA, 22 nt, Human
ggaggaggugugaagaaaugaa

SEQ ID NO: 1819 - RNA, 22 nt, Human
gcuguguuaacuguucaaacuc

SEQ ID NO: 1820 - RNA, 22 nt, Human
ggcuggagaguaaaucaggucu

SEQ ID NO: 1821 - RNA, 22 nt, Human
gguggguuuccuuaauggcauc

SEQ ID NO: 1822 - RNA, 22 nt, Human
gccuguaaucccagcuacuugg

SEQ ID NO: 1823 - RNA, 22 nt, Human
gccauugcacuccagccuggac

SEQ ID NO: 1824 - RNA, 22 nt, Human
gccauugcacuccagccugggc

SEQ ID NO: 1825 - RNA, 22 nt, Human
gagguagagguugcagugagug

SEQ ID NO: 1826 - RNA, 22 nt, Human
gacuggcuaauuuauaaaggaa

SEQ ID NO: 1827 - RNA, 22 nt, Human
ggcaugugugagcagcugcagg

SEQ ID NO: 1828 - RNA, 22 nt, Human
ggaggcagugguugcagugagc

SEQ ID NO: 1829 - RNA, 22 nt, Human
ggaguguaaagaaggauguuac

SEQ ID NO: 1830 - RNA, 22 nt, Human
gggcaugaugauggcacuagcg

SEQ ID NO: 1831 - RNA, 19 nt, Human
gggggaugauagcagccag

SEQ ID NO: 1832 - RNA, 22 nt, Human
guacuccagccugccuggguaa

SEQ ID NO: 1833 - RNA, 22 nt, Human
guauguauuuauagauguucuu

SEQ ID NO: 1834 - RNA, 22 nt, Human
cccaggaggcggagguugcagu

SEQ ID NO: 1835 - RNA, 22 nt, Human
ccagccugagguuccuggaggg

SEQ ID NO: 1836 - RNA, 22 nt, Human
ccaaagugcuaggaauacaggu

SEQ ID NO: 1837 - RNA, 22 nt, Human
cacugcacuccagccuggguga

SEQ ID NO: 1838 - RNA, 22 nt, Human
cacugcacuccacccugggcaa

SEQ ID NO: 1839 - RNA, 22 nt, Human
cacugcacuccagccugggcga

SEQ ID NO: 1840 - RNA, 22 nt, Human
cacugcacucagccugggugac

SEQ ID NO: 1841 - RNA, 22 nt, Human
cuccuaggcuggagugcagugg

SEQ ID NO: 1842 - RNA, 22 nt, Human
cguguaaucccagcuacuuggg

SEQ ID NO: 1843 - RNA, 22 nt, Human
cucuugaaggaguauuuguguu

SEQ ID NO: 1844 - RNA, 22 nt, Human
aggcaagagguugcagugagcu

SEQ ID NO: 1845 - RNA, 22 nt, Human
agcagcacagaaauauuggcac

SEQ ID NO: 1846 - RNA, 22 nt, Human
uugagcaaaauaucugguuuca

SEQ ID NO: 1847 - RNA, 22 nt, Human
uugcacuccagccugggugaca

SEQ ID NO: 1848 - RNA, 22 nt, Human
uuguaaauaacauuuuuuagca

SEQ ID NO: 1849 - RNA, 22 nt, Human
uacccugugaucaucugugugc

SEQ ID NO: 1850 - RNA, 22 nt, Human
uauaacagccagcuuggauuca

SEQ ID NO: 1851 - RNA, 22 nt, Human
uauuacauucauuuugaugguu

SEQ ID NO: 1852 - RNA, 22 nt, Human
uauugaucugucccagccugug

SEQ ID NO: 1853 - RNA, 22 nt, Human
uauugcacuccagccugggcaa

SEQ ID NO: 1854 - RNA, 22 nt, Human
gugcuugaccaugugguggcag

SEQ ID NO: 1855 - RNA, 22 nt, Human
aggguuguuaguuuuuugguug

SEQ ID NO: 1856 - RNA, 22 nt, Human
gugaagaaguugcuucauccuu

SEQ ID NO: 1857 - RNA, 22 nt, Human
ugaggcagaaggauuacuugag

SEQ ID NO: 1858 - RNA, 22 nt, Human
uaggaaguauuuuuuaaaaaca

SEQ ID NO: 1859 - RNA, 22 nt, Human
guggccuuucuggucuguguau

SEQ ID NO: 1860 - RNA, 22 nt, Human
gucuuccuccguccccaccucc

SEQ ID NO: 1861 - RNA, 22 nt, Human
uaaugcucagcuggaccagugu

SEQ ID NO: 1862 - RNA, 22 nt, Human
ucauaaacuggcaagcacuacc

SEQ ID NO: 1863 - RNA, 22 nt, Human
ucauugguugcauaauuugauc

SEQ ID NO: 1864 - RNA, 22 nt, Human
uauugcuaagaauucagguagu

SEQ ID NO: 1865 - RNA, 22 nt, Human
ugcagauacauguguaacugaa

SEQ ID NO: 1866 - RNA, 22 nt, Human
ugagaugaacccgguaccucag

SEQ ID NO: 1867 - RNA, 22 nt, Human
ugaggaaggugugagaaaugag

SEQ ID NO: 1868 - RNA, 22 nt, Human
ugagggggaaggugugugugug

SEQ ID NO: 1869 - RNA, 22 nt, Human
uggaagaauaggcaguauugga

SEQ ID NO: 1870 - RNA, 22 nt, Human
ugcuacauuucuucauucuugg

SEQ ID NO: 1871 - RNA, 22 nt, Human
uguagcagaacacuggguccag

SEQ ID NO: 1872 - RNA, 22 nt, Human
uucauuaggccaggugcggugg

SEQ ID NO: 1873 - RNA, 22 nt, Human
uuaacugagaggaucugaguag

SEQ ID NO: 1874 - RNA, 22 nt, Human
uggagagauagugauuuagcuc

SEQ ID NO: 1875 - RNA, 22 nt, Human
guucuucugggagaaaaauggc

SEQ ID NO: 1876 - RNA, 22 nt, Human
ugcagauacauguguaacugaa

SEQ ID NO: 1877 - RNA, 22 nt, Human
ucaaagcugcagauugccugug

SEQ ID NO: 1878 - RNA, 22 nt, Human
ugaaguaguuagguuguagcuc

SEQ ID NO: 1879 - RNA, 22 nt, Human
guucuggagcccauacucacca

SEQ ID NO: 1880 - RNA, 22 nt, Human
uuugcaccugagacagauagcc

SEQ ID NO: 1881 - RNA, 22 nt, Human
cucaccaguuacucuccaguug

SEQ ID NO: 1882 - RNA, 22 nt, Human
gaacuguacuggacccauaguu

SEQ ID NO: 1883 - RNA, 22 nt, Human
gggggaucauuauaaaaauacu

SEQ ID NO: 1884 - RNA, 22 nt, Human
ggcagcugugcagagugggggu

SEQ ID NO: 1885 - RNA, 22 nt, Human
gaggacccuuaggucagacaga

SEQ ID NO: 1886 - RNA, 22 nt, Human
gccaggaugaagaggaggagaa

SEQ ID NO: 1887 - RNA, 22 nt, Human
gaaaguaguaaguuguauaguu

SEQ ID NO: 1888 - RNA, 22 nt, Human
cugaauguaaucuuaguuguaa

SEQ ID NO: 1889 - RNA, 22 nt, Human
cuggagaggagcggucacuggu

SEQ ID NO: 1890 - RNA, 22 nt, Human
uggggcacuguggaggugucau

SEQ ID NO: 1891 - RNA, 22 nt, Human
acugcacuccagucugggugac

SEQ ID NO: 1892 - RNA, 22 nt, Human
acugcagcuucagggacuugug

SEQ ID NO: 1893 - RNA, 22 nt, Human
acacaggcccagagaggcagug

SEQ ID NO: 1894 - RNA, 22 nt, Human
agagacacagacacaugggaga

SEQ ID NO: 1895 - RNA, 22 nt, Human
uugccuggagacauuucuacug

SEQ ID NO: 1896 - RNA, 22 nt, Human
cugugccugugacgagggauga

SEQ ID NO: 1897 - RNA, 22 nt, Human
gaccccuugcccguggcuccca

SEQ ID NO: 1898 - RNA, 22 nt, Human
cccaggaggcggagguugcagu

SEQ ID NO: 1899 - RNA, 22 nt, Human
gcuucuccuguccccucccuac

SEQ ID NO: 1900 - RNA, 22 nt, Human
ggcugggcaugguggcucacgc

SEQ ID NO: 1901 - RNA, 22 nt, Human
guacaguggguguagggaccag

SEQ ID NO: 1902 - RNA, 22 nt, Human
ccccaccccaguggagcucacc

SEQ ID NO: 1903 - RNA, 22 nt, Human
cacugcaacccccgccucccag

SEQ ID NO: 1904 - RNA, 22 nt, Human
guucuggagcccauacucacca

SEQ ID NO: 1905 - RNA, 22 nt, Human
guguauguguguaugucugugu

SEQ ID NO: 1906 - RNA, 22 nt, Human
aggggguuuagcuccacagggu

SEQ ID NO: 1907 - RNA, 22 nt, Human
ucagagcagugccgaagcccag

SEQ ID NO: 1908 - RNA, 22 nt, Human
ugaggacaggagguugugaguu

SEQ ID NO: 1909 - RNA, 22 nt, Human
uguggcagaaggcucuggauua

SEQ ID NO: 1910 - RNA, 22 nt, Human
uaaaguguguaugggcaggugu

SEQ ID NO: 1911 - RNA, 22 nt, Human
guggaguucucugcuaguccua

SEQ ID NO: 1912 - RNA, 22 nt, Human
ucuuccccaccuucggcuugca

SEQ ID NO: 1913 - RNA, 22 nt, Human
gacauggagacaacagccaaau

SEQ ID NO: 1914 - RNA, 22 nt, Human
gaggucacuguuggaugucaga

SEQ ID NO: 1915 - RNA, 22 nt, Human
gagcagguuuggaauggcucca

SEQ ID NO: 1916 - RNA, 22 nt, Human
ggaguguaaagaaggauguuac

SEQ ID NO: 1917 - RNA, 22 nt, Human
cucagauacuugggagguugag

SEQ ID NO: 1918 - RNA, 22 nt, Human
uuugcacacuuuccaaguugcc

SEQ ID NO: 1919 - RNA, 22 nt, Human
agaaguguaaauaaguauguau

SEQ ID NO: 1920 - RNA, 22 nt, Human
aaggcuguguaggcagaauucu

SEQ ID NO: 1921 - RNA, 22 nt, Human
aacacguugcaucugugucucu

SEQ ID NO: 1922 - RNA, 22 nt, Human
aagcagccuuggaccaggaggg

SEQ ID NO: 1923 - RNA, 22 nt, Human
acugcacuccagucugggugac

SEQ ID NO: 1924 - RNA, 20 nt, Human
acaggagcauggagaggcua

SEQ ID NO: 1925 - RNA, 22 nt, Human
acuggcccacuccauuuagggu

SEQ ID NO: 1926 - RNA, 22 nt, Human
agaagguuggggcuggaggucu

SEQ ID NO: 1927 - RNA, 22 nt, Human
aguauuucuuguuuuauugaga

SEQ ID NO: 1928 - RNA, 22 nt, Human
augggcaguuucuucccuuucc

SEQ ID NO: 1929 - RNA, 22 nt, Human
aaccugcugguaaagcacuggc

SEQ ID NO: 1930 - RNA, 22 nt, Human
uuuguaauagcaaaauacugga

SEQ ID NO: 1931 - RNA, 22 nt, Human
uugguugcugaugagcuuugag

SEQ ID NO: 1932 - RNA, 22 nt, Human
uugcacuccagucugggugaca

SEQ ID NO: 1933 - RNA, 22 nt, Human
uguaguuugaugcuagaacacu

SEQ ID NO: 1934 - RNA, 22 nt, Human
augguguaggugaagagaacau

SEQ ID NO: 1935 - RNA, 22 nt, Human
aggugagaaaacugaggcucag

SEQ ID NO: 1936 - RNA, 22 nt, Human
agguggaguuuugcuuucccau

SEQ ID NO: 1937 - RNA, 22 nt, Human
cuacuuguuccucucaccucaa

SEQ ID NO: 1938 - RNA, 22 nt, Human
ccaggguacucugggaucacuu

SEQ ID NO: 1939 - RNA, 22 nt, Human
gaaaccuacacaucccacuaac

SEQ ID NO: 1940 - RNA, 22 nt, Human
gagguagagguugcagugagug

SEQ ID NO: 1941 - RNA, 22 nt, Human
gagagugcuuuggguguaggcc

SEQ ID NO: 1942 - RNA, 22 nt, Human
cugugcauguugauauccuggc

SEQ ID NO: 1943 - RNA, 22 nt, Human
cuggcucccucucuucucuccc

SEQ ID NO: 1944 - RNA, 22 nt, Human
gcagcaggcagggccaggcagg

SEQ ID NO: 1945 - RNA, 22 nt, Human
ggugaugcauuuaaaagggcag

SEQ ID NO: 1946 - RNA, 22 nt, Human
gagguagagguugcagugaguc

SEQ ID NO: 1947 - RNA, 22 nt, Human
gcagagaggaaggcuaugaaac

SEQ ID NO: 1948 - RNA, 22 nt, Human
gcugcuccugcucucccucucc

SEQ ID NO: 1949 - RNA, 22 nt, Human
ggagcuguaguuuuucccacau

SEQ ID NO: 1950 - RNA, 22 nt, Human
gggggaucauuauaaaaauacu

SEQ ID NO: 1951 - RNA, 22 nt, Human
gguagcuagaggggagauagca

SEQ ID NO: 1952 - RNA, 22 nt, Human
ggaguaugagagagaaugggac

SEQ ID NO: 1953 - RNA, 22 nt, Human
ggaggcagugguugcagugagc

SEQ ID NO: 1954 - RNA, 22 nt, Human
ggcaugauggagaggguggaga

SEQ ID NO: 1955 - RNA, 22 nt, Human
cucugccucccgggucuaggcu

SEQ ID NO: 1956 - RNA, 22 nt, Human
cagaggaugcggcugggaacgg

SEQ ID NO: 1957 - RNA, 22 nt, Human
caugguacugccacagaagagu

SEQ ID NO: 1958 - RNA, 22 nt, Human
ugaaaugcuuuuaggacacugc

SEQ ID NO: 1959 - RNA, 22 nt, Human
ugacuggaggaagggagguaag

SEQ ID NO: 1960 - RNA, 22 nt, Human
ucugguuugagagacaaugaca

SEQ ID NO: 1961 - RNA, 22 nt, Human
ucaguagcugucaaaacuggag

SEQ ID NO: 1962 - RNA, 22 nt, Human
uccagugaaacaggucucuuug

SEQ ID NO: 1963 - RNA, 22 nt, Human
uaagaagagaaagaagaggcug

SEQ ID NO: 1964 - RNA, 22 nt, Human
guucacaguucagccuguaaca

SEQ ID NO: 1965 - RNA, 22 nt, Human
uguggcagaaggcucuggauua

SEQ ID NO: 1966 - RNA, 22 nt, Human
ugugcugguugcccccgagggg

SEQ ID NO: 1967 - RNA, 22 nt, Human
ugguuaguuuuaugggccugga

SEQ ID NO: 1968 - RNA, 22 nt, Human
ugguccagaggaggaaugaggg

SEQ ID NO: 1969 - RNA, 22 nt, Human
uggucuccuauccuggcucaca

SEQ ID NO: 1970 - RNA, 22 nt, Human
uuaaugcuaaucgugauagggg

SEQ ID NO: 1971 - RNA, 22 nt, Human
uuccagauggguaggaauaccu

SEQ ID NO: 1972 - RNA, 22 nt, Human
ugcuagguuuuuuccuuucccc

SEQ ID NO: 1973 - RNA, 22 nt, Human
uggagaauuaaaaaggguagug

SEQ ID NO: 1974 - RNA, 22 nt, Human
uggaaugaggaagggugugguc

SEQ ID NO: 1975 - RNA, 22 nt, Human
uggagagauaagccaaguaucc

SEQ ID NO: 1976 - RNA, 22 nt, Human
ucagagugagucccugggacua

SEQ ID NO: 1977 - RNA, 22 nt, Human
uccaaaauuaaagguuguagaa

SEQ ID NO: 1978 - RNA, 22 nt, Human
uccagggugggccucagacccu

SEQ ID NO: 1979 - RNA, 22 nt, Human
ucuuuuuguuguagcuguaugg

SEQ ID NO: 1980 - RNA, 22 nt, Human
uuuccuguuuugguuuggagag

SEQ ID NO: 1981 - RNA, 22 nt, Human
uucucauuggcccacaggggua

SEQ ID NO: 1982 - RNA, 22 nt, Human
uuuucaauggcugacacugucu

SEQ ID NO: 1983 - RNA, 22 nt, Human
uuuuuaucuuuuucuccagaug

SEQ ID NO: 1984 - RNA, 22 nt, Human
gugugggcagggccgugcuccc

SEQ ID NO: 1985 - RNA, 22 nt, Human
ucuuccccaccuucggcuugca

SEQ ID NO: 1986 - RNA, 22 nt, Human
ucugcuuggacugaucauugaa

SEQ ID NO: 1987 - RNA, 22 nt, Human
uccccagguucuaguccugagu

SEQ ID NO: 1988 - RNA, 22 nt, Human
ucagagcagugccgaagcccag

SEQ ID NO: 1989 - RNA, 22 nt, Human
ugcagccuugaacucuuucugg

SEQ ID NO: 1990 - RNA, 22 nt, Human
uguguuggagcagaggcagggg

SEQ ID NO: 1991 - RNA, 22 nt, Human
ugggcucgcucuucagucucgg

SEQ ID NO: 1992 - RNA, 22 nt, Human
guuuuguugucucuguguugua

SEQ ID NO: 1993 - RNA, 22 nt, Human
uaucucuugccuugaccuccua

SEQ ID NO: 1994 - RNA, 22 nt, Human
ucaggcugaggucaucugcauc

SEQ ID NO: 1995 - RNA, 22 nt, Human
cagagcauuugugaggaguguu

SEQ ID NO: 1996 - RNA, 22 nt, Human
ccccaccccaguggagcucacc

SEQ ID NO: 1997 - RNA, 22 nt, Human
cugugcccagccagggcugugu

SEQ ID NO: 1998 - RNA, 22 nt, Human
ggaguaugagagagaaugggac

SEQ ID NO: 1999 - RNA, 22 nt, Human
ggccugguggcuguuguuuugg

SEQ ID NO: 2000 - RNA, 22 nt, Human
gaggagguggggcagcagcagg

SEQ ID NO: 2001 - RNA, 22 nt, Human
gagagagguagaggggagcaga

SEQ ID NO: 2002 - RNA, 22 nt, Human
gguagcuagaggggagauagca

SEQ ID NO: 2003 - RNA, 22 nt, Human
gcagcaggcagggccaggcagg

SEQ ID NO: 2004 - RNA, 22 nt, Human
ggaggaggaggcuggugcuggu

SEQ ID NO: 2005 - RNA, 22 nt, Human
ggcccaggagggggagaaaggc

SEQ ID NO: 2006 - RNA, 22 nt, Human
cugggcucuggucuguagguuu

SEQ ID NO: 2007 - RNA, 22 nt, Human
cugugagcuauuuguuuugguu

SEQ ID NO: 2008 - RNA, 22 nt, Human
augggagacugaggggcggacg

SEQ ID NO: 2009 - RNA, 22 nt, Human
auaacugugaagaggcaauugu

SEQ ID NO: 2010 - RNA, 22 nt, Human
auacugagagaaaaagcuuguc

SEQ ID NO: 2011 - RNA, 22 nt, Human
cacugcacuccacccugggcaa

SEQ ID NO: 2012 - RNA, 21 nt, Human
ugugauaguucuuuuggaggc

SEQ ID NO: 2013 - RNA, 22 nt, Human
ugucuucauccaggaaccacau

SEQ ID NO: 2014 - RNA, 22 nt, Human
uggcacagaucagcagaacagg

SEQ ID NO: 2015 - RNA, 22 nt, Human
uucaggcaccaggcacuuugcc

SEQ ID NO: 2016 - RNA, 22 nt, Human
uucuggugaauucaggauggua

SEQ ID NO: 2017 - RNA, 22 nt, Human
uugcaaggaaggggaggaggcu

SEQ ID NO: 2018 - RNA, 22 nt, Human
auucaagauaagggucugggag

SEQ ID NO: 2019 - RNA, 22 nt, Human
aggggguuuagcuccacagggu

SEQ ID NO: 2020 - RNA, 22 nt, Human
aggccagagaggacucucuuuu

SEQ ID NO: 2021 - RNA, 22 nt, Human
agcuccaggagcuggcaggagg

SEQ ID NO: 2022 - RNA, 22 nt, Human
agguagggaggguagaugcucu

SEQ ID NO: 2023 - RNA, 22 nt, Human
agagcuaggaagauacaggguu

SEQ ID NO: 2024 - RNA, 22 nt, Human
auuuauuuucccucaaguaccu

SEQ ID NO: 2025 - RNA, 22 nt, Human
ggccugaggucagcaguagagg

SEQ ID NO: 2026 - RNA, 22 nt, Human
ccuuguguuuuccagauucuga

SEQ ID NO: 2027 - RNA, 22 nt, Human
uuacaaaauuuggagggauugu

SEQ ID NO: 2028 - RNA, 22 nt, Human
uccaaaaguggagaggaauaug

SEQ ID NO: 2029 - RNA, 22 nt, Human
gugagaauggaggaagaacagu

SEQ ID NO: 2030 - RNA, 22 nt, Human
gucuuccuccguccccaccucc

SEQ ID NO: 2031 - RNA, 22 nt, Human
uucugugcagguuaacauuucu

SEQ ID NO: 2032 - RNA, 22 nt, Human
ugaaaugcuuuuaggacacugc

SEQ ID NO: 2033 - RNA, 22 nt, Human
ucuuuuuguuguagcuguaugg

SEQ ID NO: 2034 - RNA, 22 nt, Human
uaagaagagaaagaagaggcug

SEQ ID NO: 2035 - RNA, 22 nt, Human
uggcucugugcuucuaguaucu

SEQ ID NO: 2036 - RNA, 22 nt, Human
agcaagaugguagcauuggaga

SEQ ID NO: 2037 - RNA, 22 nt, Human
acacaucuaauggcugugcuga

SEQ ID NO: 2038 - RNA, 22 nt, Human
uuccugguggaggcauucggag

SEQ ID NO: 2039 - RNA, 22 nt, Human
cacacagucguguaguuuugcg

SEQ ID NO: 2040 - RNA, 22 nt, Human
gcuucuccuguccccucccuac

SEQ ID NO: 2041 - RNA, 22 nt, Human
cuggcugcauuuaggaacaagg

SEQ ID NO: 2042 - RNA, 22 nt, Human
ugugaaggaggaagggaggagc

SEQ ID NO: 2043 - RNA, 22 nt, Human
guccuggagcuguuggagaaau

SEQ ID NO: 2044 - RNA, 22 nt, Human
gggggaucauuauaaaaauacu

SEQ ID NO: 2045 - RNA, 22 nt, Human
gagguuugagccuucuccugcu

SEQ ID NO: 2046 - RNA, 22 nt, Human
cucugccucccgggucuaggcu

SEQ ID NO: 2047 - RNA, 22 nt, Human
cucugagucugagagaguaggu

SEQ ID NO: 2048 - RNA, 22 nt, Human
ugugagagaaauggcaaguugg

SEQ ID NO: 2049 - RNA, 22 nt, Human
uggcucugucuauugggaugug

SEQ ID NO: 2050 - RNA, 22 nt, Human
ugcaugaugcugagguuuggga

SEQ ID NO: 2051 - RNA, 22 nt, Human
uacucauuuaugcauuguuuug

SEQ ID NO: 2052 - RNA, 22 nt, Human
ugacuggaggaagggagguaag

SEQ ID NO: 2053 - RNA, 22 nt, Human
uuucauucauuucuuucaugga

SEQ ID NO: 2054 - RNA, 22 nt, Human
gugagaauggaggaagaacagu

SEQ ID NO: 2055 - RNA, 22 nt, Human
cugggauuacaggugugaacca

SEQ ID NO: 2056 - RNA, 22 nt, Human
cuggcuaauuuucuugaguuuu

SEQ ID NO: 2057 - RNA, 22 nt, Human
gccuguaaucccagcuacuugg

SEQ ID NO: 2058 - RNA, 22 nt, Human
gccucaguuguggccagggauu

SEQ ID NO: 2059 - RNA, 22 nt, Human
auaaagcuagacguucauugac

SEQ ID NO: 2060 - RNA, 22 nt, Human
uguaaacauccccgacuggaag

SEQ ID NO: 2061 - RNA, 22 nt, Human
uugugcuuguacugaccaugua

SEQ ID NO: 2062 - RNA, 22 nt, Human
aagcuggccuguaccugcugag

SEQ ID NO: 2063 - RNA, 22 nt, Human
aaaggaguuugugacauugaca

SEQ ID NO: 2064 - RNA, 22 nt, Human
auuguaaauuaacaauuugcuc

SEQ ID NO: 2065 - RNA, 22 nt, Human
augagaguaggaguuugggcuc

SEQ ID NO: 2066 - RNA, 22 nt, Human
aguuaugugaugcuuugaagca

SEQ ID NO: 2067 - RNA, 22 nt, Human
agggaguuuacauguuuucuaa

SEQ ID NO: 2068 - RNA, 22 nt, Human
aggcuuuuggagaagcauaugc

SEQ ID NO: 2069 - RNA, 22 nt, Human
aaaguggcuggaguggagucuu

SEQ ID NO: 2070 - RNA, 22 nt, Human
aagcagaacuguuuuguuuucu

SEQ ID NO: 2071 - RNA, 22 nt, Human
acagggcuaaggauguuugcug

SEQ ID NO: 2072 - RNA, 22 nt, Human
aacugcuuuuguugugcaggga

SEQ ID NO: 2073 - RNA, 22 nt, Human
caagugcuugaacauggcagag

SEQ ID NO: 2074 - RNA, 22 nt, Human
aguaagcaaacucaguuuaauc

SEQ ID NO: 2075 - RNA, 22 nt, Human
ggcaaaaaaauagagcagaggg

SEQ ID NO: 2076 - RNA, 22 nt, Human
gagaugacugguggcugggggc

SEQ ID NO: 2077 - RNA, 22 nt, Human
gaagcauugugagaaacagguu

SEQ ID NO: 2078 - RNA, 22 nt, Human
gacaagaggcacagacagcagg

SEQ ID NO: 2079 - RNA, 22 nt, Human
cauaucuccagguucugcugga

SEQ ID NO: 2080 - RNA, 22 nt, Human
cagugggaaaaguuugucucau

SEQ ID NO: 2081 - RNA, 22 nt, Human
guggcaccauuggagucuaagg

SEQ ID NO: 2082 - RNA, 22 nt, Human
uuuguaauagcaaaauacugga

SEQ ID NO: 2083 - RNA, 22 nt, Human
ucugccucccugucucacucuc

SEQ ID NO: 2084 - RNA, 22 nt, Human
ugagguuaguaguuugagacca

SEQ ID NO: 2085 - RNA, 22 nt, Human
ugaguauucaccaggugcuggg

SEQ ID NO: 2086 - RNA, 22 nt, Human
uccccaagccuuguaccagcgu

SEQ ID NO: 2087 - RNA, 22 nt, Human
uaggcagucucaguuguugggu

SEQ ID NO: 2088 - RNA, 22 nt, Human
ugggaaaaaaggcaguuuagaa

SEQ ID NO: 2089 - RNA, 22 nt, Human
ugugaaggaggaagggaggagc

SEQ ID NO: 2090 - RNA, 22 nt, Human
uguuaacauuuuggcuagauag

SEQ ID NO: 2091 - RNA, 22 nt, Human
uguguuggagcagaggcagggg

SEQ ID NO: 2092 - RNA, 21 nt, Human
ugugauaguucuuuuggaggc

SEQ ID NO: 2093 - RNA, 22 nt, Human
uucccuuaggucuggaauggua

SEQ ID NO: 2094 - RNA, 22 nt, Human
cucugccucccgggucuaggcu

SEQ ID NO: 2095 - RNA, 22 nt, Human
cccugggcugguguuugacuug

SEQ ID NO: 2096 - RNA, 22 nt, Human
gaggaagguaaugaucuugauc

SEQ ID NO: 2097 - RNA, 22 nt, Human
gaggagggcuuucccugacuuu

SEQ ID NO: 2098 - RNA, 21 nt, Human
gccuccauuucuacaucucua

SEQ ID NO: 2099 - RNA, 22 nt, Human
ggaagaaugugcuuuuguuguu

SEQ ID NO: 2100 - RNA, 22 nt, Human
uggcaaagaaggcaguacaguu

SEQ ID NO: 2101 - RNA, 22 nt, Human
ugagauggugucauauugcugg

SEQ ID NO: 2102 - RNA, 22 nt, Human
uagggaaugaacaaauagaggc

SEQ ID NO: 2103 - RNA, 22 nt, Human
ugaaaugcuuuuaggacacugc

SEQ ID NO: 2104 - RNA, 22 nt, Human
guauguauuuauagauguucuu

SEQ ID NO: 2105 - RNA, 22 nt, Human
ccguaaaauguucaaauguuuu

SEQ ID NO: 2106 - RNA, 22 nt, Human
cugcagauuuugggguccacag

SEQ ID NO: 2107 - RNA, 22 nt, Human
cugccauuuccaggagaucacc

SEQ ID NO: 2108 - RNA, 22 nt, Human
cuggcucccaggaggccucucu

SEQ ID NO: 2109 - RNA, 22 nt, Human
gggggaucauuauaaaaauacu

SEQ ID NO: 2110 - RNA, 22 nt, Human
aguauuacagcagguacugguu

SEQ ID NO: 2111 - RNA, 22 nt, Human
uuuuuaucuuuuucuccagaug

SEQ ID NO: 2112 - RNA, 22 nt, Human
uugcccaggcuggagugcagug

SEQ ID NO: 2113 - RNA, 22 nt, Human
uugcccaggcuagagugcagug

SEQ ID NO: 2114 - RNA, 22 nt, Human
uucagcauugccaguguuucca

SEQ ID NO: 2115 - RNA, 22 nt, Human
cugcugccuuucucucagagau

SEQ ID NO: 2116 - RNA, 22 nt, Human
ccccagucaaugcuucucucca

SEQ ID NO: 2117 - RNA, 22 nt, Human
gugugggcagggccgugcuccc

SEQ ID NO: 2118 - RNA, 22 nt, Human
uggagcagaaaggcaggagucc

SEQ ID NO: 2119 - RNA, 22 nt, Human
ucuuggugcuuuugcuggauga

SEQ ID NO: 2120 - RNA, 22 nt, Human
ucuggcuccugaguccuagcuc

SEQ ID NO: 2121 - RNA, 22 nt, Human
uagguugugcgcuccuuaugag

SEQ ID NO: 2122 - RNA, 22 nt, Human
ugcuaggcuuauucucuuccuc

SEQ ID NO: 2123 - RNA, 22 nt, Human
acauuuccaauguuuggggaca

SEQ ID NO: 2124 - RNA, 22 nt, Human
agugcagguucacaggcugggc

SEQ ID NO: 2125 - RNA, 20 nt, Human
acaggagcauggagaggcua

SEQ ID NO: 2126 - RNA, 22 nt, Human
ugugcugguugcccccgagggg

SEQ ID NO: 2127 - RNA, 22 nt, Human
ucuuggugcuuuugcuggauga

SEQ ID NO: 2128 - RNA, 22 nt, Human
gucuggaggcuggaaccuggug

SEQ ID NO: 2129 - RNA, 22 nt, Human
gguccacaaggggagagcaggg

SEQ ID NO: 2130 - RNA, 22 nt, Human
ggagcuguaacagaucuguucu

SEQ ID NO: 2131 - RNA, 22 nt, Human
ugguggggagaggcuugggaag

SEQ ID NO: 2132 - RNA, 22 nt, Human
ugguuaguuuuaugggccugga

SEQ ID NO: 2133 - RNA, 22 nt, Human
agugcagguucacaggcugggc

SEQ ID NO: 2134 - RNA, 22 nt, Human
cacccucugccugugguugucu

SEQ ID NO: 2135 - RNA, 22 nt, Human
uugcaaggaaggggaggaggcu

SEQ ID NO: 2136 - RNA, 22 nt, Human
ggaagaaugugcuuuuguuguu

SEQ ID NO: 2137 - RNA, 22 nt, Human
ggcaaggaagaaagcagaaguu

SEQ ID NO: 2138 - RNA, 22 nt, Human
ggaguaugagagagaaugggac

SEQ ID NO: 2139 - RNA, 22 nt, Human
ggcaugugugagcagcugcagg

SEQ ID NO: 2140 - RNA, 22 nt, Human
ggcugcagugaacuaugaucgu

SEQ ID NO: 2141 - RNA, 22 nt, Human
cauaaaaucagaaaguauuacu

SEQ ID NO: 2142 - RNA, 22 nt, Human
uuugcagcuuccaaauuucuga

SEQ ID NO: 2143 - RNA, 22 nt, Human
agcugagaaagcgaagaggugg

SEQ ID NO: 2144 - RNA, 22 nt, Human
uccagggugggccucagacccu

SEQ ID NO: 2145 - RNA, 22 nt, Human
ucccgugugaaaauuuguaugc

SEQ ID NO: 2146 - RNA, 22 nt, Human
uggaauugaguucccuggguuu

SEQ ID NO: 2147 - RNA, 22 nt, Human
ugaguuuaagcuaagaagucug

SEQ ID NO: 2148 - RNA, 22 nt, Human
ugaaaugcuuuuaggacacugc

SEQ ID NO: 2149 - RNA, 22 nt, Human
ucccacagcuuccuagccacag

SEQ ID NO: 2150 - RNA, 22 nt, Human
gcaggugugcaaaucacaacuu

SEQ ID NO: 2151 - RNA, 22 nt, Human
gacccuguguucaagguuaggg

SEQ ID NO: 2152 - RNA, 22 nt, Human
gagguagagguugcagugaguc

SEQ ID NO: 2153 - RNA, 22 nt, Human
gucgggaggaaaagaaagaaga

SEQ ID NO: 2154 - RNA, 22 nt, Human
guaaagaaaucauaaaagucca

SEQ ID NO: 2155 - RNA, 22 nt, Human
guaacaaaaugaauaauaccug

SEQ ID NO: 2156 - RNA, 22 nt, Human
cugugagcuauuuguuuugguu

SEQ ID NO: 2157 - RNA, 22 nt, Human
aagucaccugaaaacucaacua

SEQ ID NO: 2158 - RNA, 22 nt, Human
agagauaaagagguuuaggcag

SEQ ID NO: 2159 - RNA, 22 nt, Human
agauggaguugcaggugguccu

SEQ ID NO: 2160 - RNA, 22 nt, Human
acacaggcccagagaggcagug

SEQ ID NO: 2161 - RNA, 22 nt, Human
acugcacuccagccuggguggc

SEQ ID NO: 2162 - RNA, 22 nt, Human
gacaagaggcacagacagcagg

SEQ ID NO: 2163 - RNA, 22 nt, Human
cuuggcccugugaggcuucacc

SEQ ID NO: 2164 - RNA, 22 nt, Human
cggugcuguucaacagguccug

SEQ ID NO: 2165 - RNA, 22 nt, Human
ccaaagugcuaggauuacagcc

SEQ ID NO: 2166 - RNA, 22 nt, Human
ccacugcacuccagccugggug

SEQ ID NO: 2167 - RNA, 22 nt, Human
ggaggcagugguugcagugagc

SEQ ID NO: 2168 - RNA, 22 nt, Human
gagaggugaagccaggcuucug

SEQ ID NO: 2169 - RNA, 22 nt, Human
gaggugaagaucuuggagucug

SEQ ID NO: 2170 - RNA, 22 nt, Human
gcugcuccugcucucccucucc

SEQ ID NO: 2171 - RNA, 22 nt, Human
gcuggguugagcugggcugaga

SEQ ID NO: 2172 - RNA, 22 nt, Human
ucuggauuugagaggcuuuacu

SEQ ID NO: 2173 - RNA, 22 nt, Human
guugggguuucaguggcaguca

SEQ ID NO: 2174 - RNA, 22 nt, Human
guggcauuggugguggcauugg

SEQ ID NO: 2175 - RNA, 22 nt, Human
ugcgccccuguacucugggcaa

SEQ ID NO: 2176 - RNA, 22 nt, Human
uguguuggagcagaggcagggg

SEQ ID NO: 2177 - RNA, 22 nt, Human
uggaggcaggugcagauggagg

SEQ ID NO: 2178 - RNA, 22 nt, Human
cauaucuccagguucugcugga

SEQ ID NO: 2179 - RNA, 22 nt, Human
ccagccugagguuccuggaggg

SEQ ID NO: 2180 - RNA, 22 nt, Human
gagguuugagccuucuccugcu

SEQ ID NO: 2181 - RNA, 22 nt, Human
cuggcucccucucuucucuccc

SEQ ID NO: 2182 - RNA, 22 nt, Human
gcugcuccugcucucccucucc

SEQ ID NO: 2183 - RNA, 22 nt, Human
cugaauagaacagaagagcagc

SEQ ID NO: 2184 - RNA, 22 nt, Human
agugguuucagggacuucugua

SEQ ID NO: 2185 - RNA, 22 nt, Human
uguggcuuaggugagcauguga

SEQ ID NO: 2186 - RNA, 22 nt, Human
uucaagaaagccaagauggcug

SEQ ID NO: 2187 - RNA, 22 nt, Human
uguaaacaucccacacacucag

SEQ ID NO: 2188 - RNA, 22 nt, Human
uuugcacacuuuccaaguugcc

SEQ ID NO: 2189 - RNA, 22 nt, Human
cacacagucguguaguuuugcg

SEQ ID NO: 2190 - RNA, 22 nt, Human
guaaagaaaucauaaaagucca

SEQ ID NO: 2191 - RNA, 22 nt, Human
cugaauguaaucuuaguuguaa

SEQ ID NO: 2192 - RNA, 22 nt, Human
gcagugaaggaggcaugugauc

SEQ ID NO: 2193 - RNA, 22 nt, Human
uggagccuuguuguuuguucac

SEQ ID NO: 2194 - RNA, 22 nt, Human
uugucagaggcugguagggugu

SEQ ID NO: 2195 - RNA, 22 nt, Human
uugugcuuguacugaccaugua

SEQ ID NO: 2196 - RNA, 22 nt, Human
uucuuuuuccgcuuucugagcc

SEQ ID NO: 2197 - RNA, 22 nt, Human
uaggagugaaaauaaacucugu

SEQ ID NO: 2198 - RNA, 22 nt, Human
uacaguucugguuucuucuuua

SEQ ID NO: 2199 - RNA, 22 nt, Human
uaaguaaagagagaagccagaa

SEQ ID NO: 2200 - RNA, 22 nt, Human
guggcauuggugguggcauugg

SEQ ID NO: 2201 - RNA, 22 nt, Human
ucugagcccaggaguuugaggc

SEQ ID NO: 2202 - RNA, 22 nt, Human
acugcagcuucagggacuugug

SEQ ID NO: 2203 - RNA, 22 nt, Human
acacaggcccagagaggcagug

SEQ ID NO: 2204 - RNA, 22 nt, Human
aaucccagcuacucgggaggcu

SEQ ID NO: 2205 - RNA, 22 nt, Human
aaaggaguuugugacauugaca

SEQ ID NO: 2206 - RNA, 22 nt, Human
agugcagguucacaggcugggc

SEQ ID NO: 2207 - RNA, 22 nt, Human
aggcaagagguugcagugagcu

SEQ ID NO: 2208 - RNA, 22 nt, Human
uucugccacugcauuccagccu

SEQ ID NO: 2209 - RNA, 22 nt, Human
ugcaccacuacacuccuaggca

SEQ ID NO: 2210 - RNA, 22 nt, Human
ugcaccacugcacuccagccug

SEQ ID NO: 2211 - RNA, 22 nt, Human
agcugugagccugccuuccagu

SEQ ID NO: 2212 - RNA, 22 nt, Human
aggcugagugacugggaguuag

SEQ ID NO: 2213 - RNA, 22 nt, Human
ugcaccacugcacucuaaccug

SEQ ID NO: 2214 - RNA, 22 nt, Human
uggaaagcauguacauuuggag

SEQ ID NO: 2215 - RNA, 22 nt, Human
ugagggggaaggugugugugug

SEQ ID NO: 2216 - RNA, 22 nt, Human
gccauugcacuccagccuggac

SEQ ID NO: 2217 - RNA, 21 nt, Human
gacacaggcccagagaggcag

SEQ ID NO: 2218 - RNA, 22 nt, Human
cggcaagaugccggagugcugg

SEQ ID NO: 2219 - RNA, 22 nt, Human
ccacugcacuccagcacuccag

SEQ ID NO: 2220 - RNA, 22 nt, Human
cacugcacuccagccuggguga

SEQ ID NO: 2221 - RNA, 22 nt, Human
cacugcacuccagccuaggcaa

SEQ ID NO: 2222 - RNA, 22 nt, Human
ggcugggcaugguggcucacgc

SEQ ID NO: 2223 - RNA, 22 nt, Human
gccauugcacuccagccugggc

SEQ ID NO: 2224 - RNA, 22 nt, Human
ccagccugagguuccuggaggg

SEQ ID NO: 2225 - RNA, 22 nt, Human
ccacugcacuccagccugggug

SEQ ID NO: 2226 - RNA, 22 nt, Human
cacugcacuguagccuccuggg

SEQ ID NO: 2227 - RNA, 22 nt, Human
cacugcacucuagccucgguga

SEQ ID NO: 2228 - RNA, 22 nt, Human
cacugcacuccagccugggcga

SEQ ID NO: 2229 - RNA, 22 nt, Human
uuugcacuguaauaccucgguc

SEQ ID NO: 2230 - RNA, 22 nt, Human
uguaaacuugucuugaauggaa

SEQ ID NO: 2231 - RNA, 22 nt, Human
uggggcacuguggaggugucau

SEQ ID NO: 2232 - RNA, 22 nt, Human
cuguccugugucagccugaaau

SEQ ID NO: 2233 - RNA, 22 nt, Human
augggcaaauacugggagcugg

SEQ ID NO: 2234 - RNA, 22 nt, Human
aagcuggccuguaccugcugag

SEQ ID NO: 2235 - RNA, 22 nt, Human
aaucuccauuuguaaaugugac

SEQ ID NO: 2236 - RNA, 22 nt, Human
acugcacuccauccugggacag

SEQ ID NO: 2237 - RNA, 21 nt, Human
cuuuggcaagggagaagucac

SEQ ID NO: 2238 - RNA, 22 nt, Human
gguccacaaggggagagcaggg

SEQ ID NO: 2239 - RNA, 22 nt, Human
uggagagauaagccaaguaucc

SEQ ID NO: 2240 - RNA, 22 nt, Human
uggaagaauaggcaguauugga

SEQ ID NO: 2241 - RNA, 22 nt, Human
uccaaagacucaacaguuagac

SEQ ID NO: 2242 - RNA, 22 nt, Human
agcuccaggagcuggcaggagg

SEQ ID NO: 2243 - RNA, 22 nt, Human
ugcaaguugucuucuagggugu

SEQ ID NO: 2244 - RNA, 22 nt, Human
uggagagaaagcgaagauguag

SEQ ID NO: 2245 - RNA, 22 nt, Human
uggagagagcagguugcuaaga

SEQ ID NO: 2246 - RNA, 22 nt, Human
uucaggacugucuggauuuauu

SEQ ID NO: 2247 - RNA, 22 nt, Human
ucacugcaaccucugcuucugg

SEQ ID NO: 2248 - RNA, 22 nt, Human
cacugcacuccagccugggcga

SEQ ID NO: 2249 - RNA, 22 nt, Human
cacugcacuccagccuggguga

SEQ ID NO: 2250 - RNA, 22 nt, Human
ccaaagugcuggcguuacaggu

SEQ ID NO: 2251 - RNA, 22 nt, Human
gaguuaagcaaagagaggaaga

SEQ ID NO: 2252 - RNA, 22 nt, Human
gaguacaaaugaagucuguggg

SEQ ID NO: 2253 - RNA, 22 nt, Human
gcaggcugguuggugaggcaaa

SEQ ID NO: 2254 - RNA, 22 nt, Human
ggcaugauggagaggguggaga

SEQ ID NO: 2255 - RNA, 22 nt, Human
gcuguguuaacuguucaaacuc

SEQ ID NO: 2256 - RNA, 22 nt, Human
ggaaaacaaguaccccuggaac

SEQ ID NO: 2257 - RNA, 22 nt, Human
gggccaugacagggagauaggc

SEQ ID NO: 2258 - RNA, 22 nt, Human
cuuuuccugggucugggcugug

SEQ ID NO: 2259 - RNA, 22 nt, Human
agguggaguuuugcuuucccau

SEQ ID NO: 2260 - RNA, 22 nt, Human
ugugaaggaggaagggaggagc

SEQ ID NO: 2261 - RNA, 22 nt, Human
uguggcagaaggcucuggauua

SEQ ID NO: 2262 - RNA, 22 nt, Human
ucacccaguguaaacagcauga

SEQ ID NO: 2263 - RNA, 22 nt, Human
ucuggauuugagaggcuuuacu

SEQ ID NO: 2264 - RNA, 22 nt, Human
ucugucauuuuucucuuuccau

SEQ ID NO: 2265 - RNA, 22 nt, Human
ucugguuugagagacaaugaca

SEQ ID NO: 2266 - RNA, 22 nt, Human
ugacuggaggaagggagguaag

SEQ ID NO: 2267 - RNA, 22 nt, Human
uagacugaggcuuccugcaggg

SEQ ID NO: 2268 - RNA, 21 nt, Human
uucacccaucuuuccacccac

SEQ ID NO: 2269 - RNA, 22 nt, Human
uucacccaucuuuccacccacg

SEQ ID NO: 2270 - RNA, 22 nt, Human
ugucuucauccaggaaccacau

SEQ ID NO: 2271 - RNA, 22 nt, Human
ugguggggagaggcuugggaag

SEQ ID NO: 2272 - RNA, 22 nt, Human
ugguccagaggaggaaugaggg

SEQ ID NO: 2273 - RNA, 22 nt, Human
uggauuaguaaagaagaaugaa

SEQ ID NO: 2274 - RNA, 22 nt, Human
uggagugucuggaggugucucu

SEQ ID NO: 2275 - RNA, 22 nt, Human
ugagagaggaaggccguaggga

SEQ ID NO: 2276 - RNA, 22 nt, Human
uaaggcacugcuucuaaguagg

SEQ ID NO: 2277 - RNA, 22 nt, Human
guggcauuggugguggcauugg

SEQ ID NO: 2278 - RNA, 22 nt, Human
guccagugcucacugccgacau

SEQ ID NO: 2279 - RNA, 22 nt, Human
ucacuugccuagggucacacag

SEQ ID NO: 2280 - RNA, 22 nt, Human
ucccuuugaagccagguuccag

SEQ ID NO: 2281 - RNA, 22 nt, Human
uggaaugacagaagaugagagc

SEQ ID NO: 2282 - RNA, 22 nt, Human
ugagggaggaaguuugggauga

SEQ ID NO: 2283 - RNA, 22 nt, Human
ugauggaggaaauggugguauc

SEQ ID NO: 2284 - RNA, 22 nt, Human
ggcccaggagggggagaaaggc

SEQ ID NO: 2285 - RNA, 22 nt, Human
gagaugacugguggcugggggc

SEQ ID NO: 2286 - RNA, 22 nt, Human
gcagugaaggaggcaugugauc

SEQ ID NO: 2287 - RNA, 22 nt, Human
gccuggaugugaccacccucac

SEQ ID NO: 2288 - RNA, 22 nt, Human
gcugaauuuugacuccaucucc

SEQ ID NO: 2289 - RNA, 22 nt, Human
gcccaggagucugaggcuggag

SEQ ID NO: 2290 - RNA, 22 nt, Human
gcuucuccuguccccucccuac

SEQ ID NO: 2291 - RNA, 22 nt, Human
cuuuggccacggggauaugaau

SEQ ID NO: 2292 - RNA, 22 nt, Human
cuuggcccugugaggcuucacc

SEQ ID NO: 2293 - RNA, 22 nt, Human
cugcccugaacucuggccaucc

SEQ ID NO: 2294 - RNA, 22 nt, Human
cacccucugccugugguugucu

SEQ ID NO: 2295 - RNA, 22 nt, Human
ccagccugagguuccuggaggg

SEQ ID NO: 2296 - RNA, 22 nt, Human
aaaguguguuaucuagguaguc

SEQ ID NO: 2297 - RNA, 22 nt, Human
aagguggugucauguuuugggg

SEQ ID NO: 2298 - RNA, 22 nt, Human
accaucuucccuuucucgagua

SEQ ID NO: 2299 - RNA, 22 nt, Human
aggcaagagguugcagugagcu

SEQ ID NO: 2300 - RNA, 22 nt, Human
aggcagguggguguaugggucu

SEQ ID NO: 2301 - RNA, 22 nt, Human
aggcugagugcaguggugugau

SEQ ID NO: 2302 - RNA, 22 nt, Human
acugcagcuucagggacuugug

SEQ ID NO: 2303 - RNA, 22 nt, Human
agguagggaggguagaugcucu

SEQ ID NO: 2304 - RNA, 22 nt, Human
aggcaguaagggagaguuuugc

SEQ ID NO: 2305 - RNA, 22 nt, Human
aucacuauuaaugugugcuagu

SEQ ID NO: 2306 - RNA, 22 nt, Human
acaaccucugccuccuggguuc

SEQ ID NO: 2307 - RNA, 22 nt, Human
aaugugcauggaucgcucagaa

SEQ ID NO: 2308 - RNA, 22 nt, Human
aaaggcagacggugaaugccuu

SEQ ID NO: 2309 - RNA, 22 nt, Human
acugcacuccaaccaggcugac

SEQ ID NO: 2310 - RNA, 22 nt, Human
ccagccugagguuccuggaggg

SEQ ID NO: 2311 - RNA, 22 nt, Human
cagguggugcuguuaagaagca

SEQ ID NO: 2312 - RNA, 22 nt, Human
cagagcugccuuucccuuccug

SEQ ID NO: 2313 - RNA, 22 nt, Human
gagaaguaggaauaucaggagu

SEQ ID NO: 2314 - RNA, 22 nt, Human
gguccacaaggggagagcaggg

SEQ ID NO: 2315 - RNA, 22 nt, Human
gucaccaggcagaauucagaua

SEQ ID NO: 2316 - RNA, 22 nt, Human
uggaagaauaggcaguauugga

SEQ ID NO: 2317 - RNA, 22 nt, Human
ugcagauacauguguaacugaa

SEQ ID NO: 2318 - RNA, 22 nt, Human
ucugagcccaggaguuugaggc

SEQ ID NO: 2319 - RNA, 22 nt, Human
ugaaaagccuuuggguagugau

SEQ ID NO: 2320 - RNA, 22 nt, Human
ucaaagcugcagauugccugug

SEQ ID NO: 2321 - RNA, 22 nt, Human
uacaggcaggcacagaggcagu

SEQ ID NO: 2322 - RNA, 22 nt, Human
uagcucauuuuugaaaucaguu

SEQ ID NO: 2323 - RNA, 22 nt, Human
uuuguguccugacccagaggac

SEQ ID NO: 2324 - RNA, 22 nt, Human
aggccuuuuugggaagagacag

SEQ ID NO: 2325 - RNA, 22 nt, Human
uugucagaggcugguagggugu

SEQ ID NO: 2326 - RNA, 22 nt, Human
ugcaaguugucuucuagggugu

SEQ ID NO: 2327 - RNA, 22 nt, Human
uggagcagaaaggcaggagucc

SEQ ID NO: 2328 - RNA, 22 nt, Human
uggaggcaggugcagauggagg

SEQ ID NO: 2329 - RNA, 22 nt, Human
uagacugaggcuuccugcaggg

SEQ ID NO: 2330 - RNA, 22 nt, Human
uucacaguggcugaagcuguuc

SEQ ID NO: 2331 - RNA, 22 nt, Human
uuaaagaucacuugacauggac

SEQ ID NO: 2332 - RNA, 22 nt, Human
uuaacugagaggaucugaguag

SEQ ID NO: 2333 - RNA, 22 nt, Human
ugggaggcuacacguuucucca

SEQ ID NO: 2334 - RNA, 22 nt, Human
uggauuaguaaagaagaaugaa

SEQ ID NO: 2335 - RNA, 22 nt, Human
cacagcauuggucaugagguca

SEQ ID NO: 2336 - RNA, 22 nt, Human
auaccagcacaguggaugggga

SEQ ID NO: 2337 - RNA, 22 nt, Human
gagagagguagaggggagcaga

SEQ ID NO: 2338 - RNA, 21 nt, Human
gacacaggcccagagaggcag

SEQ ID NO: 2339 - RNA, 22 nt, Human
gagguagagguugcagugaguc

SEQ ID NO: 2340 - RNA, 22 nt, Human
cuggcucccucucuucucuccc

SEQ ID NO: 2341 - RNA, 22 nt, Human
cuggaagacaugguagagcuga

SEQ ID NO: 2342 - RNA, 22 nt, Human
cugaauagaacagaagagcagc

SEQ ID NO: 2343 - RNA, 22 nt, Human
cuggcugcauuuaggaacaagg

SEQ ID NO: 2344 - RNA, 22 nt, Human
ccccagucaaugcuucucucca

SEQ ID NO: 2345 - RNA, 22 nt, Human
ggcaugauggagaggguggaga

SEQ ID NO: 2346 - RNA, 22 nt, Human
ggcagcugugcagagugggggu

SEQ ID NO: 2347 - RNA, 22 nt, Human
ggcaccaucucagcucacugga

SEQ ID NO: 2348 - RNA, 22 nt, Human
gaccagccauccugguuuacau

SEQ ID NO: 2349 - RNA, 22 nt, Human
uuuggggucuccccagcaugca

SEQ ID NO: 2350 - RNA, 22 nt, Human
ucaacuaugauuaccaaagcag

SEQ ID NO: 2351 - RNA, 22 nt, Human
uggcacagaucagcagaacagg

SEQ ID NO: 2352 - RNA, 22 nt, Human
ugauucauuucuaaacccagcu

SEQ ID NO: 2353 - RNA, 22 nt, Human
ugagguuaguaguuugagacca

SEQ ID NO: 2354 - RNA, 22 nt, Human
uggucucuugaaagaggcucuu

SEQ ID NO: 2355 - RNA, 22 nt, Human
uguagugugaaaggcauagugu

SEQ ID NO: 2356 - RNA, 22 nt, Human
agcaaguguugaaacagcuggu

SEQ ID NO: 2357 - RNA, 22 nt, Human
uagcugccaggcaacaaguacg

SEQ ID NO: 2358 - RNA, 22 nt, Human
uagacugaggcuuccugcaggg

SEQ ID NO: 2359 - RNA, 22 nt, Human
uccuuuggacaugggcaagggu

SEQ ID NO: 2360 - RNA, 22 nt, Human
ugauuguccaaacgcaauucuu

SEQ ID NO: 2361 - RNA, 22 nt, Human
ugagguaggugcugaaacugcu

SEQ ID NO: 2362 - RNA, 21 nt, Human
ugagguaggugcugaaacugc

SEQ ID NO: 2363 - RNA, 22 nt, Human
guaacaaaaugaauaauaccug

SEQ ID NO: 2364 - RNA, 22 nt, Human
gagcagguuuggaauggcucca

SEQ ID NO: 2365 - RNA, 22 nt, Human
gauuccuccucuuuaaaauggu

SEQ ID NO: 2366 - RNA, 22 nt, Human
cugcacuagaaggcacuauguu

SEQ ID NO: 2367 - RNA, 22 nt, Human
ccugggggccacuuugcacagg

SEQ ID NO: 2368 - RNA, 22 nt, Human
gaacagcuccagucuacagccc

SEQ ID NO: 2369 - RNA, 22 nt, Human
accaucuucccuuucucgagua

SEQ ID NO: 2370 - RNA, 22 nt, Human
agcugguguguagcggguaccu

SEQ ID NO: 2371 - RNA, 22 nt, Human
ggaagaaugugcuuuuguuguu

SEQ ID NO: 2372 - RNA, 22 nt, Human
ugcagcagaccuuuugccuucu

SEQ ID NO: 2373 - RNA, 22 nt, Human
gcugcuccugcucucccucucc

SEQ ID NO: 2374 - RNA, 22 nt, Human
gccuguaaucccagcuacuugg

SEQ ID NO: 2375 - RNA, 22 nt, Human
gcacucaagccuggguuacaga

SEQ ID NO: 2376 - RNA, 22 nt, Human
gccauugcacuccagccuggac

SEQ ID NO: 2377 - RNA, 22 nt, Human
ggcugcagugaacuaugaucgu

SEQ ID NO: 2378 - RNA, 22 nt, Human
cuugcacuccacagccugggug

SEQ ID NO: 2379 - RNA, 22 nt, Human
gagguagagguugcagugagug

SEQ ID NO: 2380 - RNA, 22 nt, Human
cucagauacuugggagguugag

SEQ ID NO: 2381 - RNA, 22 nt, Human
ccacugcacuccagccugggug

SEQ ID NO: 2382 - RNA, 22 nt, Human
cauugcacuccagccuggguga

SEQ ID NO: 2383 - RNA, 22 nt, Human
cauugcacuccacccuaggcaa

SEQ ID NO: 2384 - RNA, 22 nt, Human
uggcuguuugggguugccgugu

SEQ ID NO: 2385 - RNA, 22 nt, Human
ugucuggaggcgcaguuuucag

SEQ ID NO: 2386 - RNA, 22 nt, Human
agugagcuaugaucaugccggu

SEQ ID NO: 2387 - RNA, 22 nt, Human
cacugcacucagccugggugac

SEQ ID NO: 2388 - RNA, 22 nt, Human
cacugcacucuagccucgguga

SEQ ID NO: 2389 - RNA, 22 nt, Human
cacugcacuccagccugggcga

SEQ ID NO: 2390 - RNA, 22 nt, Human
cacugcacuccagcccggcaac

SEQ ID NO: 2391 - RNA, 22 nt, Human
cacugcacuccagccuaggcaa

SEQ ID NO: 2392 - RNA, 22 nt, Human
auugcacuccagccugggcaau

SEQ ID NO: 2393 - RNA, 22 nt, Human
auugcacuccagcuugggcaac

SEQ ID NO: 2394 - RNA, 22 nt, Human
auugcacuucagccugggugac

SEQ ID NO: 2395 - RNA, 22 nt, Human
ugagaucaucguuacaagcagc

SEQ ID NO: 2396 - RNA, 22 nt, Human
ugaguguaugugugagagagaa

SEQ ID NO: 2397 - RNA, 22 nt, Human
ugcaagucugugauuuuguguu

SEQ ID NO: 2398 - RNA, 22 nt, Human
ugcaccaaugcacuccagccug

SEQ ID NO: 2399 - RNA, 22 nt, Human
uccauugcacuccagucugggc

SEQ ID NO: 2400 - RNA, 22 nt, Human
uaguaguuagaggcugcaguga

SEQ ID NO: 2401 - RNA, 22 nt, Human
uauugcacuccagccugggcaa

SEQ ID NO: 2402 - RNA, 22 nt, Human
uugcacuccagccugggugaca

SEQ ID NO: 2403 - RNA, 22 nt, Human
uugcacuccagccuggguaaca

SEQ ID NO: 2404 - RNA, 22 nt, Human
uugcacuccagucugggugaca

SEQ ID NO: 2405 - RNA, 22 nt, Human
ugugccacugcacuccaugggu

SEQ ID NO: 2406 - RNA, 22 nt, Human
uucugccacugcauuccagccu

SEQ ID NO: 2407 - RNA, 22 nt, Human
ugcaccacugcacuccagccug

SEQ ID NO: 2408 - RNA, 22 nt, Human
ugcaccacugcacucuaaccug

SEQ ID NO: 2409 - RNA, 22 nt, Human
ucauccuuuucugcaaccuguu

SEQ ID NO: 2410 - RNA, 22 nt, Human
ucuuugaucucuuccggggcuu

SEQ ID NO: 2411 - RNA, 22 nt, Human
ggaauggauggaagugugugag

SEQ ID NO: 2412 - RNA, 22 nt, Human
gcugcuccugcucucccucucc

SEQ ID NO: 2413 - RNA, 22 nt, Human
gccauugcacuccagccugggc

SEQ ID NO: 2414 - RNA, 22 nt, Human
gagguagagguugcagugaguc

SEQ ID NO: 2415 - RNA, 22 nt, Human
gaggagguggggcagcagcagg

SEQ ID NO: 2416 - RNA, 22 nt, Human
guacuccagccugccuggguaa

SEQ ID NO: 2417 - RNA, 22 nt, Human
ggaggcagugguugcagugagc

SEQ ID NO: 2418 - RNA, 22 nt, Human
ggcaaggaagaaagcagaaguu

SEQ ID NO: 2419 - RNA, 22 nt, Human
cugggcgugugaggcggcugug

SEQ ID NO: 2420 - RNA, 22 nt, Human
cguguaaucccagcuacuuggg

SEQ ID NO: 2421 - RNA, 22 nt, Human
cacugcacuccagccuggguga

SEQ ID NO: 2422 - RNA, 22 nt, Human
cacugcacuguagccuccuggg

SEQ ID NO: 2423 - RNA, 22 nt, Human
cacugcacuccaaccuggacaa

SEQ ID NO: 2424 - RNA, 22 nt, Human
cacugcacuccacccugggcaa

SEQ ID NO: 2425 - RNA, 22 nt, Human
cacugcacuccagccuggguaa

SEQ ID NO: 2426 - RNA, 22 nt, Human
cauugcacuccagccuaggcaa

SEQ ID NO: 2427 - RNA, 22 nt, Human
ccacugcacuccagcacuccag

SEQ ID NO: 2428 - RNA, 22 nt, Human
aggcaagagguugcagugagcu

SEQ ID NO: 2429 - RNA, 22 nt, Human
acugcacuccauccugggacag

SEQ ID NO: 2430 - RNA, 22 nt, Human
acuguacuccagccuaggcaac

SEQ ID NO: 2431 - RNA, 22 nt, Human
acuguacuccagccugggugac

SEQ ID NO: 2432 - RNA, 22 nt, Human
acuguacuucagccuggguaac

SEQ ID NO: 2433 - RNA, 22 nt, Human
agauaguucucuguuguugggg

SEQ ID NO: 2434 - RNA, 22 nt, Human
auggccuuuucucuuauccugg

SEQ ID NO: 2435 - RNA, 22 nt, Human
auugcacuccagccugggugac

SEQ ID NO: 2436 - RNA, 22 nt, Human
auuguucuccagccugggcgac

SEQ ID NO: 2437 - RNA, 22 nt, Human
acugcacuccagccuaugggau

SEQ ID NO: 2438 - RNA, 22 nt, Human
acugcacuccagccuggcgaca

SEQ ID NO: 2439 - RNA, 22 nt, Human
acagcaguccagccugggugac

SEQ ID NO: 2440 - RNA, 22 nt, Human
acugcacuccagccugggcgau

SEQ ID NO: 2441 - RNA, 22 nt, Human
aaauccuggggaucuggaggga

SEQ ID NO: 2442 - RNA, 22 nt, Human
aaucccagcuacucgggaggcu

SEQ ID NO: 2443 - RNA, 22 nt, Human
acugcacuccaaccaggcugac

SEQ ID NO: 2444 - RNA, 22 nt, Human
accugcauuccagccugcugac

SEQ ID NO: 2445 - RNA, 22 nt, Human
acugcacuccagucuaggugac

SEQ ID NO: 2446 - RNA, 22 nt, Human
acugcacuccagccuguugaca

SEQ ID NO: 2447 - RNA, 22 nt, Human
acugcacucuagccugagcaac

SEQ ID NO: 2448 - RNA, 22 nt, Human
acugcacuccugccugggugac

SEQ ID NO: 2449 - RNA, 22 nt, Human
acugcacucuagccuaggugau

SEQ ID NO: 2450 - RNA, 22 nt, Human
acugcacuccagccugggugac

SEQ ID NO: 2451 - RNA, 22 nt, Human
acuguacuccagccugggcaac

SEQ ID NO: 2452 - RNA, 22 nt, Human
acuguacuccacccugggcgac

SEQ ID NO: 2453 - RNA, 22 nt, Human
acuguacuucagccugggcaac

SEQ ID NO: 2454 - RNA, 22 nt, Human
acugcacuucagccugggcaau

SEQ ID NO: 2455 - RNA, 22 nt, Human
acugcacucuagccugggcaac

SEQ ID NO: 2456 - RNA, 22 nt, Human
acugcacuccauccuggggagc

SEQ ID NO: 2457 - RNA, 22 nt, Human
acugcacuccugccuaggugac

SEQ ID NO: 2458 - RNA, 22 nt, Human
acugcacuccagccuggguggc

SEQ ID NO: 2459 - RNA, 22 nt, Human
acugcacuccagccugggugau

SEQ ID NO: 2460 - RNA, 22 nt, Human
acugcacuccagucugggugac

SEQ ID NO: 2461 - RNA, 22 nt, Human
acugcacuccauccugagugac

SEQ ID NO: 2462 - RNA, 22 nt, Human
agaaguguaaauaaguauguau

SEQ ID NO: 2463 - RNA, 22 nt, Human
aaccugucauuccaaggacagu

SEQ ID NO: 2464 - RNA, 22 nt, Human
augcccuuccucuucugccaug

SEQ ID NO: 2465 - RNA, 22 nt, Human
cccaggcuggagugcaguggug

SEQ ID NO: 2466 - RNA, 22 nt, Human
cacccaggcuggagugcagugg

SEQ ID NO: 2467 - RNA, 22 nt, Human
ccaggguacucugggaucacuu

SEQ ID NO: 2468 - RNA, 22 nt, Human
cgacucuugaccauggcugggg

SEQ ID NO: 2469 - RNA, 22 nt, Human
cugcugccuuucucucagagau

SEQ ID NO: 2470 - RNA, 22 nt, Human
cuucuuuggggugggcuugcuc

SEQ ID NO: 2471 - RNA, 21 nt, Human
cuuuggcaagggagaagucac

SEQ ID NO: 2472 - RNA, 22 nt, Human
gcccuguugaccagaauuuguu

SEQ ID NO: 2473 - RNA, 22 nt, Human
ugaaaugcuuuuaggacacugc

SEQ ID NO: 2474 - RNA, 22 nt, Human
ucagucguuucucucucccagc

SEQ ID NO: 2475 - RNA, 22 nt, Human
ucacuguuccuuuuuguugaga

SEQ ID NO: 2476 - RNA, 22 nt, Human
uccauugcacuccagucugggc

SEQ ID NO: 2477 - RNA, 22 nt, Human
ucacccaggcuggagugcagug

SEQ ID NO: 2478 - RNA, 22 nt, Human
uaugucacuccuuugcccagac

SEQ ID NO: 2479 - RNA, 22 nt, Human
guggccuuucuggucuguguau

SEQ ID NO: 2480 - RNA, 22 nt, Human
guguuuuuccaaaugacaucca

SEQ ID NO: 2481 - RNA, 22 nt, Human
ugagguaggugcugaaacugcu

SEQ ID NO: 2482 - RNA, 22 nt, Human
uggaauggcugaagacugugaa

SEQ ID NO: 2483 - RNA, 22 nt, Human
uuccuucugcauugugagaaaa

SEQ ID NO: 2484 - RNA, 22 nt, Human
gucugcugucuacacuacacac

SEQ ID NO: 2485 - RNA, 22 nt, Human
guauguguggguuucucagccu

SEQ ID NO: 2486 - RNA, 22 nt, Human
ucugguuuuaauccugaaggca

SEQ ID NO: 2487 - RNA, 22 nt, Human
ugagaugaaccagguaucucag

SEQ ID NO: 2488 - RNA, 21 nt, Human
ugagguaggugcugaaacugc

SEQ ID NO: 2489 - RNA, 22 nt, Human
ugagggaggaaguuugggauga

SEQ ID NO: 2490 - RNA, 22 nt, Human
ugugacacguucauucugcaag

SEQ ID NO: 2491 - RNA, 22 nt, Human
uugcccaggcuggagugcagug

SEQ ID NO: 2492 - RNA, 22 nt, Human
ccuccuuucaucaaauucgagu

SEQ ID NO: 2493 - RNA, 22 nt, Human
cuggcucccucucuucucuccc

SEQ ID NO: 2494 - RNA, 22 nt, Human
cuggagaggagcggucacuggu

SEQ ID NO: 2495 - RNA, 22 nt, Human
gaggucacuguuggaugucaga

SEQ ID NO: 2496 - RNA, 22 nt, Human
ggcccaggagggggagaaaggc

SEQ ID NO: 2497 - RNA, 22 nt, Human
uuagaaagaauauugccagucc

SEQ ID NO: 2498 - RNA, 22 nt, Human
uguguaaugcugagauuugggc

SEQ ID NO: 2499 - RNA, 22 nt, Human
uuccuucaguucagggaacccu

SEQ ID NO: 2500 - RNA, 22 nt, Human
agguggcacugugugggguggg

SEQ ID NO: 2501 - RNA, 22 nt, Human
ugcuuuaguucuucugaagugu

SEQ ID NO: 2502 - RNA, 22 nt, Human
uagugcaguugaaugaacauuu

SEQ ID NO: 2503 - RNA, 22 nt, Human
gucacugcaaucaacaauacuc

SEQ ID NO: 2504 - RNA, 22 nt, Human
gugugugauaaggacacagaua

SEQ ID NO: 2505 - RNA, 22 nt, Human
uaagaagagaaagaagaggcug

SEQ ID NO: 2506 - RNA, 22 nt, Human
aggcagguggguguaugggucu

SEQ ID NO: 2507 - RNA, 22 nt, Human
uacagcucugcuucuggcucac

SEQ ID NO: 2508 - RNA, 22 nt, Human
ugaaagagaugggacagugacu

SEQ ID NO: 2509 - RNA, 22 nt, Human
cuugcacuccacagccugggug

SEQ ID NO: 2510 - RNA, 22 nt, Human
auuuggggaaauguguuucugg

SEQ ID NO: 2511 - RNA, 22 nt, Human
cacugcaaugacugucagaaca

SEQ ID NO: 2512 - RNA, 22 nt, Human
agagacacagacacaugggaga

SEQ ID NO: 2513 - RNA, 22 nt, Human
agcugccaguugaagaacauuu

SEQ ID NO: 2514 - RNA, 22 nt, Human
aguaagcaaacucaguuuaauc

SEQ ID NO: 2515 - RNA, 22 nt, Human
aggcugagugcaguggugugau

SEQ ID NO: 2516 - RNA, 22 nt, Human
aggcugcaguguaguggcauga

SEQ ID NO: 2517 - RNA, 22 nt, Human
augaugcuggaacuggacaaca

SEQ ID NO: 2518 - RNA, 22 nt, Human
auuagcuauagcaaaaggcuua

SEQ ID NO: 2519 - RNA, 22 nt, Human
acugcacuccagucugggugac

SEQ ID NO: 2520 - RNA, 22 nt, Human
guacaguggguguagggaccag

SEQ ID NO: 2521 - RNA, 22 nt, Human
guaaggcuggcauuagggugag

SEQ ID NO: 2522 - RNA, 22 nt, Human
ucauccuuuucugcaaccuguu

SEQ ID NO: 2523 - RNA, 22 nt, Human
gugcauuuguaguuaaaugugu

SEQ ID NO: 2524 - RNA, 22 nt, Human
uuaaugcuaaucgugauagggg

SEQ ID NO: 2525 - RNA, 22 nt, Human
uugagcacaguuugaggagugu

SEQ ID NO: 2526 - RNA, 22 nt, Human
uuucauucauuucuuucaugga

SEQ ID NO: 2527 - RNA, 22 nt, Human
ucacuguuccuuuuuguugaga

SEQ ID NO: 2528 - RNA, 22 nt, Human
uggagcagaaaggcaggagucc

SEQ ID NO: 2529 - RNA, 22 nt, Human
ugcagccuugaacucuuucugg

SEQ ID NO: 2530 - RNA, 22 nt, Human
ugagggcaggugugaaaaugcu

SEQ ID NO: 2531 - RNA, 22 nt, Human
ugcaagucugugauuuuguguu

SEQ ID NO: 2532 - RNA, 22 nt, Human
cacccaggcuggagugcagugg

SEQ ID NO: 2533 - RNA, 22 nt, Human
uucaggacugucuggauuuauu

SEQ ID NO: 2534 - RNA, 22 nt, Human
gggcgugaugucagccagaguc

SEQ ID NO: 2535 - RNA, 22 nt, Human
cccaggcuggagugcaguggug

SEQ ID NO: 2536 - RNA, 22 nt, Human
cuacuuguuccucucaccucaa

SEQ ID NO: 2537 - RNA, 22 nt, Human
cuccuaggcuggagugcagugg

SEQ ID NO: 2538 - RNA, 22 nt, Human
ugacagagguacauaggaggcu

SEQ ID NO: 2539 - RNA, 22 nt, Human
uaaggacgcaaagagggcaagg

SEQ ID NO: 2540 - RNA, 22 nt, Human
guuacagcucucaaagaagaca

SEQ ID NO: 2541 - RNA, 22 nt, Human
agcaaaagccaugcccaggaga

SEQ ID NO: 2542 - RNA, 22 nt, Human
agucagacguuuggcaacagca

SEQ ID NO: 2543 - RNA, 22 nt, Human
aggccuuuuugggaagagacag

SEQ ID NO: 2544 - RNA, 22 nt, Human
agcuccaggagcuggcaggagg

SEQ ID NO: 2545 - RNA, 22 nt, Human
aagugcugggauuacaggccug

SEQ ID NO: 2546 - RNA, 22 nt, Human
aaucccagcuacucgggaggcu

SEQ ID NO: 2547 - RNA, 22 nt, Human
aaaggcagacggugaaugccuu

SEQ ID NO: 2548 - RNA, 22 nt, Human
gugugggcagggccgugcuccc

SEQ ID NO: 2549 - RNA, 22 nt, Human
uagcagcaggagcagguaacau

SEQ ID NO: 2550 - RNA, 22 nt, Human
uaucgcuugagcccaggaguuu

SEQ ID NO: 2551 - RNA, 22 nt, Human
ucagucguuucucucucccagc

SEQ ID NO: 2552 - RNA, 22 nt, Human
ucugagcccaggaguuugaggc

SEQ ID NO: 2553 - RNA, 22 nt, Human
uguguuggagcagaggcagggg

SEQ ID NO: 2554 - RNA, 22 nt, Human
uucccucauucuccacccaguc

SEQ ID NO: 2555 - RNA, 22 nt, Human
ugucuggaggcgcaguuuucag

SEQ ID NO: 2556 - RNA, 22 nt, Human
ugaggugaucagcaagguggag

SEQ ID NO: 2557 - RNA, 22 nt, Human
uuuacagauggcaaagaucugg

SEQ ID NO: 2558 - RNA, 22 nt, Human
ugcaugaugcugagguuuggga

SEQ ID NO: 2559 - RNA, 22 nt, Human
uccccaagccuuguaccagcgu

SEQ ID NO: 2560 - RNA, 22 nt, Human
ucucaguuuccucugcaaacag

SEQ ID NO: 2561 - RNA, 22 nt, Human
ucugcuuggacugaucauugaa

SEQ ID NO: 2562 - RNA, 22 nt, Human
ggcccaggagggggagaaaggc

SEQ ID NO: 2563 - RNA, 22 nt, Human
ggccucagaagcugaggggaga

SEQ ID NO: 2564 - RNA, 22 nt, Human
ggcaugauucagcagaggagag

SEQ ID NO: 2565 - RNA, 22 nt, Human
gcccaggagucugaggcuggag

SEQ ID NO: 2566 - RNA, 21 nt, Human
gccuccauuucuacaucucua

SEQ ID NO: 2567 - RNA, 22 nt, Human
gcugcuccugcucucccucucc

SEQ ID NO: 2568 - RNA, 22 nt, Human
gagagagguagaggggagcaga

SEQ ID NO: 2569 - RNA, 22 nt, Human
gauugcuugagcccuggagguu

SEQ ID NO: 2570 - RNA, 22 nt, Human
caaagugcugagauuacaggca

SEQ ID NO: 2571 - RNA, 22 nt, Human
ccagccugagguuccuggaggg

SEQ ID NO: 2572 - RNA, 22 nt, Human
ccucuccauguacccauucccc

SEQ ID NO: 2573 - RNA, 22 nt, Human
cguguaaucccagcuacuuggg

SEQ ID NO: 2574 - RNA, 22 nt, Human
ccaaagugcuggcguuacaggu

SEQ ID NO: 2575 - RNA, 22 nt, Human
ccaaagugcugggauuacaggc

SEQ ID NO: 2576 - RNA, 22 nt, Human
cuggcucccucucuucucuccc

SEQ ID NO: 2577 - RNA, 22 nt, Human
gaggagguggggcagcagcagg

SEQ ID NO: 2578 - RNA, 22 nt, Human
gacccuguguucaagguuaggg

SEQ ID NO: 2579 - RNA, 22 nt, Human
gguccacaaggggagagcaggg

SEQ ID NO: 2580 - RNA, 22 nt, Human
ggcugggcaugguggcucacgc

SEQ ID NO: 2581 - RNA, 22 nt, Human
ggcuggagaguaaaucaggucu

SEQ ID NO: 2582 - RNA, 22 nt, Human
gauggcagcuggagguggagca

SEQ ID NO: 2583 - RNA, 22 nt, Human
gcagcaggcagggccaggcagg

SEQ ID NO: 2584 - RNA, 22 nt, Human
gccuguaaucccagcuacuugg

SEQ ID NO: 2585 - RNA, 22 nt, Human
gccuuuccuccagaacugcucc

SEQ ID NO: 2586 - RNA, 22 nt, Human
uucacauguugcucaguuuugc

SEQ ID NO: 2587 - RNA, 22 nt, Human
uucaguucuugaccugccccag

SEQ ID NO: 2588 - RNA, 22 nt, Human
ugguccagaggaggaaugaggg

SEQ ID NO: 2589 - RNA, 22 nt, Human
uggcucaguuugcucagcagug

SEQ ID NO: 2590 - RNA, 22 nt, Human
uuugaaguggguccucgaaaug

SEQ ID NO: 2591 - RNA, 22 nt, Human
uuuggucuaaucuucaagagga

SEQ ID NO: 2592 - RNA, 22 nt, Human
auugcuugagcccaggaguuca

SEQ ID NO: 2593 - RNA, 22 nt, Human
uuuguaauagcaaaauacugga

SEQ ID NO: 2594 - RNA, 22 nt, Human
uuugaugcaugugaccugggau

SEQ ID NO: 2595 - RNA, 22 nt, Human
uguuauuuuguccaagagagag

SEQ ID NO: 2596 - RNA, 22 nt, Human
ggcaugauggagaggguggaga

SEQ ID NO: 2597 - RNA, 22 nt, Human
ggaggaggaggcuggugcuggu

SEQ ID NO: 2598 - RNA, 22 nt, Human
gcuucuccuguccccucccuac

SEQ ID NO: 2599 - RNA, 22 nt, Human
ggcuggagaguaaaucaggucu

SEQ ID NO: 2600 - RNA, 22 nt, Human
gggaggauccuugcucaacuua

SEQ ID NO: 2601 - RNA, 22 nt, Human
cucugagucugagagaguaggu

SEQ ID NO: 2602 - RNA, 22 nt, Human
caggugcaaguguuaaagggua

SEQ ID NO: 2603 - RNA, 22 nt, Human
ccuggagugacagguguagccu

SEQ ID NO: 2604 - RNA, 22 nt, Human
cuggcucccucucuucucuccc

SEQ ID NO: 2605 - RNA, 22 nt, Human
cagagaauggcacagcuguccu

SEQ ID NO: 2606 - RNA, 22 nt, Human
gcaggcugguuggugaggcaaa

SEQ ID NO: 2607 - RNA, 22 nt, Human
ggcacugagaagcaaacaggau

SEQ ID NO: 2608 - RNA, 22 nt, Human
ggaggaggugugaagaaaugaa

SEQ ID NO: 2609 - RNA, 22 nt, Human
gguucaauucaccggagucuca

SEQ ID NO: 2610 - RNA, 22 nt, Human
guccagugcucacugccgacau

SEQ ID NO: 2611 - RNA, 22 nt, Human
uccuuaggaccuagagguagua

SEQ ID NO: 2612 - RNA, 22 nt, Human
ucuuugcuggaaggugccuccc

SEQ ID NO: 2613 - RNA, 22 nt, Human
ucccacagcuuccuagccacag

SEQ ID NO: 2614 - RNA, 22 nt, Human
uuucauucauuucuuucaugga

SEQ ID NO: 2615 - RNA, 22 nt, Human
uugcuuugguucaaguuaggca

SEQ ID NO: 2616 - RNA, 22 nt, Human
uugcaaggaaggggaggaggcu

SEQ ID NO: 2617 - RNA, 22 nt, Human
agcagcucaagucuucuccaga

SEQ ID NO: 2618 - RNA, 22 nt, Human
uaagcagucuuucuucuucuuc

SEQ ID NO: 2619 - RNA, 22 nt, Human
uucaagaaagccaagauggcug

SEQ ID NO: 2620 - RNA, 22 nt, Human
aagugcugguauuacaagugug

SEQ ID NO: 2621 - RNA, 22 nt, Human
aggcagguggguguaugggucu

SEQ ID NO: 2622 - RNA, 22 nt, Human
aggugggguuucaccauguugg

SEQ ID NO: 2623 - RNA, 22 nt, Human
agagcuaggaagauacaggguu

SEQ ID NO: 2624 - RNA, 22 nt, Human
caugguacugccacagaagagu

SEQ ID NO: 2625 - RNA, 22 nt, Human
ugggcucauuuugcagugauuu

SEQ ID NO: 2626 - RNA, 22 nt, Human
uaauuuccugguagugaugaca

SEQ ID NO: 2627 - RNA, 22 nt, Human
uagugcaagguuuugccaacuu

SEQ ID NO: 2628 - RNA, 22 nt, Human
uaggagugaaaauaaacucugu

SEQ ID NO: 2629 - RNA, 22 nt, Human
uaggaaguauuuuuuaaaaaca

SEQ ID NO: 2630 - RNA, 22 nt, Human
aggccagagaggacucucuuuu

SEQ ID NO: 2631 - RNA, 22 nt, Human
uugagcaaaauaucugguuuca

SEQ ID NO: 2632 - RNA, 22 nt, Human
uucuuuuuccgcuuucugagcc

SEQ ID NO: 2633 - RNA, 22 nt, Human
uugccuggagacauuucuacug

SEQ ID NO: 2634 - RNA, 22 nt, Human
ucuuugaucucuuccggggcuu

SEQ ID NO: 2635 - RNA, 22 nt, Human
ugcuagguuuuuuccuuucccc

SEQ ID NO: 2636 - RNA, 22 nt, Human
ugagguaaguauguuauuggaa

SEQ ID NO: 2637 - RNA, 22 nt, Human
uucacauguugcucaguuuugc

SEQ ID NO: 2638 - RNA, 22 nt, Human
ugaguauucaccaggugcuggg

SEQ ID NO: 2639 - RNA, 22 nt, Human
ugagggggaaggugugugugug

SEQ ID NO: 2640 - RNA, 22 nt, Human
uaugaauguaaggaauguggga

SEQ ID NO: 2641 - RNA, 22 nt, Human
uaagaagagaaagaagaggcug

SEQ ID NO: 2642 - RNA, 22 nt, Human
gugcauuuguaguuaaaugugu

SEQ ID NO: 2643 - RNA, 22 nt, Human
ggcagaugggacucugugccca

SEQ ID NO: 2644 - RNA, 22 nt, Human
gagguagagguugcagugagug

SEQ ID NO: 2645 - RNA, 22 nt, Human
cagugggaaaaguuugucucau

SEQ ID NO: 2646 - RNA, 22 nt, Human
gagguagagguugcagugaguc

SEQ ID NO: 2647 - RNA, 22 nt, Human
gguucucaaaugagggacauuu

SEQ ID NO: 2648 - RNA, 22 nt, Human
uuuccuguuuugguuuggagag

SEQ ID NO: 2649 - RNA, 22 nt, Human
uuguaaauaacauuuuuuagca

SEQ ID NO: 2650 - RNA, 22 nt, Human
augcccuuccucuucugccaug

SEQ ID NO: 2651 - RNA, 22 nt, Human
aguauuucuuguuuuauugaga

SEQ ID NO: 2652 - RNA, 22 nt, Human
agaggcacagauuaauggaguu

SEQ ID NO: 2653 - RNA, 22 nt, Human
aagacacuuucuaaauagaagu

SEQ ID NO: 2654 - RNA, 22 nt, Human
acaaggcagggcaggugucugu

SEQ ID NO: 2655 - RNA, 22 nt, Human
aaaggcagacggugaaugccuu

SEQ ID NO: 2656 - RNA, 22 nt, Human
uuacugggcuccucucagugug

SEQ ID NO: 2657 - RNA, 22 nt, Human
aggcugcaguguaguggcauga

SEQ ID NO: 2658 - RNA, 22 nt, Human
aggccuuuuugggaagagacag

SEQ ID NO: 2659 - RNA, 22 nt, Human
aggcagguggguguaugggucu

SEQ ID NO: 2660 - RNA, 22 nt, Human
uuuggucuaaucuucaagagga

SEQ ID NO: 2661 - RNA, 22 nt, Human
uuucuggagggcaagugcaggg

SEQ ID NO: 2662 - RNA, 22 nt, Human
uagggggucaccuaugugggag

SEQ ID NO: 2663 - RNA, 22 nt, Human
uauugcacuccagccugggcaa

SEQ ID NO: 2664 - RNA, 22 nt, Human
guuuuaggcaacauaggaagac

SEQ ID NO: 2665 - RNA, 22 nt, Human
gugauuaaauuaaggcucuuga

SEQ ID NO: 2666 - RNA, 22 nt, Human
aggggguuuagcuccacagggu

SEQ ID NO: 2667 - RNA, 22 nt, Human
uggaggcaggugcagauggagg

SEQ ID NO: 2668 - RNA, 22 nt, Human
ucugccucccugucucacucuc

SEQ ID NO: 2669 - RNA, 22 nt, Human
ucccagucaucugggaugugca

SEQ ID NO: 2670 - RNA, 22 nt, Human
uucacaguggcugaagcuguuc

SEQ ID NO: 2671 - RNA, 22 nt, Human
ugggaggcuacacguuucucca

SEQ ID NO: 2672 - RNA, 22 nt, Human
uggagugucuggaggugucucu

SEQ ID NO: 2673 - RNA, 22 nt, Human
uggagaccugugugguuugugg

SEQ ID NO: 2674 - RNA, 22 nt, Human
gucuuccuccguccccaccucc

SEQ ID NO: 2675 - RNA, 22 nt, Human
uaaguaaagagagaagccagaa

SEQ ID NO: 2676 - RNA, 22 nt, Human
uaagcagucuuucuucuucuuc

SEQ ID NO: 2677 - RNA, 22 nt, Human
ucccucugccugcaguccugcu

SEQ ID NO: 2678 - RNA, 21 nt, Human
ucugcugugauggacacuugu

SEQ ID NO: 2679 - RNA, 22 nt, Human
ucugcugugauggacacuugua

SEQ ID NO: 2680 - RNA, 22 nt, Human
gcagcucccuauuccaugacag

SEQ ID NO: 2681 - RNA, 22 nt, Human
gcugaauuuugacuccaucucc

SEQ ID NO: 2682 - RNA, 22 nt, Human
ggcaauauuccaggauaggcug

SEQ ID NO: 2683 - RNA, 22 nt, Human
ggcaccaucucagcucacugga

SEQ ID NO: 2684 - RNA, 22 nt, Human
ggcaugauggagaggguggaga

SEQ ID NO: 2685 - RNA, 22 nt, Human
ggaguaugagagagaaugggac

SEQ ID NO: 2686 - RNA, 22 nt, Human
ggacugcagucacacucuaaga

SEQ ID NO: 2687 - RNA, 22 nt, Human
gucagcaaggagggguggacaa

SEQ ID NO: 2688 - RNA, 22 nt, Human
guauguauuuauagauguucuu

SEQ ID NO: 2689 - RNA, 22 nt, Human
guauggagaucucugcccuugu

SEQ ID NO: 2690 - RNA, 22 nt, Human
guaacaaaaugaauaauaccug

SEQ ID NO: 2691 - RNA, 22 nt, Human
caugguacugccacagaagagu

SEQ ID NO: 2692 - RNA, 22 nt, Human
cagugggaaaaguuugucucau

SEQ ID NO: 2693 - RNA, 22 nt, Human
cauugcacuccagccuaggcaa

SEQ ID NO: 2694 - RNA, 22 nt, Human
cauugcacuccacccuaggcaa

SEQ ID NO: 2695 - RNA, 22 nt, Human
cauuggguaucaccuauacaga

SEQ ID NO: 2696 - RNA, 22 nt, Human
cuggcucccucucuucucuccc

SEQ ID NO: 2697 - RNA, 22 nt, Human
cuggcucccaggaggccucucu

SEQ ID NO: 2698 - RNA, 22 nt, Human
cgcuauguuggccaggcugguc

SEQ ID NO: 2699 - RNA, 22 nt, Human
cugugcccagccagggcugugu

SEQ ID NO: 2700 - RNA, 22 nt, Human
cuggguggccuucaguccauga

SEQ ID NO: 2701 - RNA, 22 nt, Human
gaacagcuccagucuacagccc

SEQ ID NO: 2702 - RNA, 22 nt, Human
gaagcauugugagaaacagguu

SEQ ID NO: 2703 - RNA, 22 nt, Human
auucccuuuagcucugauggca

SEQ ID NO: 2704 - RNA, 22 nt, Human
auaagcacagggagguucuguc

SEQ ID NO: 2705 - RNA, 22 nt, Human
agucagacguuuggcaacagca

SEQ ID NO: 2706 - RNA, 22 nt, Human
aguccaguguucucugcucugu

SEQ ID NO: 2707 - RNA, 22 nt, Human
uugcauaugcauggguacacag

SEQ ID NO: 2708 - RNA, 22 nt, Human
uugcaaggaaggggaggaggcu

SEQ ID NO: 2709 - RNA, 22 nt, Human
uugagcaaaauaucugguuuca

SEQ ID NO: 2710 - RNA, 22 nt, Human
ugucuggaggcgcaguuuucag

SEQ ID NO: 2711 - RNA, 22 nt, Human
uguacaaggggcucagccagcc

SEQ ID NO: 2712 - RNA, 22 nt, Human
ggugacagagacucugccucga

SEQ ID NO: 2713 - RNA, 22 nt, Human
ggaggaggaggcuggugcuggu

SEQ ID NO: 2714 - RNA, 22 nt, Human
ggcaugugugagcagcugcagg

SEQ ID NO: 2715 - RNA, 22 nt, Human
gcugcuccugcucucccucucc

SEQ ID NO: 2716 - RNA, 22 nt, Human
gauggcagcuggagguggagca

SEQ ID NO: 2717 - RNA, 22 nt, Human
gaggucacuguuggaugucaga

SEQ ID NO: 2718 - RNA, 22 nt, Human
cuggugaggaaggagcagaguu

SEQ ID NO: 2719 - RNA, 22 nt, Human
cagaggaugcggcugggaacgg

SEQ ID NO: 2720 - RNA, 22 nt, Human
caucucagucuauguccuugcu

SEQ ID NO: 2721 - RNA, 22 nt, Human
cuccuacaacugacucucugga

SEQ ID NO: 2722 - RNA, 22 nt, Human
accagcugcauccugcaaacuu

SEQ ID NO: 2723 - RNA, 22 nt, Human
acccacccucugugaggaggau

SEQ ID NO: 2724 - RNA, 22 nt, Human
acugcacuccagccuggcaaca

SEQ ID NO: 2725 - RNA, 22 nt, Human
agagacacagacacaugggaga

SEQ ID NO: 2726 - RNA, 22 nt, Human
acuguacuccacccugggcgac

SEQ ID NO: 2727 - RNA, 22 nt, Human
acugcacuccauccugagugac

SEQ ID NO: 2728 - RNA, 22 nt, Human
aaauccuggggaucuggaggga

SEQ ID NO: 2729 - RNA, 22 nt, Human
aaagacaguucagugacaaguu

SEQ ID NO: 2730 - RNA, 22 nt, Human
aaagacuuggcugucagcccug

SEQ ID NO: 2731 - RNA, 22 nt, Human
aaggcuuuucugggaagagcug

SEQ ID NO: 2732 - RNA, 22 nt, Human
aaugaagccacagagauuugcu

SEQ ID NO: 2733 - RNA, 22 nt, Human
agcaagaugguagcauuggaga

SEQ ID NO: 2734 - RNA, 22 nt, Human
agcagagccaccaaauuuagug

SEQ ID NO: 2735 - RNA, 22 nt, Human
agcagcucaagucuucuccaga

SEQ ID NO: 2736 - RNA, 22 nt, Human
agagcuaggaagauacaggguu

SEQ ID NO: 2737 - RNA, 22 nt, Human
agguggcacugugugggguggg

SEQ ID NO: 2738 - RNA, 22 nt, Human
aggcaguaagggagaguuuugc

SEQ ID NO: 2739 - RNA, 22 nt, Human
augggagacugaggggcggacg

SEQ ID NO: 2740 - RNA, 22 nt, Human
augugucugggacucuaugcca

SEQ ID NO: 2741 - RNA, 22 nt, Human
agggagugucagaaugccagca

SEQ ID NO: 2742 - RNA, 22 nt, Human
agaaguaguaguagcaguagua

SEQ ID NO: 2743 - RNA, 22 nt, Human
acagcaagucuuugucaaagcu

SEQ ID NO: 2744 - RNA, 22 nt, Human
acaguguuacccaggcuggucu

SEQ ID NO: 2745 - RNA, 22 nt, Human
aagugcugggauuacaggccug

SEQ ID NO: 2746 - RNA, 22 nt, Human
agacuggccucaagcucccaga

SEQ ID NO: 2747 - RNA, 22 nt, Human
ccaaagugcuggcguuacaggu

SEQ ID NO: 2748 - RNA, 22 nt, Human
cagaaucuuuugucucugagaa

SEQ ID NO: 2749 - RNA, 22 nt, Human
cacugcaaugacugucagaaca

SEQ ID NO: 2750 - RNA, 22 nt, Human
cagguggugcuguuaagaagca

SEQ ID NO: 2751 - RNA, 22 nt, Human
gauuuucauaggagcagaaacc

SEQ ID NO: 2752 - RNA, 22 nt, Human
ggcaaggaagaaagcagaaguu

SEQ ID NO: 2753 - RNA, 22 nt, Human
ggcgugaucuuggcucaccaca

SEQ ID NO: 2754 - RNA, 22 nt, Human
agugauuuuccugccucagccu

SEQ ID NO: 2755 - RNA, 22 nt, Human
cugggauuacaggugugaacca

SEQ ID NO: 2756 - RNA, 22 nt, Human
cugauugaaccauucacuuuau

SEQ ID NO: 2757 - RNA, 22 nt, Human
ccaaagugcuaggauuacagcc

SEQ ID NO: 2758 - RNA, 22 nt, Human
ccaaagugcuaggaauacaggu

SEQ ID NO: 2759 - RNA, 22 nt, Human
ccaaagugcugggauuacaggc

SEQ ID NO: 2760 - RNA, 22 nt, Human
cccaggcuggagugcaguggug

SEQ ID NO: 2761 - RNA, 22 nt, Human
cccaggaggcggagguugcagu

SEQ ID NO: 2762 - RNA, 22 nt, Human
caaagugcugagauuacaggca

SEQ ID NO: 2763 - RNA, 22 nt, Human
ggcaggaucauagcucacugca

SEQ ID NO: 2764 - RNA, 22 nt, Human
gagauccuuucacaguuguggu

SEQ ID NO: 2765 - RNA, 22 nt, Human
gagugagugugaucuuggcuca

SEQ ID NO: 2766 - RNA, 22 nt, Human
ugaaaugcuuuuaggacacugc

SEQ ID NO: 2767 - RNA, 22 nt, Human
gugcucaucuucuguaacuguu

SEQ ID NO: 2768 - RNA, 22 nt, Human
uagcaaccuuaauauuuuacag

SEQ ID NO: 2769 - RNA, 22 nt, Human
uagaaagcuaacaagcuagaga

SEQ ID NO: 2770 - RNA, 22 nt, Human
ucaguagcugucaaaacuggag

SEQ ID NO: 2771 - RNA, 22 nt, Human
ucacugcaaccucugcuucugg

SEQ ID NO: 2772 - RNA, 22 nt, Human
ucucauauagcuggguugcagc

SEQ ID NO: 2773 - RNA, 22 nt, Human
ugcagccuugaacucuuucugg

SEQ ID NO: 2774 - RNA, 22 nt, Human
ugauccucuggcuucagccucc

SEQ ID NO: 2775 - RNA, 22 nt, Human
aggcuuuuggagaagcauaugc

SEQ ID NO: 2776 - RNA, 22 nt, Human
uugcccaggcuagagugcagug

SEQ ID NO: 2777 - RNA, 22 nt, Human
uugcccaggcuggagugcagug

SEQ ID NO: 2778 - RNA, 22 nt, Human
aggcugagugcaguggugugau

SEQ ID NO: 2779 - RNA, 22 nt, Human
agcagcgcagguagauggggcu

SEQ ID NO: 2780 - RNA, 22 nt, Human
uugcuucauuagggcaagcaag

SEQ ID NO: 2781 - RNA, 22 nt, Human
guuaggaaaugugcuuacuggg

SEQ ID NO: 2782 - RNA, 22 nt, Human
ugcaagucugugauuuuguguu

SEQ ID NO: 2783 - RNA, 22 nt, Human
ucuaacacugacuucuauucca

SEQ ID NO: 2784 - RNA, 22 nt, Human
ucugccucccugucucacucuc

SEQ ID NO: 2785 - RNA, 21 nt, Human
ucugcugugauggacacuugu

SEQ ID NO: 2786 - RNA, 22 nt, Human
ucacugcaaccucugcuucugg

SEQ ID NO: 2787 - RNA, 22 nt, Human
uagaaagugucucauuuuaaua

SEQ ID NO: 2788 - RNA, 22 nt, Human
uaguuguuugggauugguagug

SEQ ID NO: 2789 - RNA, 22 nt, Human
uaagcagucuuucuucuucuuc

SEQ ID NO: 2790 - RNA, 22 nt, Human
ucugcugugauggacacuugua

SEQ ID NO: 2791 - RNA, 22 nt, Human
ucaaguaauccaggauaggcug

SEQ ID NO: 2792 - RNA, 22 nt, Human
uggagcagaaaggcaggagucc

SEQ ID NO: 2793 - RNA, 22 nt, Human
uucagcauugccaguguuucca

SEQ ID NO: 2794 - RNA, 22 nt, Human
uuauccuaaauguguuuugaag

SEQ ID NO: 2795 - RNA, 22 nt, Human
uguguuggagcagaggcagggg

SEQ ID NO: 2796 - RNA, 22 nt, Human
uuccaguuuuuccuaccccuua

SEQ ID NO: 2797 - RNA, 22 nt, Human
gcacauucccgcaggguguaag

SEQ ID NO: 2798 - RNA, 22 nt, Human
gagauccuuucacaguuguggu

SEQ ID NO: 2799 - RNA, 22 nt, Human
gagguagagguugcagugaguc

SEQ ID NO: 2800 - RNA, 22 nt, Human
ggaauggauggaagugugugag

SEQ ID NO: 2801 - RNA, 22 nt, Human
ggcaugauggagaggguggaga

SEQ ID NO: 2802 - RNA, 22 nt, Human
caaagugcugagauuacaggca

SEQ ID NO: 2803 - RNA, 22 nt, Human
cacugcaaccucugccuccugg

SEQ ID NO: 2804 - RNA, 22 nt, Human
cacuuucagagaugcccugagu

SEQ ID NO: 2805 - RNA, 22 nt, Human
cugcacuagaaggcacuauguu

SEQ ID NO: 2806 - RNA, 22 nt, Human
cugugagcuauuuguuuugguu

SEQ ID NO: 2807 - RNA, 22 nt, Human
gaaacuaguguugggacaaagg

SEQ ID NO: 2808 - RNA, 22 nt, Human
gacaagaggcacagacagcagg

SEQ ID NO: 2809 - RNA, 22 nt, Human
gggcaugaugauggcacuagcg

SEQ ID NO: 2810 - RNA, 22 nt, Human
ggcaauauuccaggauaggcug

SEQ ID NO: 2811 - RNA, 22 nt, Human
gcagcaggcagggccaggcagg

SEQ ID NO: 2812 - RNA, 22 nt, Human
gaguuaagcaaagagaggaaga

SEQ ID NO: 2813 - RNA, 22 nt, Human
cuggcuaauuuucuugaguuuu

SEQ ID NO: 2814 - RNA, 22 nt, Human
cuguucagaucugugugcauuu

SEQ ID NO: 2815 - RNA, 22 nt, Human
acacuugucugcuuucuacacu

SEQ ID NO: 2816 - RNA, 22 nt, Human
aagcagaacuguuuuguuuucu

SEQ ID NO: 2817 - RNA, 22 nt, Human
aggcaagagguugcagugagcu

SEQ ID NO: 2818 - RNA, 22 nt, Human
auaagcacagggagguucuguc

SEQ ID NO: 2819 - RNA, 22 nt, Human
agugauuuuccugccucagccu

SEQ ID NO: 2820 - RNA, 22 nt, Human
aguuccauggaaaacaacaaag

SEQ ID NO: 2821 - RNA, 22 nt, Human
acaaccucugccuccuggguuc

SEQ ID NO: 2822 - RNA, 22 nt, Human
aagugcugggauuacaggccug

SEQ ID NO: 2823 - RNA, 22 nt, Human
acaguguuacccaggcuggucu

SEQ ID NO: 2824 - RNA, 22 nt, Human
acugcagcuucagggacuugug

SEQ ID NO: 2825 - RNA, 22 nt, Human
cugggauuacaggugugaacca

SEQ ID NO: 2826 - RNA, 22 nt, Human
cacugcacuguagccuccuggg

SEQ ID NO: 2827 - RNA, 22 nt, Human
ccaaagugcugggauuacaggc

SEQ ID NO: 2828 - RNA, 22 nt, Human
ccaaagugcuaggaauacaggu

SEQ ID NO: 2829 - RNA, 22 nt, Human
cuccuaggcuggagugcagugg

SEQ ID NO: 2830 - RNA, 22 nt, Human
cucacugcaaccuccgccuccc

SEQ ID NO: 2831 - RNA, 22 nt, Human
cccaggcuggagugcaguggug

SEQ ID NO: 2832 - RNA, 22 nt, Human
auuguaaauuaacaauuugcuc

SEQ ID NO: 2833 - RNA, 22 nt, Human
cacugcaaccucugccaccugg

SEQ ID NO: 2834 - RNA, 22 nt, Human
aggugggguuucaccauguugg

SEQ ID NO: 2835 - RNA, 22 nt, Human
ugugacugaggugcgcauaaag

SEQ ID NO: 2836 - RNA, 22 nt, Human
uuaccauguuggccaggcuggu

SEQ ID NO: 2837 - RNA, 22 nt, Human
uugcccaggcuagagugcagug

SEQ ID NO: 2838 - RNA, 22 nt, Human
uugccuaggccggagugcagug

SEQ ID NO: 2839 - RNA, 22 nt, Human
uugccuaggcuggagugcagug

SEQ ID NO: 2840 - RNA, 22 nt, Human
uuuugcaaauuacuaaauuucu

SEQ ID NO: 2841 - RNA, 22 nt, Human
cugccuccuggguucaagcaau

SEQ ID NO: 2842 - RNA, 22 nt, Human
cgcuauguuggccaggcugguc

SEQ ID NO: 2843 - RNA, 22 nt, Human
ccuggagugacagguguagccu

SEQ ID NO: 2844 - RNA, 22 nt, Human
cacugcuguaauggacggugag

SEQ ID NO: 2845 - RNA, 22 nt, Human
cacugcaaccucugccuccugg

SEQ ID NO: 2846 - RNA, 22 nt, Human
cacugcaaccuccaccuccugg

SEQ ID NO: 2847 - RNA, 22 nt, Human
cacugcaagcuccaccucccgg

SEQ ID NO: 2848 - RNA, 22 nt, Human
caaagugcugagauuacaggca

SEQ ID NO: 2849 - RNA, 22 nt, Human
cacccaggcuggagugcagugg

SEQ ID NO: 2850 - RNA, 22 nt, Human
cacugcaacccccgccucccag

SEQ ID NO: 2851 - RNA, 22 nt, Human
ccaaagugcuaggauuacagcc

SEQ ID NO: 2852 - RNA, 22 nt, Human
ccaaagugcuggcguuacaggu

SEQ ID NO: 2853 - RNA, 22 nt, Human
gcugugguucugcaugaagaca

SEQ ID NO: 2854 - RNA, 22 nt, Human
gagguuugagccuucuccugcu

SEQ ID NO: 2855 - RNA, 22 nt, Human
ugggguuucuccauguugguca

SEQ ID NO: 2856 - RNA, 22 nt, Human
ugugccacugcacuccaugggu

SEQ ID NO: 2857 - RNA, 22 nt, Human
ucacugcaaccuccgccugccg

SEQ ID NO: 2858 - RNA, 22 nt, Human
ucacugcaaccucugccuuccg

SEQ ID NO: 2859 - RNA, 22 nt, Human
ucacccaggcuggagugcagug

SEQ ID NO: 2860 - RNA, 22 nt, Human
ucaagcgauucucaugccuuag

SEQ ID NO: 2861 - RNA, 22 nt, Human
gucuugaucuccugaccuugug

SEQ ID NO: 2862 - RNA, 22 nt, Human
uagaguuauaugaugugcuagu

SEQ ID NO: 2863 - RNA, 22 nt, Human
ucacugcaaccucugcuucugg

SEQ ID NO: 2864 - RNA, 22 nt, Human
ucacugcaaccuccaccucccg

SEQ ID NO: 2865 - RNA, 22 nt, Human
ucauugcaaccuccaccuccug

SEQ ID NO: 2866 - RNA, 22 nt, Human
ugagguaggugcugaaacugcu

SEQ ID NO: 2867 - RNA, 21 nt, Human
ugagguaggugcugaaacugc

SEQ ID NO: 2868 - RNA, 22 nt, Human
uggacaaugaaacccugaccuu

SEQ ID NO: 2869 - RNA, 22 nt, Human
uugcucaggcuggagugcagug

SEQ ID NO: 2870 - RNA, 22 nt, Human
uugcccaggcuggagugcagug

SEQ ID NO: 2871 - RNA, 22 nt, Human
aggcugagugcaguggugugau

SEQ ID NO: 2872 - RNA, 22 nt, Human
ccaggguacucugggaucacuu

SEQ ID NO: 2873 - RNA, 22 nt, Human
cuggcuaauuuucuugaguuuu

SEQ ID NO: 2874 - RNA, 22 nt, Human
aaaguggcuggaguggagucuu

SEQ ID NO: 2875 - RNA, 22 nt, Human
aacccuggaggcagagguugcg

SEQ ID NO: 2876 - RNA, 22 nt, Human
acugcacucuagccugagcaac

SEQ ID NO: 2877 - RNA, 22 nt, Human
acugcacucuagccuaggugau

SEQ ID NO: 2878 - RNA, 22 nt, Human
acugcacuccugccugggugac

SEQ ID NO: 2879 - RNA, 22 nt, Human
acugcacuccagucugggugac

SEQ ID NO: 2880 - RNA, 22 nt, Human
acugcacuccagccuggguggc

SEQ ID NO: 2881 - RNA, 22 nt, Human
acugcacuccagucuaggugac

SEQ ID NO: 2882 - RNA, 22 nt, Human
accugcauuccagccugcugac

SEQ ID NO: 2883 - RNA, 22 nt, Human
acugcacuccagccugggugac

SEQ ID NO: 2884 - RNA, 22 nt, Human
acccgagagguggagguugcag

SEQ ID NO: 2885 - RNA, 22 nt, Human
acugcacuccagccugggugau

SEQ ID NO: 2886 - RNA, 22 nt, Human
acugcacuccagccuggcgaca

SEQ ID NO: 2887 - RNA, 22 nt, Human
acuguacuucagccuggguaac

SEQ ID NO: 2888 - RNA, 22 nt, Human
agagacacagacacaugggaga

SEQ ID NO: 2889 - RNA, 22 nt, Human
acugcacuccagccugggcgau

SEQ ID NO: 2890 - RNA, 22 nt, Human
acuguacuccagccuaggcaac

SEQ ID NO: 2891 - RNA, 22 nt, Human
acuguacuccagccugggugac

SEQ ID NO: 2892 - RNA, 22 nt, Human
acugcacuccauccugagugac

SEQ ID NO: 2893 - RNA, 22 nt, Human
acugcacuccagccuguugaca

SEQ ID NO: 2894 - RNA, 22 nt, Human
acugcacuccugccuaggugac

SEQ ID NO: 2895 - RNA, 22 nt, Human
acugcacuccauccuggggagc

SEQ ID NO: 2896 - RNA, 22 nt, Human
acugcacucuagccugggcaac

SEQ ID NO: 2897 - RNA, 22 nt, Human
acugcacuucagccugggcaau

SEQ ID NO: 2898 - RNA, 22 nt, Human
aaucccagcuacucgggaggcu

SEQ ID NO: 2899 - RNA, 22 nt, Human
acagcaguccagccugggugac

SEQ ID NO: 2900 - RNA, 22 nt, Human
acugcacuccaaccaggcugac

SEQ ID NO: 2901 - RNA, 22 nt, Human
acugcacuccagccuggcaaca

SEQ ID NO: 2902 - RNA, 22 nt, Human
acugcacuccagccuaugggau

SEQ ID NO: 2903 - RNA, 22 nt, Human
acaaaaaauuagccagacuggu

SEQ ID NO: 2904 - RNA, 22 nt, Human
acaaaaaauacgaaaauuagcu

SEQ ID NO: 2905 - RNA, 22 nt, Human
aagcugccauugaagaucuggg

SEQ ID NO: 2906 - RNA, 22 nt, Human
auauuggugaaaugcuagcaaa

SEQ ID NO: 2907 - RNA, 22 nt, Human
auacugagagaaaaagcuuguc

SEQ ID NO: 2908 - RNA, 22 nt, Human
aucuuucuuaauuccaggacuc

SEQ ID NO: 2909 - RNA, 22 nt, Human
augacacaguggggccaguugg

SEQ ID NO: 2910 - RNA, 22 nt, Human
augccuguaaucccagcauuuu

SEQ ID NO: 2911 - RNA, 22 nt, Human
aggcaagagguugcagugagcu

SEQ ID NO: 2912 - RNA, 22 nt, Human
agggcacacgucucucugaauu

SEQ ID NO: 2913 - RNA, 22 nt, Human
acuguacuucagccugggcaac

SEQ ID NO: 2914 - RNA, 22 nt, Human
acuguacuccagccugggcaac

SEQ ID NO: 2915 - RNA, 22 nt, Human
acugcacuccauccugggacag

SEQ ID NO: 2916 - RNA, 22 nt, Human
acugggauaugaagacugugug

SEQ ID NO: 2917 - RNA, 22 nt, Human
agcaaaagccaugcccaggaga

SEQ ID NO: 2918 - RNA, 22 nt, Human
agauggaguuugagagggaaua

SEQ ID NO: 2919 - RNA, 22 nt, Human
agaugauguuggagucugugcu

SEQ ID NO: 2920 - RNA, 22 nt, Human
agaggcacagauuaauggaguu

SEQ ID NO: 2921 - RNA, 22 nt, Human
agauggagaaguguuuucagau

SEQ ID NO: 2922 - RNA, 22 nt, Human
cuggcuaauuuucuugaguuuu

SEQ ID NO: 2923 - RNA, 22 nt, Human
cugaggcaggagggcucaggag

SEQ ID NO: 2924 - RNA, 22 nt, Human
cugggauggaggagaauuagag

SEQ ID NO: 2925 - RNA, 21 nt, Human
cugcuaaacauccuacacugc

SEQ ID NO: 2926 - RNA, 22 nt, Human
cuugcacuccacagccugggug

SEQ ID NO: 2927 - RNA, 22 nt, Human
gaauaaugucccacugggaggc

SEQ ID NO: 2928 - RNA, 22 nt, Human
gagguagagguugcagugaguc

SEQ ID NO: 2929 - RNA, 22 nt, Human
gaggcgggaagcccacuaggag

SEQ ID NO: 2930 - RNA, 22 nt, Human
gagauggaguuuuacuauguug

SEQ ID NO: 2931 - RNA, 22 nt, Human
cccaggaggcggagguugcagu

SEQ ID NO: 2932 - RNA, 22 nt, Human
cccaggagguggagguuacagu

SEQ ID NO: 2933 - RNA, 22 nt, Human
cucagauacuugggagguugag

SEQ ID NO: 2934 - RNA, 22 nt, Human
cguguaaucccagcuacuuggg

SEQ ID NO: 2935 - RNA, 22 nt, Human
cuauuuuacauggucacuauca

SEQ ID NO: 2936 - RNA, 22 nt, Human
cauugcacuccagccuaggcaa

SEQ ID NO: 2937 - RNA, 22 nt, Human
cauugcacuccagccuggguga

SEQ ID NO: 2938 - RNA, 22 nt, Human
ccacugcacuccagccugggug

SEQ ID NO: 2939 - RNA, 22 nt, Human
cacugcacuguagccuccuggg

SEQ ID NO: 2940 - RNA, 22 nt, Human
cagaaucuuuugucucugagaa

SEQ ID NO: 2941 - RNA, 22 nt, Human
gaguaacagcacucacuggagu

SEQ ID NO: 2942 - RNA, 22 nt, Human
gauugcuugagcccuggagguu

SEQ ID NO: 2943 - RNA, 22 nt, Human
gauuccuccucuuuaaaauggu

SEQ ID NO: 2944 - RNA, 22 nt, Human
gcccaggagucugaggcuggag

SEQ ID NO: 2945 - RNA, 22 nt, Human
gccauugcacuccagccuggac

SEQ ID NO: 2946 - RNA, 22 nt, Human
gcaagugcugucauauggaaga

SEQ ID NO: 2947 - RNA, 22 nt, Human
ggcaaaaaaauagagcagaggg

SEQ ID NO: 2948 - RNA, 22 nt, Human
gcuggguugagcugggcugaga

SEQ ID NO: 2949 - RNA, 22 nt, Human
ggcaugauucagcagaggagag

SEQ ID NO: 2950 - RNA, 22 nt, Human
ggcccaggagggggagaaaggc

SEQ ID NO: 2951 - RNA, 22 nt, Human
ggcaugauggagaggguggaga

SEQ ID NO: 2952 - RNA, 22 nt, Human
ggcugcagugcaacucuuucua

SEQ ID NO: 2953 - RNA, 22 nt, Human
gguagcuuauuaaagaaacucc

SEQ ID NO: 2954 - RNA, 22 nt, Human
ggcugcagugaacuaugaucgu

SEQ ID NO: 2955 - RNA, 22 nt, Human
ggcugggcaugguggcucacgc

SEQ ID NO: 2956 - RNA, 22 nt, Human
gguucaauucaccggagucuca

SEQ ID NO: 2957 - RNA, 22 nt, Human
uuugcacacuuuccaaguugcc

SEQ ID NO: 2958 - RNA, 22 nt, Human
uugccuaggcuggagugcagug

SEQ ID NO: 2959 - RNA, 22 nt, Human
uuuacagauggcaaagaucugg

SEQ ID NO: 2960 - RNA, 22 nt, Human
uugguuggugaugagcauugaa

SEQ ID NO: 2961 - RNA, 22 nt, Human
uugcacuccagucugggugaca

SEQ ID NO: 2962 - RNA, 22 nt, Human
uugcacuccagccuggguaaca

SEQ ID NO: 2963 - RNA, 22 nt, Human
uugaugaaugggugcuccagga

SEQ ID NO: 2964 - RNA, 22 nt, Human
uuaccauguuggccaggcuggu

SEQ ID NO: 2965 - RNA, 22 nt, Human
uguuauuuuguccaagagagag

SEQ ID NO: 2966 - RNA, 22 nt, Human
uguguuggagcagaggcagggg

SEQ ID NO: 2967 - RNA, 22 nt, Human
ugggaagaugcuggcaaggugc

SEQ ID NO: 2968 - RNA, 22 nt, Human
ugugacucguacuuguaauccu

SEQ ID NO: 2969 - RNA, 22 nt, Human
uggcagauuugguugcuguugg

SEQ ID NO: 2970 - RNA, 22 nt, Human
aggugagaaaacugaggcucag

SEQ ID NO: 2971 - RNA, 22 nt, Human
cacccccaggaccaccuugcga

SEQ ID NO: 2972 - RNA, 22 nt, Human
cacugcacuccagccugggcga

SEQ ID NO: 2973 - RNA, 22 nt, Human
cacugcacuccagccuggguaa

SEQ ID NO: 2974 - RNA, 22 nt, Human
cacugcacuccagccuggguga

SEQ ID NO: 2975 - RNA, 22 nt, Human
auugcuugagcccaggaguuca

SEQ ID NO: 2976 - RNA, 22 nt, Human
auuguucuccagccugggcgac

SEQ ID NO: 2977 - RNA, 22 nt, Human
auugcacuucagccugggugac

SEQ ID NO: 2978 - RNA, 22 nt, Human
auugcacuccagcuugggcaac

SEQ ID NO: 2979 - RNA, 22 nt, Human
auugcacuccagccugggcaau

SEQ ID NO: 2980 - RNA, 22 nt, Human
auugcacuccagccugggugac

SEQ ID NO: 2981 - RNA, 22 nt, Human
agugagccgagauacauacaua

SEQ ID NO: 2982 - RNA, 22 nt, Human
auagaagagcagugggguagaa

SEQ ID NO: 2983 - RNA, 22 nt, Human
agugagcuaugaucaugccggu

SEQ ID NO: 2984 - RNA, 22 nt, Human
agugguuucagggacuucugua

SEQ ID NO: 2985 - RNA, 22 nt, Human
auggcucauguuuguagucuca

SEQ ID NO: 2986 - RNA, 22 nt, Human
augccuguaaucccagcacuuu

SEQ ID NO: 2987 - RNA, 22 nt, Human
augagaguaggaguuugggcuc

SEQ ID NO: 2988 - RNA, 22 nt, Human
auacagcucucucuggggacuu

SEQ ID NO: 2989 - RNA, 22 nt, Human
agcggagaccugagcuaugagu

SEQ ID NO: 2990 - RNA, 22 nt, Human
uugcaaggaaggggaggaggcu

SEQ ID NO: 2991 - RNA, 22 nt, Human
uugcacuccagccugggugaca

SEQ ID NO: 2992 - RNA, 22 nt, Human
uugguugcugaugagcuuugag

SEQ ID NO: 2993 - RNA, 22 nt, Human
uuguuuuagaagaaggucagaa

SEQ ID NO: 2994 - RNA, 22 nt, Human
uaugagugugaugguguuugag

SEQ ID NO: 2995 - RNA, 22 nt, Human
uagcagaucugugacuccuaug

SEQ ID NO: 2996 - RNA, 22 nt, Human
uagcucauuuuugaaaucaguu

SEQ ID NO: 2997 - RNA, 22 nt, Human
aggguuguuaguuuuuugguug

SEQ ID NO: 2998 - RNA, 22 nt, Human
guguuauuaauaaacucuuuuu

SEQ ID NO: 2999 - RNA, 22 nt, Human
guggcaccauuggagucuaagg

SEQ ID NO: 3000 - RNA, 22 nt, Human
ugcaccacugcacuccagccug

SEQ ID NO: 3001 - RNA, 22 nt, Human
ugcuacauuucuucauucuugg

SEQ ID NO: 3002 - RNA, 22 nt, Human
uggaaagcauguacauuuggag

SEQ ID NO: 3003 - RNA, 21 nt, Human
ugagguaggugcugaaacugc

SEQ ID NO: 3004 - RNA, 22 nt, Human
ugaggucauguucugucagguu

SEQ ID NO: 3005 - RNA, 22 nt, Human
ugagguuaguaguuugagacca

SEQ ID NO: 3006 - RNA, 22 nt, Human
ugcaagucugugauuuuguguu

SEQ ID NO: 3007 - RNA, 22 nt, Human
ugcaccaaugcacuccagccug

SEQ ID NO: 3008 - RNA, 22 nt, Human
uccaaaaguggagaggaauaug

SEQ ID NO: 3009 - RNA, 22 nt, Human
ucagugcaaacuaagcagggca

SEQ ID NO: 3010 - RNA, 22 nt, Human
ucauaucauuuugaaagcugag

SEQ ID NO: 3011 - RNA, 22 nt, Human
uccauugcacuccagucugggc

SEQ ID NO: 3012 - RNA, 22 nt, Human
uauugcuaagaauucagguagu

SEQ ID NO: 3013 - RNA, 22 nt, Human
ucacuguuccuuuuuguugaga

SEQ ID NO: 3014 - RNA, 22 nt, Human
ucagaguaggcuugauguaauc

SEQ ID NO: 3015 - RNA, 21 nt, Human
ucugcugugauggacacuugu

SEQ ID NO: 3016 - RNA, 22 nt, Human
ucgaguugaugcuagaaugggu

SEQ ID NO: 3017 - RNA, 22 nt, Human
ucuuucuuaaauggaugcauga

SEQ ID NO: 3018 - RNA, 22 nt, Human
uaugaauguaaggaauguggga

SEQ ID NO: 3019 - RNA, 22 nt, Human
uauugcacuccagccugggcaa

SEQ ID NO: 3020 - RNA, 22 nt, Human
uaucgcuugagcccaggaguuu

SEQ ID NO: 3021 - RNA, 22 nt, Human
gugucacuuucaggagcucuaa

SEQ ID NO: 3022 - RNA, 21 nt, Human
uaagugaguaggcauuguucu

SEQ ID NO: 3023 - RNA, 22 nt, Human
ucacuguaaacucaaacuccug

SEQ ID NO: 3024 - RNA, 22 nt, Human
ucacuugccuagggucacacag

SEQ ID NO: 3025 - RNA, 22 nt, Human
uccaaaauuaaagguuguagaa

SEQ ID NO: 3026 - RNA, 22 nt, Human
ucugcugugauggacacuugua

SEQ ID NO: 3027 - RNA, 22 nt, Human
ucugagcccaggaguuugaggc

SEQ ID NO: 3028 - RNA, 22 nt, Human
ugugccacugcacuccaugggu

SEQ ID NO: 3029 - RNA, 22 nt, Human
ugucauauagaauguucuauga

SEQ ID NO: 3030 - RNA, 22 nt, Human
uuccaagccuuccccgggauca

SEQ ID NO: 3031 - RNA, 22 nt, Human
uucugccacugcauuccagccu

SEQ ID NO: 3032 - RNA, 22 nt, Human
uggagagagcagguugcuaaga

SEQ ID NO: 3033 - RNA, 22 nt, Human
uggagagaaagcgaagauguag

SEQ ID NO: 3034 - RNA, 22 nt, Human
ugacucaguggaagauccagag

SEQ ID NO: 3035 - RNA, 22 nt, Human
ugaggcagaaggauuacuugag

SEQ ID NO: 3036 - RNA, 22 nt, Human
ugagggcaggugugaaaaugcu

SEQ ID NO: 3037 - RNA, 22 nt, Human
ugagguaggugcugaaacugcu

SEQ ID NO: 3038 - RNA, 22 nt, Human
ugagauggugucauauugcugg

SEQ ID NO: 3039 - RNA, 22 nt, Human
ugaggugaucagcaagguggag

SEQ ID NO: 3040 - RNA, 22 nt, Human
ugagguaggaugauugcuagcu

SEQ ID NO: 3041 - RNA, 22 nt, Human
ugcaccacugcacucuaaccug

SEQ ID NO: 3042 - RNA, 22 nt, Human
gcacucaagccuggguuacaga

SEQ ID NO: 3043 - RNA, 22 nt, Human
gagguagagguugcagugagug

SEQ ID NO: 3044 - RNA, 22 nt, Human
gagcagguuuggaauggcucca

SEQ ID NO: 3045 - RNA, 22 nt, Human
gccuguaaucccagcuacuugg

SEQ ID NO: 3046 - RNA, 22 nt, Human
ggaaaguuaaagauguauguau

SEQ ID NO: 3047 - RNA, 22 nt, Human
ggagcuguaguuuuucccacau

SEQ ID NO: 3048 - RNA, 22 nt, Human
ggaagaaugugcuuuuguuguu

SEQ ID NO: 3049 - RNA, 22 nt, Human
gccauugcacuccagccugggc

SEQ ID NO: 3050 - RNA, 22 nt, Human
gcaggugugcaaaucacaacuu

SEQ ID NO: 3051 - RNA, 22 nt, Human
ggacugagacaugauuaacuug

SEQ ID NO: 3052 - RNA, 22 nt, Human
ggaggcagugguugcagugagc

SEQ ID NO: 3053 - RNA, 22 nt, Human
guacuccagccugccuggguaa

SEQ ID NO: 3054 - RNA, 22 nt, Human
cauuucaacuuuguuguucuuu

SEQ ID NO: 3055 - RNA, 22 nt, Human
cauugcacuccacccuaggcaa

SEQ ID NO: 3056 - RNA, 22 nt, Human
caugguacugccacagaagagu

SEQ ID NO: 3057 - RNA, 22 nt, Human
cagagagguucaaugucuuacu

SEQ ID NO: 3058 - RNA, 22 nt, Human
ccaggcaacuguguuuuuuaag

SEQ ID NO: 3059 - RNA, 22 nt, Human
ccacugcacuccagcacuccag

SEQ ID NO: 3060 - RNA, 22 nt, Human
cacugcacucagccugggugac

SEQ ID NO: 3061 - RNA, 22 nt, Human
cacacagucguguaguuuugcg

SEQ ID NO: 3062 - RNA, 22 nt, Human
cacugcacucuagccucgguga

SEQ ID NO: 3063 - RNA, 22 nt, Human
cacugcacuccaaccuggacaa

SEQ ID NO: 3064 - RNA, 22 nt, Human
cacugcacuccacccugggcaa

SEQ ID NO: 3065 - RNA, 22 nt, Human
cacugcacuccagcccggcaac

SEQ ID NO: 3066 - RNA, 22 nt, Human
cacugcacuccagccuaggcaa

SEQ ID NO: 3067 - RNA, 22 nt, Human
cuggaagacaugguagagcuga

SEQ ID NO: 3068 - RNA, 22 nt, Human
cuccuacaacugacucucugga

SEQ ID NO: 3069 - RNA, 22 nt, Human
cugaggucaggaguucgagacc

SEQ ID NO: 3070 - RNA, 22 nt, Human
cugugggugagagagugggaga

SEQ ID NO: 3071 - RNA, 22 nt, Human
ccagaggugagucuugauuuug

SEQ ID NO: 3072 - RNA, 22 nt, Human
gggcgugaugucagccagaguc

SEQ ID NO: 3073 - RNA, 22 nt, Human
ugagagaggaaggccguaggga

SEQ ID NO: 3074 - RNA, 22 nt, Human
uggagaaauuauauuuuacuaa

SEQ ID NO: 3075 - RNA, 22 nt, Human
uggcucaguuugcucagcagug

SEQ ID NO: 3076 - RNA, 22 nt, Human
gucuugaucuccugaccuugug

SEQ ID NO: 3077 - RNA, 22 nt, Human
gugcuuccauuuccccaucugu

SEQ ID NO: 3078 - RNA, 22 nt, Human
uaggaaguauuuuuuaaaaaca

SEQ ID NO: 3079 - RNA, 22 nt, Human
ucuuuuuguuguagcuguaugg

SEQ ID NO: 3080 - RNA, 22 nt, Human
ucauaucauuuugaaagcugag

SEQ ID NO: 3081 - RNA, 22 nt, Human
ugaggugaucagcaagguggag

SEQ ID NO: 3082 - RNA, 22 nt, Human
ugagggggaaggugugugugug

SEQ ID NO: 3083 - RNA, 22 nt, Human
ugaggaaggugugagaaaugag

SEQ ID NO: 3084 - RNA, 22 nt, Human
uauuacauucauuuugaugguu

SEQ ID NO: 3085 - RNA, 21 nt, Human
uacaagugcuccaguacggcc

SEQ ID NO: 3086 - RNA, 22 nt, Human
uugaugaaugggugcuccagga

SEQ ID NO: 3087 - RNA, 22 nt, Human
uugaggucaucuaaugguguug

SEQ ID NO: 3088 - RNA, 22 nt, Human
uucuggugaauucaggauggua

SEQ ID NO: 3089 - RNA, 22 nt, Human
aggaauauaauuaaaacuuugc

SEQ ID NO: 3090 - RNA, 22 nt, Human
augguguaggugaagagaacau

SEQ ID NO: 3091 - RNA, 22 nt, Human
aggugagaaaacugaggcucag

SEQ ID NO: 3092 - RNA, 22 nt, Human
uguguacuugucuuaguuugcu

SEQ ID NO: 3093 - RNA, 22 nt, Human
uuagggcaggcaugagagaacu

SEQ ID NO: 3094 - RNA, 22 nt, Human
uugagcacaguuugaggagugu

SEQ ID NO: 3095 - RNA, 22 nt, Human
uugcuuugguucaaguuaggca

SEQ ID NO: 3096 - RNA, 22 nt, Human
ggcccaggagggggagaaaggc

SEQ ID NO: 3097 - RNA, 22 nt, Human
ggaagaaugugcuuuuguuguu

SEQ ID NO: 3098 - RNA, 22 nt, Human
agagugugucuauggaaggggu

SEQ ID NO: 3099 - RNA, 22 nt, Human
aggccagagaggacucucuuuu

SEQ ID NO: 3100 - RNA, 22 nt, Human
aagcagccuuggaccaggaggg

SEQ ID NO: 3101 - RNA, 22 nt, Human
aggugagaaaacugaggcucag

SEQ ID NO: 3102 - RNA, 22 nt, Human
cugaauagaacagaagagcagc

SEQ ID NO: 3103 - RNA, 22 nt, Human
uggucucuugaaagaggcucuu

SEQ ID NO: 3104 - RNA, 22 nt, Human
guggcauuggugguggcauugg

SEQ ID NO: 3105 - RNA, 22 nt, Human
ugaggucauguucugucagguu

SEQ ID NO: 3106 - RNA, 22 nt, Human
ugaguguaugugugagagagaa

SEQ ID NO: 3107 - RNA, 22 nt, Human
uagagcaccuguugugugugca

SEQ ID NO: 3108 - RNA, 22 nt, Human
uaaggagcacacaaccuagauu

SEQ ID NO: 3109 - RNA, 22 nt, Human
uuccaguucucagcacagcgcu

SEQ ID NO: 3110 - RNA, 22 nt, Human
uggagagagcagguugcuaaga

SEQ ID NO: 3111 - RNA, 22 nt, Human
ugaggacaggagguugugaguu

SEQ ID NO: 3112 - RNA, 22 nt, Human
ggccaggacucuugcagaacug

SEQ ID NO: 3113 - RNA, 22 nt, Human
gcagcuguuuauuuagaaccug

SEQ ID NO: 3114 - RNA, 22 nt, Human
cuggcucuaauaaccugagcuu

SEQ ID NO: 3115 - RNA, 22 nt, Human
cuggcucccucucuucucuccc

SEQ ID NO: 3116 - RNA, 22 nt, Human
cuuuuugggguuuggggcuugg

SEQ ID NO: 3117 - RNA, 22 nt, Human
cuuuuccugggucugggcugug

SEQ ID NO: 3118 - RNA, 22 nt, Human
gcccaggagucugaggcuggag

SEQ ID NO: 3119 - RNA, 22 nt, Human
gcagcaggcagggccaggcagg

SEQ ID NO: 3120 - RNA, 22 nt, Human
ugguggggagaggcuugggaag

SEQ ID NO: 3121 - RNA, 22 nt, Human
ucugguuuuaauccugaaggca

SEQ ID NO: 3122 - RNA, 22 nt, Human
ugcaccacuacacuccuaggca

SEQ ID NO: 3123 - RNA, 22 nt, Human
ucauccuuuucugcaaccuguu

SEQ ID NO: 3124 - RNA, 22 nt, Human
ucccucugccugcaguccugcu

SEQ ID NO: 3125 - RNA, 22 nt, Human
ucugccucccugucucacucuc

SEQ ID NO: 3126 - RNA, 22 nt, Human
ugguuaguuuuaugggccugga

SEQ ID NO: 3127 - RNA, 22 nt, Human
uucucccugcccacacauccag

SEQ ID NO: 3128 - RNA, 22 nt, Human
uuuucugggcucccuuuucugc

SEQ ID NO: 3129 - RNA, 22 nt, Human
aucucauaggcccccagugggg

SEQ ID NO: 3130 - RNA, 22 nt, Human
cugaauguaaucuuaguuguaa

SEQ ID NO: 3131 - RNA, 22 nt, Human
cagagcugccuuucccuuccug

SEQ ID NO: 3132 - RNA, 22 nt, Human
gcuucuccuguccccucccuac

SEQ ID NO: 3133 - RNA, 22 nt, Human
guaaagaaaucauaaaagucca

SEQ ID NO: 3134 - RNA, 22 nt, Human
auaagcacagggagguucuguc

SEQ ID NO: 3135 - RNA, 22 nt, Human
acucagagccauuccgcucagg

SEQ ID NO: 3136 - RNA, 22 nt, Human
acccacccucugugaggaggau

SEQ ID NO: 3137 - RNA, 22 nt, Human
agagacacagacacaugggaga

SEQ ID NO: 3138 - RNA, 22 nt, Human
acuggcacagacaucugucaag

SEQ ID NO: 3139 - RNA, 22 nt, Human
aacgaugggcuggauuguuuug

SEQ ID NO: 3140 - RNA, 22 nt, Human
aacccuggaggcagagguugcg

SEQ ID NO: 3141 - RNA, 22 nt, Human
aaugcugugccagagcugcacc

SEQ ID NO: 3142 - RNA, 22 nt, Human
aagagcugaguaauugggggca

SEQ ID NO: 3143 - RNA, 22 nt, Human
aagcugccauugaagaucuggg

SEQ ID NO: 3144 - RNA, 22 nt, Human
aguaagcaaacucaguuuaauc

SEQ ID NO: 3145 - RNA, 22 nt, Human
agcuacauugucugcuggguuu

SEQ ID NO: 3146 - RNA, 22 nt, Human
agagcuaggaagauacaggguu

SEQ ID NO: 3147 - RNA, 22 nt, Human
gguggguuuccuuaauggcauc

SEQ ID NO: 3148 - RNA, 22 nt, Human
ggugaugcauuuaaaagggcag

SEQ ID NO: 3149 - RNA, 22 nt, Human
gccaggaugaagaggaggagaa

SEQ ID NO: 3150 - RNA, 22 nt, Human
gagcuaaggauagaggugagga

SEQ ID NO: 3151 - RNA, 22 nt, Human
gagguagagguugcagugaguc

SEQ ID NO: 3152 - RNA, 22 nt, Human
uggcuguuugggguugccgugu

SEQ ID NO: 3153 - RNA, 22 nt, Human
ucucacacucugauuucuugcu

SEQ ID NO: 3154 - RNA, 22 nt, Human
ucauaaacuggcaagcacuacc

SEQ ID NO: 3155 - RNA, 22 nt, Human
ugagggcaggugugaaaaugcu

SEQ ID NO: 3156 - RNA, 22 nt, Human
guccugagaacugcuccaguua

SEQ ID NO: 3157 - RNA, 22 nt, Human
guuuggcacugaaucauauaca

SEQ ID NO: 3158 - RNA, 22 nt, Human
ucagugcaaacuaagcagggca

SEQ ID NO: 3159 - RNA, 22 nt, Human
uggggcacuguggaggugucau

SEQ ID NO: 3160 - RNA, 22 nt, Human
ugaggacaggagguugugaguu

SEQ ID NO: 3161 - RNA, 22 nt, Human
ugauuggcaaugguuaugacgg

SEQ ID NO: 3162 - RNA, 22 nt, Human
uggagagagcagguugcuaaga

SEQ ID NO: 3163 - RNA, 22 nt, Human
uggcagauuugguugcuguugg

SEQ ID NO: 3164 - RNA, 22 nt, Human
gaggugaagaucuuggagucug

SEQ ID NO: 3165 - RNA, 22 nt, Human
ggaaaguuaaagauguauguau

SEQ ID NO: 3166 - RNA, 22 nt, Human
ggcaugugugagcagcugcagg

SEQ ID NO: 3167 - RNA, 22 nt, Human
ggcaugauggagaggguggaga

SEQ ID NO: 3168 - RNA, 22 nt, Human
ggcaaggaagaaagcagaaguu

SEQ ID NO: 3169 - RNA, 22 nt, Human
ggcgugaucuuggcucaccaca

SEQ ID NO: 3170 - RNA, 22 nt, Human
gguccacaaggggagagcaggg

SEQ ID NO: 3171 - RNA, 22 nt, Human
guacuccagccugccuggguaa

SEQ ID NO: 3172 - RNA, 22 nt, Human
ggaggaggaggcuggugcuggu

SEQ ID NO: 3173 - RNA, 22 nt, Human
gcugcuccugcucucccucucc

SEQ ID NO: 3174 - RNA, 22 nt, Human
gcugagaaaaccagguuaaugg

SEQ ID NO: 3175 - RNA, 22 nt, Human
gcagcgcugagaugauuuguug

SEQ ID NO: 3176 - RNA, 22 nt, Human
cuuccuggguucauauccuggu

SEQ ID NO: 3177 - RNA, 22 nt, Human
cucugagucugagagaguaggu

SEQ ID NO: 3178 - RNA, 22 nt, Human
cgacucuugaccauggcugggg

SEQ ID NO: 3179 - RNA, 22 nt, Human
uggcagauuugguugcuguugg

SEQ ID NO: 3180 - RNA, 22 nt, Human
uggagagagcagguugcuaaga

SEQ ID NO: 3181 - RNA, 22 nt, Human
ugggaggcuacacguuucucca

SEQ ID NO: 3182 - RNA, 22 nt, Human
ugugagagaaauggcaaguugg

SEQ ID NO: 3183 - RNA, 22 nt, Human
uguaggugguugagagaaugaa

SEQ ID NO: 3184 - RNA, 22 nt, Human
ucaguugauagcagaugcuguu

SEQ ID NO: 3185 - RNA, 22 nt, Human
guguguggaaaugcagaugacc

SEQ ID NO: 3186 - RNA, 22 nt, Human
uaccccgauagggagggugggg

SEQ ID NO: 3187 - RNA, 22 nt, Human
uacaaauguuucuucuccuuuu

SEQ ID NO: 3188 - RNA, 22 nt, Human
gugaggcaggaaccccaaagcc

SEQ ID NO: 3189 - RNA, 22 nt, Human
guggcauuggugguggcauugg

SEQ ID NO: 3190 - RNA, 22 nt, Human
guggcaagugaccagaugucac

SEQ ID NO: 3191 - RNA, 22 nt, Human
gugcuuccauuuccccaucugu

SEQ ID NO: 3192 - RNA, 22 nt, Human
guugggugugagggggguccca

SEQ ID NO: 3193 - RNA, 22 nt, Human
uugugcuuguacugaccaugua

SEQ ID NO: 3194 - RNA, 22 nt, Human
ugcaccaaugcacuccagccug

SEQ ID NO: 3195 - RNA, 22 nt, Human
ugcucuugcucuuucuucugga

SEQ ID NO: 3196 - RNA, 22 nt, Human
ucccucugccugcaguccugcu

SEQ ID NO: 3197 - RNA, 22 nt, Human
ucugccucccugucucacucuc

SEQ ID NO: 3198 - RNA, 22 nt, Human
ucugcuuggacugaucauugaa

SEQ ID NO: 3199 - RNA, 22 nt, Human
ucuugggauagugucucauggc

SEQ ID NO: 3200 - RNA, 22 nt, Human
guauggagaucucugcccuugu

SEQ ID NO: 3201 - RNA, 22 nt, Human
uggcaaggugugggcuagagau

SEQ ID NO: 3202 - RNA, 22 nt, Human
ugguggggagaggcuugggaag

SEQ ID NO: 3203 - RNA, 22 nt, Human
uugccuaggcuggagugcagug

SEQ ID NO: 3204 - RNA, 22 nt, Human
augagaguaggaguuugggcuc

SEQ ID NO: 3205 - RNA, 22 nt, Human
aguggcccuggcccuggggcau

SEQ ID NO: 3206 - RNA, 22 nt, Human
gagguagagguugcagugaguc

SEQ ID NO: 3207 - RNA, 22 nt, Human
gacaagaggcacagacagcagg

SEQ ID NO: 3208 - RNA, 22 nt, Human
gaccagccauccugguuuacau

SEQ ID NO: 3209 - RNA, 21 nt, Human
gacacaggcccagagaggcag

SEQ ID NO: 3210 - RNA, 22 nt, Human
cugugccugugacgagggauga

SEQ ID NO: 3211 - RNA, 22 nt, Human
cacuuucagagaugcccugagu

SEQ ID NO: 3212 - RNA, 22 nt, Human
caguggaugauguuuucugugg

SEQ ID NO: 3213 - RNA, 22 nt, Human
ccccaccccaguggagcucacc

SEQ ID NO: 3214 - RNA, 22 nt, Human
ccugcccauccugccuccacca

SEQ ID NO: 3215 - RNA, 22 nt, Human
gcagcaggcagggccaggcagg

SEQ ID NO: 3216 - RNA, 22 nt, Human
gauggcagcuggagguggagca

SEQ ID NO: 3217 - RNA, 22 nt, Human
ggaguguaaagaaggauguuac

SEQ ID NO: 3218 - RNA, 22 nt, Human
ggcacugagaagcaaacaggau

SEQ ID NO: 3219 - RNA, 22 nt, Human
agagcuaggaagauacaggguu

SEQ ID NO: 3220 - RNA, 22 nt, Human
agaaggcucgcucucucagggg

SEQ ID NO: 3221 - RNA, 22 nt, Human
aggccagagaggacucucuuuu

SEQ ID NO: 3222 - RNA, 22 nt, Human
auaccagcacaguggaugggga

SEQ ID NO: 3223 - RNA, 22 nt, Human
augacacaguggggccaguugg

SEQ ID NO: 3224 - RNA, 22 nt, Human
auucccuuuagcucugauggca

SEQ ID NO: 3225 - RNA, 22 nt, Human
aagagguaguguaaggaauugu

SEQ ID NO: 3226 - RNA, 22 nt, Human
acacaggcccagagaggcagug

SEQ ID NO: 3227 - RNA, 22 nt, Human
aagagcugaguaauugggggca

SEQ ID NO: 3228 - RNA, 22 nt, Human
accugcauuccagccugcugac

SEQ ID NO: 3229 - RNA, 22 nt, Human
accagcugugugaacuuaggaa

SEQ ID NO: 3230 - RNA, 22 nt, Human
augucagugaagaggucuggca

SEQ ID NO: 3231 - RNA, 22 nt, Human
aucuuucuuaauuccaggacuc

SEQ ID NO: 3232 - RNA, 22 nt, Human
agcuccaggagcuggcaggagg

SEQ ID NO: 3233 - RNA, 22 nt, Human
agcaagaugguagcauuggaga

SEQ ID NO: 3234 - RNA, 22 nt, Human
agaagaucccugcucugaguca

SEQ ID NO: 3235 - RNA, 22 nt, Human
aacccuggaggcagagguugcg

SEQ ID NO: 3236 - RNA, 22 nt, Human
aaauccuggggaucuggaggga

SEQ ID NO: 3237 - RNA, 22 nt, Human
ggaggaggaggcuggugcuggu

SEQ ID NO: 3238 - RNA, 22 nt, Human
gauaucaugggaagguguacuu

SEQ ID NO: 3239 - RNA, 22 nt, Human
gcugcuccugcucucccucucc

SEQ ID NO: 3240 - RNA, 22 nt, Human
ggcugcagugaacuaugaucgu

SEQ ID NO: 3241 - RNA, 22 nt, Human
cucagugguucagacacuguuu

SEQ ID NO: 3242 - RNA, 22 nt, Human
gaccagccauccugguuuacau

SEQ ID NO: 3243 - RNA, 22 nt, Human
gaaacuaguguugggacaaagg

SEQ ID NO: 3244 - RNA, 22 nt, Human
aguggcuuugaaacuguaauga

SEQ ID NO: 3245 - RNA, 22 nt, Human
auauuguguauucaggauagca

SEQ ID NO: 3246 - RNA, 22 nt, Human
aggugagaaaacugaggcucag

SEQ ID NO: 3247 - RNA, 22 nt, Human
uguaggugguugagagaaugaa

SEQ ID NO: 3248 - RNA, 22 nt, Human
ugugaaggaggaagggaggagc

SEQ ID NO: 3249 - RNA, 22 nt, Human
ugggaaacauccagcacauacu

SEQ ID NO: 3250 - RNA, 22 nt, Human
ugugucuguggaacagaagcag

SEQ ID NO: 3251 - RNA, 22 nt, Human
ugcucuugcucuuucuucugga

SEQ ID NO: 3252 - RNA, 22 nt, Human
ugcuguaguauguauauaguau

SEQ ID NO: 3253 - RNA, 22 nt, Human
ugauuguaugauauaugaguuu

SEQ ID NO: 3254 - RNA, 22 nt, Human
ugaucacaggcaaaggaauaaa

SEQ ID NO: 3255 - RNA, 22 nt, Human
aggccuuuuugggaagagacag

SEQ ID NO: 3256 - RNA, 22 nt, Human
aggcugagugacugggaguuag

SEQ ID NO: 3257 - RNA, 22 nt, Human
uuuguaauagcaaaauacugga

SEQ ID NO: 3258 - RNA, 22 nt, Human
gugggcugagaaaggcugccca

SEQ ID NO: 3259 - RNA, 22 nt, Human
agggaguuuacauguuuucuaa

SEQ ID NO: 3260 - RNA, 22 nt, Human
uagcugccaggcaacaaguacg

SEQ ID NO: 3261 - RNA, 22 nt, Human
uagcagcaggagcagguaacau

SEQ ID NO: 3262 - RNA, 22 nt, Human
uagaaagcuaacaagcuagaga

SEQ ID NO: 3263 - RNA, 22 nt, Human
uacucauuuaugcauuguuuug

SEQ ID NO: 3264 - RNA, 22 nt, Human
uauaugucugguauucuugggg

SEQ ID NO: 3265 - RNA, 22 nt, Human
uagugcaagguuuugccaacuu

SEQ ID NO: 3266 - RNA, 22 nt, Human
uaugugagacacuguccuaggc

SEQ ID NO: 3267 - RNA, 22 nt, Human
uaugaauguaaggaauguggga

SEQ ID NO: 3268 - RNA, 22 nt, Human
guucuucugggagaaaaauggc

SEQ ID NO: 3269 - RNA, 22 nt, Human
gugagaauggaggaagaacagu

SEQ ID NO: 3270 - RNA, 22 nt, Human
uccaaaauuaaagguuguagaa

SEQ ID NO: 3271 - RNA, 22 nt, Human
ugacagagguacauaggaggcu

SEQ ID NO: 3272 - RNA, 22 nt, Human
ucuuuuuugggagacggagucg

SEQ ID NO: 3273 - RNA, 22 nt, Human
ugugagagaaauggcaaguugg

SEQ ID NO: 3274 - RNA, 22 nt, Human
ugggcacauacugcaucauuua

SEQ ID NO: 3275 - RNA, 22 nt, Human
uggcacauaguaaguguucagu

SEQ ID NO: 3276 - RNA, 22 nt, Human
ugauggaggaaauggugguauc

SEQ ID NO: 3277 - RNA, 22 nt, Human
ugcacuugucuuuacccuagag

SEQ ID NO: 3278 - RNA, 22 nt, Human
ugaggacaggagguugugaguu

SEQ ID NO: 3279 - RNA, 22 nt, Human
ugaggucauguucugucagguu

SEQ ID NO: 3280 - RNA, 22 nt, Human
cugggcgugugaggcggcugug

SEQ ID NO: 3281 - RNA, 22 nt, Human
gacaugauguagcagaugaugg

SEQ ID NO: 3282 - RNA, 22 nt, Human
cagagcaguggagaguaggucu

SEQ ID NO: 3283 - RNA, 22 nt, Human
cagugggaaaaguuugucucau

SEQ ID NO: 3284 - RNA, 22 nt, Human
gcagcuguuuauuuagaaccug

SEQ ID NO: 3285 - RNA, 22 nt, Human
gcugugguucugcaugaagaca

SEQ ID NO: 3286 - RNA, 22 nt, Human
ggaagaaugugcuuuuguuguu

SEQ ID NO: 3287 - RNA, 22 nt, Human
guacaguggguguagggaccag

SEQ ID NO: 3288 - RNA, 22 nt, Human
guaacaaaaugaauaauaccug

SEQ ID NO: 3289 - RNA, 22 nt, Human
guauguauuuauagauguucuu

SEQ ID NO: 3290 - RNA, 22 nt, Human
ggcaugauggagaggguggaga

SEQ ID NO: 3291 - RNA, 22 nt, Human
ggaggaggugugaagaaaugaa

SEQ ID NO: 3292 - RNA, 22 nt, Human
gcucccuugucuagggcgugga

SEQ ID NO: 3293 - RNA, 22 nt, Human
gcugcugccucaacauuuuagg

SEQ ID NO: 3294 - RNA, 22 nt, Human
cuuggcccugugaggcuucacc

SEQ ID NO: 3295 - RNA, 22 nt, Human
cugugcccagccagggcugugu

SEQ ID NO: 3296 - RNA, 22 nt, Human
ccccaccccaguggagcucacc

SEQ ID NO: 3297 - RNA, 22 nt, Human
cuggcucccucucuucucuccc

SEQ ID NO: 3298 - RNA, 22 nt, Human
gucuuccuccguccccaccucc

SEQ ID NO: 3299 - RNA, 22 nt, Human
uaggcagucucaguuguugggu

SEQ ID NO: 3300 - RNA, 22 nt, Human
gugugugauaaggacacagaua

SEQ ID NO: 3301 - RNA, 22 nt, Human
agguccucacacacagcucugc

SEQ ID NO: 3302 - RNA, 22 nt, Human
uggagaauuaaaaaggguagug

SEQ ID NO: 3303 - RNA, 22 nt, Human
uggagcagaaaggcaggagucc

SEQ ID NO: 3304 - RNA, 22 nt, Human
ucagguuccugauuggaguucu

SEQ ID NO: 3305 - RNA, 22 nt, Human
uggcucugucuauugggaugug

SEQ ID NO: 3306 - RNA, 22 nt, Human
ugucaguuuuuuaaauacucag

SEQ ID NO: 3307 - RNA, 22 nt, Human
gagcuaaggauagaggugagga

SEQ ID NO: 3308 - RNA, 22 nt, Human
cuggugaggaaggagcagaguu

SEQ ID NO: 3309 - RNA, 22 nt, Human
cucagugugaagaacuacgggu

SEQ ID NO: 3310 - RNA, 22 nt, Human
cucacugcaaccuccgccuccc

SEQ ID NO: 3311 - RNA, 22 nt, Human
cagaggaugcggcugggaacgg

SEQ ID NO: 3312 - RNA, 22 nt, Human
gggccaugacagggagauaggc

SEQ ID NO: 3313 - RNA, 22 nt, Human
ggcaccaucucagcucacugga

SEQ ID NO: 3314 - RNA, 22 nt, Human
aacacguaguagguguucgaua

SEQ ID NO: 3315 - RNA, 22 nt, Human
aggcaguguuguuccugauugc

SEQ ID NO: 3316 - RNA, 22 nt, Human
agguagggaggguagaugcucu

SEQ ID NO: 3317 - RNA, 22 nt, Human
gauggcagcuggagguggagca

SEQ ID NO: 3318 - RNA, 22 nt, Human
gaggagguggggcagcagcagg

SEQ ID NO: 3319 - RNA, 22 nt, Human
gguccacaaggggagagcaggg

SEQ ID NO: 3320 - RNA, 19 nt, Human
gggggaugauagcagccag

SEQ ID NO: 3321 - RNA, 22 nt, Human
cucugccucccgggucuaggcu

SEQ ID NO: 3322 - RNA, 22 nt, Human
cugugcccagccagggcugugu

SEQ ID NO: 3323 - RNA, 22 nt, Human
cugggauuacaggugugaacca

SEQ ID NO: 3324 - RNA, 22 nt, Human
ccaaagugcuggcguuacaggu

SEQ ID NO: 3325 - RNA, 22 nt, Human
ccaaagugcugggauuacaggc

SEQ ID NO: 3326 - RNA, 22 nt, Human
cacugcaaccucugccuccugg

SEQ ID NO: 3327 - RNA, 22 nt, Human
cacugcaaccucugccaccugg

SEQ ID NO: 3328 - RNA, 22 nt, Human
caaagugcugagauuacaggca

SEQ ID NO: 3329 - RNA, 22 nt, Human
ugauccucuggcuucagccucc

SEQ ID NO: 3330 - RNA, 22 nt, Human
uagugcaauggcgcgaucucgg

SEQ ID NO: 3331 - RNA, 22 nt, Human
uuuuuguggaauauuuuuuuaa

SEQ ID NO: 3332 - RNA, 22 nt, Human
uugguuggugaugagcauugaa

SEQ ID NO: 3333 - RNA, 22 nt, Human
ugaaagagauguggugugugaa

SEQ ID NO: 3334 - RNA, 22 nt, Human
ucccugagcccugaaggguguu

SEQ ID NO: 3335 - RNA, 22 nt, Human
ucacugcaaccucugccuuccg

SEQ ID NO: 3336 - RNA, 22 nt, Human
ucacugcaaccucugcuucugg

SEQ ID NO: 3337 - RNA, 22 nt, Human
uguaugcucugugaagcuuacu

SEQ ID NO: 3338 - RNA, 22 nt, Human
gaggagguggggcagcagcagg

SEQ ID NO: 3339 - RNA, 22 nt, Human
cacugggauuacagaugugagc

SEQ ID NO: 3340 - RNA, 22 nt, Human
ccaaagugcuaggaauacaggu

SEQ ID NO: 3341 - RNA, 22 nt, Human
ccaaagugcuaggauuacagcc

SEQ ID NO: 3342 - RNA, 22 nt, Human
ggcaacaugcugaaaccccagc

SEQ ID NO: 3343 - RNA, 22 nt, Human
ggaagaaugugcuuuuguuguu

SEQ ID NO: 3344 - RNA, 22 nt, Human
ggcgugaucuuggcucaccaca

SEQ ID NO: 3345 - RNA, 22 nt, Human
uucccagaaaccugugagugug

SEQ ID NO: 3346 - RNA, 22 nt, Human
uugguugcugaugagcuuugag

SEQ ID NO: 3347 - RNA, 22 nt, Human
acuggcacagacaucugucaag

SEQ ID NO: 3348 - RNA, 22 nt, Human
agugauuuuccugccucagccu

SEQ ID NO: 3349 - RNA, 22 nt, Human
acaaccucugccuccuggguuc

SEQ ID NO: 3350 - RNA, 22 nt, Human
aagugcugggauuacaggccug

SEQ ID NO: 3351 - RNA, 22 nt, Human
aagugcugguauuacaagugug

SEQ ID NO: 3352 - RNA, 22 nt, Human
aggcugcaguguaguggcauga

SEQ ID NO: 3353 - RNA, 22 nt, Human
uucuggugaauucaggauggua

SEQ ID NO: 3354 - RNA, 22 nt, Human
uuugcaguguucaucaguauuu

SEQ ID NO: 3355 - RNA, 22 nt, Human
auuuggggaaauguguuucugg

SEQ ID NO: 3356 - RNA, 22 nt, Human
gcugcugccucaacauuuuagg

SEQ ID NO: 3357 - RNA, 22 nt, Human
cauaaaaucagaaaguauuacu

SEQ ID NO: 3358 - RNA, 22 nt, Human
ugcagccuugaacucuuucugg

SEQ ID NO: 3359 - RNA, 22 nt, Human
uacgcugugcugugacauggua

SEQ ID NO: 3360 - RNA, 22 nt, Human
guggcauuggugguggcauugg

SEQ ID NO: 3361 - RNA, 22 nt, Human
agcagcacagaaauauuggcac

SEQ ID NO: 3362 - RNA, 22 nt, Human
uaagugcugcugauuuuggaaa

SEQ ID NO: 3363 - RNA, 22 nt, Human
ucacugcaaccucugccuuccg

SEQ ID NO: 3364 - RNA, 22 nt, Human
cucacugcaaccuccgccuccc

SEQ ID NO: 3365 - RNA, 22 nt, Human
gucuuccagccuccaucuuucu

SEQ ID NO: 3366 - RNA, 22 nt, Human
gcuucuccuguccccucccuac

SEQ ID NO: 3367 - RNA, 22 nt, Human
uccagugauucauuugguuguu

SEQ ID NO: 3368 - RNA, 22 nt, Human
gugggcugagaaaggcugccca

SEQ ID NO: 3369 - RNA, 22 nt, Human
agcuccaggagcuggcaggagg

SEQ ID NO: 3370 - RNA, 22 nt, Human
uuuguaauagcaaaauacugga

SEQ ID NO: 3371 - RNA, 22 nt, Human
aggcugagugacugggaguuag

SEQ ID NO: 3372 - RNA, 22 nt, Human
ugacuggaggaagggagguaag

SEQ ID NO: 3373 - RNA, 21 nt, Human
gacacaggcccagagaggcag

SEQ ID NO: 3374 - RNA, 22 nt, Human
agguggcacugugugggguggg

SEQ ID NO: 3375 - RNA, 22 nt, Human
acacaggcccagagaggcagug

SEQ ID NO: 3376 - RNA, 20 nt, Human
acaggagcauggagaggcua

SEQ ID NO: 3377 - RNA, 22 nt, Human
agaaggcucgcucucucagggg

SEQ ID NO: 3378 - RNA, 22 nt, Human
accuggccuguaggcaagucuu

SEQ ID NO: 3379 - RNA, 22 nt, Human
accacagugucacagaguccau

SEQ ID NO: 3380 - RNA, 22 nt, Human
agauauggugaacagacagaug

SEQ ID NO: 3381 - RNA, 22 nt, Human
auaccagcacaguggaugggga

SEQ ID NO: 3382 - RNA, 22 nt, Human
cuggcucccucucuucucuccc

SEQ ID NO: 3383 - RNA, 22 nt, Human
ccagccugagguuccuggaggg

SEQ ID NO: 3384 - RNA, 22 nt, Human
gagguuugagccuucuccugcu

SEQ ID NO: 3385 - RNA, 22 nt, Human
gggucucaaaugagggacauuu

SEQ ID NO: 3386 - RNA, 22 nt, Human
agucagggagacugucaguaaa

SEQ ID NO: 3387 - RNA, 22 nt, Human
uucaguucuugaccugccccag

SEQ ID NO: 3388 - RNA, 22 nt, Human
ugggaugauguuaaacguacuc

SEQ ID NO: 3389 - RNA, 22 nt, Human
ugguccagaggaggaaugaggg

SEQ ID NO: 3390 - RNA, 22 nt, Human
ucuuucuacaccucugccagug

SEQ ID NO: 3391 - RNA, 22 nt, Human
ucuuccccaccuucggcuugca

SEQ ID NO: 3392 - RNA, 22 nt, Human
gucuuccuccguccccaccucc

SEQ ID NO: 3393 - RNA, 22 nt, Human
uaagaagagaaagaagaggcug

SEQ ID NO: 3394 - RNA, 22 nt, Human
uacaggcaggcacagaggcagu

SEQ ID NO: 3395 - RNA, 22 nt, Human
ugcuaggcuuauucucuuccuc

SEQ ID NO: 3396 - RNA, 22 nt, Human
aggccagagaggacucucuuuu

SEQ ID NO: 3397 - RNA, 22 nt, Human
ucacugcaaccucugccuuccg

SEQ ID NO: 3398 - RNA, 22 nt, Human
ucucauauagcuggguugcagc

SEQ ID NO: 3399 - RNA, 22 nt, Human
ugacuggaggaagggagguaag

SEQ ID NO: 3400 - RNA, 22 nt, Human
uggaggcaggugcagauggagg

SEQ ID NO: 3401 - RNA, 22 nt, Human
ugccuaggcaggacggaaugca

SEQ ID NO: 3402 - RNA, 22 nt, Human
gcuucuccuguccccucccuac

SEQ ID NO: 3403 - RNA, 22 nt, Human
gcugagaccacccuugccugcc

SEQ ID NO: 3404 - RNA, 22 nt, Human
gcagcaggcagggccaggcagg

SEQ ID NO: 3405 - RNA, 22 nt, Human
gaggacccuuaggucagacaga

SEQ ID NO: 3406 - RNA, 22 nt, Human
gguucucaaaugagggacauuu

SEQ ID NO: 3407 - RNA, 22 nt, Human
gggagaaaaggaggggauacag

SEQ ID NO: 3408 - RNA, 22 nt, Human
cuagcacagugcuuggcacaca

SEQ ID NO: 3409 - RNA, 22 nt, Human
cggcaagaugccggagugcugg

SEQ ID NO: 3410 - RNA, 22 nt, Human
cacugcaacccccgccucccag

SEQ ID NO: 3411 - RNA, 22 nt, Human
cucacugcaaccuccgccuccc

SEQ ID NO: 3412 - RNA, 22 nt, Human
ccugggggccacuuugcacagg

SEQ ID NO: 3413 - RNA, 22 nt, Human
cugugcccagccagggcugugu

SEQ ID NO: 3414 - RNA, 22 nt, Human
gggguuucuguaggcacuuuau

SEQ ID NO: 3415 - RNA, 22 nt, Human
ggcagcugugcagagugggggu

SEQ ID NO: 3416 - RNA, 22 nt, Human
ugagguaggugcugaaacugcu

SEQ ID NO: 3417 - RNA, 22 nt, Human
ugaguauucaccaggugcuggg

SEQ ID NO: 3418 - RNA, 22 nt, Human
ucugccucccugucucacucuc

SEQ ID NO: 3419 - RNA, 22 nt, Human
aggcacugugcaggaugauggg

SEQ ID NO: 3420 - RNA, 22 nt, Human
agcuggauuguuuaccuggggc

SEQ ID NO: 3421 - RNA, 22 nt, Human
uugcccaggcuggagugcagug

SEQ ID NO: 3422 - RNA, 22 nt, Human
uagcucauuuuugaaaucaguu

SEQ ID NO: 3423 - RNA, 22 nt, Human
ugcaugaugcugagguuuggga

SEQ ID NO: 3424 - RNA, 22 nt, Human
uuaaagucaccauuuguggguu

SEQ ID NO: 3425 - RNA, 22 nt, Human
gugggcugagaaaggcugccca

SEQ ID NO: 3426 - RNA, 22 nt, Human
ucacccaggcuggagugcagug

SEQ ID NO: 3427 - RNA, 22 nt, Human
uucaagaaagccaagauggcug

SEQ ID NO: 3428 - RNA, 22 nt, Human
uugccuaggcuggagugcagug

SEQ ID NO: 3429 - RNA, 22 nt, Human
aguauuucuuguuuuauugaga

SEQ ID NO: 3430 - RNA, 22 nt, Human
cccaggcuggagugcaguggug

SEQ ID NO: 3431 - RNA, 22 nt, Human
cuggcucuaauaaccugagcuu

SEQ ID NO: 3432 - RNA, 22 nt, Human
accuggccuguaggcaagucuu

SEQ ID NO: 3433 - RNA, 22 nt, Human
aagcagaacuguuuuguuuucu

SEQ ID NO: 3434 - RNA, 22 nt, Human
aggccagagaggacucucuuuu

SEQ ID NO: 3435 - RNA, 22 nt, Human
ggcuagaaagccagagagacag

SEQ ID NO: 3436 - RNA, 22 nt, Human
ugugcugguugcccccgagggg

SEQ ID NO: 3437 - RNA, 22 nt, Human
uaagauguuugcauuucagcac

SEQ ID NO: 3438 - RNA, 22 nt, Human
uauugcuaagaauucagguagu

SEQ ID NO: 3439 - RNA, 22 nt, Human
ugagagagcaagugaauuuccc

SEQ ID NO: 3440 - RNA, 22 nt, Human
ugcaugaugcugagguuuggga

SEQ ID NO: 3441 - RNA, 22 nt, Human
ucuuucuacaccucugccagug

SEQ ID NO: 3442 - RNA, 22 nt, Human
ucuuagauugagaagauguggc

SEQ ID NO: 3443 - RNA, 22 nt, Human
agguccucacacacagcucugc

SEQ ID NO: 3444 - RNA, 22 nt, Human
ucugagcccaggaguuugaggc

SEQ ID NO: 3445 - RNA, 22 nt, Human
guugggguuucaguggcaguca

SEQ ID NO: 3446 - RNA, 22 nt, Human
uuaguguucaggcucaaaugaa

SEQ ID NO: 3447 - RNA, 22 nt, Human
uucacaguggcugaagcuguuc

SEQ ID NO: 3448 - RNA, 22 nt, Human
ugguccagaggaggaaugaggg

SEQ ID NO: 3449 - RNA, 22 nt, Human
gaguacaaaugaagucuguggg

SEQ ID NO: 3450 - RNA, 22 nt, Human
gaggagguggggcagcagcagg

SEQ ID NO: 3451 - RNA, 22 nt, Human
gcuucuccuguccccucccuac

SEQ ID NO: 3452 - RNA, 22 nt, Human
gccuuuccuccagaacugcucc

SEQ ID NO: 3453 - RNA, 22 nt, Human
cacugcaaccucugccaccugg

SEQ ID NO: 3454 - RNA, 22 nt, Human
cacugcaaccucugccuccugg

SEQ ID NO: 3455 - RNA, 22 nt, Human
cccaggagguggagguuacagu

SEQ ID NO: 3456 - RNA, 22 nt, Human
uggcacagaucagcagaacagg

SEQ ID NO: 3457 - RNA, 22 nt, Human
uguguuggagcagaggcagggg

SEQ ID NO: 3458 - RNA, 22 nt, Human
uuguugcggguggggagaggau

SEQ ID NO: 3459 - RNA, 22 nt, Human
uuuucugggcucccuuuucugc

SEQ ID NO: 3460 - RNA, 22 nt, Human
cacugcaaccuccaccuccugg

SEQ ID NO: 3461 - RNA, 22 nt, Human
ggcuggagaguaaaucaggucu

SEQ ID NO: 3462 - RNA, 22 nt, Human
ggaggaggaggcuggugcuggu

SEQ ID NO: 3463 - RNA, 22 nt, Human
ggcccaggagggggagaaaggc

SEQ ID NO: 3464 - RNA, 22 nt, Human
cugugggugagagagugggaga

SEQ ID NO: 3465 - RNA, 21 nt, Human
cuuuggcaagggagaagucac

SEQ ID NO: 3466 - RNA, 22 nt, Human
cagagcugccuuucccuuccug

SEQ ID NO: 3467 - RNA, 22 nt, Human
agggcaguggaucucugcaaag

SEQ ID NO: 3468 - RNA, 22 nt, Human
ccagaggugagucuugauuuug

SEQ ID NO: 3469 - RNA, 22 nt, Human
cugugggugagagagugggaga

SEQ ID NO: 3470 - RNA, 22 nt, Human
cucugagucugagagaguaggu

SEQ ID NO: 3471 - RNA, 22 nt, Human
gauguugaugagcuugugugca

SEQ ID NO: 3472 - RNA, 22 nt, Human
auaaagcagguuaacaaagcug

SEQ ID NO: 3473 - RNA, 22 nt, Human
uuuucugggcucccuuuucugc

SEQ ID NO: 3474 - RNA, 22 nt, Human
uucuuuuuccgcuuucugagcc

SEQ ID NO: 3475 - RNA, 22 nt, Human
uugagcaaaauaucugguuuca

SEQ ID NO: 3476 - RNA, 22 nt, Human
uucucccugcccacacauccag

SEQ ID NO: 3477 - RNA, 22 nt, Human
ugguggggagaggcuugggaag

SEQ ID NO: 3478 - RNA, 22 nt, Human
gacaugauguagcagaugaugg

SEQ ID NO: 3479 - RNA, 22 nt, Human
ggcagcugugcagagugggggu

SEQ ID NO: 3480 - RNA, 22 nt, Human
gucuggaggcuggaaccuggug

SEQ ID NO: 3481 - RNA, 22 nt, Human
uguguacuugucuuaguuugcu

SEQ ID NO: 3482 - RNA, 22 nt, Human
uucuaugauucucuaaguagca

SEQ ID NO: 3483 - RNA, 22 nt, Human
uggagugucuggaggugucucu

SEQ ID NO: 3484 - RNA, 22 nt, Human
uagguugugcgcuccuuaugag

SEQ ID NO: 3485 - RNA, 22 nt, Human
uaaguaaagagagaagccagaa

SEQ ID NO: 3486 - RNA, 22 nt, Human
uaucacgugcagcuuugcugac

SEQ ID NO: 3487 - RNA, 22 nt, Human
uucuggugaauucaggauggua

SEQ ID NO: 3488 - RNA, 22 nt, Human
aggcacugugcaggaugauggg

SEQ ID NO: 3489 - RNA, 22 nt, Human
uuuguaauagcaaaauacugga

SEQ ID NO: 3490 - RNA, 22 nt, Human
ucagguuccugauuggaguucu

SEQ ID NO: 3491 - RNA, 22 nt, Human
ucuuugcuggaaggugccuccc

SEQ ID NO: 3492 - RNA, 22 nt, Human
uucuggguuuuuguggguuugc

SEQ ID NO: 3493 - RNA, 22 nt, Human
uacaaauuccugggucuccugg

SEQ ID NO: 3494 - RNA, 22 nt, Human
gcuucuccuguccccucccuac

SEQ ID NO: 3495 - RNA, 22 nt, Human
acugggauaugaagacugugug

SEQ ID NO: 3496 - RNA, 22 nt, Human
acugcacuccauccuggggagc

SEQ ID NO: 3497 - RNA, 22 nt, Human
gguucucaaaugagggacauuu

SEQ ID NO: 3498 - RNA, 22 nt, Human
ccaaagugcuggcguuacaggu

SEQ ID NO: 3499 - RNA, 22 nt, Human
uaggagugaaaauaaacucugu

SEQ ID NO: 3500 - RNA, 22 nt, Human
uaaggagugguuccaauuuggg

SEQ ID NO: 3501 - RNA, 22 nt, Human
ucccuucagagcccauggguuu

SEQ ID NO: 3502 - RNA, 22 nt, Human
uggagugucuggaggugucucu

SEQ ID NO: 3503 - RNA, 22 nt, Human
guauggagaucucugcccuugu

SEQ ID NO: 3504 - RNA, 22 nt, Human
ucacccaguguaaacagcauga

SEQ ID NO: 3505 - RNA, 22 nt, Human
uggagaaauuauauuuuacuaa

SEQ ID NO: 3506 - RNA, 22 nt, Human
uucccucauucuccacccaguc

SEQ ID NO: 3507 - RNA, 22 nt, Human
uguggcuaguuugaacugagau

SEQ ID NO: 3508 - RNA, 22 nt, Human
gcaggugugcaaaucacaacuu

SEQ ID NO: 3509 - RNA, 22 nt, Human
cuggguggccuucaguccauga

SEQ ID NO: 3510 - RNA, 22 nt, Human
cuggcucuacccucucacuuca

SEQ ID NO: 3511 - RNA, 22 nt, Human
ccuggagugacagguguagccu

SEQ ID NO: 3512 - RNA, 22 nt, Human
cuagcacagugcuuggcacaca

SEQ ID NO: 3513 - RNA, 22 nt, Human
cugcacuagaaggcacuauguu

SEQ ID NO: 3514 - RNA, 22 nt, Human
ggcaugauggagaggguggaga

SEQ ID NO: 3515 - RNA, 22 nt, Human
augggcaaauacugggagcugg

SEQ ID NO: 3516 - RNA, 22 nt, Human
guggaguucucugcuaguccua

SEQ ID NO: 3517 - RNA, 22 nt, Human
agcaccacaacagggacugggc

SEQ ID NO: 3518 - RNA, 22 nt, Human
uucaggacuguggacugggcug

SEQ ID NO: 3519 - RNA, 22 nt, Human
gacaagaggcacagacagcagg

SEQ ID NO: 3520 - RNA, 22 nt, Human
agaaggcucgcucucucagggg

SEQ ID NO: 3521 - RNA, 22 nt, Human
acugcacucuagccugagcaac

SEQ ID NO: 3522 - RNA, 22 nt, Human
agaggcagagguuacaguagug

SEQ ID NO: 3523 - RNA, 22 nt, Human
agauaguucucuguuguugggg

SEQ ID NO: 3524 - RNA, 22 nt, Human
aggcugcaguguaguggcauga

SEQ ID NO: 3525 - RNA, 22 nt, Human
agguccucacacacagcucugc

SEQ ID NO: 3526 - RNA, 22 nt, Human
agugagccgagauacauacaua

SEQ ID NO: 3527 - RNA, 22 nt, Human
aggcaagagguugcagugagcu

SEQ ID NO: 3528 - RNA, 22 nt, Human
augaccaggaauugagagacug

SEQ ID NO: 3529 - RNA, 22 nt, Human
augccacagcacuucagccuga

SEQ ID NO: 3530 - RNA, 22 nt, Human
acugcacuccauccuggggagc

SEQ ID NO: 3531 - RNA, 22 nt, Human
acugcacuccauccugggacag

SEQ ID NO: 3532 - RNA, 22 nt, Human
acugcacuccagucugggugac

SEQ ID NO: 3533 - RNA, 22 nt, Human
acugcacuccauccugagugac

SEQ ID NO: 3534 - RNA, 22 nt, Human
acugcacuccugccugggugac

SEQ ID NO: 3535 - RNA, 22 nt, Human
acugcacucuagccuaggugau

SEQ ID NO: 3536 - RNA, 22 nt, Human
acugcacuccagccuggcgaca

SEQ ID NO: 3537 - RNA, 22 nt, Human
acugcacuccagccugggugac

SEQ ID NO: 3538 - RNA, 22 nt, Human
acugcacuccagccuggcaaca

SEQ ID NO: 3539 - RNA, 22 nt, Human
acugcacuccagccugggcgau

SEQ ID NO: 3540 - RNA, 22 nt, Human
acuguacuccagccugggcaac

SEQ ID NO: 3541 - RNA, 22 nt, Human
acuguacuccagccuaggcaac

SEQ ID NO: 3542 - RNA, 22 nt, Human
agaaggcucgcucucucagggg

SEQ ID NO: 3543 - RNA, 22 nt, Human
acuguacuccagccugggugac

SEQ ID NO: 3544 - RNA, 22 nt, Human
acuguacuucagccugggcaac

SEQ ID NO: 3545 - RNA, 22 nt, Human
acuguacuucagccuggguaac

SEQ ID NO: 3546 - RNA, 22 nt, Human
acugcacuucagccugggcaau

SEQ ID NO: 3547 - RNA, 22 nt, Human
acugcacucuagccugggcaac

SEQ ID NO: 3548 - RNA, 22 nt, Human
acugcacuccugccuaggugac

SEQ ID NO: 3549 - RNA, 22 nt, Human
acugcacuccagccuguugaca

SEQ ID NO: 3550 - RNA, 22 nt, Human
acugcacuccagucuaggugac

SEQ ID NO: 3551 - RNA, 22 nt, Human
acugcacuccagccugggugau

SEQ ID NO: 3552 - RNA, 22 nt, Human
acugcacuccagccuggguggc

SEQ ID NO: 3553 - RNA, 22 nt, Human
aacccuggaggcagagguugcg

SEQ ID NO: 3554 - RNA, 22 nt, Human
aaagcuuuguucauuguaucug

SEQ ID NO: 3555 - RNA, 22 nt, Human
acaaaaaauacgaaaauuagcu

SEQ ID NO: 3556 - RNA, 22 nt, Human
acugcacuccagccuaugggau

SEQ ID NO: 3557 - RNA, 22 nt, Human
aaucccagcuacucgggaggcu

SEQ ID NO: 3558 - RNA, 22 nt, Human
aaugugaauguuguaugcagug

SEQ ID NO: 3559 - RNA, 22 nt, Human
aagguggugucauguuuugggg

SEQ ID NO: 3560 - RNA, 22 nt, Human
cugugcccagccagggcugugu

SEQ ID NO: 3561 - RNA, 22 nt, Human
cuugcacuccacagccugggug

SEQ ID NO: 3562 - RNA, 22 nt, Human
ccuccuuucaucaaauucgagu

SEQ ID NO: 3563 - RNA, 22 nt, Human
cauugcacuccacccuaggcaa

SEQ ID NO: 3564 - RNA, 22 nt, Human
cauugcacuccagccuaggcaa

SEQ ID NO: 3565 - RNA, 22 nt, Human
cccaggagguggagguuacagu

SEQ ID NO: 3566 - RNA, 22 nt, Human
cccaggaggcggagguugcagu

SEQ ID NO: 3567 - RNA, 22 nt, Human
ccacugcacuccagccugggug

SEQ ID NO: 3568 - RNA, 22 nt, Human
ccagccugagguuccuggaggg

SEQ ID NO: 3569 - RNA, 22 nt, Human
cacugcaaccucugccuccugg

SEQ ID NO: 3570 - RNA, 22 nt, Human
cacugcacucagccugggugac

SEQ ID NO: 3571 - RNA, 22 nt, Human
caagugcuugaacauggcagag

SEQ ID NO: 3572 - RNA, 22 nt, Human
cacugcacuccagccuaggcaa

SEQ ID NO: 3573 - RNA, 22 nt, Human
cacugcacuccagccuggguaa

SEQ ID NO: 3574 - RNA, 22 nt, Human
cacugcacuccagccugggcga

SEQ ID NO: 3575 - RNA, 22 nt, Human
cacugcacuccagccuggguga

SEQ ID NO: 3576 - RNA, 22 nt, Human
guacuccagccugccuggguaa

SEQ ID NO: 3577 - RNA, 22 nt, Human
ggcugcagugaacuaugaucgu

SEQ ID NO: 3578 - RNA, 22 nt, Human
ggcugggcaugguggcucacgc

SEQ ID NO: 3579 - RNA, 22 nt, Human
gggcaugaugauggcacuagcg

SEQ ID NO: 3580 - RNA, 22 nt, Human
ggcccaggagggggagaaaggc

SEQ ID NO: 3581 - RNA, 22 nt, Human
ggcaacaugcugaaaccccagc

SEQ ID NO: 3582 - RNA, 22 nt, Human
ggccugaggucagcaguagagg

SEQ ID NO: 3583 - RNA, 22 nt, Human
gccauugcacuccagccugggc

SEQ ID NO: 3584 - RNA, 22 nt, Human
gagguagagguugcagugagug

SEQ ID NO: 3585 - RNA, 22 nt, Human
uucugccacugcauuccagccu

SEQ ID NO: 3586 - RNA, 21 nt, Human
uucacccaucuuuccacccac

SEQ ID NO: 3587 - RNA, 22 nt, Human
ugugacucguacuuguaauccu

SEQ ID NO: 3588 - RNA, 22 nt, Human
ugugccacugcacuccaugggu

SEQ ID NO: 3589 - RNA, 22 nt, Human
uggagcagaaaggcaggagucc

SEQ ID NO: 3590 - RNA, 22 nt, Human
ugcucuugcucuuucuucugga

SEQ ID NO: 3591 - RNA, 22 nt, Human
ugcugugcuaaaggaaggauua

SEQ ID NO: 3592 - RNA, 22 nt, Human
ugcaccacugcacucuaaccug

SEQ ID NO: 3593 - RNA, 22 nt, Human
ucugagcccaggaguuugaggc

SEQ ID NO: 3594 - RNA, 22 nt, Human
ucucacacucugauuucuugcu

SEQ ID NO: 3595 - RNA, 22 nt, Human
ucugucauuuuucucuuuccau

SEQ ID NO: 3596 - RNA, 22 nt, Human
gugugggcagggccgugcuccc

SEQ ID NO: 3597 - RNA, 22 nt, Human
guggcauuggugguggcauugg

SEQ ID NO: 3598 - RNA, 22 nt, Human
uaggagugaaaauaaacucugu

SEQ ID NO: 3599 - RNA, 22 nt, Human
uauggcaaagucacugauuucc

SEQ ID NO: 3600 - RNA, 22 nt, Human
uaccagugucagcuuccugugu

SEQ ID NO: 3601 - RNA, 22 nt, Human
uaucgcuugagcccaggaguuu

SEQ ID NO: 3602 - RNA, 22 nt, Human
uugagaaugcuguaauuggagg

SEQ ID NO: 3603 - RNA, 22 nt, Human
uugagcacaguuugaggagugu

SEQ ID NO: 3604 - RNA, 22 nt, Human
uugcacuccagccuggguaaca

SEQ ID NO: 3605 - RNA, 22 nt, Human
uuuaagcuauaguuccaggccc

SEQ ID NO: 3606 - RNA, 22 nt, Human
gugcuugaccaugugguggcag

SEQ ID NO: 3607 - RNA, 22 nt, Human
uauugcacuccagccugggcaa

SEQ ID NO: 3608 - RNA, 22 nt, Human
uacaugugcccaguggcugcug

SEQ ID NO: 3609 - RNA, 22 nt, Human
uggagccuuguuguuuguucac

SEQ ID NO: 3610 - RNA, 22 nt, Human
ugcaccacugcacuccagccug

SEQ ID NO: 3611 - RNA, 22 nt, Human
ugcgccccuguacucugggcaa

SEQ ID NO: 3612 - RNA, 22 nt, Human
ugauucauuucuaaacccagcu

SEQ ID NO: 3613 - RNA, 22 nt, Human
ugcaccaaugcacuccagccug

SEQ ID NO: 3614 - RNA, 22 nt, Human
uccauugcacuccagucugggc

SEQ ID NO: 3615 - RNA, 22 nt, Human
ucccuucagagcccauggguuu

SEQ ID NO: 3616 - RNA, 22 nt, Human
augccuguaaucccagcacuuu

SEQ ID NO: 3617 - RNA, 22 nt, Human
augccuguaaucccagcauuuu

SEQ ID NO: 3618 - RNA, 22 nt, Human
agugagcuaugaucaugccggu

SEQ ID NO: 3619 - RNA, 22 nt, Human
cacugcacuccaaccuggacaa

SEQ ID NO: 3620 - RNA, 22 nt, Human
cacugcacuccacccugggcaa

SEQ ID NO: 3621 - RNA, 22 nt, Human
cacugcacucuagccucgguga

SEQ ID NO: 3622 - RNA, 22 nt, Human
cacugcacuccagcccggcaac

SEQ ID NO: 3623 - RNA, 22 nt, Human
auuguucuccagccugggcgac

SEQ ID NO: 3624 - RNA, 22 nt, Human
auugcuugagcccaggaguuca

SEQ ID NO: 3625 - RNA, 22 nt, Human
auugcacaccaaccugggcaac

SEQ ID NO: 3626 - RNA, 22 nt, Human
auugcacuccagccugggugac

SEQ ID NO: 3627 - RNA, 22 nt, Human
auugcacuccagccugggcaau

SEQ ID NO: 3628 - RNA, 22 nt, Human
auugcacuccagcuugggcaac

SEQ ID NO: 3629 - RNA, 22 nt, Human
auugcacuucagccugggugac

SEQ ID NO: 3630 - RNA, 22 nt, Human
ugggaaacauccagcacauacu

SEQ ID NO: 3631 - RNA, 22 nt, Human
uugcaauagugaaaaaacugaa

SEQ ID NO: 3632 - RNA, 22 nt, Human
uugcacuccagccugggugaca

SEQ ID NO: 3633 - RNA, 22 nt, Human
uugcacuccagucugggugaca

SEQ ID NO: 3634 - RNA, 22 nt, Human
uuguuuuagaagaaggucagaa

SEQ ID NO: 3635 - RNA, 22 nt, Human
ggaggcagugguugcagugagc

SEQ ID NO: 3636 - RNA, 22 nt, Human
ggacugcagucacacucuaaga

SEQ ID NO: 3637 - RNA, 22 nt, Human
gcacucaagccuggguuacaga

SEQ ID NO: 3638 - RNA, 22 nt, Human
gccauugcacuccagccuggac

SEQ ID NO: 3639 - RNA, 22 nt, Human
gccuguaaucccagcuacuugg

SEQ ID NO: 3640 - RNA, 22 nt, Human
ggccugguggcuguuguuuugg

SEQ ID NO: 3641 - RNA, 22 nt, Human
guacacauuuucauguuaccau

SEQ ID NO: 3642 - RNA, 22 nt, Human
cugaggucaggaguucgagacc

SEQ ID NO: 3643 - RNA, 22 nt, Human
cucugagucugagagaguaggu

SEQ ID NO: 3644 - RNA, 22 nt, Human
cuggaggauaacaaugauaaug

SEQ ID NO: 3645 - RNA, 22 nt, Human
gaccagccauccugguuuacau

SEQ ID NO: 3646 - RNA, 22 nt, Human
gagguagagguugcagugaguc

SEQ ID NO: 3647 - RNA, 22 nt, Human
cucagauacuugggagguugag

SEQ ID NO: 3648 - RNA, 22 nt, Human
cguguaaucccagcuacuuggg

SEQ ID NO: 3649 - RNA, 22 nt, Human
cauugcacuccagccuggguga

SEQ ID NO: 3650 - RNA, 22 nt, Human
cacugcacuguagccuccuggg

SEQ ID NO: 3651 - RNA, 22 nt, Human
cugugagcuauuuguuuugguu

SEQ ID NO: 3652 - RNA, 22 nt, Human
ggagcuguaguuuuucccacau

SEQ ID NO: 3653 - RNA, 22 nt, Human
uggcagauuugguugcuguugg

SEQ ID NO: 3654 - RNA, 22 nt, Human
uuccaguucucagcacagcgcu

SEQ ID NO: 3655 - RNA, 22 nt, Human
aggcagucuugauuagcuucua

SEQ ID NO: 3656 - RNA, 22 nt, Human
uuguugcggguggggagaggau

SEQ ID NO: 3657 - RNA, 22 nt, Human
uuugcacacuuuccaaguugcc

SEQ ID NO: 3658 - RNA, 22 nt, Human
agcugguguguagcggguaccu

SEQ ID NO: 3659 - RNA, 22 nt, Human
agcugugagccugccuuccagu

SEQ ID NO: 3660 - RNA, 22 nt, Human
ucugucauuuuucucuuuccau

SEQ ID NO: 3661 - RNA, 22 nt, Human
gcuguguuaacuguucaaacuc

SEQ ID NO: 3662 - RNA, 22 nt, Human
ggcuggagaguaaaucaggucu

SEQ ID NO: 3663 - RNA, 22 nt, Human
ggugaugcauuuaaaagggcag

SEQ ID NO: 3664 - RNA, 22 nt, Human
gaacagcuccagucuacagccc

SEQ ID NO: 3665 - RNA, 22 nt, Human
acugcacuccugccuaggugac

SEQ ID NO: 3666 - RNA, 22 nt, Human
aggcagagagguauuuaggcau

SEQ ID NO: 3667 - RNA, 22 nt, Human
agcaagaugguagcauuggaga

SEQ ID NO: 3668 - RNA, 22 nt, Human
aggugggguuucaccauguugg

SEQ ID NO: 3669 - RNA, 22 nt, Human
auuugaggaggcuuuacagcca

SEQ ID NO: 3670 - RNA, 22 nt, Human
acugcacuccagccuggguggc

SEQ ID NO: 3671 - RNA, 22 nt, Human
aagguggugucauguuuugggg

SEQ ID NO: 3672 - RNA, 22 nt, Human
aaggcuguguaggcagaauucu

SEQ ID NO: 3673 - RNA, 22 nt, Human
aauuuagaaucguuucugauag

SEQ ID NO: 3674 - RNA, 22 nt, Human
gacaagaggcacagacagcagg

SEQ ID NO: 3675 - RNA, 22 nt, Human
cugggcgugugaggcggcugug

SEQ ID NO: 3676 - RNA, 22 nt, Human
ccugcccauccugccuccacca

SEQ ID NO: 3677 - RNA, 22 nt, Human
cucaccaguuacucuccaguug

SEQ ID NO: 3678 - RNA, 22 nt, Human
ggcaugauggagaggguggaga

SEQ ID NO: 3679 - RNA, 22 nt, Human
gcugcuccugcucucccucucc

SEQ ID NO: 3680 - RNA, 22 nt, Human
uccauugcacuccagucugggc

SEQ ID NO: 3681 - RNA, 22 nt, Human
uauuggguuuaaagucaccguu

SEQ ID NO: 3682 - RNA, 22 nt, Human
uaucucuugccuugaccuccua

SEQ ID NO: 3683 - RNA, 22 nt, Human
uacaguucugguuucuucuuua

SEQ ID NO: 3684 - RNA, 22 nt, Human
uagcagcaggagcagguaacau

SEQ ID NO: 3685 - RNA, 22 nt, Human
gugcuuccauuuccccaucugu

SEQ ID NO: 3686 - RNA, 22 nt, Human
guuacagcucucaaagaagaca

SEQ ID NO: 3687 - RNA, 22 nt, Human
guucugcugagauacgugcucu

SEQ ID NO: 3688 - RNA, 22 nt, Human
ugaugcuugagcacaguaccuc

SEQ ID NO: 3689 - RNA, 22 nt, Human
ugguccagaggaggaaugaggg

SEQ ID NO: 3690 - RNA, 22 nt, Human
ugggaagaugcuggcaaggugc

SEQ ID NO: 3691 - RNA, 22 nt, Human
uuagcaguugugagacccuaga

SEQ ID NO: 3692 - RNA, 22 nt, Human
uaacuggccuuggaaccuguag

SEQ ID NO: 3693 - RNA, 22 nt, Human
uaugagugugaugguguuugag

SEQ ID NO: 3694 - RNA, 22 nt, Human
uccagggugggccucagacccu

SEQ ID NO: 3695 - RNA, 22 nt, Human
ugacaagauacaggguagugaa

SEQ ID NO: 3696 - RNA, 22 nt, Human
ugaguuuaagcuaagaagucug

SEQ ID NO: 3697 - RNA, 22 nt, Human
ugcuaggcuuauucucuuccuc

SEQ ID NO: 3698 - RNA, 22 nt, Human
ugcaugcucuucaugagaaucu

SEQ ID NO: 3699 - RNA, 22 nt, Human
uuccccaugugaugcuauugcu

SEQ ID NO: 3700 - RNA, 21 nt, Human
uucacccaucuuuccacccac

SEQ ID NO: 3701 - RNA, 22 nt, Human
uucacccaucuuuccacccacg

SEQ ID NO: 3702 - RNA, 22 nt, Human
uggauuaguaaagaagaaugaa

SEQ ID NO: 3703 - RNA, 22 nt, Human
uuguuuuagaagaaggucagaa

SEQ ID NO: 3704 - RNA, 22 nt, Human
uuggugcaaauggcauuuccau

SEQ ID NO: 3705 - RNA, 22 nt, Human
augucagugaagaggucuggca

SEQ ID NO: 3706 - RNA, 22 nt, Human
ggaaaacaaguaccccuggaac

SEQ ID NO: 3707 - RNA, 22 nt, Human
ggaggaggaggcuggugcuggu

SEQ ID NO: 3708 - RNA, 22 nt, Human
ggcagugucauuagcugauugu

SEQ ID NO: 3709 - RNA, 22 nt, Human
gguucucaaaugagggacauuu

SEQ ID NO: 3710 - RNA, 22 nt, Human
gagggaagcaugggaccaugau

SEQ ID NO: 3711 - RNA, 22 nt, Human
gaggagguggggcagcagcagg

SEQ ID NO: 3712 - RNA, 22 nt, Human
cagagcugccuuucccuuccug

SEQ ID NO: 3713 - RNA, 22 nt, Human
ccucuccauguacccauucccc

SEQ ID NO: 3714 - RNA, 22 nt, Human
cuucaaugcuugagaagucgua

SEQ ID NO: 3715 - RNA, 22 nt, Human
ggugcagaucauggauagagcu

SEQ ID NO: 3716 - RNA, 22 nt, Human
gggccaugacagggagauaggc

SEQ ID NO: 3717 - RNA, 22 nt, Human
gccauugcacuccagccugggc

SEQ ID NO: 3718 - RNA, 22 nt, Human
uggcucugugcuucuaguaucu

SEQ ID NO: 3719 - RNA, 22 nt, Human
uuccuucagcccuagcugcuuu

SEQ ID NO: 3720 - RNA, 22 nt, Human
uggagagauagugauuuagcuc

SEQ ID NO: 3721 - RNA, 22 nt, Human
ucuuugcuggaaggugccuccc

SEQ ID NO: 3722 - RNA, 22 nt, Human
ucugcugugauggacacuugua

SEQ ID NO: 3723 - RNA, 21 nt, Human
ucugcugugauggacacuugu

SEQ ID NO: 3724 - RNA, 22 nt, Human
ucacuugccuagggucacacag

SEQ ID NO: 3725 - RNA, 22 nt, Human
gugaggcaggaaccccaaagcc

SEQ ID NO: 3726 - RNA, 22 nt, Human
uggcucaguuugcucagcagug

SEQ ID NO: 3727 - RNA, 22 nt, Human
ugaguauucaccaggugcuggg

SEQ ID NO: 3728 - RNA, 22 nt, Human
ucugccucccugucucacucuc

SEQ ID NO: 3729 - RNA, 22 nt, Human
cuggcucccucucuucucuccc

SEQ ID NO: 3730 - RNA, 22 nt, Human
caucucagucuauguccuugcu

SEQ ID NO: 3731 - RNA, 22 nt, Human
cagaaucuuuugucucugagaa

SEQ ID NO: 3732 - RNA, 22 nt, Human
acugcagcuucagggacuugug

SEQ ID NO: 3733 - RNA, 22 nt, Human
acaguguuacccaggcuggucu

SEQ ID NO: 3734 - RNA, 22 nt, Human
agaaugaaaggcaguuccuagc

SEQ ID NO: 3735 - RNA, 22 nt, Human
cuggaagacaugguagagcuga

SEQ ID NO: 3736 - RNA, 22 nt, Human
ucugccucccugucucacucuc

SEQ ID NO: 3737 - RNA, 22 nt, Human
ugcaccacuacacuccuaggca

SEQ ID NO: 3738 - RNA, 22 nt, Human
guuuggcacugaaucauauaca

SEQ ID NO: 3739 - RNA, 22 nt, Human
agcagcgcagguagauggggcu

SEQ ID NO: 3740 - RNA, 22 nt, Human
ugccuaggcaggacggaaugca

SEQ ID NO: 3741 - RNA, 22 nt, Human
agugauuuuccugccucagccu

SEQ ID NO: 3742 - RNA, 22 nt, Human
gaggcgggaagcccacuaggag

SEQ ID NO: 3743 - RNA, 21 nt, Human
gacacaggcccagagaggcag

SEQ ID NO: 3744 - RNA, 22 nt, Human
ggugaugcauuuaaaagggcag

SEQ ID NO: 3745 - RNA, 22 nt, Human
uggcucaguuugcucagcagug

SEQ ID NO: 3746 - RNA, 22 nt, Human
ucugccucccugucucacucuc

SEQ ID NO: 3747 - RNA, 22 nt, Human
ugcuaggcuuauucucuuccuc

SEQ ID NO: 3748 - RNA, 22 nt, Human
uauuuguuuuuaaugcugggug

SEQ ID NO: 3749 - RNA, 22 nt, Human
ucccugggacaacuuucuuauu

SEQ ID NO: 3750 - RNA, 22 nt, Human
uacaaauuccugggucuccugg

SEQ ID NO: 3751 - RNA, 22 nt, Human
gcacacaccuccuugcaguggc

SEQ ID NO: 3752 - RNA, 22 nt, Human
agauggagaaguguuuucagau

SEQ ID NO: 3753 - RNA, 22 nt, Human
agcuccaggagcuggcaggagg

SEQ ID NO: 3754 - RNA, 22 nt, Human
auuagcuauagcaaaaggcuua

SEQ ID NO: 3755 - RNA, 22 nt, Human
aaguuuuuuuaaauuagcuagg

SEQ ID NO: 3756 - RNA, 22 nt, Human
acacaggcccagagaggcagug

SEQ ID NO: 3757 - RNA, 22 nt, Human
gcaggaugguuggacugaaggg

SEQ ID NO: 3758 - RNA, 22 nt, Human
ggccaggacucuugcagaacug

SEQ ID NO: 3759 - RNA, 22 nt, Human
ccugggggccacuuugcacagg

SEQ ID NO: 3760 - RNA, 22 nt, Human
cugggcgugugaggcggcugug

SEQ ID NO: 3761 - RNA, 22 nt, Human
uuuggauuccugguuccuacag

SEQ ID NO: 3762 - RNA, 22 nt, Human
gcagcaggcagggccaggcagg

SEQ ID NO: 3763 - RNA, 22 nt, Human
cuagacugaagcuuuaugagga

SEQ ID NO: 3764 - RNA, 22 nt, Human
gagagugcuuuggguguaggcc

SEQ ID NO: 3765 - RNA, 22 nt, Human
cuggcugcauuuaggaacaagg

SEQ ID NO: 3766 - RNA, 22 nt, Human
cugaggcaggagggcucaggag

SEQ ID NO: 3767 - RNA, 22 nt, Human
ggcaugauggagaggguggaga

SEQ ID NO: 3768 - RNA, 22 nt, Human
ggccugaggucagcaguagagg

SEQ ID NO: 3769 - RNA, 22 nt, Human
ggcaggauggagcagggcuaaa

SEQ ID NO: 3770 - RNA, 22 nt, Human
uuugcagcuuccaaauuucuga

SEQ ID NO: 3771 - RNA, 22 nt, Human
auuuuucugcauuuguauugga

SEQ ID NO: 3772 - RNA, 22 nt, Human
ccagccugagguuccuggaggg

SEQ ID NO: 3773 - RNA, 22 nt, Human
gguccacaaggggagagcaggg

SEQ ID NO: 3774 - RNA, 22 nt, Human
uggaauggcugaagacugugaa

SEQ ID NO: 3775 - RNA, 22 nt, Human
ugaggcaggaguuggcaagagg

SEQ ID NO: 3776 - RNA, 22 nt, Human
ugccuaggcaggacggaaugca

SEQ ID NO: 3777 - RNA, 22 nt, Human
aggcugagugacugggaguuag

SEQ ID NO: 3778 - RNA, 22 nt, Human
aauggcagucccuggagcagga

SEQ ID NO: 3779 - RNA, 22 nt, Human
acacaggcccagagaggcagug

SEQ ID NO: 3780 - RNA, 22 nt, Human
agaagguuggggcuggaggucu

SEQ ID NO: 3781 - RNA, 22 nt, Human
agaagguuggggcuggaggucu

SEQ ID NO: 3782 - RNA, 22 nt, Human
aaaguggcuggaguggagucuu

SEQ ID NO: 3783 - RNA, 22 nt, Human
aaccugcugguaaagcacuggc

SEQ ID NO: 3784 - RNA, 22 nt, Human
ugacuggaggaagggagguaag

SEQ ID NO: 3785 - RNA, 22 nt, Human
uggagcagaaaggcaggagucc

SEQ ID NO: 3786 - RNA, 22 nt, Human
gugucacagauggccggaagag

SEQ ID NO: 3787 - RNA, 22 nt, Human
ucacaguugagagaagguucug

SEQ ID NO: 3788 - RNA, 22 nt, Human
ucacauccucccacuucaagug

SEQ ID NO: 3789 - RNA, 22 nt, Human
ucuuugaucucuuccggggcuu

SEQ ID NO: 3790 - RNA, 22 nt, Human
ggccaggacucuugcagaacug

SEQ ID NO: 3791 - RNA, 22 nt, Human
ggaggaggaggcuggugcuggu

SEQ ID NO: 3792 - RNA, 22 nt, Human
gagaugacugguggcugggggc

SEQ ID NO: 3793 - RNA, 22 nt, Human
cuggcucccucucuucucuccc

SEQ ID NO: 3794 - RNA, 22 nt, Human
uggauuaguaaagaagaaugaa

SEQ ID NO: 3795 - RNA, 22 nt, Human
uuaaugcuaaucgugauagggg

SEQ ID NO: 3796 - RNA, 22 nt, Human
gagauccuuucacaguuguggu

SEQ ID NO: 3797 - RNA, 22 nt, Human
ggcagcugugcagagugggggu

SEQ ID NO: 3798 - RNA, 22 nt, Human
gauuccuccucuuuaaaauggu

SEQ ID NO: 3799 - RNA, 22 nt, Human
uuaguguucaggcucaaaugaa

SEQ ID NO: 3800 - RNA, 22 nt, Human
uugucagaggcugguagggugu

SEQ ID NO: 3801 - RNA, 22 nt, Human
cacaauauagcaaauagagggu

SEQ ID NO: 3802 - RNA, 22 nt, Human
agucagacguuuggcaacagca

SEQ ID NO: 3803 - RNA, 22 nt, Human
cuggucccugugucagucuuaa

SEQ ID NO: 3804 - RNA, 22 nt, Human
gaggugaaggaacaaaugcuga

SEQ ID NO: 3805 - RNA, 22 nt, Human
gugaagguagguuucagguuug

SEQ ID NO: 3806 - RNA, 22 nt, Human
uagcaccuucugaaauaacgug

SEQ ID NO: 3807 - RNA, 22 nt, Human
ugagggcaggugugaaaaugcu

SEQ ID NO: 3808 - RNA, 22 nt, Human
uugaucacagcuacuuuugucc

SEQ ID NO: 3809 - RNA, 22 nt, Human
aagguagauaaaggcuucacgu

SEQ ID NO: 3810 - RNA, 22 nt, Human
aagagcugaguaauugggggca

SEQ ID NO: 3811 - RNA, 22 nt, Human
agugguuucagggacuucugua

SEQ ID NO: 3812 - RNA, 22 nt, Human
ugagugacagagcaacacucug

SEQ ID NO: 3813 - RNA, 22 nt, Human
ucugucauuuuucucuuuccau

SEQ ID NO: 3814 - RNA, 22 nt, Human
ugcuaggcuuauucucuuccuc

SEQ ID NO: 3815 - RNA, 22 nt, Human
ugaguguaugugugagagagaa

SEQ ID NO: 3816 - RNA, 22 nt, Human
ggaagaaugugcuuuuguuguu

SEQ ID NO: 3817 - RNA, 22 nt, Human
cagaaaguagaaagcagauucg

SEQ ID NO: 3818 - RNA, 22 nt, Human
uggcucaguuugcucagcagug

SEQ ID NO: 3819 - RNA, 22 nt, Human
ggccucagaagcugaggggaga

SEQ ID NO: 3820 - RNA, 22 nt, Human
cugggcgugugaggcggcugug

SEQ ID NO: 3821 - RNA, 22 nt, Human
cuuggcccugugaggcuucacc

SEQ ID NO: 3822 - RNA, 22 nt, Human
gggccaugacagggagauaggc

SEQ ID NO: 3823 - RNA, 22 nt, Human
uacagcucugcuucuggcucac

SEQ ID NO: 3824 - RNA, 22 nt, Human
ugaggacagaaaguuugugcug

SEQ ID NO: 3825 - RNA, 22 nt, Human
uugccuaggccggagugcagug

SEQ ID NO: 3826 - RNA, 22 nt, Human
acacaggcccagagaggcagug

SEQ ID NO: 3827 - RNA, 22 nt, Human
accuggccuguaggcaagucuu

SEQ ID NO: 3828 - RNA, 22 nt, Human
uacaggcaggcacagaggcagu

SEQ ID NO: 3829 - RNA, 22 nt, Human
ugccuaggcaggacggaaugca

SEQ ID NO: 3830 - RNA, 22 nt, Human
gcaggcugguuggugaggcaaa

SEQ ID NO: 3831 - RNA, 22 nt, Human
gcagcaggcagggccaggcagg

SEQ ID NO: 3832 - RNA, 22 nt, Human
gaggagguggggcagcagcagg

SEQ ID NO: 3833 - RNA, 22 nt, Human
ugucaguuuuuuaaauacucag

SEQ ID NO: 3834 - RNA, 22 nt, Human
auauuggugaaaugcuagcaaa

SEQ ID NO: 3835 - RNA, 22 nt, Human
aggcagaaaacaauuccaagca

SEQ ID NO: 3836 - RNA, 22 nt, Human
acugcacucuagccuaggugau

SEQ ID NO: 3837 - RNA, 22 nt, Human
aauuuaacagacagccacagcc

SEQ ID NO: 3838 - RNA, 22 nt, Human
uuacaaaauuuggagggauugu

SEQ ID NO: 3839 - RNA, 22 nt, Human
uucucccugcccacacauccag

SEQ ID NO: 3840 - RNA, 22 nt, Human
agucagacguuuggcaacagca

SEQ ID NO: 3841 - RNA, 22 nt, Human
aguccaguguucucugcucugu

SEQ ID NO: 3842 - RNA, 22 nt, Human
cuggcucccucucuucucuccc

SEQ ID NO: 3843 - RNA, 22 nt, Human
cucugccucccgggucuaggcu

SEQ ID NO: 3844 - RNA, 22 nt, Human
ccugcccauccugccuccacca

SEQ ID NO: 3845 - RNA, 22 nt, Human
ggugacagagacucugccucga

SEQ ID NO: 3846 - RNA, 22 nt, Human
gaggugaaggaacaaaugcuga

SEQ ID NO: 3847 - RNA, 22 nt, Human
gggaggauccuugcucaacuua

SEQ ID NO: 3848 - RNA, 22 nt, Human
ggccaggacucuugcagaacug

SEQ ID NO: 3849 - RNA, 22 nt, Human
cacugcaacccccgccucccag

SEQ ID NO: 3850 - RNA, 22 nt, Human
ucugccucccugucucacucuc

SEQ ID NO: 3851 - RNA, 22 nt, Human
ucugagcccaggaguuugaggc

SEQ ID NO: 3852 - RNA, 22 nt, Human
uccaguacaggucucucauuuc

SEQ ID NO: 3853 - RNA, 22 nt, Human
uccccaagccuuguaccagcgu

SEQ ID NO: 3854 - RNA, 22 nt, Human
uacaggcaggcacagaggcagu

SEQ ID NO: 3855 - RNA, 22 nt, Human
uguaaacaucccacacacucag

SEQ ID NO: 3856 - RNA, 22 nt, Human
uucaguucuugaccugccccag

SEQ ID NO: 3857 - RNA, 22 nt, Human
uuaccauguuggccaggcuggu

SEQ ID NO: 3858 - RNA, 22 nt, Human
ugguggggagaggcuugggaag

SEQ ID NO: 3859 - RNA, 22 nt, Human
ugaucacaggcaaaggaauaaa

SEQ ID NO: 3860 - RNA, 22 nt, Human
ugauccucuggcuucagccucc

SEQ ID NO: 3861 - RNA, 22 nt, Human
ugaggcaggaguuggcaagagg

SEQ ID NO: 3862 - RNA, 22 nt, Human
uggagcagaaaggcaggagucc

SEQ ID NO: 3863 - RNA, 22 nt, Human
uggagugucuggaggugucucu

SEQ ID NO: 3864 - RNA, 22 nt, Human
uacaggcaggcacagaggcagu

SEQ ID NO: 3865 - RNA, 22 nt, Human
gugugggcagggccgugcuccc

SEQ ID NO: 3866 - RNA, 22 nt, Human
ucuuccauuccccuccuacgcc

SEQ ID NO: 3867 - RNA, 22 nt, Human
ucagucguuucucucucccagc

SEQ ID NO: 3868 - RNA, 22 nt, Human
uagacugaggcuuccugcaggg

SEQ ID NO: 3869 - RNA, 22 nt, Human
uugcucaggcuggagugcagug

SEQ ID NO: 3870 - RNA, 22 nt, Human
ucccuuugaagccagguuccag

SEQ ID NO: 3871 - RNA, 22 nt, Human
uccucaucuuugagucccagcg

SEQ ID NO: 3872 - RNA, 22 nt, Human
ucuuccccaccuucggcuugca

SEQ ID NO: 3873 - RNA, 22 nt, Human
uggagagauagugauuuagcuc

SEQ ID NO: 3874 - RNA, 22 nt, Human
cacccaggcuggagugcagugg

SEQ ID NO: 3875 - RNA, 22 nt, Human
caaagugcugagauuacaggca

SEQ ID NO: 3876 - RNA, 22 nt, Human
ccaaagugcugggauuacaggc

SEQ ID NO: 3877 - RNA, 22 nt, Human
ccaaagugcuaggaauacaggu

SEQ ID NO: 3878 - RNA, 22 nt, Human
cugggauuacaggugugaacca

SEQ ID NO: 3879 - RNA, 22 nt, Human
ccugcccauccugccuccacca

SEQ ID NO: 3880 - RNA, 22 nt, Human
gggccaugacagggagauaggc

SEQ ID NO: 3881 - RNA, 22 nt, Human
gagauggaguuuuacuauguug

SEQ ID NO: 3882 - RNA, 22 nt, Human
gcugcuccugcucucccucucc

SEQ ID NO: 3883 - RNA, 22 nt, Human
gauuccuccucuuuaaaauggu

SEQ ID NO: 3884 - RNA, 22 nt, Human
gcagcaggcagggccaggcagg

SEQ ID NO: 3885 - RNA, 22 nt, Human
gcacacaccuccuugcaguggc

SEQ ID NO: 3886 - RNA, 22 nt, Human
cgcuauguuggccaggcugguc

SEQ ID NO: 3887 - RNA, 22 nt, Human
cccaggcuggagugcaguggug

SEQ ID NO: 3888 - RNA, 22 nt, Human
cucugccucccgggucuaggcu

SEQ ID NO: 3889 - RNA, 22 nt, Human
cacugggauuacagaugugagc

SEQ ID NO: 3890 - RNA, 22 nt, Human
ccaaagugcuaggauuacagcc

SEQ ID NO: 3891 - RNA, 22 nt, Human
ccagccugagguuccuggaggg

SEQ ID NO: 3892 - RNA, 22 nt, Human
ccaaagugcuggcguuacaggu

SEQ ID NO: 3893 - RNA, 22 nt, Human
cugaggcaggagggcucaggag

SEQ ID NO: 3894 - RNA, 22 nt, Human
cugugccugugacgagggauga

SEQ ID NO: 3895 - RNA, 22 nt, Human
gaccccuugcccguggcuccca

SEQ ID NO: 3896 - RNA, 22 nt, Human
gaaccuucaacugcuuagccug

SEQ ID NO: 3897 - RNA, 22 nt, Human
uugcccaggcuagagugcagug

SEQ ID NO: 3898 - RNA, 22 nt, Human
uugcccaggcuggagugcagug

SEQ ID NO: 3899 - RNA, 22 nt, Human
aagugcugggauuacaggccug

SEQ ID NO: 3900 - RNA, 22 nt, Human
acaguguuacccaggcuggucu

SEQ ID NO: 3901 - RNA, 22 nt, Human
agacuggccucaagcucccaga

SEQ ID NO: 3902 - RNA, 22 nt, Human
aaugcugugccagagcugcacc

SEQ ID NO: 3903 - RNA, 22 nt, Human
uucaggcaccaggcacuuugcc

SEQ ID NO: 3904 - RNA, 22 nt, Human
cuggcucccucucuucucuccc

SEQ ID NO: 3905 - RNA, 22 nt, Human
gguccagacuggaguauagugc

SEQ ID NO: 3906 - RNA, 22 nt, Human
ggcaugauucagcagaggagag

SEQ ID NO: 3907 - RNA, 22 nt, Human
gacaagaggcacagacagcagg

SEQ ID NO: 3908 - RNA, 22 nt, Human
ucugguuugagagacaaugaca

SEQ ID NO: 3909 - RNA, 22 nt, Human
uggaaugaggaagggugugguc

SEQ ID NO: 3910 - RNA, 22 nt, Human
uggagagauaagccaaguaucc

SEQ ID NO: 3911 - RNA, 22 nt, Human
ugagagaggaaggccguaggga

SEQ ID NO: 3912 - RNA, 22 nt, Human
ugguggggagaggcuugggaag

SEQ ID NO: 3913 - RNA, 22 nt, Human
uggguuagugguugaauaguuu

SEQ ID NO: 3914 - RNA, 22 nt, Human
uucuacuagugguugauggccu

SEQ ID NO: 3915 - RNA, 22 nt, Human
uggagagagcagguugcuaaga

SEQ ID NO: 3916 - RNA, 22 nt, Human
ucaaagcugcagauugccugug

SEQ ID NO: 3917 - RNA, 22 nt, Human
gacaagaggcacagacagcagg

SEQ ID NO: 3918 - RNA, 22 nt, Human
ccuuguguuuuccagauucuga

SEQ ID NO: 3919 - RNA, 22 nt, Human
gagguagagguugcagugaguc

SEQ ID NO: 3920 - RNA, 22 nt, Human
gguccacaaggggagagcaggg

SEQ ID NO: 3921 - RNA, 22 nt, Human
ggcugggcaugguggcucacgc

SEQ ID NO: 3922 - RNA, 22 nt, Human
cugggcucuggucuguagguuu

SEQ ID NO: 3923 - RNA, 22 nt, Human
uguccuuuguuuugagauggag

SEQ ID NO: 3924 - RNA, 22 nt, Human
uucugugcagguuaacauuucu

SEQ ID NO: 3925 - RNA, 22 nt, Human
augggcaaauacugggagcugg

SEQ ID NO: 3926 - RNA, 22 nt, Human
aucugcugucuuuuagaagugg

SEQ ID NO: 3927 - RNA, 22 nt, Human
acugcacuccauccuggggagc

SEQ ID NO: 3928 - RNA, 22 nt, Human
acugcacuccugccugggugac

SEQ ID NO: 3929 - RNA, 22 nt, Human
auugcacuucagccugggugac

SEQ ID NO: 3930 - RNA, 22 nt, Human
auugcacuccagccugggugac

SEQ ID NO: 3931 - RNA, 22 nt, Human
uugcacuccagucugggugaca

SEQ ID NO: 3932 - RNA, 22 nt, Human
uugcacuccagccugggugaca

SEQ ID NO: 3933 - RNA, 22 nt, Human
cuggguggccuucaguccauga

SEQ ID NO: 3934 - RNA, 22 nt, Human
cagcaguguugcgaaucaucac

SEQ ID NO: 3935 - RNA, 22 nt, Human
ccccagucaaugcuucucucca

SEQ ID NO: 3936 - RNA, 22 nt, Human
cauugcacuccagccuggguga

SEQ ID NO: 3937 - RNA, 22 nt, Human
uccaguacaggucucucauuuc

SEQ ID NO: 3938 - RNA, 22 nt, Human
uccagugaaacaggucucuuug

SEQ ID NO: 3939 - RNA, 22 nt, Human
ucugccucccugucucacucuc

SEQ ID NO: 3940 - RNA, 22 nt, Human
guucugcugagauacgugcucu

SEQ ID NO: 3941 - RNA, 22 nt, Human
ugcagccuugaacucuuucugg

SEQ ID NO: 3942 - RNA, 22 nt, Human
uggagcagaaaggcaggagucc

SEQ ID NO: 3943 - RNA, 22 nt, Human
uggagaccugugugguuugugg

SEQ ID NO: 3944 - RNA, 22 nt, Human
uggagccuuguuguuuguucac

SEQ ID NO: 3945 - RNA, 22 nt, Human
uucuuuuuccgcuuucugagcc

SEQ ID NO: 3946 - RNA, 21 nt, Human
ucugcugugauggacacuugu

SEQ ID NO: 3947 - RNA, 22 nt, Human
ucugcugugauggacacuugua

SEQ ID NO: 3948 - RNA, 22 nt, Human
ucugucauuuuucucuuuccau

SEQ ID NO: 3949 - RNA, 22 nt, Human
gaccagccauccugguuuacau

SEQ ID NO: 3950 - RNA, 22 nt, Human
cugugcccagccagggcugugu

SEQ ID NO: 3951 - RNA, 22 nt, Human
ggcaugauggagaggguggaga

SEQ ID NO: 3952 - RNA, 22 nt, Human
cuauuggauuuuaagcauuggg

SEQ ID NO: 3953 - RNA, 22 nt, Human
gagguagagguugcagugaguc

SEQ ID NO: 3954 - RNA, 22 nt, Human
ggugaugcauuuaaaagggcag

SEQ ID NO: 3955 - RNA, 22 nt, Human
uuuggcuguuugucuugggcaa

SEQ ID NO: 3956 - RNA, 22 nt, Human
uucccucauucuccacccaguc

SEQ ID NO: 3957 - RNA, 22 nt, Human
uuaaugcuuuuugucauacuca

SEQ ID NO: 3958 - RNA, 22 nt, Human
uguguuugaacaccuuggucac

SEQ ID NO: 3959 - RNA, 22 nt, Human
aucuagagaggcagucuggcca

SEQ ID NO: 3960 - RNA, 22 nt, Human
auggauauuuuugaugcccaga

SEQ ID NO: 3961 - RNA, 22 nt, Human
agugcuuugauuaugagaaagu

SEQ ID NO: 3962 - RNA, 22 nt, Human
agauaguucucuguuguugggg

SEQ ID NO: 3963 - RNA, 22 nt, Human
acagcucacuacagccuggauu

SEQ ID NO: 3964 - RNA, 22 nt, Human
aaguggcuuuugucuggcagau

SEQ ID NO: 3965 - RNA, 22 nt, Human
auggccuuuucucuuauccugg

SEQ ID NO: 3966 - RNA, 22 nt, Human
uuugaugcaugugaccugggau

SEQ ID NO: 3967 - RNA, 22 nt, Human
uugcaauagugaaaaaacugaa

SEQ ID NO: 3968 - RNA, 22 nt, Human
cagguacuuuuugguuuacaug

SEQ ID NO: 3969 - RNA, 22 nt, Human
ggcaugauggagaggguggaga

SEQ ID NO: 3970 - RNA, 22 nt, Human
gcagcuguuuauuuagaaccug

SEQ ID NO: 3971 - RNA, 22 nt, Human
gaacagcuccagucuacagccc

SEQ ID NO: 3972 - RNA, 22 nt, Human
cucuuuaguaggaacucuggau

SEQ ID NO: 3973 - RNA, 22 nt, Human
auuuuucugcauuuguauugga

SEQ ID NO: 3974 - RNA, 22 nt, Human
cagagaauggcacagcuguccu

SEQ ID NO: 3975 - RNA, 22 nt, Human
uggagugucuggaggugucucu

SEQ ID NO: 3976 - RNA, 22 nt, Human
uuagggcaggcaugagagaacu

SEQ ID NO: 3977 - RNA, 22 nt, Human
gugcuuccauuuccccaucugu

SEQ ID NO: 3978 - RNA, 22 nt, Human
ucaggcugaggucaucugcauc

SEQ ID NO: 3979 - RNA, 22 nt, Human
uucaggacuguggacugggcug

SEQ ID NO: 3980 - RNA, 22 nt, Human
uguacaaggggcucagccagcc

SEQ ID NO: 3981 - RNA, 22 nt, Human
uggcaaggugugggcuagagau

SEQ ID NO: 3982 - RNA, 22 nt, Human
ugaggucauguucugucagguu

SEQ ID NO: 3983 - RNA, 22 nt, Human
uugguuggugaugagcauugaa

SEQ ID NO: 3984 - RNA, 22 nt, Human
aggccagagaggacucucuuuu

SEQ ID NO: 3985 - RNA, 22 nt, Human
aggcaguaagggagaguuuugc

SEQ ID NO: 3986 - RNA, 22 nt, Human
uacgcugugcugugacauggua

SEQ ID NO: 3987 - RNA, 22 nt, Human
ccagccugagguuccuggaggg

SEQ ID NO: 3988 - RNA, 22 nt, Human
cugaggucaggaguucgagacc

SEQ ID NO: 3989 - RNA, 22 nt, Human
ccuggcuuaggaagcucacaag

SEQ ID NO: 3990 - RNA, 22 nt, Human
ccccagucaaugcuucucucca

SEQ ID NO: 3991 - RNA, 22 nt, Human
cugugcauguugauauccuggc

SEQ ID NO: 3992 - RNA, 22 nt, Human
ggcaugugugagcagcugcagg

SEQ ID NO: 3993 - RNA, 22 nt, Human
ggccccuuugugaggcacgcuu

SEQ ID NO: 3994 - RNA, 22 nt, Human
gguccacaaggggagagcaggg

SEQ ID NO: 3995 - RNA, 22 nt, Human
cucagugguucagacacuguuu

SEQ ID NO: 3996 - RNA, 22 nt, Human
cucugccucccgggucuaggcu

SEQ ID NO: 3997 - RNA, 22 nt, Human
cguguaaucccagcuacuuggg

SEQ ID NO: 3998 - RNA, 22 nt, Human
cgacucuugaccauggcugggg

SEQ ID NO: 3999 - RNA, 22 nt, Human
gaggcagcaacuggugaggcac

SEQ ID NO: 4000 - RNA, 22 nt, Human
gagaugacugguggcugggggc

SEQ ID NO: 4001 - RNA, 22 nt, Human
cuuggcccugugaggcuucacc

SEQ ID NO: 4002 - RNA, 22 nt, Human
cugaauagaacagaagagcagc

SEQ ID NO: 4003 - RNA, 22 nt, Human
gcugagaccacccuugccugcc

SEQ ID NO: 4004 - RNA, 22 nt, Human
gcagcaggcagggccaggcagg

SEQ ID NO: 4005 - RNA, 22 nt, Human
ggccugaggucagcaguagagg

SEQ ID NO: 4006 - RNA, 22 nt, Human
ggcaugauucagcagaggagag

SEQ ID NO: 4007 - RNA, 22 nt, Human
uucaggcaccaggcacuuugcc

SEQ ID NO: 4008 - RNA, 22 nt, Human
uucacauguugcucaguuuugc

SEQ ID NO: 4009 - RNA, 22 nt, Human
uggcagauuugguugcuguugg

SEQ ID NO: 4010 - RNA, 22 nt, Human
ugguccagaggaggaaugaggg

SEQ ID NO: 4011 - RNA, 22 nt, Human
aaggaagugucucuuggcuggc

SEQ ID NO: 4012 - RNA, 22 nt, Human
acaguccucuacuccagcuccc

SEQ ID NO: 4013 - RNA, 22 nt, Human
agagcuaggaagauacaggguu

SEQ ID NO: 4014 - RNA, 22 nt, Human
aggugggguuucaccauguugg

SEQ ID NO: 4015 - RNA, 22 nt, Human
agguagggaggguagaugcucu

SEQ ID NO: 4016 - RNA, 22 nt, Human
agugcagguucacaggcugggc

SEQ ID NO: 4017 - RNA, 22 nt, Human
auaagcacagggagguucuguc

SEQ ID NO: 4018 - RNA, 22 nt, Human
uucaccaaccacuccaccagcu

SEQ ID NO: 4019 - RNA, 22 nt, Human
uucacccaucuuuccacccacg

SEQ ID NO: 4020 - RNA, 22 nt, Human
uguuaacauuuuggcuagauag

SEQ ID NO: 4021 - RNA, 22 nt, Human
ggcagcugugcagagugggggu

SEQ ID NO: 4022 - RNA, 22 nt, Human
cagcuauucaggagcuugaggu

SEQ ID NO: 4023 - RNA, 22 nt, Human
uggggcacuguggaggugucau

SEQ ID NO: 4024 - RNA, 21 nt, Human
uucacccaucuuuccacccac

SEQ ID NO: 4025 - RNA, 22 nt, Human
uaugaauguaaggaauguggga

SEQ ID NO: 4026 - RNA, 22 nt, Human
ucaaagcugcagauugccugug

SEQ ID NO: 4027 - RNA, 22 nt, Human
acagcaagucuuugucaaagcu

SEQ ID NO: 4028 - RNA, 22 nt, Human
agauggaguuugagagggaaua

SEQ ID NO: 4029 - RNA, 22 nt, Human
ugacuggaggaagggagguaag

SEQ ID NO: 4030 - RNA, 22 nt, Human
uggagagaaagcgaagauguag

SEQ ID NO: 4031 - RNA, 22 nt, Human
uggaaugcauaagaaauugcaa

SEQ ID NO: 4032 - RNA, 22 nt, Human
uggagagauagugauuuagcuc

SEQ ID NO: 4033 - RNA, 22 nt, Human
uggagagauaagccaaguaucc

SEQ ID NO: 4034 - RNA, 22 nt, Human
ugaguguaugugugagagagaa

SEQ ID NO: 4035 - RNA, 22 nt, Human
ugagggaggaaguuugggauga

SEQ ID NO: 4036 - RNA, 22 nt, Human
ugaggcaggaguuggcaagagg

SEQ ID NO: 4037 - RNA, 22 nt, Human
uggaggcaggugcagauggagg

SEQ ID NO: 4038 - RNA, 22 nt, Human
uggcucaguuugcucagcagug

SEQ ID NO: 4039 - RNA, 22 nt, Human
ugucuacugcacccagcggaca

SEQ ID NO: 4040 - RNA, 22 nt, Human
uagcucauuuuugaaaucaguu

SEQ ID NO: 4041 - RNA, 22 nt, Human
ugacaagauacaggguagugaa

SEQ ID NO: 4042 - RNA, 22 nt, Human
agcagcgcagguagauggggcu

SEQ ID NO: 4043 - RNA, 22 nt, Human
cagugucuugucaaaucuagcu

SEQ ID NO: 4044 - RNA, 22 nt, Human
ccagccugagguuccuggaggg

SEQ ID NO: 4045 - RNA, 22 nt, Human
cagagaauggcacagcuguccu

SEQ ID NO: 4046 - RNA, 22 nt, Human
cugaggcaggagggcucaggag

SEQ ID NO: 4047 - RNA, 22 nt, Human
gguccagacuggaguauagugc

SEQ ID NO: 4048 - RNA, 22 nt, Human
ugguccagaggaggaaugaggg

SEQ ID NO: 4049 - RNA, 22 nt, Human
auucccuuuagcucugauggca

SEQ ID NO: 4050 - RNA, 22 nt, Human
auagaagagcagugggguagaa

SEQ ID NO: 4051 - RNA, 22 nt, Human
ggcagcugugcagagugggggu

SEQ ID NO: 4052 - RNA, 22 nt, Human
ccuuguguuuuccagauucuga

SEQ ID NO: 4053 - RNA, 22 nt, Human
agagcuaggaagauacaggguu

SEQ ID NO: 4054 - RNA, 22 nt, Human
agggcaguggaucucugcaaag

SEQ ID NO: 4055 - RNA, 22 nt, Human
aggcaagagguugcagugagcu

SEQ ID NO: 4056 - RNA, 22 nt, Human
aaagcuuuguucauuguaucug

SEQ ID NO: 4057 - RNA, 22 nt, Human
cauugcacuccagccuaggcaa

SEQ ID NO: 4058 - RNA, 22 nt, Human
gaggagguggggcagcagcagg

SEQ ID NO: 4059 - RNA, 22 nt, Human
gagguagagguugcagugaguc

SEQ ID NO: 4060 - RNA, 22 nt, Human
gauggcagcuggagguggagca

SEQ ID NO: 4061 - RNA, 22 nt, Human
gcugcugccucaacauuuuagg

SEQ ID NO: 4062 - RNA, 22 nt, Human
gguuaugcacuacuuaugagaa

SEQ ID NO: 4063 - RNA, 22 nt, Human
gggagaaaaggaggggauacag

SEQ ID NO: 4064 - RNA, 22 nt, Human
auaaagcagguuaacaaagcug

SEQ ID NO: 4065 - RNA, 22 nt, Human
auggagcuguuuucuucagagc

SEQ ID NO: 4066 - RNA, 22 nt, Human
augagaguaggaguuugggcuc

SEQ ID NO: 4067 - RNA, 22 nt, Human
ugggaaaaaaggcaguuuagaa

SEQ ID NO: 4068 - RNA, 22 nt, Human
ugugagagaaauggcaaguugg

SEQ ID NO: 4069 - RNA, 22 nt, Human
ugugaaggaggaagggaggagc

SEQ ID NO: 4070 - RNA, 22 nt, Human
uuaacugagaggaucugaguag

SEQ ID NO: 4071 - RNA, 22 nt, Human
uuaucaugcuuguuggcuggug

SEQ ID NO: 4072 - RNA, 22 nt, Human
uucugaguggcuuucaacacug

SEQ ID NO: 4073 - RNA, 22 nt, Human
uuucaaaacaaagcuuucccag

SEQ ID NO: 4074 - RNA, 22 nt, Human
uugcuuugguucaaguuaggca

SEQ ID NO: 4075 - RNA, 22 nt, Human
uuuuuaucuuuuucuccagaug

SEQ ID NO: 4076 - RNA, 22 nt, Human
gucgggaggaaaagaaagaaga

SEQ ID NO: 4077 - RNA, 22 nt, Human
ggaagcauguaagaaugcguuu

SEQ ID NO: 4078 - RNA, 22 nt, Human
gcagcucccuauuccaugacag

SEQ ID NO: 4079 - RNA, 22 nt, Human
ggacggugacucuugugucagu

SEQ ID NO: 4080 - RNA, 22 nt, Human
gagguagagguugcagugagug

SEQ ID NO: 4081 - RNA, 22 nt, Human
cugggauuacaggugugaacca

SEQ ID NO: 4082 - RNA, 22 nt, Human
gacaugauguagcagaugaugg

SEQ ID NO: 4083 - RNA, 22 nt, Human
gaagagcugugugcugugaugu

SEQ ID NO: 4084 - RNA, 22 nt, Human
caggaacacaaugagucucaaa

SEQ ID NO: 4085 - RNA, 22 nt, Human
agcagcgcagguagauggggcu

SEQ ID NO: 4086 - RNA, 22 nt, Human
agcagcacagaaauauuggcac

SEQ ID NO: 4087 - RNA, 22 nt, Human
agcuccaggagcuggcaggagg

SEQ ID NO: 4088 - RNA, 22 nt, Human
aggcaguguuguuccugauugc

SEQ ID NO: 4089 - RNA, 22 nt, Human
uugguuggugaugagcauugaa

SEQ ID NO: 4090 - RNA, 22 nt, Human
uaagaagagaaagaagaggcug

SEQ ID NO: 4091 - RNA, 22 nt, Human
guguguggaaaugcagaugacc

SEQ ID NO: 4092 - RNA, 22 nt, Human
gugaggcaggaaccccaaagcc

SEQ ID NO: 4093 - RNA, 22 nt, Human
ucuuuuuguuguagcuguaugg

SEQ ID NO: 4094 - RNA, 22 nt, Human
ucuuugcuggaaggugccuccc

SEQ ID NO: 4095 - RNA, 22 nt, Human
ucugucauuuuucucuuuccau

SEQ ID NO: 4096 - RNA, 22 nt, Human
ucugugacuguauuuucccaaa

SEQ ID NO: 4097 - RNA, 22 nt, Human
ucuggauuugagaggcuuuacu

SEQ ID NO: 4098 - RNA, 22 nt, Human
uauuucuuguuggcuuaguuug

SEQ ID NO: 4099 - RNA, 22 nt, Human
ucaaguaauccaggauaggcug

SEQ ID NO: 4100 - RNA, 22 nt, Human
ucacuguuccuuuuuguugaga

SEQ ID NO: 4101 - RNA, 22 nt, Human
ucagucuuuuugucuauuccug

SEQ ID NO: 4102 - RNA, 22 nt, Human
uggagagauagugauuuagcuc

SEQ ID NO: 4103 - RNA, 22 nt, Human
ugcuaggcuuauucucuuccuc

SEQ ID NO: 4104 - RNA, 22 nt, Human
ugacuguucucaaaguuugaag

SEQ ID NO: 4105 - RNA, 22 nt, Human
uacaggcaggcacagaggcagu

SEQ ID NO: 4106 - RNA, 22 nt, Human
uagaaagcuaacaagcuagaga

SEQ ID NO: 4107 - RNA, 22 nt, Human
guucuggagcccauacucacca

SEQ ID NO: 4108 - RNA, 22 nt, Human
guuuuguugucucuguguugua

SEQ ID NO: 4109 - RNA, 22 nt, Human
ucacccaguguaaacagcauga

SEQ ID NO: 4110 - RNA, 22 nt, Human
ucugguuugagagacaaugaca

SEQ ID NO: 4111 - RNA, 22 nt, Human
ugucaguuuuuuaaauacucag

SEQ ID NO: 4112 - RNA, 22 nt, Human
uucaggacugucuggauuuauu

SEQ ID NO: 4113 - RNA, 22 nt, Human
uuccuucugcauugugagaaaa

SEQ ID NO: 4114 - RNA, 22 nt, Human
uuccuucagcccuagcugcuuu

SEQ ID NO: 4115 - RNA, 22 nt, Human
uggagccuuguuguuuguucac

SEQ ID NO: 4116 - RNA, 22 nt, Human
uggaggaaguaguggcuguguu

SEQ ID NO: 4117 - RNA, 22 nt, Human
uggagaccugugugguuugugg

SEQ ID NO: 4118 - RNA, 22 nt, Human
uggcacagaucagcagaacagg

SEQ ID NO: 4119 - RNA, 22 nt, Human
ugcuagguuuuuuccuuucccc

SEQ ID NO: 4120 - RNA, 22 nt, Human
ugaggaggugcuaccagcgucu

SEQ ID NO: 4121 - RNA, 22 nt, Human
ugagggcaggugugaaaaugcu

SEQ ID NO: 4122 - RNA, 22 nt, Human
ugagggggaaggugugugugug

SEQ ID NO: 4123 - RNA, 22 nt, Human
ugaguguaugugugagagagaa

SEQ ID NO: 4124 - RNA, 22 nt, Human
ugagagaggaaggccguaggga

SEQ ID NO: 4125 - RNA, 22 nt, Human
ugugaaggaggaagggaggagc

SEQ ID NO: 4126 - RNA, 22 nt, Human
ugcuauucucagagcacucuau

SEQ ID NO: 4127 - RNA, 22 nt, Human
aggggguuuagcuccacagggu

SEQ ID NO: 4128 - RNA, 22 nt, Human
guauggagaucucugcccuugu

SEQ ID NO: 4129 - RNA, 22 nt, Human
gcagcaggcagggccaggcagg

SEQ ID NO: 4130 - RNA, 22 nt, Human
cugagucaguuacaacaggucc

SEQ ID NO: 4131 - RNA, 22 nt, Human
cugggcucuggucuguagguuu

SEQ ID NO: 4132 - RNA, 22 nt, Human
cuggcucuacccucucacuuca

SEQ ID NO: 4133 - RNA, 22 nt, Human
agugcagguucacaggcugggc

SEQ ID NO: 4134 - RNA, 22 nt, Human
uauuuguuuuuaaugcugggug

SEQ ID NO: 4135 - RNA, 22 nt, Human
ugcuguaguauguauauaguau

SEQ ID NO: 4136 - RNA, 22 nt, Human
uagaaagugucucauuuuaaua

SEQ ID NO: 4137 - RNA, 22 nt, Human
uucauuaggccaggugcggugg

SEQ ID NO: 4138 - RNA, 22 nt, Human
uucacugagggagugagguucu

SEQ ID NO: 4139 - RNA, 22 nt, Human
uggcuguuugggguugccgugu

SEQ ID NO: 4140 - RNA, 22 nt, Human
uugugguuuucccaggugguag

SEQ ID NO: 4141 - RNA, 22 nt, Human
uugcaaggaaggggaggaggcu

SEQ ID NO: 4142 - RNA, 22 nt, Human
augggcaaauacugggagcugg

SEQ ID NO: 4143 - RNA, 22 nt, Human
augggcaguuucuucccuuucc

SEQ ID NO: 4144 - RNA, 22 nt, Human
auagaagagcagugggguagaa

SEQ ID NO: 4145 - RNA, 22 nt, Human
cucuuuaguaggaacucuggau

SEQ ID NO: 4146 - RNA, 22 nt, Human
gaggcgggaagcccacuaggag

SEQ ID NO: 4147 - RNA, 22 nt, Human
cuuuuugggguuuggggcuugg

SEQ ID NO: 4148 - RNA, 21 nt, Human
gacacaggcccagagaggcag

SEQ ID NO: 4149 - RNA, 22 nt, Human
caguccaguguugaagagaggc

SEQ ID NO: 4150 - RNA, 22 nt, Human
cgacucuugaccauggcugggg

SEQ ID NO: 4151 - RNA, 22 nt, Human
cggcaagaugccggagugcugg

SEQ ID NO: 4152 - RNA, 22 nt, Human
gcagcaggcagggccaggcagg

SEQ ID NO: 4153 - RNA, 22 nt, Human
ggccucagaagcugaggggaga

SEQ ID NO: 4154 - RNA, 22 nt, Human
ggcccaggagggggagaaaggc

SEQ ID NO: 4155 - RNA, 22 nt, Human
gguagcuagaggggagauagca

SEQ ID NO: 4156 - RNA, 22 nt, Human
uagcucauuuuugaaaucaguu

SEQ ID NO: 4157 - RNA, 22 nt, Human
uuugcacacuuuccaaguugcc

SEQ ID NO: 4158 - RNA, 22 nt, Human
aggcaguaagggagaguuuugc

SEQ ID NO: 4159 - RNA, 22 nt, Human
ugagggggaaggugugugugug

SEQ ID NO: 4160 - RNA, 22 nt, Human
ucagugcacuucaaacuuuuug

SEQ ID NO: 4161 - RNA, 22 nt, Human
ugaaaagccuuuggguagugau

SEQ ID NO: 4162 - RNA, 22 nt, Human
ugugcugguugcccccgagggg

SEQ ID NO: 4163 - RNA, 22 nt, Human
ugggaaaaaaggcaguuuagaa

SEQ ID NO: 4164 - RNA, 22 nt, Human
uuccuucagcccuagcugcuuu

SEQ ID NO: 4165 - RNA, 22 nt, Human
uuccccaugugaugcuauugcu

SEQ ID NO: 4166 - RNA, 22 nt, Human
ugugucuguggaacagaagcag

SEQ ID NO: 4167 - RNA, 22 nt, Human
uuacaaaauuuggagggauugu

SEQ ID NO: 4168 - RNA, 22 nt, Human
uccccaagccuuguaccagcgu

SEQ ID NO: 4169 - RNA, 22 nt, Human
ucugagcccaggaguuugaggc

SEQ ID NO: 4170 - RNA, 22 nt, Human
ucugagugggaacucucaugac

SEQ ID NO: 4171 - RNA, 22 nt, Human
ucuuuuuugggagacggagucg

SEQ ID NO: 4172 - RNA, 22 nt, Human
ucuuggugcuuuugcuggauga

SEQ ID NO: 4173 - RNA, 22 nt, Human
ugacuggaggaagggagguaag

SEQ ID NO: 4174 - RNA, 22 nt, Human
guugggugugagggggguccca

SEQ ID NO: 4175 - RNA, 22 nt, Human
guggcauuggugguggcauugg

SEQ ID NO: 4176 - RNA, 22 nt, Human
guguauggaagugaaggauugg

SEQ ID NO: 4177 - RNA, 22 nt, Human
gguccacaaggggagagcaggg

SEQ ID NO: 4178 - RNA, 22 nt, Human
ggaguuaugauagcaguggagg

SEQ ID NO: 4179 - RNA, 22 nt, Human
gcacucaagccuggguuacaga

SEQ ID NO: 4180 - RNA, 22 nt, Human
gauggcagcuggagguggagca

SEQ ID NO: 4181 - RNA, 22 nt, Human
cccaggagguggagguuacagu

SEQ ID NO: 4182 - RNA, 22 nt, Human
cuuugguuggguggguauuugg

SEQ ID NO: 4183 - RNA, 22 nt, Human
cuguucagaucugugugcauuu

SEQ ID NO: 4184 - RNA, 22 nt, Human
agugauuuuccugccucagccu

SEQ ID NO: 4185 - RNA, 22 nt, Human
agugguuucagggacuucugua

SEQ ID NO: 4186 - RNA, 22 nt, Human
aggcaagagguugcagugagcu

SEQ ID NO: 4187 - RNA, 22 nt, Human
agcuccaggagcuggcaggagg

SEQ ID NO: 4188 - RNA, 22 nt, Human
aggcugcaguguaguggcauga

SEQ ID NO: 4189 - RNA, 22 nt, Human
aaagcuuuguucauuguaucug

SEQ ID NO: 4190 - RNA, 22 nt, Human
aaggaagugucucuuggcuggc

SEQ ID NO: 4191 - RNA, 22 nt, Human
acauuuccaauguuuggggaca

SEQ ID NO: 4192 - RNA, 22 nt, Human
aagguggugucauguuuugggg

SEQ ID NO: 4193 - RNA, 22 nt, Human
aagacuguguguggaaugaagg

SEQ ID NO: 4194 - RNA, 22 nt, Human
acugcacuccagucugggugac

SEQ ID NO: 4195 - RNA, 22 nt, Human
aguuccauggaaaacaacaaag

SEQ ID NO: 4196 - RNA, 22 nt, Human
auacugagagaaaaagcuuguc

SEQ ID NO: 4197 - RNA, 22 nt, Human
cuuggcccugugaggcuucacc

SEQ ID NO: 4198 - RNA, 22 nt, Human
ggaguaugagagagaaugggac

SEQ ID NO: 4199 - RNA, 22 nt, Human
gggagaaaaggaggggauacag

SEQ ID NO: 4200 - RNA, 22 nt, Human
guuguguggaagaugcuuugcc

SEQ ID NO: 4201 - RNA, 22 nt, Human
uacaggcaggcacagaggcagu

SEQ ID NO: 4202 - RNA, 22 nt, Human
uagacugaggcuuccugcaggg

SEQ ID NO: 4203 - RNA, 22 nt, Human
ugacuguucucaaaguuugaag

SEQ ID NO: 4204 - RNA, 22 nt, Human
ucucuaagacaaaggagaaguc

SEQ ID NO: 4205 - RNA, 22 nt, Human
uucccagaaaccugugagugug

SEQ ID NO: 4206 - RNA, 22 nt, Human
uuccuucaguucagggaacccu

SEQ ID NO: 4207 - RNA, 22 nt, Human
uucauuuuggugaagccuuaaa

SEQ ID NO: 4208 - RNA, 22 nt, Human
ugugaaggaggaagggaggagc

SEQ ID NO: 4209 - RNA, 22 nt, Human
uguaguuugaugcuagaacacu

SEQ ID NO: 4210 - RNA, 22 nt, Human
ugaguuuaagcuaagaagucug

SEQ ID NO: 4211 - RNA, 22 nt, Human
ugaggcaggaguuggcaagagg

SEQ ID NO: 4212 - RNA, 22 nt, Human
ugauggaggaaauggugguauc

SEQ ID NO: 4213 - RNA, 22 nt, Human
uggagugucuggaggugucucu

SEQ ID NO: 4214 - RNA, 22 nt, Human
aggcagaaugcaauggcaucca

SEQ ID NO: 4215 - RNA, 22 nt, Human
uagcagaucugugacuccuaug

SEQ ID NO: 4216 - RNA, 22 nt, Human
gucaccaggcagaauucagaua

SEQ ID NO: 4217 - RNA, 22 nt, Human
gucuuccuccguccccaccucc

SEQ ID NO: 4218 - RNA, 22 nt, Human
guuacagcucucaaagaagaca

SEQ ID NO: 4219 - RNA, 22 nt, Human
guugggguuucaguggcaguca

SEQ ID NO: 4220 - RNA, 22 nt, Human
gcagcaggcagggccaggcagg

SEQ ID NO: 4221 - RNA, 22 nt, Human
gccaggaugaagaggaggagaa

SEQ ID NO: 4222 - RNA, 22 nt, Human
cagaaucuuuugucucugagaa

SEQ ID NO: 4223 - RNA, 22 nt, Human
cauuucaguuugcaguuucucu

SEQ ID NO: 4224 - RNA, 22 nt, Human
auagaagagcagugggguagaa

SEQ ID NO: 4225 - RNA, 22 nt, Human
cacugcacuccagccuggguga

SEQ ID NO: 4226 - RNA, 22 nt, Human
uugcccaggcuggagugcagug

SEQ ID NO: 4227 - RNA, 22 nt, Human
uugcucaggcuggagugcagug

SEQ ID NO: 4228 - RNA, 22 nt, Human
uugccuaggcuggagugcagug

SEQ ID NO: 4229 - RNA, 22 nt, Human
uugcccaggcuagagugcagug

SEQ ID NO: 4230 - RNA, 22 nt, Human
ugaggucauguucugucagguu

SEQ ID NO: 4231 - RNA, 22 nt, Human
ugaaauauuuucaagcugauua

SEQ ID NO: 4232 - RNA, 22 nt, Human
uccaguacaggucucucauuuc

SEQ ID NO: 4233 - RNA, 22 nt, Human
ucacccaggcuggagugcagug

SEQ ID NO: 4234 - RNA, 22 nt, Human
uacaaauguuucuucuccuuuu

SEQ ID NO: 4235 - RNA, 22 nt, Human
ggccccuuugugaggcacgcuu

SEQ ID NO: 4236 - RNA, 22 nt, Human
cugugcccagccagggcugugu

SEQ ID NO: 4237 - RNA, 22 nt, Human
augggcaguuucuucccuuucc

SEQ ID NO: 4238 - RNA, 22 nt, Human
aaucuccauuuguaaaugugac

SEQ ID NO: 4239 - RNA, 22 nt, Human
agaaggcucgcucucucagggg

SEQ ID NO: 4240 - RNA, 22 nt, Human
aggaauauaauuaaaacuuugc

SEQ ID NO: 4241 - RNA, 22 nt, Human
agaaccacagcucgaugucccc

SEQ ID NO: 4242 - RNA, 22 nt, Human
cuggugaggaaggagcagaguu

SEQ ID NO: 4243 - RNA, 22 nt, Human
ucacagugauggguucaggaau

SEQ ID NO: 4244 - RNA, 22 nt, Human
ucuuuuuguuguagcuguaugg

SEQ ID NO: 4245 - RNA, 22 nt, Human
ucugucauuuuucucuuuccau

SEQ ID NO: 4246 - RNA, 22 nt, Human
uggcaaagaaggcaguacaguu

SEQ ID NO: 4247 - RNA, 22 nt, Human
uuccaguuuuuccuaccccuua

SEQ ID NO: 4248 - RNA, 22 nt, Human
uuuguauauuugaucauuugug

SEQ ID NO: 4249 - RNA, 22 nt, Human
ugugagagaaauggcaaguugg

SEQ ID NO: 4250 - RNA, 22 nt, Human
cagagaauggcacagcuguccu

SEQ ID NO: 4251 - RNA, 22 nt, Human
cggguccaggaaucaagggaua

SEQ ID NO: 4252 - RNA, 22 nt, Human
cucagugugaagaacuacgggu

SEQ ID NO: 4253 - RNA, 22 nt, Human
ggaguaugagagagaaugggac

SEQ ID NO: 4254 - RNA, 22 nt, Human
ggaggcagugguugcagugagc

SEQ ID NO: 4255 - RNA, 22 nt, Human
gcccaggagucugaggcuggag

SEQ ID NO: 4256 - RNA, 22 nt, Human
gccauugcacuccagccugggc

SEQ ID NO: 4257 - RNA, 22 nt, Human
ggcugcagugaacuaugaucgu

SEQ ID NO: 4258 - RNA, 22 nt, Human
cccaggagguggagguuacagu

SEQ ID NO: 4259 - RNA, 22 nt, Human
cccaggaggcggagguugcagu

SEQ ID NO: 4260 - RNA, 22 nt, Human
cacugcacuguagccuccuggg

SEQ ID NO: 4261 - RNA, 22 nt, Human
caguccaguguugaagagaggc

SEQ ID NO: 4262 - RNA, 22 nt, Human
cauugcacuccagccuaggcaa

SEQ ID NO: 4263 - RNA, 22 nt, Human
ccacugcacuccagcacuccag

SEQ ID NO: 4264 - RNA, 22 nt, Human
gacccuguguucaagguuaggg

SEQ ID NO: 4265 - RNA, 22 nt, Human
gagguagagguugcagugagug

SEQ ID NO: 4266 - RNA, 22 nt, Human
cugggcgugugaggcggcugug

SEQ ID NO: 4267 - RNA, 22 nt, Human
ugugacugagacaccagagggc

SEQ ID NO: 4268 - RNA, 22 nt, Human
ugugccacugcacuccaugggu

SEQ ID NO: 4269 - RNA, 22 nt, Human
ugugaaggaggaagggaggagc

SEQ ID NO: 4270 - RNA, 22 nt, Human
uugcacuccagucugggugaca

SEQ ID NO: 4271 - RNA, 22 nt, Human
cacugcacuccagccuggguga

SEQ ID NO: 4272 - RNA, 22 nt, Human
cacugcacuccagccuggguaa

SEQ ID NO: 4273 - RNA, 22 nt, Human
cacugcacuccacccugggcaa

SEQ ID NO: 4274 - RNA, 22 nt, Human
cacugcacuccaaccuggacaa

SEQ ID NO: 4275 - RNA, 22 nt, Human
auugcuugagcccaggaguuca

SEQ ID NO: 4276 - RNA, 22 nt, Human
auugcacuccagccugggugac

SEQ ID NO: 4277 - RNA, 22 nt, Human
auugcacuccagccugggcaau

SEQ ID NO: 4278 - RNA, 22 nt, Human
auugcacuccagcuugggcaac

SEQ ID NO: 4279 - RNA, 22 nt, Human
uucugccacugcauuccagccu

SEQ ID NO: 4280 - RNA, 22 nt, Human
ugguccagaggaggaaugaggg

SEQ ID NO: 4281 - RNA, 22 nt, Human
uggagugucuggaggugucucu

SEQ ID NO: 4282 - RNA, 22 nt, Human
ugcaccacuacacuccuaggca

SEQ ID NO: 4283 - RNA, 22 nt, Human
ucugccucccugucucacucuc

SEQ ID NO: 4284 - RNA, 22 nt, Human
ucuuugcuggaaggugccuccc

SEQ ID NO: 4285 - RNA, 22 nt, Human
ucagguuccugauuggaguucu

SEQ ID NO: 4286 - RNA, 22 nt, Human
uccauugcacuccagucugggc

SEQ ID NO: 4287 - RNA, 22 nt, Human
gugcuuccauuuccccaucugu

SEQ ID NO: 4288 - RNA, 22 nt, Human
gucuugaucuccugaccuugug

SEQ ID NO: 4289 - RNA, 22 nt, Human
uaggaaguauuuuuuaaaaaca

SEQ ID NO: 4290 - RNA, 22 nt, Human
uugcacuccagccuggguaaca

SEQ ID NO: 4291 - RNA, 22 nt, Human
uugcacuccagccugggugaca

SEQ ID NO: 4292 - RNA, 22 nt, Human
uugguuggugaugagcauugaa

SEQ ID NO: 4293 - RNA, 22 nt, Human
aggcaagagguugcagugagcu

SEQ ID NO: 4294 - RNA, 22 nt, Human
aggcugcaguguaguggcauga

SEQ ID NO: 4295 - RNA, 22 nt, Human
agcaagaugguagcauuggaga

SEQ ID NO: 4296 - RNA, 22 nt, Human
uaguaguuagaggcugcaguga

SEQ ID NO: 4297 - RNA, 22 nt, Human
uaucgcuugagcccaggaguuu

SEQ ID NO: 4298 - RNA, 22 nt, Human
uauugcacuccagccugggcaa

SEQ ID NO: 4299 - RNA, 22 nt, Human
ugccagagaccaccuggaggca

SEQ ID NO: 4300 - RNA, 22 nt, Human
ugcaugaugcugagguuuggga

SEQ ID NO: 4301 - RNA, 22 nt, Human
ugcaccacugcacucuaaccug

SEQ ID NO: 4302 - RNA, 22 nt, Human
ugcaccacugcacuccagccug

SEQ ID NO: 4303 - RNA, 22 nt, Human
ugcaccaaugcacuccagccug

SEQ ID NO: 4304 - RNA, 22 nt, Human
ugaggaggugcuaccagcgucu

SEQ ID NO: 4305 - RNA, 22 nt, Human
ugacuggaggaagggagguaag

SEQ ID NO: 4306 - RNA, 22 nt, Human
ucugagcccaggaguuugaggc

SEQ ID NO: 4307 - RNA, 22 nt, Human
ucccagucaucugggaugugca

SEQ ID NO: 4308 - RNA, 22 nt, Human
cuggcucccucucuucucuccc

SEQ ID NO: 4309 - RNA, 22 nt, Human
ccacugcacuccagccugggug

SEQ ID NO: 4310 - RNA, 22 nt, Human
ccagccugagguuccuggaggg

SEQ ID NO: 4311 - RNA, 22 nt, Human
cauugcacuccagccuggguga

SEQ ID NO: 4312 - RNA, 22 nt, Human
cacugcacucuagccucgguga

SEQ ID NO: 4313 - RNA, 22 nt, Human
cacugcacuccagccugggcga

SEQ ID NO: 4314 - RNA, 22 nt, Human
cacugcacuccagccuaggcaa

SEQ ID NO: 4315 - RNA, 22 nt, Human
cacugcacuccagcccggcaac

SEQ ID NO: 4316 - RNA, 22 nt, Human
cacugcacucagccugggugac

SEQ ID NO: 4317 - RNA, 22 nt, Human
gauugcuugagcccuggagguu

SEQ ID NO: 4318 - RNA, 22 nt, Human
gagguagagguugcagugaguc

SEQ ID NO: 4319 - RNA, 22 nt, Human
gcuggguugagcugggcugaga

SEQ ID NO: 4320 - RNA, 22 nt, Human
gccauugcacuccagccuggac

SEQ ID NO: 4321 - RNA, 22 nt, Human
acuguacuccagccugggcaac

SEQ ID NO: 4322 - RNA, 22 nt, Human
acuguacuccagccuaggcaac

SEQ ID NO: 4323 - RNA, 22 nt, Human
acuguacuccagccugggugac

SEQ ID NO: 4324 - RNA, 22 nt, Human
agguccucacacacagcucugc

SEQ ID NO: 4325 - RNA, 22 nt, Human
acugcacuccagccugggugac

SEQ ID NO: 4326 - RNA, 22 nt, Human
acugcacuccagucugggugac

SEQ ID NO: 4327 - RNA, 22 nt, Human
acugcacuccagucuaggugac

SEQ ID NO: 4328 - RNA, 22 nt, Human
acugcacuccagccuggguggc

SEQ ID NO: 4329 - RNA, 22 nt, Human
acugcacuccagccugggugau

SEQ ID NO: 4330 - RNA, 22 nt, Human
acugcacucuagccuaggugau

SEQ ID NO: 4331 - RNA, 22 nt, Human
acugcacuccauccuggggagc

SEQ ID NO: 4332 - RNA, 22 nt, Human
acugcacucuagccugggcaac

SEQ ID NO: 4333 - RNA, 22 nt, Human
acugcacuccagccugggcgau

SEQ ID NO: 4334 - RNA, 22 nt, Human
acugcacuccagccuggcgaca

SEQ ID NO: 4335 - RNA, 22 nt, Human
acugcacuccagccuaugggau

SEQ ID NO: 4336 - RNA, 22 nt, Human
acugcacuccugccuaggugac

SEQ ID NO: 4337 - RNA, 22 nt, Human
acugcacuccauccugggacag

SEQ ID NO: 4338 - RNA, 22 nt, Human
acugcacuccagccuguugaca

SEQ ID NO: 4339 - RNA, 22 nt, Human
acugcacuccugccugggugac

SEQ ID NO: 4340 - RNA, 22 nt, Human
acugcacucuagccugagcaac

SEQ ID NO: 4341 - RNA, 22 nt, Human
acugcacuucagccugggcaau

SEQ ID NO: 4342 - RNA, 22 nt, Human
acugcacuccagccuggcaaca

SEQ ID NO: 4343 - RNA, 22 nt, Human
acugcacuccaaccaggcugac

SEQ ID NO: 4344 - RNA, 22 nt, Human
acuggcacagacaucugucaag

SEQ ID NO: 4345 - RNA, 22 nt, Human
gcacagaaaugucuacacaugu

SEQ ID NO: 4346 - RNA, 22 nt, Human
gaugugacucaggaauuccaca

SEQ ID NO: 4347 - RNA, 22 nt, Human
cacugcaaccucugccaccugg

SEQ ID NO: 4348 - RNA, 22 nt, Human
cuucuuuggggugggcuugcuc

SEQ ID NO: 4349 - RNA, 22 nt, Human
cuuuuccugggucugggcugug

SEQ ID NO: 4350 - RNA, 22 nt, Human
ucagaguaggcuugauguaauc

SEQ ID NO: 4351 - RNA, 22 nt, Human
ugauauguguuugacauccccc

SEQ ID NO: 4352 - RNA, 22 nt, Human
ugcucuugcucuuucuucugga

SEQ ID NO: 4353 - RNA, 22 nt, Human
uaggaaguauuuuuuaaaaaca

SEQ ID NO: 4354 - RNA, 22 nt, Human
uacaaauguuucuucuccuuuu

SEQ ID NO: 4355 - RNA, 22 nt, Human
uagacugaggcuuccugcaggg

SEQ ID NO: 4356 - RNA, 22 nt, Human
ugaggucauguucugucagguu

SEQ ID NO: 4357 - RNA, 22 nt, Human
uuaaacuucccugcugccccag

SEQ ID NO: 4358 - RNA, 22 nt, Human
cagugauggugaugccaccagc

SEQ ID NO: 4359 - RNA, 22 nt, Human
guaugcacaauuccaugacaau

SEQ ID NO: 4360 - RNA, 22 nt, Human
agugaagcgaguugggccagag

SEQ ID NO: 4361 - RNA, 22 nt, Human
uguccuuuguuuugagauggag

SEQ ID NO: 4362 - RNA, 22 nt, Human
uguggcuuaggugagcauguga

SEQ ID NO: 4363 - RNA, 22 nt, Human
ugauggaggaaggaggggaaug

SEQ ID NO: 4364 - RNA, 22 nt, Human
cagagcugccuuucccuuccug

SEQ ID NO: 4365 - RNA, 22 nt, Human
gggagaaaaggaggggauacag

SEQ ID NO: 4366 - RNA, 22 nt, Human
gggccaugacagggagauaggc

SEQ ID NO: 4367 - RNA, 22 nt, Human
ggcaaggaagaaagcagaaguu

SEQ ID NO: 4368 - RNA, 22 nt, Human
auuugaggaggcuuuacagcca

SEQ ID NO: 4369 - RNA, 22 nt, Human
ugaggucauguucugucagguu

SEQ ID NO: 4370 - RNA, 22 nt, Human
uggaaugacagaagaugagagc

SEQ ID NO: 4371 - RNA, 22 nt, Human
ucuuuuuugggagacggagucg

SEQ ID NO: 4372 - RNA, 22 nt, Human
uuugaggaagguuauuugcaau

SEQ ID NO: 4373 - RNA, 22 nt, Human
ugaggcaggaguuggcaagagg

SEQ ID NO: 4374 - RNA, 22 nt, Human
gaggucuguuguucagaaaaau

SEQ ID NO: 4375 - RNA, 22 nt, Human
cugaggcaggagggcucaggag

SEQ ID NO: 4376 - RNA, 22 nt, Human
gacaagagaaccucaugcuggg

SEQ ID NO: 4377 - RNA, 22 nt, Human
aacugcuuuuguugugcaggga

SEQ ID NO: 4378 - RNA, 22 nt, Human
agcaacagaacgccacuauuug

SEQ ID NO: 4379 - RNA, 22 nt, Human
aagucaccugaaaacucaacua

SEQ ID NO: 4380 - RNA, 22 nt, Human
aaacuuuuggcuguggggaccc

SEQ ID NO: 4381 - RNA, 22 nt, Human
agaaguguaaauaaguauguau

SEQ ID NO: 4382 - RNA, 22 nt, Human
cauugcacuccagccuggguga

SEQ ID NO: 4383 - RNA, 22 nt, Human
gauuccuccucuuuaaaauggu

SEQ ID NO: 4384 - RNA, 22 nt, Human
gcacucaagccuggguuacaga

SEQ ID NO: 4385 - RNA, 22 nt, Human
ggcaugauucagcagaggagag

SEQ ID NO: 4386 - RNA, 22 nt, Human
uggcuguuugggguugccgugu

SEQ ID NO: 4387 - RNA, 22 nt, Human
uuaguguucaggcucaaaugaa

SEQ ID NO: 4388 - RNA, 22 nt, Human
uuugaggaagguuauuugcaau

SEQ ID NO: 4389 - RNA, 22 nt, Human
auugcacuccagcuugggcaac

SEQ ID NO: 4390 - RNA, 22 nt, Human
cacugcacuccagccuggguga

SEQ ID NO: 4391 - RNA, 22 nt, Human
uggagagaaagcgaagauguag

SEQ ID NO: 4392 - RNA, 22 nt, Human
uccaaugcaccaugggugaauu

SEQ ID NO: 4393 - RNA, 22 nt, Human
uccuuaggaccuagagguagua

SEQ ID NO: 4394 - RNA, 22 nt, Human
uuucuggagggcaagugcaggg

SEQ ID NO: 4395 - RNA, 22 nt, Human
uugagaaugcuguaauuggagg

SEQ ID NO: 4396 - RNA, 22 nt, Human
uacaaauguuucuucuccuuuu

SEQ ID NO: 4397 - RNA, 22 nt, Human
uaugaauguaaggaauguggga

SEQ ID NO: 4398 - RNA, 22 nt, Human
gugcauuuguaguuaaaugugu

SEQ ID NO: 4399 - RNA, 22 nt, Human
ucacccaggcuggagugcagug

SEQ ID NO: 4400 - RNA, 22 nt, Human
uauacacaucuauccgcauaug

SEQ ID NO: 4401 - RNA, 22 nt, Human
gugcuuguaguugcagcuuagu

SEQ ID NO: 4402 - RNA, 22 nt, Human
guguauguguguaugucugugu

SEQ ID NO: 4403 - RNA, 22 nt, Human
ugcuguaguauguauauaguau

SEQ ID NO: 4404 - RNA, 22 nt, Human
ugggguuucuccauguugguca

SEQ ID NO: 4405 - RNA, 22 nt, Human
uuacuacugacauccaggguga

SEQ ID NO: 4406 - RNA, 22 nt, Human
uucccuuaggucuggaauggua

SEQ ID NO: 4407 - RNA, 22 nt, Human
uuccagauggguaggaauaccu

SEQ ID NO: 4408 - RNA, 22 nt, Human
gucuggaggcuggaaccuggug

SEQ ID NO: 4409 - RNA, 22 nt, Human
cacccaggcuggagugcagugg

SEQ ID NO: 4410 - RNA, 22 nt, Human
ccacugcacuccagccugggug

SEQ ID NO: 4411 - RNA, 22 nt, Human
cugggcucuggucuguagguuu

SEQ ID NO: 4412 - RNA, 22 nt, Human
uagauggguuacucagaugacu

SEQ ID NO: 4413 - RNA, 22 nt, Human
ucaucuauuaaagugggagaac

SEQ ID NO: 4414 - RNA, 22 nt, Human
ucuggcccugcuaggcccaaag

SEQ ID NO: 4415 - RNA, 22 nt, Human
auggauauuuuugaugcccaga

SEQ ID NO: 4416 - RNA, 22 nt, Human
aggcugagugcaguggugugau

SEQ ID NO: 4417 - RNA, 22 nt, Human
acaaccucugccuccuggguuc

SEQ ID NO: 4418 - RNA, 22 nt, Human
uccaaagacucaacaguuagac

SEQ ID NO: 4419 - RNA, 22 nt, Human
ucauugguugcauaauuugauc

SEQ ID NO: 4420 - RNA, 22 nt, Human
uaucucuugccuugaccuccua

SEQ ID NO: 4421 - RNA, 22 nt, Human
uaccagugucagcuuccugugu

SEQ ID NO: 4422 - RNA, 22 nt, Human
ucauugcaaccuccaccuccug

SEQ ID NO: 4423 - RNA, 22 nt, Human
ucagugcaaacuaagcagggca

SEQ ID NO: 4424 - RNA, 22 nt, Human
ucacugcaaccucugcuucugg

SEQ ID NO: 4425 - RNA, 22 nt, Human
gucuuguuccaguuucucagcc

SEQ ID NO: 4426 - RNA, 22 nt, Human
ugccuaggcaggacggaaugca

SEQ ID NO: 4427 - RNA, 22 nt, Human
cuccuaggcuggagugcagugg

SEQ ID NO: 4428 - RNA, 22 nt, Human
cacccaggcuggagugcagugg

SEQ ID NO: 4429 - RNA, 22 nt, Human
cacugcaaccucugccuccugg

SEQ ID NO: 4430 - RNA, 22 nt, Human
ggcgugaucuuggcucaccaca

SEQ ID NO: 4431 - RNA, 22 nt, Human
cacugcaaccuccaccuccugg

SEQ ID NO: 4432 - RNA, 22 nt, Human
agugauuuuccugccucagccu

SEQ ID NO: 4433 - RNA, 22 nt, Human
aucugcugucuuuuagaagugg

SEQ ID NO: 4434 - RNA, 22 nt, Human
aucacuuugcagggauuacuaa

SEQ ID NO: 4435 - RNA, 22 nt, Human
uugugguuuucccaggugguag

SEQ ID NO: 4436 - RNA, 22 nt, Human
uugguuggugaugagcauugaa

SEQ ID NO: 4437 - RNA, 22 nt, Human
uugccuaggcuggagugcagug

SEQ ID NO: 4438 - RNA, 22 nt, Human
uguuaacauuuuggcuagauag

SEQ ID NO: 4439 - RNA, 22 nt, Human
ggcagugucauuagcugauugu

SEQ ID NO: 4440 - RNA, 22 nt, Human
gccuuuccuccagaacugcucc

SEQ ID NO: 4441 - RNA, 22 nt, Human
cccaggcuggagugcaguggug

SEQ ID NO: 4442 - RNA, 22 nt, Human
cgcuauguuggccaggcugguc

SEQ ID NO: 4443 - RNA, 22 nt, Human
cucagauacuugggagguugag

SEQ ID NO: 4444 - RNA, 22 nt, Human
cuuggcccugugaggcuucacc

SEQ ID NO: 4445 - RNA, 22 nt, Human
ggcccaggagggggagaaaggc

SEQ ID NO: 4446 - RNA, 22 nt, Human
ggagcuguaacagaucuguucu

SEQ ID NO: 4447 - RNA, 22 nt, Human
ugguuaguuuuaugggccugga

SEQ ID NO: 4448 - RNA, 22 nt, Human
uuucagcaguggaagagggauc

SEQ ID NO: 4449 - RNA, 22 nt, Human
aguccaguguucucugcucugu

SEQ ID NO: 4450 - RNA, 22 nt, Human
aguggcccuggcccuggggcau

SEQ ID NO: 4451 - RNA, 22 nt, Human
gguccacaaggggagagcaggg

SEQ ID NO: 4452 - RNA, 22 nt, Human
ggguccaccucugucaaaggaa

SEQ ID NO: 4453 - RNA, 22 nt, Human
gucuggaggcuggaaccuggug

SEQ ID NO: 4454 - RNA, 22 nt, Human
ggaggcagugguugcagugagc

SEQ ID NO: 4455 - RNA, 22 nt, Human
ggcagcugugcagagugggggu

SEQ ID NO: 4456 - RNA, 22 nt, Human
ggcaugauucagcagaggagag

SEQ ID NO: 4457 - RNA, 22 nt, Human
gcagcaggcagggccaggcagg

SEQ ID NO: 4458 - RNA, 22 nt, Human
gccaggaugaagaggaggagaa

SEQ ID NO: 4459 - RNA, 22 nt, Human
uucacauguugcucaguuuugc

SEQ ID NO: 4460 - RNA, 22 nt, Human
ugugaaggaggaagggaggagc

SEQ ID NO: 4461 - RNA, 22 nt, Human
ucuuuuuugggagacggagucg

SEQ ID NO: 4462 - RNA, 22 nt, Human
uacaggcaggcacagaggcagu

SEQ ID NO: 4463 - RNA, 22 nt, Human
gugagaauggaggaagaacagu

SEQ ID NO: 4464 - RNA, 22 nt, Human
guauguguggguuucucagccu

SEQ ID NO: 4465 - RNA, 22 nt, Human
uuugcaccugagacagauagcc

SEQ ID NO: 4466 - RNA, 22 nt, Human
uggaaugaggaagggugugguc

SEQ ID NO: 4467 - RNA, 22 nt, Human
uggaaugacagaagaugagagc

SEQ ID NO: 4468 - RNA, 22 nt, Human
ugccagagaccaccuggaggca

SEQ ID NO: 4469 - RNA, 22 nt, Human
aaaguggcuggaguggagucuu

SEQ ID NO: 4470 - RNA, 22 nt, Human
aggcaagagguugcagugagcu

SEQ ID NO: 4471 - RNA, 22 nt, Human
agcggagaccugagcuaugagu

SEQ ID NO: 4472 - RNA, 22 nt, Human
agcaaaagccaugcccaggaga

SEQ ID NO: 4473 - RNA, 22 nt, Human
agaagguuggggcuggaggucu

SEQ ID NO: 4474 - RNA, 22 nt, Human
agugauuuuccugccucagccu

SEQ ID NO: 4475 - RNA, 22 nt, Human
aaacggaaccacuagugacuug

SEQ ID NO: 4476 - RNA, 22 nt, Human
ucauaucauuuugaaagcugag

SEQ ID NO: 4477 - RNA, 22 nt, Human
agcugugagccugccuuccagu

SEQ ID NO: 4478 - RNA, 22 nt, Human
gucuuccuccguccccaccucc

SEQ ID NO: 4479 - RNA, 22 nt, Human
gugugggcagggccgugcuccc

SEQ ID NO: 4480 - RNA, 22 nt, Human
uaggcccauuaauaguguacau

SEQ ID NO: 4481 - RNA, 22 nt, Human
ucuggcccugcuaggcccaaag

SEQ ID NO: 4482 - RNA, 22 nt, Human
uaggaaguauuuuuuaaaaaca

SEQ ID NO: 4483 - RNA, 22 nt, Human
uggagagaaagcgaagauguag

SEQ ID NO: 4484 - RNA, 22 nt, Human
ggcaugugugagcagcugcagg

SEQ ID NO: 4485 - RNA, 22 nt, Human
ggcccaggagggggagaaaggc

SEQ ID NO: 4486 - RNA, 22 nt, Human
aucucauaggcccccagugggg

SEQ ID NO: 4487 - RNA, 22 nt, Human
uucucuccaauuugaaauaccu

SEQ ID NO: 4488 - RNA, 22 nt, Human
ccacccuuccauucuuccucuu

SEQ ID NO: 4489 - RNA, 22 nt, Human
gaggagguggggcagcagcagg

SEQ ID NO: 4490 - RNA, 22 nt, Human
cuggcucccucucuucucuccc

SEQ ID NO: 4491 - RNA, 22 nt, Human
gagugagugugaucuuggcuca

SEQ ID NO: 4492 - RNA, 22 nt, Human
guuuuguugucucuguguugua

SEQ ID NO: 4493 - RNA, 22 nt, Human
ucuuugcuggaaggugccuccc

SEQ ID NO: 4494 - RNA, 22 nt, Human
acaguccucuacuccagcuccc

SEQ ID NO: 4495 - RNA, 22 nt, Human
aaggcuguguaggcagaauucu

SEQ ID NO: 4496 - RNA, 22 nt, Human
acaaaaaauacgaaaauuagcu

SEQ ID NO: 4497 - RNA, 22 nt, Human
aaugugaauguuguaugcagug

SEQ ID NO: 4498 - RNA, 22 nt, Human
aggccuuuuugggaagagacag

SEQ ID NO: 4499 - RNA, 22 nt, Human
aaaagugccugcugcugcuucu

SEQ ID NO: 4500 - RNA, 22 nt, Human
ugacuuugaacagggaauuucu

SEQ ID NO: 4501 - RNA, 22 nt, Human
ucuagcucugauuuuaagggau

SEQ ID NO: 4502 - RNA, 22 nt, Human
gugcuuguaguugcagcuuagu

SEQ ID NO: 4503 - RNA, 22 nt, Human
uaggaaguauuuuuuaaaaaca

SEQ ID NO: 4504 - RNA, 22 nt, Human
uagauggguuacucagaugacu

SEQ ID NO: 4505 - RNA, 22 nt, Human
uacgcugugcugugacauggua

SEQ ID NO: 4506 - RNA, 22 nt, Human
uggagagaaagcgaagauguag

SEQ ID NO: 4507 - RNA, 22 nt, Human
uggaaagcauguacauuuggag

SEQ ID NO: 4508 - RNA, 22 nt, Human
uggagagauagugauuuagcuc

SEQ ID NO: 4509 - RNA, 22 nt, Human
ugagguaggugcugaaacugcu

SEQ ID NO: 4510 - RNA, 22 nt, Human
uguggcuuaggugagcauguga

SEQ ID NO: 4511 - RNA, 22 nt, Human
uggguuagugguugaauaguuu

SEQ ID NO: 4512 - RNA, 22 nt, Human
uggucucuugaaagaggcucuu

SEQ ID NO: 4513 - RNA, 22 nt, Human
uagcucauuuuugaaaucaguu

SEQ ID NO: 4514 - RNA, 22 nt, Human
guuacagcucucaaagaagaca

SEQ ID NO: 4515 - RNA, 22 nt, Human
guauguauuuauagauguucuu

SEQ ID NO: 4516 - RNA, 22 nt, Human
uuugcagcuuccaaauuucuga

SEQ ID NO: 4517 - RNA, 22 nt, Human
ucuuucuuaaauggaugcauga

SEQ ID NO: 4518 - RNA, 22 nt, Human
ugccagagaccaccuggaggca

SEQ ID NO: 4519 - RNA, 22 nt, Human
ugaggacagaaaguuugugcug

SEQ ID NO: 4520 - RNA, 22 nt, Human
ugacuggaggaagggagguaag

SEQ ID NO: 4521 - RNA, 22 nt, Human
ugagguaaguauguuauuggaa

SEQ ID NO: 4522 - RNA, 22 nt, Human
ggccugaggucagcaguagagg

SEQ ID NO: 4523 - RNA, 22 nt, Human
gaggugaaggaacaaaugcuga

SEQ ID NO: 4524 - RNA, 22 nt, Human
cacaauauagcaaauagagggu

SEQ ID NO: 4525 - RNA, 22 nt, Human
cuggcuaauuuucuugaguuuu

SEQ ID NO: 4526 - RNA, 22 nt, Human
ccuuggcacuuaaucuucaagc

SEQ ID NO: 4527 - RNA, 22 nt, Human
uguuauuuuguccaagagagag

SEQ ID NO: 4528 - RNA, 22 nt, Human
uuucaaaacaaagcuuucccag

SEQ ID NO: 4529 - RNA, 22 nt, Human
aguccaguguucucugcucugu

SEQ ID NO: 4530 - RNA, 22 nt, Human
cauugcacuccagccuaggcaa

SEQ ID NO: 4531 - RNA, 22 nt, Human
acugcacuccagccuaugggau

SEQ ID NO: 4532 - RNA, 22 nt, Human
auggcucauguuuguagucuca

SEQ ID NO: 4533 - RNA, 22 nt, Human
cuggcucccucucuucucuccc

SEQ ID NO: 4534 - RNA, 22 nt, Human
gcagugaaggaggcaugugauc

SEQ ID NO: 4535 - RNA, 22 nt, Human
uugcauaugcauggguacacag

SEQ ID NO: 4536 - RNA, 22 nt, Human
cagaugaagaagaugaagcccg

SEQ ID NO: 4537 - RNA, 22 nt, Human
cccugggcugguguuugacuug

SEQ ID NO: 4538 - RNA, 22 nt, Human
ggaguguaaagaaggauguuac

SEQ ID NO: 4539 - RNA, 22 nt, Human
gggagaaaaggaggggauacag

SEQ ID NO: 4540 - RNA, 22 nt, Human
ucuggcuccugaguccuagcuc

SEQ ID NO: 4541 - RNA, 22 nt, Human
gugcuuccauuuccccaucugu

SEQ ID NO: 4542 - RNA, 22 nt, Human
uaaagaauggguggcugggcug

SEQ ID NO: 4543 - RNA, 22 nt, Human
ugguccagaggaggaaugaggg

SEQ ID NO: 4544 - RNA, 22 nt, Human
uggggcacuguggaggugucau

SEQ ID NO: 4545 - RNA, 22 nt, Human
uggcggagaggguccaugguag

SEQ ID NO: 4546 - RNA, 22 nt, Human
guugggugugagggggguccca

SEQ ID NO: 4547 - RNA, 22 nt, Human
uaagccauguccuguugugggc

SEQ ID NO: 4548 - RNA, 22 nt, Human
guggcauuggugguggcauugg

SEQ ID NO: 4549 - RNA, 22 nt, Human
uagcaaccuuaauauuuuacag

SEQ ID NO: 4550 - RNA, 22 nt, Human
uauuacauucauuuugaugguu

SEQ ID NO: 4551 - RNA, 22 nt, Human
ugcuagguuuuuuccuuucccc

SEQ ID NO: 4552 - RNA, 22 nt, Human
ugagguaaguauguuauuggaa

SEQ ID NO: 4553 - RNA, 22 nt, Human
ugaguguaugugugagagagaa

SEQ ID NO: 4554 - RNA, 22 nt, Human
uggcucaguuugcucagcagug

SEQ ID NO: 4555 - RNA, 22 nt, Human
gugugcacaacagaguguggug

SEQ ID NO: 4556 - RNA, 22 nt, Human
uuuguaauagcaaaauacugga

SEQ ID NO: 4557 - RNA, 22 nt, Human
uggagaauuaaaaaggguagug

SEQ ID NO: 4558 - RNA, 22 nt, Human
uggagaaauuauauuuuacuaa

SEQ ID NO: 4559 - RNA, 22 nt, Human
gaggagguggggcagcagcagg

SEQ ID NO: 4560 - RNA, 22 nt, Human
cuggcucuaauaaccugagcuu

SEQ ID NO: 4561 - RNA, 22 nt, Human
cugaaaugcuguugauuuuagu

SEQ ID NO: 4562 - RNA, 22 nt, Human
cuuccuggguucauauccuggu

SEQ ID NO: 4563 - RNA, 22 nt, Human
gaagagcugugugcugugaugu

SEQ ID NO: 4564 - RNA, 22 nt, Human
ccagaggugagucuugauuuug

SEQ ID NO: 4565 - RNA, 22 nt, Human
cagugggaaaaguuugucucau

SEQ ID NO: 4566 - RNA, 22 nt, Human
cacugcaaccuccaccuccugg

SEQ ID NO: 4567 - RNA, 22 nt, Human
cacugcaagcuccaccucccgg

SEQ ID NO: 4568 - RNA, 22 nt, Human
gacaugauguagcagaugaugg

SEQ ID NO: 4569 - RNA, 22 nt, Human
gagguagagguugcagugaguc

SEQ ID NO: 4570 - RNA, 22 nt, Human
gagaaguaggaauaucaggagu

SEQ ID NO: 4571 - RNA, 22 nt, Human
gcugcuccugcucucccucucc

SEQ ID NO: 4572 - RNA, 22 nt, Human
ggaagaaugugcuuuuguuguu

SEQ ID NO: 4573 - RNA, 22 nt, Human
gguccacaaggggagagcaggg

SEQ ID NO: 4574 - RNA, 22 nt, Human
ggcaugauggagaggguggaga

SEQ ID NO: 4575 - RNA, 22 nt, Human
uggaggaaguaguggcuguguu

SEQ ID NO: 4576 - RNA, 22 nt, Human
ugcuagguuuuuuccuuucccc

SEQ ID NO: 4577 - RNA, 22 nt, Human
ugagggggaaggugugugugug

SEQ ID NO: 4578 - RNA, 22 nt, Human
ucuuccauuccccuccuacgcc

SEQ ID NO: 4579 - RNA, 21 nt, Human
agcaucugaggcaguuuccua

SEQ ID NO: 4580 - RNA, 22 nt, Human
agcugagaaagcgaagaggugg

SEQ ID NO: 4581 - RNA, 22 nt, Human
uuuaagcuauaguuccaggccc

SEQ ID NO: 4582 - RNA, 22 nt, Human
gugcuugaccaugugguggcag

SEQ ID NO: 4583 - RNA, 22 nt, Human
agggaugaaguaaaaacaucug

SEQ ID NO: 4584 - RNA, 22 nt, Human
ugagugacagagcaacacucug

SEQ ID NO: 4585 - RNA, 22 nt, Human
ugcaugaugcugagguuuggga

SEQ ID NO: 4586 - RNA, 22 nt, Human
uggauuaguaaagaagaaugaa

SEQ ID NO: 4587 - RNA, 22 nt, Human
uacaggcaggcacagaggcagu

SEQ ID NO: 4588 - RNA, 22 nt, Human
gugcuuguaguugcagcuuagu

SEQ ID NO: 4589 - RNA, 22 nt, Human
guguguggaaaugcagaugacc

SEQ ID NO: 4590 - RNA, 22 nt, Human
ucacugcaaccuccaccucccg

SEQ ID NO: 4591 - RNA, 22 nt, Human
uuuucugggcucccuuuucugc

SEQ ID NO: 4592 - RNA, 22 nt, Human
uucacaguggcugaagcuguuc

SEQ ID NO: 4593 - RNA, 22 nt, Human
uuacaaaauuuggagggauugu

SEQ ID NO: 4594 - RNA, 22 nt, Human
ggaguuaugauagcaguggagg

SEQ ID NO: 4595 - RNA, 22 nt, Human
gguagcuagaggggagauagca

SEQ ID NO: 4596 - RNA, 22 nt, Human
gagaggugaagccaggcuucug

SEQ ID NO: 4597 - RNA, 22 nt, Human
aucuucuguugcgggaagucag

SEQ ID NO: 4598 - RNA, 22 nt, Human
agcuccaggagcuggcaggagg

SEQ ID NO: 4599 - RNA, 22 nt, Human
acacaggcccagagaggcagug

SEQ ID NO: 4600 - RNA, 22 nt, Human
aaaagcuagaaggagacugggu

SEQ ID NO: 4601 - RNA, 22 nt, Human
aaaggcagacggugaaugccuu

SEQ ID NO: 4602 - RNA, 22 nt, Human
uguggcagaaggcucuggauua

SEQ ID NO: 4603 - RNA, 22 nt, Human
auauuggugaaaugcuagcaaa

SEQ ID NO: 4604 - RNA, 22 nt, Human
auggcucauguuuguagucuca

SEQ ID NO: 4605 - RNA, 22 nt, Human
uagcucauuuuugaaaucaguu

SEQ ID NO: 4606 - RNA, 22 nt, Human
ugccugugacaugcucuguuug

SEQ ID NO: 4607 - RNA, 22 nt, Human
ucucuaagacaaaggagaaguc

SEQ ID NO: 4608 - RNA, 22 nt, Human
ucacccaguguaaacagcauga

SEQ ID NO: 4609 - RNA, 22 nt, Human
uaugaauguaaggaauguggga

SEQ ID NO: 4610 - RNA, 22 nt, Human
ucagccuaauacaggaaaagcu

SEQ ID NO: 4611 - RNA, 22 nt, Human
uagagcaccuguugugugugca

SEQ ID NO: 4612 - RNA, 22 nt, Human
uagaaagugucucauuuuaaua

SEQ ID NO: 4613 - RNA, 22 nt, Human
uaggaaguauuuuuuaaaaaca

SEQ ID NO: 4614 - RNA, 22 nt, Human
ugaggucauguucugucagguu

SEQ ID NO: 4615 - RNA, 22 nt, Human
uuagauauguccccuucuauaa

SEQ ID NO: 4616 - RNA, 22 nt, Human
auauuggugaaaugcuagcaaa

SEQ ID NO: 4617 - RNA, 22 nt, Human
uucucaauaaucuuagaggucu

SEQ ID NO: 4618 - RNA, 22 nt, Human
ggcaccaucucagcucacugga

SEQ ID NO: 4619 - RNA, 22 nt, Human
ggcaggaucauagcucacugca

SEQ ID NO: 4620 - RNA, 22 nt, Human
agagagaguagaagcaugcaag

SEQ ID NO: 4621 - RNA, 22 nt, Human
aggagccagauauacucuuaag

SEQ ID NO: 4622 - RNA, 22 nt, Human
aaagacaguucagugacaaguu

SEQ ID NO: 4623 - RNA, 22 nt, Human
aagacuguguguggaaugaagg

SEQ ID NO: 4624 - RNA, 22 nt, Human
agaaguaguaguagcaguagua

SEQ ID NO: 4625 - RNA, 22 nt, Human
aaggcuguguaggcagaauucu

SEQ ID NO: 4626 - RNA, 22 nt, Human
cuggcugcauuuaggaacaagg

SEQ ID NO: 4627 - RNA, 22 nt, Human
uuaaacuagacaaccacugaag

SEQ ID NO: 4628 - RNA, 22 nt, Human
ugauuguaugauauaugaguuu

SEQ ID NO: 4629 - RNA, 22 nt, Human
uagacugaggcuuccugcaggg

SEQ ID NO: 4630 - RNA, 22 nt, Human
guguuauuaauaaacucuuuuu

SEQ ID NO: 4631 - RNA, 21 nt, Human
ugagguaggugcugaaacugc

SEQ ID NO: 4632 - RNA, 22 nt, Human
ugacaagauacaggguagugaa

SEQ ID NO: 4633 - RNA, 22 nt, Human
uauuacauucauuuugaugguu

SEQ ID NO: 4634 - RNA, 22 nt, Human
ucacugcaaccucugcuucugg

SEQ ID NO: 4635 - RNA, 22 nt, Human
uggauuaguaaagaagaaugaa

SEQ ID NO: 4636 - RNA, 22 nt, Human
uggaguaaaaugucagguguuu

SEQ ID NO: 4637 - RNA, 22 nt, Human
uguaggugguugagagaaugaa

SEQ ID NO: 4638 - RNA, 22 nt, Human
gaggcagcaacuggugaggcac

SEQ ID NO: 4639 - RNA, 22 nt, Human
ccguaaaauguucaaauguuuu

SEQ ID NO: 4640 - RNA, 22 nt, Human
accuggccuguaggcaagucuu

SEQ ID NO: 4641 - RNA, 22 nt, Human
aggcaguaagggagaguuuugc

SEQ ID NO: 4642 - RNA, 22 nt, Human
agggaguuuacauguuuucuaa

SEQ ID NO: 4643 - RNA, 22 nt, Human
aggcugcaguguaguggcauga

SEQ ID NO: 4644 - RNA, 22 nt, Human
agugauuuuccugccucagccu

SEQ ID NO: 4645 - RNA, 22 nt, Human
aaugugugggagaacagucuuu

SEQ ID NO: 4646 - RNA, 22 nt, Human
aagugcugggauuacaggccug

SEQ ID NO: 4647 - RNA, 22 nt, Human
acaaccucugccuccuggguuc

SEQ ID NO: 4648 - RNA, 22 nt, Human
cgcuauguuggccaggcugguc

SEQ ID NO: 4649 - RNA, 22 nt, Human
cucacugcaaccuccgccuccc

SEQ ID NO: 4650 - RNA, 22 nt, Human
cucugccucccgggucuaggcu

SEQ ID NO: 4651 - RNA, 22 nt, Human
cuccuaggcuggagugcagugg

SEQ ID NO: 4652 - RNA, 22 nt, Human
ccaaagugcuaggauuacagcc

SEQ ID NO: 4653 - RNA, 22 nt, Human
ccaaagugcuggcguuacaggu

SEQ ID NO: 4654 - RNA, 22 nt, Human
cagugcugaguaugaaaggccc

SEQ ID NO: 4655 - RNA, 22 nt, Human
cacugcgaccucuaucucuugg

SEQ ID NO: 4656 - RNA, 22 nt, Human
cacugggauuacagaugugagc

SEQ ID NO: 4657 - RNA, 22 nt, Human
cugggauuacaggugugaacca

SEQ ID NO: 4658 - RNA, 22 nt, Human
cugugagcuauuuguuuugguu

SEQ ID NO: 4659 - RNA, 22 nt, Human
cugccuccuggguucaagcaau

SEQ ID NO: 4660 - RNA, 22 nt, Human
ggcgugaucuuggcucaccaca

SEQ ID NO: 4661 - RNA, 22 nt, Human
ugucuacugcacccagcggaca

SEQ ID NO: 4662 - RNA, 22 nt, Human
ugggguuucuccauguugguca

SEQ ID NO: 4663 - RNA, 22 nt, Human
uugcaguaacaggugugagcau

SEQ ID NO: 4664 - RNA, 22 nt, Human
uugucagaggcugguagggugu

SEQ ID NO: 4665 - RNA, 22 nt, Human
uugccuaggcuggagugcagug

SEQ ID NO: 4666 - RNA, 22 nt, Human
cacugcaaccuccaccuccugg

SEQ ID NO: 4667 - RNA, 22 nt, Human
cacccaggcuggagugcagugg

SEQ ID NO: 4668 - RNA, 22 nt, Human
cacugcaaccucugccaccugg

SEQ ID NO: 4669 - RNA, 22 nt, Human
caaagugcugagauuacaggca

SEQ ID NO: 4670 - RNA, 22 nt, Human
aggugggguuucaccauguugg

SEQ ID NO: 4671 - RNA, 22 nt, Human
ugugccacugcacuccaugggu

SEQ ID NO: 4672 - RNA, 22 nt, Human
uggagugucuggaggugucucu

SEQ ID NO: 4673 - RNA, 22 nt, Human
ugagguaggugcugaaacugcu

SEQ ID NO: 4674 - RNA, 22 nt, Human
ucacugcaaccucugcuucugg

SEQ ID NO: 4675 - RNA, 22 nt, Human
ucacugcaaccuccaccucccg

SEQ ID NO: 4676 - RNA, 22 nt, Human
ucacccaggcuggagugcagug

SEQ ID NO: 4677 - RNA, 22 nt, Human
ucauugcaaccuccaccuccug

SEQ ID NO: 4678 - RNA, 22 nt, Human
ucugccucccugucucacucuc

SEQ ID NO: 4679 - RNA, 22 nt, Human
ucucauauagcuggguugcagc

SEQ ID NO: 4680 - RNA, 22 nt, Human
gucuugaucuccugaccuugug

SEQ ID NO: 4681 - RNA, 22 nt, Human
aggguuguuaguuuuuugguug

SEQ ID NO: 4682 - RNA, 22 nt, Human
uugcucaggcuggagugcagug

SEQ ID NO: 4683 - RNA, 22 nt, Human
uugcccaggcuggagugcagug

SEQ ID NO: 4684 - RNA, 22 nt, Human
ucuugggauagugucucauggc

SEQ ID NO: 4685 - RNA, 22 nt, Human
ucacugcaaccuccgccugccg

SEQ ID NO: 4686 - RNA, 22 nt, Human
ucaagcaauucucgugccucag

SEQ ID NO: 4687 - RNA, 22 nt, Human
ucacugcaaccucugccuuccg

SEQ ID NO: 4688 - RNA, 21 nt, Human
ugagguaggugcugaaacugc

SEQ ID NO: 4689 - RNA, 22 nt, Human
ugauccucuggcuucagccucc

SEQ ID NO: 4690 - RNA, 22 nt, Human
ggcaugugugagcagcugcagg

SEQ ID NO: 4691 - RNA, 22 nt, Human
gucuggaggcuggaaccuggug

SEQ ID NO: 4692 - RNA, 22 nt, Human
gagauggaguuuuacuauguug

SEQ ID NO: 4693 - RNA, 22 nt, Human
gaucagauuuccuuauuuaucu

SEQ ID NO: 4694 - RNA, 22 nt, Human
gaagauguuuaacaaaucauuu

SEQ ID NO: 4695 - RNA, 22 nt, Human
cacugcaagcuccaccucccgg

SEQ ID NO: 4696 - RNA, 22 nt, Human
cacugcaaccucugccuccugg

SEQ ID NO: 4697 - RNA, 22 nt, Human
cacugcaacccccgccucccag

SEQ ID NO: 4698 - RNA, 22 nt, Human
ccaggcaacuguguuuuuuaag

SEQ ID NO: 4699 - RNA, 22 nt, Human
cccaggcuggagugcaguggug

SEQ ID NO: 4700 - RNA, 22 nt, Human
ccaaagugcugggauuacaggc

SEQ ID NO: 4701 - RNA, 22 nt, Human
cauugcacuccagccuaggcaa

SEQ ID NO: 4702 - RNA, 22 nt, Human
cacugcacucagccugggugac

SEQ ID NO: 4703 - RNA, 22 nt, Human
cacugcacuccagcccggcaac

SEQ ID NO: 4704 - RNA, 22 nt, Human
cacugcacuccagccuggguaa

SEQ ID NO: 4705 - RNA, 22 nt, Human
gccaggaugaagaggaggagaa

SEQ ID NO: 4706 - RNA, 21 nt, Human
gccuccauuucuacaucucua

SEQ ID NO: 4707 - RNA, 22 nt, Human
ugcaccacugcacuccagccug

SEQ ID NO: 4708 - RNA, 22 nt, Human
uugcacuccagccugggugaca

SEQ ID NO: 4709 - RNA, 22 nt, Human
uucucauuggcccacaggggua

SEQ ID NO: 4710 - RNA, 22 nt, Human
uauugcacuccagccugggcaa

SEQ ID NO: 4711 - RNA, 22 nt, Human
ugcaccaaugcacuccagccug

SEQ ID NO: 4712 - RNA, 22 nt, Human
uggcacagaucagcagaacagg

SEQ ID NO: 4713 - RNA, 22 nt, Human
uucugccacugcauuccagccu

SEQ ID NO: 4714 - RNA, 22 nt, Human
auugcacuccagccugggugac

SEQ ID NO: 4715 - RNA, 22 nt, Human
cacugcacuccagccuggguga

SEQ ID NO: 4716 - RNA, 22 nt, Human
cacugcacuccagccuaggcaa

SEQ ID NO: 4717 - RNA, 22 nt, Human
cacugcacuccagccugggcga

SEQ ID NO: 4718 - RNA, 22 nt, Human
agugcagguucacaggcugggc

SEQ ID NO: 4719 - RNA, 22 nt, Human
guagacagcaagaaaaugaaga

SEQ ID NO: 4720 - RNA, 22 nt, Human
ggcaggaucauagcucacugca

SEQ ID NO: 4721 - RNA, 22 nt, Human
gccauugcacuccagccugggc

SEQ ID NO: 4722 - RNA, 22 nt, Human
gccauugcacuccagccuggac

SEQ ID NO: 4723 - RNA, 22 nt, Human
ccacugcacuccagccugggug

SEQ ID NO: 4724 - RNA, 22 nt, Human
cauugcacuccagccuggguga

SEQ ID NO: 4725 - RNA, 22 nt, Human
cuccuaggcuggagugcagugg

SEQ ID NO: 4726 - RNA, 22 nt, Human
cucagugguucagacacuguuu

SEQ ID NO: 4727 - RNA, 22 nt, Human
acugcacuccagccuggcaaca

SEQ ID NO: 4728 - RNA, 22 nt, Human
acaaggcagggcaggugucugu

SEQ ID NO: 4729 - RNA, 22 nt, Human
acugcacuccagccugggcgau

SEQ ID NO: 4730 - RNA, 22 nt, Human
acuguacuccagccugggugac

SEQ ID NO: 4731 - RNA, 22 nt, Human
acugcacuccagccugggugau

SEQ ID NO: 4732 - RNA, 22 nt, Human
acugcacuccagccuggguggc

SEQ ID NO: 4733 - RNA, 22 nt, Human
acugcacuccagccuggcgaca

SEQ ID NO: 4734 - RNA, 22 nt, Human
acugcacuccagccugggugac

SEQ ID NO: 4735 - RNA, 22 nt, Human
auugcacuucagccugggugac

SEQ ID NO: 4736 - RNA, 22 nt, Human
agaagguuggggcuggaggucu

SEQ ID NO: 4737 - RNA, 22 nt, Human
acuguacuucagccuggguaac

SEQ ID NO: 4738 - RNA, 19 nt, Human
gcugaaaagugcuuugcug

SEQ ID NO: 4739 - RNA, 20 nt, Human
agcuccuucuuucugcaaca

SEQ ID NO: 4740 - RNA, 23 nt, Human
agugcuuugcuggaguccuguuc

SEQ ID NO: 4741 - RNA, 21 nt, Human
cuccuccagcuccuucuuucu

SEQ ID NO: 4742 - RNA, 22 nt, Human
aagugcuuugcuggaguccugu

SEQ ID NO: 4743 - RNA, 18 nt, Human
ccuguucucugagcucca

SEQ ID NO: 4744 - RNA, 27 nt, Human
ccucucaaggcccugaccucaggggcc

SEQ ID NO: 4745 - RNA, 27 nt, Human
cugggcccuguccagggcagugagucc

SEQ ID NO: 4746 - RNA, 23 nt, Human
gaccucucaaggcccugaccuca

SEQ ID NO: 4747 - RNA, 24 nt, Human
cccagccucugagucccguggggc

SEQ ID NO: 4748 - RNA, 26 nt, Human
cccucgggccgggcaccacccccagu

SEQ ID NO: 4749 - RNA, 23 nt, Human
gggggagcugucugcggagccag

SEQ ID NO: 4750 - RNA, 24 nt, Human
ggagagggacgcacagcacugccu

SEQ ID NO: 4751 - RNA, 25 nt, Human
gggagagggacgcacagcacugccu

SEQ ID NO: 4752 - RNA, 24 nt, Human
agagccccaaagaucccacgggag

SEQ ID NO: 4753 - RNA, 27 nt, Human
auccucucccccacaagagccccaaag

SEQ ID NO: 4754 - RNA, 22 nt, Human
auccuuccagccaccugccuca

SEQ ID NO: 4755 - RNA, 26 nt, Human
auucguagccaucuccguggccaaug

SEQ ID NO: 4756 - RNA, 27 nt, Human
gggggccuaaagcgacagucucagggg

SEQ ID NO: 4757 - RNA, 27 nt, Human
ucccuccagagacucgaguccccauga

SEQ ID NO: 4758 - RNA, 20 nt, Human
ugaggguggucagccaaggc

SEQ ID NO: 4759 - RNA, 23 nt, Human
ugggacccacagucacacagagc

SEQ ID NO: 4760 - RNA, 28 nt, Human
cuccagggugccuccaccugcacaaccg

SEQ ID NO: 4761 - RNA, 21 nt, Human
cucucaaggcccugaccucag

SEQ ID NO: 4762 - RNA, 20 nt, Human
cuuccagccaccugccucaa

SEQ ID NO: 4763 - RNA, 22 nt, Human
caauccuuccagccaccugccu

SEQ ID NO: 4764 - RNA, 23 nt, Human
caccauguucccagcucagugcc

SEQ ID NO: 4765 - RNA, 25 nt, Human
cagggcacugacaggacaggagagc

SEQ ID NO: 4766 - RNA, 26 nt, Human
ccagggcacugacaggacaggagagc

SEQ ID NO: 4767 - RNA, 28 nt, Human
ccuccagggugccuccaccugcacaacc

SEQ ID NO: 4768 - RNA, 24 nt, Human
agggggagcugucugcggagccag

SEQ ID NO: 4769 - RNA, 24 nt, Human
uguccagggcagugaguccucuac

SEQ ID NO: 4770 - RNA, 17 nt, Human
ggagagggacgcacagc

SEQ ID NO: 4771 - RNA, 24 nt, Human
ggagaggggagagggacgcacagc

SEQ ID NO: 4772 - RNA, 18 nt, Human
gaugccauaaaagccgcc

SEQ ID NO: 4773 - RNA, 26 nt, Human
gcccugaccucaggggccagggcacu

SEQ ID NO: 4774 - RNA, 27 nt, Human
gcccugucccugucccccuccccuccc

SEQ ID NO: 4775 - RNA, 22 nt, Human
gcccccacuaggcacuguggcu

SEQ ID NO: 4776 - RNA, 21 nt, Human
gcagugagccaagaucgcacc

SEQ ID NO: 4777 - RNA, 25 nt, Human
gcacacggcugccugacacugagcc

SEQ ID NO: 4778 - RNA, 21 nt, Human
gcacaaaagggacuuggaaaa

SEQ ID NO: 4779 - RNA, 22 nt, Human
ggagcucagcaacaaggcugca

SEQ ID NO: 4780 - RNA, 27 nt, Human
ggaggcugcagugagccaagaucgcac

SEQ ID NO: 4781 - RNA, 23 nt, Human
ggcaggagaaucacuggaaccug

SEQ ID NO: 4782 - RNA, 25 nt, Human
gcugagacauucuucaccuccuugg

SEQ ID NO: 4783 - RNA, 23 nt, Human
gcugaggcaggagaaucacugga

SEQ ID NO: 4784 - RNA, 21 nt, Human
ugucaugucucugguggugcu

SEQ ID NO: 4785 - RNA, 21 nt, Human
ugcugcugggccucugccuug

SEQ ID NO: 4786 - RNA, 23 nt, Human
uggagcucagcaacaaggcugca

SEQ ID NO: 4787 - RNA, 20 nt, Human
ugggagccggaggcugcagu

SEQ ID NO: 4788 - RNA, 23 nt, Human
uccuggagaacacguuggcucag

SEQ ID NO: 4789 - RNA, 22 nt, Human
ucugacauuuauccaagaccug

SEQ ID NO: 4790 - RNA, 20 nt, Human
ucuucaugaccuacuucaaa

SEQ ID NO: 4791 - RNA, 26 nt, Human
ugagccaagaucgcaccauugcacuc

SEQ ID NO: 4792 - RNA, 31 nt, Human
ugcaggcugcagucccuggaaaaacagucac

SEQ ID NO: 4793 - RNA, 20 nt, Human
aggccucugacauuuaucca

SEQ ID NO: 4794 - RNA, 22 nt, Human
aucagccuggccaucuggauuu

SEQ ID NO: 4795 - RNA, 27 nt, Human
aucagccuggccaucuggauuuucaca

SEQ ID NO: 4796 - RNA, 23 nt, Human
augaggucaauuuccugaugcau

SEQ ID NO: 4797 - RNA, 21 nt, Human
auuccugagucugaagcugga

SEQ ID NO: 4798 - RNA, 24 nt, Human
uucaccuccuuggcgcugccaccu

SEQ ID NO: 4799 - RNA, 24 nt, Human
uucugcagguacuuccucagucug

SEQ ID NO: 4800 - RNA, 21 nt, Human
uuguccugaugcugugcucaa

SEQ ID NO: 4801 - RNA, 27 nt, Human
agccuccuugucuauccuuccuccccc

SEQ ID NO: 4802 - RNA, 21 nt, Human
ccgccagaucugcaccaccuu

SEQ ID NO: 4803 - RNA, 21 nt, Human
ccauugcacuccagcugggag

SEQ ID NO: 4804 - RNA, 27 nt, Human
ccauugcacuccagcugggagacacag

SEQ ID NO: 4805 - RNA, 18 nt, Human
cccacaagcaccugcuca

SEQ ID NO: 4806 - RNA, 21 nt, Human
cccagcccacccugcuccucc

SEQ ID NO: 4807 - RNA, 21 nt, Human
cauugcacuccagcugggaga

SEQ ID NO: 4808 - RNA, 24 nt, Human
cauugcacuccagcugggagacac

SEQ ID NO: 4809 - RNA, 27 nt, Human
cauugcacuccagcugggagacacagc

SEQ ID NO: 4810 - RNA, 21 nt, Human
caaucaggagugguggaaccu

SEQ ID NO: 4811 - RNA, 26 nt, Human
cugggagccggaggcugcagugagcc

SEQ ID NO: 4812 - RNA, 22 nt, Human
cugggcuuugucaugucucugg

SEQ ID NO: 4813 - RNA, 22 nt, Human
cugaggcaggagaaucacugga

SEQ ID NO: 4814 - RNA, 24 nt, Human
gaaucacuggaaccugggagccgg

SEQ ID NO: 4815 - RNA, 26 nt, Human
cucuccaucuuccacgaaaugggcca

SEQ ID NO: 4816 - RNA, 27 nt, Human
cuccaucuuccacgaaaugggccauuc

SEQ ID NO: 4817 - RNA, 24 nt, Human
ugggaacacuggugggcagcugag

SEQ ID NO: 4818 - RNA, 22 nt, Human
ugggagccggaggcugcaguga

SEQ ID NO: 4819 - RNA, 25 nt, Human
ugggccauuccaguacuuccugcag

SEQ ID NO: 4820 - RNA, 27 nt, Human
uucaaaccccuacugaccuggcuggug

SEQ ID NO: 4821 - RNA, 26 nt, Human
uuggaagaggcugagacauucuucac

SEQ ID NO: 4822 - RNA, 22 nt, Human
ugcagugagccaagaucgcacc

SEQ ID NO: 4823 - RNA, 20 nt, Human
ugagaaagagaaugagaaga

SEQ ID NO: 4824 - RNA, 19 nt, Human
ugcuucaguccacuucugc

SEQ ID NO: 4825 - RNA, 25 nt, Human
uccaucaucuuccgcgcaggugcca

SEQ ID NO: 4826 - RNA, 21 nt, Human
uacugaccuggcuggugacag

SEQ ID NO: 4827 - RNA, 25 nt, Human
ucauggccaccuccagggacaaaga

SEQ ID NO: 4828 - RNA, 27 nt, Human
gggggcccaucccugcccaccuccugg

SEQ ID NO: 4829 - RNA, 21 nt, Human
gucaugucucugguggugcug

SEQ ID NO: 4830 - RNA, 22 nt, Human
ccaagaucgcaccauugcacuc

SEQ ID NO: 4831 - RNA, 23 nt, Human
ccaucaucuuccgcgcaggugcc

SEQ ID NO: 4832 - RNA, 22 nt, Human
gggagccggaggcugcagugag

SEQ ID NO: 4833 - RNA, 21 nt, Human
caccauugcacuccagcuggg

SEQ ID NO: 4834 - RNA, 27 nt, Human
cacuaggcacuguggcucugcaugaca

SEQ ID NO: 4835 - RNA, 22 nt, Human
agaggcugcugcagacaagugg

SEQ ID NO: 4836 - RNA, 22 nt, Human
aggcugaggcaggagaaucacu

SEQ ID NO: 4837 - RNA, 24 nt, Human
aggcuggccagacuucagcuguuc

SEQ ID NO: 4838 - RNA, 22 nt, Human
acacaccccacaccccagccca

SEQ ID NO: 4839 - RNA, 24 nt, Human
acacuggugggcagcugaggacac

SEQ ID NO: 4840 - RNA, 31 nt, Human
acauaggccugcucagccucuagcaccagga

SEQ ID NO: 4841 - RNA, 27 nt, Human
accagccuguccaacagaggggcagcc

SEQ ID NO: 4842 - RNA, 27 nt, Human
accauuguaaaguuuaugucaccagaa

SEQ ID NO: 4843 - RNA, 22 nt, Human
acugacucaagacacugagaua

SEQ ID NO: 4844 - RNA, 19 nt, Human
gggagccggaggcugcagu

SEQ ID NO: 4845 - RNA, 22 nt, Human
ggcugcugcagacaaguggaca

SEQ ID NO: 4846 - RNA, 23 nt, Human
ggcuggccagacuucagcuguuc

SEQ ID NO: 4847 - RNA, 22 nt, Human
ggaggcugaggcaggagaauca

SEQ ID NO: 4848 - RNA, 21 nt, Human
ggaugugaauggcaugcugaa

SEQ ID NO: 4849 - RNA, 21 nt, Human
gcucuccaucuuccacgaaau

SEQ ID NO: 4850 - RNA, 23 nt, Human
gcugggagacacagcaagacucc

SEQ ID NO: 4851 - RNA, 27 nt, Human
gaugcucuaaagcugggcucaagcaag

SEQ ID NO: 4852 - RNA, 22 nt, Human
gaccagccuguccaacagaggg

SEQ ID NO: 4853 - RNA, 22 nt, Human
cuuguccugaugcugugcucaa

SEQ ID NO: 4854 - RNA, 23 nt, Human
cugggagccggaggcugcaguga

SEQ ID NO: 4855 - RNA, 27 nt, Human
cuccuugucuauccuuccucccccacc

SEQ ID NO: 4856 - RNA, 25 nt, Human
cucugcucuccugcggccaugggcc

SEQ ID NO: 4857 - RNA, 21 nt, Human
cugagccuccuugucuauccu

SEQ ID NO: 4858 - RNA, 21 nt, Human
ccuacuucaaaccccuacuga

SEQ ID NO: 4859 - RNA, 27 nt, Human
cuuuguuguuugaauggaaauggaaaa

SEQ ID NO: 4860 - RNA, 26 nt, Human
ccccgccucugcccucauccucccuc

SEQ ID NO: 4861 - RNA, 19 nt, Human
gccaguauucuuuuauaaa

SEQ ID NO: 4862 - RNA, 25 nt, Human
accguggggaagggccccacucagg

SEQ ID NO: 4863 - RNA, 19 nt, Human
agugcucccuuccuccuca

SEQ ID NO: 4864 - RNA, 31 nt, Human
auacuauuuauuucagggcugggcuauaaca

SEQ ID NO: 4865 - RNA, 22 nt, Human
ggucgccugcauuucuccgugc

SEQ ID NO: 4866 - RNA, 20 nt, Human
uagugcucccuuccuccuca

SEQ ID NO: 4867 - RNA, 22 nt, Human
uauuuauuucagggcugggcua

SEQ ID NO: 4868 - RNA, 24 nt, Human
ugaguggucggaccguggggaagg

SEQ ID NO: 4869 - RNA, 23 nt, Human
cauccucccucucgucuuucgca

SEQ ID NO: 4870 - RNA, 23 nt, Human
caucggccgccuccagcucccgg

SEQ ID NO: 4871 - RNA, 18 nt, Human
ccaguauucuuuuauaaa

SEQ ID NO: 4872 - RNA, 23 nt, Human
ccgguccucuggcaugucuucag

SEQ ID NO: 4873 - RNA, 21 nt, Human
auccccaccccaccccgacgu

SEQ ID NO: 4874 - RNA, 23 nt, Human
gcuccuccccgcgugccuucgcc

SEQ ID NO: 4875 - RNA, 32 nt, Human
gccaaagcauggguuucaacacguuuuguauu

SEQ ID NO: 4876 - RNA, 23 nt, Human
uccagagagcagggaacuaccuu

SEQ ID NO: 4877 - RNA, 19 nt, Human
ccacagcuugcuaguucug

SEQ ID NO: 4878 - RNA, 25 nt, Human
auuuuucuaaacgcuuacagauucc

SEQ ID NO: 4879 - RNA, 22 nt, Human
uaguguuugcauuccugguuau

SEQ ID NO: 4880 - RNA, 25 nt, Human
uacugcacucugcuguuagaagcag

SEQ ID NO: 4881 - RNA, 28 nt, Human
uccagagagcagggaacuaccuugagua

SEQ ID NO: 4882 - RNA, 21 nt, Human
uaaaucacaggaagaagcggc

SEQ ID NO: 4883 - RNA, 21 nt, Human
cagcccaguaggagucaugua

SEQ ID NO: 4884 - RNA, 20 nt, Human
acucaaacuuaugucucaga

SEQ ID NO: 4885 - RNA, 22 nt, Human
aaggcugaguccacacugcaag

SEQ ID NO: 4886 - RNA, 21 nt, Human
ggugcuggugacuuucuguuc

SEQ ID NO: 4887 - RNA, 23 nt, Human
gaaggcugaguccacacugcaag

SEQ ID NO: 4888 - RNA, 26 nt, Human
cuucauaaucaaauauaugacauaua

SEQ ID NO: 4889 - RNA, 21 nt, Human
ccugguuauauguaaugugau

SEQ ID NO: 4890 - RNA, 23 nt, Human
uaccuaggagcuguggauguaau

SEQ ID NO: 4891 - RNA, 22 nt, Human
uauucuacucaaacuuaugucu

SEQ ID NO: 4892 - RNA, 26 nt, Human
uaguaauccugccaaaugugccuauu

SEQ ID NO: 4893 - RNA, 27 nt, Human
uauauuuucacaacuacuuucucucuc

SEQ ID NO: 4894 - RNA, 19 nt, Human
uaacuggaggauucagcac

SEQ ID NO: 4895 - RNA, 21 nt, Human
ccuugcaauauagaaaaacuu

SEQ ID NO: 4896 - RNA, 23 nt, Human
cugcuucucuuacuauacucaua

SEQ ID NO: 4897 - RNA, 23 nt, Human
aaaaauucauaguaauccugcca

SEQ ID NO: 4898 - RNA, 21 nt, Human
gugaacaaagggaaaauucua

SEQ ID NO: 4899 - RNA, 22 nt, Human
acaaaauuuauuuuuauuuuuu

SEQ ID NO: 4900 - RNA, 25 nt, Human
aaaaagugguuaauauuaauaagac

SEQ ID NO: 4901 - RNA, 19 nt, Human
aaaccuuugacugccugua

SEQ ID NO: 4902 - RNA, 26 nt, Human
aagacuguuuccacaccauaggcaau

SEQ ID NO: 4903 - RNA, 20 nt, Human
acuauauuacaucauuucag

SEQ ID NO: 4904 - RNA, 22 nt, Human
acugaucacuauauuacaucau

SEQ ID NO: 4905 - RNA, 17 nt, Human
acugucucccccuuguc

SEQ ID NO: 4906 - RNA, 20 nt, Human
acugucucccccuugucacc

SEQ ID NO: 4907 - RNA, 22 nt, Human
acuuaaaaccuuugacugccug

SEQ ID NO: 4908 - RNA, 20 nt, Human
uacucugcuucucuuacuau

SEQ ID NO: 4909 - RNA, 24 nt, Human
gugaugauuuucagaaaguuguug

SEQ ID NO: 4910 - RNA, 22 nt, Human
gugcaaagagaauuaggagaga

SEQ ID NO: 4911 - RNA, 32 nt, Human
uauauuuucacaacuacuuucucucuccagag

SEQ ID NO: 4912 - RNA, 27 nt, Human
uucaguauuuucuuaagaaauugcuuu

SEQ ID NO: 4913 - RNA, 26 nt, Human
caaauuaaugcauaauuucagaugua

SEQ ID NO: 4914 - RNA, 21 nt, Human
cagcaaguuuucuaucauguc

SEQ ID NO: 4915 - RNA, 21 nt, Human
ccagugccauuugucugugca

SEQ ID NO: 4916 - RNA, 24 nt, Human
cccaacaacauuaaaaaauacucg

SEQ ID NO: 4917 - RNA, 23 nt, Human
ccugguucuauuaaaauauccau

SEQ ID NO: 4918 - RNA, 27 nt, Human
gaaaugaggccuguacaaggcugauaa

SEQ ID NO: 4919 - RNA, 21 nt, Human
ucuccaccuuuuucuuaugag

SEQ ID NO: 4920 - RNA, 27 nt, Human
ucuccaccuuuuucuuaugagucucac

SEQ ID NO: 4921 - RNA, 21 nt, Human
ucugcagcuauuucaacuucc

SEQ ID NO: 4922 - RNA, 21 nt, Human
aucucaguguaucuagucacu

SEQ ID NO: 4923 - RNA, 26 nt, Human
aguuugaauaguuagacauggaaauu

SEQ ID NO: 4924 - RNA, 27 nt, Human
augggcagaaucugcucucugugacca

SEQ ID NO: 4925 - RNA, 22 nt, Human
uuuccauuguugcaucuugaau

SEQ ID NO: 4926 - RNA, 27 nt, Human
gccuauuguuaaagauuugcaugugaa

SEQ ID NO: 4927 - RNA, 26 nt, Human
gcacacaccuaaagauaucuuuuuag

SEQ ID NO: 4928 - RNA, 22 nt, Human
gagcaauuaaaccacuauucca

SEQ ID NO: 4929 - RNA, 18 nt, Human
aacacugaugaauguaaa

SEQ ID NO: 4930 - RNA, 23 nt, Human
aaccuauaugugauggagaucac

SEQ ID NO: 4931 - RNA, 23 nt, Human
aauucagagaaauggaguguuca

SEQ ID NO: 4932 - RNA, 25 nt, Human
ucuccuguauaaccccaccuugcca

SEQ ID NO: 4933 - RNA, 26 nt, Human
cucuccuguauaaccccaccuugcca

SEQ ID NO: 4934 - RNA, 25 nt, Human
uggaaggaagcaggauggcagccgg

SEQ ID NO: 4935 - RNA, 26 nt, Human
caccuugccaagcuuucuucuacaac

SEQ ID NO: 4936 - RNA, 20 nt, Human
gcaggcgagaguaguacugg

SEQ ID NO: 4937 - RNA, 21 nt, Human
ggcaggcgagaguaguacugg

SEQ ID NO: 4938 - RNA, 25 nt, Human
ggcuuaaagcauccuccuccuggac

SEQ ID NO: 4939 - RNA, 19 nt, Human
gauccccuggaaacccacc

SEQ ID NO: 4940 - RNA, 28 nt, Human
gugccuaaaacccaguugcugaucccug

SEQ ID NO: 4941 - RNA, 23 nt, Human
guggccaggcaggcgggggcugc

SEQ ID NO: 4942 - RNA, 23 nt, Human
cccuccagcaccacuuuggcuua

SEQ ID NO: 4943 - RNA, 22 nt, Human
cugcccucucugcgcugaggcc

SEQ ID NO: 4944 - RNA, 22 nt, Human
cucuccucuucgugguuguguu

SEQ ID NO: 4945 - RNA, 21 nt, Human
auccugagagaccugcccucu

SEQ ID NO: 4946 - RNA, 21 nt, Human
aggcagcagcggcuggagcgg

SEQ ID NO: 4947 - RNA, 24 nt, Human
acucccuugaggauggagagcagc

SEQ ID NO: 4948 - RNA, 25 nt, Human
uggcgcuggaggcagcagcggcugg

SEQ ID NO: 4949 - RNA, 21 nt, Human
ccaaccuuaaaccucuucuau

SEQ ID NO: 4950 - RNA, 27 nt, Human
ccaggauaaaaggggaaauaacugccu

SEQ ID NO: 4951 - RNA, 23 nt, Human
ccugcucccaccaccagugagac

SEQ ID NO: 4952 - RNA, 18 nt, Human
cucuucgugguuguguuu

SEQ ID NO: 4953 - RNA, 22 nt, Human
cagacuucuuaaaaggagcucg

SEQ ID NO: 4954 - RNA, 21 nt, Human
ugcuugagggagaauccuccc

SEQ ID NO: 4955 - RNA, 22 nt, Human
ugagccaaccuuaaaccucuuc

SEQ ID NO: 4956 - RNA, 27 nt, Human
agccaaccuuaaaccucuucuauugcu

SEQ ID NO: 4957 - RNA, 19 nt, Human
aggauggagagcagccagc

SEQ ID NO: 4958 - RNA, 21 nt, Human
uucuugugucuggagauucug

SEQ ID NO: 4959 - RNA, 25 nt, Human
ugucuucucccugcacaagccaggg

SEQ ID NO: 4960 - RNA, 22 nt, Human
ugacuaaugaccacaccugccu

SEQ ID NO: 4961 - RNA, 20 nt, Human
caacaugaaaacuccauauu

SEQ ID NO: 4962 - RNA, 22 nt, Human
cagcccagccacggacgcuggc

SEQ ID NO: 4963 - RNA, 26 nt, Human
cugucuucucccugcacaagccaggg

SEQ ID NO: 4964 - RNA, 18 nt, Human
gccagccgugagugcaga

SEQ ID NO: 4965 - RNA, 27 nt, Human
ggcccccacaauggucccaaacagcug

SEQ ID NO: 4966 - RNA, 24 nt, Human
ucuaggguuuuccaaugugacuaa

SEQ ID NO: 4967 - RNA, 23 nt, Human
acuguccuguggacagacggggu

SEQ ID NO: 4968 - RNA, 22 nt, Human
acucauuuuaguggcugccucc

SEQ ID NO: 4969 - RNA, 22 nt, Human
augauggccacaacaugaaaac

SEQ ID NO: 4970 - RNA, 17 nt, Human
caaaggagagucacaga

SEQ ID NO: 4971 - RNA, 17 nt, Human
cugccucucccgucguc

SEQ ID NO: 4972 - RNA, 17 nt, Human
ggguuuuccaaugugac

SEQ ID NO: 4973 - RNA, 22 nt, Human
gcugccucugccacugacugca

SEQ ID NO: 4974 - RNA, 20 nt, Human
guuuguaaagcguuccaagu

SEQ ID NO: 4975 - RNA, 20 nt, Human
ggccccagggaacuaaaggg

SEQ ID NO: 4976 - RNA, 27 nt, Human
ggagugguaacaagaggagcaggaagc

SEQ ID NO: 4977 - RNA, 26 nt, Human
gggugugggucagggaggggucuaga

SEQ ID NO: 4978 - RNA, 27 nt, Human
cccugcuccaugggcaccucugcugua

SEQ ID NO: 4979 - RNA, 24 nt, Human
aucuaaucccuucaaggaagugau

SEQ ID NO: 4980 - RNA, 23 nt, Human
aggcuauuccuaggccucaggcc

SEQ ID NO: 4981 - RNA, 22 nt, Human
ggcuauuccuaggccucaggcc

SEQ ID NO: 4982 - RNA, 21 nt, Human
gggucccuucccccugcucca

SEQ ID NO: 4983 - RNA, 23 nt, Human
gccaggccucauccuccuggacc

SEQ ID NO: 4984 - RNA, 21 nt, Human
cuacgguucccugccuaggag

SEQ ID NO: 4985 - RNA, 19 nt, Human
cagggaggggucuagaggc

SEQ ID NO: 4986 - RNA, 27 nt, Human
cccuucccccugcuccaugggcaccuc

SEQ ID NO: 4987 - RNA, 25 nt, Human
ccucagccagagaacuagagcagaa

SEQ ID NO: 4988 - RNA, 25 nt, Human
ccucccaaaugcaggaaaaaauaug

SEQ ID NO: 4989 - RNA, 21 nt, Human
cccaccccuccuagugaacua

SEQ ID NO: 4990 - RNA, 27 nt, Human
cccagcuccccggaugaaacagauaua

SEQ ID NO: 4991 - RNA, 23 nt, Human
ccaacuggcagcuuucccugaca

SEQ ID NO: 4992 - RNA, 23 nt, Human
cacaucccaacaggaacgacuca

SEQ ID NO: 4993 - RNA, 23 nt, Human
cuacagcuguuugugggauguug

SEQ ID NO: 4994 - RNA, 20 nt, Human
cguccuuggaaugaaugaug

SEQ ID NO: 4995 - RNA, 21 nt, Human
ccuggcaccgagcgaugagga

SEQ ID NO: 4996 - RNA, 23 nt, Human
cuguaaaaauaggauggcgaguu

SEQ ID NO: 4997 - RNA, 22 nt, Human
cucugccaacaucaagcuggug

SEQ ID NO: 4998 - RNA, 26 nt, Human
gaaguuagaggguaaagagccccacc

SEQ ID NO: 4999 - RNA, 21 nt, Human
gaaacuucaaaauugaugaaa

SEQ ID NO: 5000 - RNA, 26 nt, Human
ugacaccuuggcaguguuuauggcca

SEQ ID NO: 5001 - RNA, 26 nt, Human
uccagcuggacaacguugucccaaga

SEQ ID NO: 5002 - RNA, 27 nt, Human
ucccaaaacagcauuuuccugcuccuu

SEQ ID NO: 5003 - RNA, 24 nt, Human
ugucuucuuggcuggaccugucac

SEQ ID NO: 5004 - RNA, 21 nt, Human
uguggucggaucugcccagcc

SEQ ID NO: 5005 - RNA, 24 nt, Human
ugggugggacauauuucaaacuuc

SEQ ID NO: 5006 - RNA, 22 nt, Human
uguaaaaauaggauggcgaguu

SEQ ID NO: 5007 - RNA, 23 nt, Human
ugcugaugcuuugucuucagaga

SEQ ID NO: 5008 - RNA, 23 nt, Human
uuuuccauuuuacuuugaagauu

SEQ ID NO: 5009 - RNA, 31 nt, Human
augcagaucuggaaaccucagccagagaacu

SEQ ID NO: 5010 - RNA, 23 nt, Human
auguucucucgucuugccaccau

SEQ ID NO: 5011 - RNA, 20 nt, Human
aguucuguaacgccaucucc

SEQ ID NO: 5012 - RNA, 27 nt, Human
aucucccaccccagagaacgaggauuu

SEQ ID NO: 5013 - RNA, 25 nt, Human
gcccagccacaccaccaaacacccu

SEQ ID NO: 5014 - RNA, 27 nt, Human
gcacagccccugcugggaaauggcucu

SEQ ID NO: 5015 - RNA, 21 nt, Human
gcucuaucccccucugaugcu

SEQ ID NO: 5016 - RNA, 21 nt, Human
gcuagagguaaacguucugcu

SEQ ID NO: 5017 - RNA, 25 nt, Human
aaagagccccacccacaggauuccu

SEQ ID NO: 5018 - RNA, 21 nt, Human
aaagcugaggcugacaauaau

SEQ ID NO: 5019 - RNA, 26 nt, Human
guaccaaagaccugggaaaacuaacc

SEQ ID NO: 5020 - RNA, 26 nt, Human
ccaguuuaaaagaguuugaaggagca

SEQ ID NO: 5021 - RNA, 21 nt, Human
ccaaaacagcauuuuccugcu

SEQ ID NO: 5022 - RNA, 24 nt, Human
ucccagcccaggagaacuaagagc

SEQ ID NO: 5023 - RNA, 27 nt, Human
uccucaucagccuuucauccuuaguuu

SEQ ID NO: 5024 - RNA, 22 nt, Human
uagucuuguuuacuucuucuua

SEQ ID NO: 5025 - RNA, 26 nt, Human
ugcagcuagagaauuauaguucacua

SEQ ID NO: 5026 - RNA, 19 nt, Human
agcauuuuccugcuccuuc

SEQ ID NO: 5027 - RNA, 27 nt, Human
agcauuuuccugcuccuucguauguag

SEQ ID NO: 5028 - RNA, 19 nt, Human
agccccacugcagucauca

SEQ ID NO: 5029 - RNA, 20 nt, Human
agccuuucauccuuaguuug

SEQ ID NO: 5030 - RNA, 21 nt, Human
caacaaauuacauuagguuga

SEQ ID NO: 5031 - RNA, 22 nt, Human
cagaccccaguccagcccugaa

SEQ ID NO: 5032 - RNA, 22 nt, Human
agaauuauaguucacuauggcc

SEQ ID NO: 5033 - RNA, 20 nt, Human
acagcauuuuccugcuccuu

SEQ ID NO: 5034 - RNA, 19 nt, Human
acacauggacaccauuuca

SEQ ID NO: 5035 - RNA, 19 nt, Human
aauacuccucaucagccuu

SEQ ID NO: 5036 - RNA, 27 nt, Human
ugugauuuuugcuaguccaugugcuag

SEQ ID NO: 5037 - RNA, 19 nt, Human
uguuguccaggcagcucau

SEQ ID NO: 5038 - RNA, 23 nt, Human
guaguaucaacagugacccagaa

SEQ ID NO: 5039 - RNA, 24 nt, Human
guugaaccuuuccuugauuuuaug

SEQ ID NO: 5040 - RNA, 20 nt, Human
gucuucuuggcuggaccugu

SEQ ID NO: 5041 - RNA, 26 nt, Human
guucugcuggaauucugcauccagcu

SEQ ID NO: 5042 - RNA, 21 nt, Human
ggaauucugcauccagcucua

SEQ ID NO: 5043 - RNA, 22 nt, Human
gaucuccaggguucuaggaaag

SEQ ID NO: 5044 - RNA, 23 nt, Human
gcauuuugggugggacauauuuc

SEQ ID NO: 5045 - RNA, 22 nt, Human
ucauccagcccagaaaccaaga

SEQ ID NO: 5046 - RNA, 21 nt, Human
cuggucacugcuucugcuaua

SEQ ID NO: 5047 - RNA, 21 nt, Human
cccucauccuggucacugcuu

SEQ ID NO: 5048 - RNA, 30 nt, Human
acaucugcagucuuucuucuuugaauuucc

SEQ ID NO: 5049 - RNA, 26 nt, Human
uguugucugcuacccucauccugguc

SEQ ID NO: 5050 - RNA, 20 nt, Human
ucugcuacccucauccuggu

SEQ ID NO: 5051 - RNA, 22 nt, Human
cuagggggacagccacuguguu

SEQ ID NO: 5052 - RNA, 21 nt, Human
auucacccucucauguuuccc

SEQ ID NO: 5053 - RNA, 20 nt, Human
ccuccccucuuccuggagcc

SEQ ID NO: 5054 - RNA, 21 nt, Human
uccccacguggcaccuccuca

SEQ ID NO: 5055 - RNA, 27 nt, Human
uccucaccuuaauuuauuuuuuaaguu

SEQ ID NO: 5056 - RNA, 22 nt, Human
ggccgggcgggagugcagggga

SEQ ID NO: 5057 - RNA, 23 nt, Human
gccgggccgggcgggagugcagg

SEQ ID NO: 5058 - RNA, 21 nt, Human
acucccagccuagggcagcag

SEQ ID NO: 5059 - RNA, 25 nt, Human
agggcagcagggagucuugaaguga

SEQ ID NO: 5060 - RNA, 24 nt, Human
gggcagcagggagucuugaaguga

SEQ ID NO: 5061 - RNA, 21 nt, Human
gggccgggcgggagugcaggg

SEQ ID NO: 5062 - RNA, 22 nt, Human
cuagggcagcagggagucuuga

SEQ ID NO: 5063 - RNA, 24 nt, Human
ggaaauucuuauuuccccuuucca

SEQ ID NO: 5064 - RNA, 17 nt, Human
gcucacugcuucugcuu

SEQ ID NO: 5065 - RNA, 19 nt, Human
gcucacugcuucugcuuuu

SEQ ID NO: 5066 - RNA, 22 nt, Human
gacuauauaaaguacuacugua

SEQ ID NO: 5067 - RNA, 22 nt, Human
cgucuucuagagagcuuagugu

SEQ ID NO: 5068 - RNA, 24 nt, Human
cuccacccccuccugucaccggcc

SEQ ID NO: 5069 - RNA, 20 nt, Human
ccgcugcugcuuuccuucgg

SEQ ID NO: 5070 - RNA, 24 nt, Human
ccucuacuuuguccccucaccucc

SEQ ID NO: 5071 - RNA, 26 nt, Human
cuggauaccugugugucuccauaaaa

SEQ ID NO: 5072 - RNA, 27 nt, Human
uacuacuguagaacugcaauuuccauu

SEQ ID NO: 5073 - RNA, 24 nt, Human
uacuacuguagaacugcaauuucc

SEQ ID NO: 5074 - RNA, 26 nt, Human
ccagugcuuccacagagauuagccug

SEQ ID NO: 5075 - RNA, 26 nt, Human
ugaaacugagucuguggacacugugg

SEQ ID NO: 5076 - RNA, 17 nt, Human
ucugacauccugaccuc

SEQ ID NO: 5077 - RNA, 26 nt, Human
ugcugagaaaugggguggaauaggga

SEQ ID NO: 5078 - RNA, 25 nt, Human
ucaacucuucagccucauucacugu

SEQ ID NO: 5079 - RNA, 21 nt, Human
augcuuguacaguugaugucg

SEQ ID NO: 5080 - RNA, 22 nt, Human
auuguauugucugacacaugcu

SEQ ID NO: 5081 - RNA, 27 nt, Human
acugagucuguggacacuguggaaagc

SEQ ID NO: 5082 - RNA, 21 nt, Human
uuguauugucugacacaugcu

SEQ ID NO: 5083 - RNA, 22 nt, Human
gagucuguggacacuguggaaa

SEQ ID NO: 5084 - RNA, 25 nt, Human
gaggaguccgagugugugagcuuga

SEQ ID NO: 5085 - RNA, 18 nt, Human
gcucacugcuucugcuuu

SEQ ID NO: 5086 - RNA, 21 nt, Human
ugggguggaauagggaacugu

SEQ ID NO: 5087 - RNA, 19 nt, Human
ugcucacugcuucugcuuu

SEQ ID NO: 5088 - RNA, 21 nt, Human
uugucugacacaugcucucaa

SEQ ID NO: 5089 - RNA, 26 nt, Human
ccucauucacuguccuggcuuuuauu

SEQ ID NO: 5090 - RNA, 25 nt, Human
ccuccacccccuccugucaccggcc

SEQ ID NO: 5091 - RNA, 17 nt, Human
accaauaaaaauccuac

SEQ ID NO: 5092 - RNA, 23 nt, Human
agcgccugugcugaggacucccg

SEQ ID NO: 5093 - RNA, 22 nt, Human
ggugacauccaggaggggccuc

SEQ ID NO: 5094 - RNA, 20 nt, Human
ccuccagcaaggauucagga

SEQ ID NO: 5095 - RNA, 27 nt, Human
cccuccagcaaggauucaggagugccc

SEQ ID NO: 5096 - RNA, 26 nt, Human
gacucaugggaccugaagggugacau

SEQ ID NO: 5097 - RNA, 15 nt, Human
ggcggaucccacucg

SEQ ID NO: 5098 - RNA, 22 nt, Human
uacuacauuauuaauggguuuu

SEQ ID NO: 5099 - RNA, 27 nt, Human
gggcggguggggaggggugcucugcug

SEQ ID NO: 5100 - RNA, 22 nt, Human
cauguaaauaaauacauucuug

SEQ ID NO: 5101 - RNA, 23 nt, Human
ucccuguucauuguaagcacuuu

SEQ ID NO: 5102 - RNA, 23 nt, Human
ucucuauacuacauuauuaaugg

SEQ ID NO: 5103 - RNA, 20 nt, Human
ucucuccugauuauuuauca

SEQ ID NO: 5104 - RNA, 24 nt, Human
aucccuguucauuguaagcacuuu

SEQ ID NO: 5105 - RNA, 19 nt, Human
acggggcggguggggaggg

SEQ ID NO: 5106 - RNA, 22 nt, Human
uuggguggggagaagaggcaga

SEQ ID NO: 5107 - RNA, 21 nt, Human
uuuccugaucacuaugcauuu

SEQ ID NO: 5108 - RNA, 21 nt, Human
uggguggggagaagaggcaga

SEQ ID NO: 5109 - RNA, 21 nt, Human
cgugccuguuuuaugugcaca

SEQ ID NO: 5110 - RNA, 22 nt, Human
aguucagcugcuucucuugccu

SEQ ID NO: 5111 - RNA, 20 nt, Human
augugggaagaaacaaaccc

SEQ ID NO: 5112 - RNA, 23 nt, Human
ugccugaacuugaauuaauccac

SEQ ID NO: 5113 - RNA, 23 nt, Human
uguugcccaggcugggagggcaa

SEQ ID NO: 5114 - RNA, 24 nt, Human
uguugcccaggcugggagggcaau

SEQ ID NO: 5115 - RNA, 20 nt, Human
uuaacacaaguacuaauaaa

SEQ ID NO: 5116 - RNA, 20 nt, Human
uuaggauaaguuagaugugu

SEQ ID NO: 5117 - RNA, 22 nt, Human
uccgaguagcugggauuacagg

SEQ ID NO: 5118 - RNA, 22 nt, Human
ucuuccauguggagguauucaa

SEQ ID NO: 5119 - RNA, 24 nt, Human
ugacauuuggauuaaucuccagcu

SEQ ID NO: 5120 - RNA, 20 nt, Human
ugaauuauugaccuaauaaa

SEQ ID NO: 5121 - RNA, 23 nt, Human
ugccaaaacaugauugaagccuu

SEQ ID NO: 5122 - RNA, 22 nt, Human
ugcaaccuccgccucccggguu

SEQ ID NO: 5123 - RNA, 23 nt, Human
aucugauagaccagcacuucuga

SEQ ID NO: 5124 - RNA, 22 nt, Human
uuguugcccaggcugggagggc

SEQ ID NO: 5125 - RNA, 20 nt, Human
uuuaauauguaauucuucca

SEQ ID NO: 5126 - RNA, 26 nt, Human
uucaguuauauucagcauguaccgca

SEQ ID NO: 5127 - RNA, 23 nt, Human
uuccagcgauucuccugccucag

SEQ ID NO: 5128 - RNA, 21 nt, Human
cucauuucuguauauuccuuu

SEQ ID NO: 5129 - RNA, 22 nt, Human
cgccgucccucaguuugccccc

SEQ ID NO: 5130 - RNA, 22 nt, Human
gaaacaucauuauuggcaguuu

SEQ ID NO: 5131 - RNA, 21 nt, Human
cuuuaaguagggauguuuagg

SEQ ID NO: 5132 - RNA, 18 nt, Human
cugcagugaacacaugcc

SEQ ID NO: 5133 - RNA, 24 nt, Human
cuggaccaguguugaucuguaaug

SEQ ID NO: 5134 - RNA, 22 nt, Human
ccgaguagcugggauuacaggc

SEQ ID NO: 5135 - RNA, 20 nt, Human
cccaggcugggagggcaaug

SEQ ID NO: 5136 - RNA, 18 nt, Human
auuuuuuguaagccaguc

SEQ ID NO: 5137 - RNA, 26 nt, Human
caucauuauuggcaguuucuccuuau

SEQ ID NO: 5138 - RNA, 19 nt, Human
gcugcagccaucccccuca

SEQ ID NO: 5139 - RNA, 25 nt, Human
gcugcuggggaggaccucaguuaac

SEQ ID NO: 5140 - RNA, 20 nt, Human
gcuuaagaaaacauugccau

SEQ ID NO: 5141 - RNA, 27 nt, Human
gaguagcugggauuacaggcuccugcc

SEQ ID NO: 5142 - RNA, 23 nt, Human
gauaaugcaaaaauuauguaaua

SEQ ID NO: 5143 - RNA, 22 nt, Human
gaugaagcaaacccacacccua

SEQ ID NO: 5144 - RNA, 18 nt, Human
gcacauguuuuucaagag

SEQ ID NO: 5145 - RNA, 22 nt, Human
uguuugaagcuguuauuugcag

SEQ ID NO: 5146 - RNA, 27 nt, Human
uguuuuuaaaaaauucauuuugcagaa

SEQ ID NO: 5147 - RNA, 23 nt, Human
uuaaaaaauucauuuugcagaaa

SEQ ID NO: 5148 - RNA, 23 nt, Human
uuaagaauuugugacauguagca

SEQ ID NO: 5149 - RNA, 21 nt, Human
ugggauuacaggcuccugcca

SEQ ID NO: 5150 - RNA, 22 nt, Human
uuccagcgauucuccugccuca

SEQ ID NO: 5151 - RNA, 23 nt, Human
uuaccucaauucuuacuguagua

SEQ ID NO: 5152 - RNA, 19 nt, Human
uugcccaggcugggagggc

SEQ ID NO: 5153 - RNA, 23 nt, Human
uugcccaggcugggagggcaaug

SEQ ID NO: 5154 - RNA, 24 nt, Human
uuugaacuucccaaccuuguuuga

SEQ ID NO: 5155 - RNA, 22 nt, Human
uuuuaaaaaauucauuuugcag

SEQ ID NO: 5156 - RNA, 22 nt, Human
accuuuguuccuagccuguugg

SEQ ID NO: 5157 - RNA, 22 nt, Human
agaaaacauugccauuuugguu

SEQ ID NO: 5158 - RNA, 22 nt, Human
acugcaaccuccgccucccggg

SEQ ID NO: 5159 - RNA, 27 nt, Human
accacgccuggcuaggaaauuuuuugu

SEQ ID NO: 5160 - RNA, 26 nt, Human
aaggaugauuuuaacaacuuuuuaau

SEQ ID NO: 5161 - RNA, 19 nt, Human
acacugguccaguccauug

SEQ ID NO: 5162 - RNA, 21 nt, Human
aaacaaaacacuaacaaucuu

SEQ ID NO: 5163 - RNA, 22 nt, Human
aagcaagucuauaaauaucggc

SEQ ID NO: 5164 - RNA, 23 nt, Human
aacuaaaacuuuucaguucuacu

SEQ ID NO: 5165 - RNA, 21 nt, Human
aucaaauuuaagaauuuguga

SEQ ID NO: 5166 - RNA, 24 nt, Human
aguuugcccccggaggaggcaggg

SEQ ID NO: 5167 - RNA, 22 nt, Human
agccuuccgaguagcugggauu

SEQ ID NO: 5168 - RNA, 23 nt, Human
aguauagaaaaguuaacacaagu

SEQ ID NO: 5169 - RNA, 25 nt, Human
ugaaacacugguccaguccauugaa

SEQ ID NO: 5170 - RNA, 21 nt, Human
ugcccaggcugggagggcaau

SEQ ID NO: 5171 - RNA, 23 nt, Human
ugcccaggcugggagggcaaugg

SEQ ID NO: 5172 - RNA, 24 nt, Human
ucaaaucucugucucugcuugguu

SEQ ID NO: 5173 - RNA, 27 nt, Human
uauguagaagccuaggaucacagggug

SEQ ID NO: 5174 - RNA, 22 nt, Human
cauugugauauauucuguacuu

SEQ ID NO: 5175 - RNA, 19 nt, Human
ccaggcugggagggcaaug

SEQ ID NO: 5176 - RNA, 25 nt, Human
ccauugcauuuaaguucccuaggag

SEQ ID NO: 5177 - RNA, 23 nt, Human
gucucauccuucucugacucuuc

SEQ ID NO: 5178 - RNA, 25 nt, Human
uagugcagacagaaaacugcaguga

SEQ ID NO: 5179 - RNA, 24 nt, Human
guugcccaggcugggagggcaaug

SEQ ID NO: 5180 - RNA, 27 nt, Human
guugcccaggcugggagggcaauggca

SEQ ID NO: 5181 - RNA, 27 nt, Human
ggaggugggggccuucgggaggaggag

SEQ ID NO: 5182 - RNA, 21 nt, Human
ggcucacugcaaccuccgccu

SEQ ID NO: 5183 - RNA, 22 nt, Human
ggcucacugcaaccuccgccuc

SEQ ID NO: 5184 - RNA, 22 nt, Human
gcucacugcaaccuccgccucc

SEQ ID NO: 5185 - RNA, 20 nt, Human
gcucuuguugcccaggcugg

SEQ ID NO: 5186 - RNA, 20 nt, Human
gacguacuugcaguuuauga

SEQ ID NO: 5187 - RNA, 22 nt, Human
gccaaaacaugauugaagccuu

SEQ ID NO: 5188 - RNA, 20 nt, Human
gcagugccauaagcaagucu

SEQ ID NO: 5189 - RNA, 23 nt, Human
gcccaggcugggagggcaauggc

SEQ ID NO: 5190 - RNA, 23 nt, Human
guugcccaggcugggagggcaau

SEQ ID NO: 5191 - RNA, 20 nt, Human
gugcuauuauuucugguucu

SEQ ID NO: 5192 - RNA, 20 nt, Human
guguacuucaccucuuggcu

SEQ ID NO: 5193 - RNA, 24 nt, Human
guuaccucaauucuuacuguagua

SEQ ID NO: 5194 - RNA, 21 nt, Human
guacacagauggcagugccau

SEQ ID NO: 5195 - RNA, 28 nt, Human
ggguucaugacuuggcuguuaaagaugu

SEQ ID NO: 5196 - RNA, 21 nt, Human
ccgagcugcuggggaggaccu

SEQ ID NO: 5197 - RNA, 27 nt, Human
cucauuucuguauauuccuuuuauggg

SEQ ID NO: 5198 - RNA, 23 nt, Human
cuauuauuucugguucuaaugaa

SEQ ID NO: 5199 - RNA, 20 nt, Human
cucaaagcugacuuugccaa

SEQ ID NO: 5200 - RNA, 23 nt, Human
cgaguagcugggauuacaggcuc

SEQ ID NO: 5201 - RNA, 18 nt, Human
cggcugcagccauccccc

SEQ ID NO: 5202 - RNA, 22 nt, Human
cugccccccaccccucaguuaa

SEQ ID NO: 5203 - RNA, 25 nt, Human
cuggguggcaaaguuacuacuggaa

SEQ ID NO: 5204 - RNA, 26 nt, Human
cugggacggaacccggguuccucucg

SEQ ID NO: 5205 - RNA, 22 nt, Human
cugcaaccuccgccucccgggu

SEQ ID NO: 5206 - RNA, 24 nt, Human
cugccaccacgccuggcuaggaaa

SEQ ID NO: 5207 - RNA, 29 nt, Human
gaaacaaaaagguauuuugcuguuaccuc

SEQ ID NO: 5208 - RNA, 26 nt, Human
gaccaguguugaucuguaauguaaua

SEQ ID NO: 5209 - RNA, 21 nt, Human
cucagucucucuucucuccag

SEQ ID NO: 5210 - RNA, 23 nt, Human
ccgucuggcccaccaggguccuu

SEQ ID NO: 5211 - RNA, 21 nt, Human
gcacagcccuuaugcgguuaa

SEQ ID NO: 5212 - RNA, 21 nt, Human
ucaggcaauuagacacuuugg

SEQ ID NO: 5213 - RNA, 22 nt, Human
ccagguucccucccagaggagc

SEQ ID NO: 5214 - RNA, 21 nt, Human
ggcuguaacuacuuuauaacu

SEQ ID NO: 5215 - RNA, 27 nt, Human
aguauuuuguauaauuggauucuaaua

SEQ ID NO: 5216 - RNA, 22 nt, Human
agcuguggcagaguuacaguuc

SEQ ID NO: 5217 - RNA, 28 nt, Human
uggcucuaauucacagugcucuuucucc

SEQ ID NO: 5218 - RNA, 22 nt, Human
uggugagucaccacuucagggc

SEQ ID NO: 5219 - RNA, 21 nt, Human
gcccuccucugcacucccacc

SEQ ID NO: 5220 - RNA, 24 nt, Human
ggcacucagucucucuucucucca

SEQ ID NO: 5221 - RNA, 23 nt, Human
cagcugcaagguacucuggugag

SEQ ID NO: 5222 - RNA, 22 nt, Human
cucaggcaauuagacacuuugg

SEQ ID NO: 5223 - RNA, 20 nt, Human
cuacccagacuagauguagu

SEQ ID NO: 5224 - RNA, 19 nt, Human
uucggccccauguaucuca

SEQ ID NO: 5225 - RNA, 21 nt, Human
uucuccucacuguauccaggu

SEQ ID NO: 5226 - RNA, 19 nt, Human
auuaucugucagcugcaag

SEQ ID NO: 5227 - RNA, 17 nt, Human
aggcuguaacuacuuua

SEQ ID NO: 5228 - RNA, 21 nt, Human
uuaccuaagauuacaaaucag

SEQ ID NO: 5229 - RNA, 22 nt, Human
uuaucuuguugucacagggcua

SEQ ID NO: 5230 - RNA, 21 nt, Human
uggcggccgugggcuccuggg

SEQ ID NO: 5231 - RNA, 25 nt, Human
uggcggccgugggcuccuggggagc

SEQ ID NO: 5232 - RNA, 21 nt, Human
uggggaggggguggcggccgc

SEQ ID NO: 5233 - RNA, 21 nt, Human
ugggggugcgggggugucaug

SEQ ID NO: 5234 - RNA, 22 nt, Human
cucagagauggucuccagguga

SEQ ID NO: 5235 - RNA, 32 nt, Human
ccuguccucaccacucugggcuugugcuguuc

SEQ ID NO: 5236 - RNA, 22 nt, Human
cagccagcagaggcagcagcac

SEQ ID NO: 5237 - RNA, 19 nt, Human
ccucucauucugugucccu

SEQ ID NO: 5238 - RNA, 21 nt, Human
uggggagccacuggggagggg

SEQ ID NO: 5239 - RNA, 28 nt, Human
uuaucuuguugucacagggcuaacccuc

SEQ ID NO: 5240 - RNA, 23 nt, Human
uuggucccuuaucuuguugucac

SEQ ID NO: 5241 - RNA, 22 nt, Human
acccugugagaacaagccccuc

SEQ ID NO: 5242 - RNA, 23 nt, Human
ggggagccacuggggagggggug

SEQ ID NO: 5243 - RNA, 24 nt, Human
ucucuggugcagccccuguccuca

SEQ ID NO: 5244 - RNA, 22 nt, Human
gcacagacaggcccacgugugu

SEQ ID NO: 5245 - RNA, 22 nt, Human
gccugaguccccaugcccugcu

SEQ ID NO: 5246 - RNA, 23 nt, Human
gggguccaccugugugcaccagg

SEQ ID NO: 5247 - RNA, 21 nt, Human
cccuguccucaccacucuggg

SEQ ID NO: 5248 - RNA, 27 nt, Human
ccuguccucaccacucugggcuugugc

SEQ ID NO: 5249 - RNA, 23 nt, Human
gaauccagagcgcugcagucaca

SEQ ID NO: 5250 - RNA, 27 nt, Human
cucucccugaauccagagcgcugcagu

SEQ ID NO: 5251 - RNA, 21 nt, Human
cugggcuugugcuguucuugg

SEQ ID NO: 5252 - RNA, 22 nt, Human
cuccauguuugauguaucugag

SEQ ID NO: 5253 - RNA, 24 nt, Human
ggcaacuuagagguggggagcaga

SEQ ID NO: 5254 - RNA, 24 nt, Human
ucucuuauccaacaucaacaucuu

SEQ ID NO: 5255 - RNA, 21 nt, Human
caaauucugcuugcuugcuuu

SEQ ID NO: 5256 - RNA, 22 nt, Human
cuuugagugcugucuccauguu

SEQ ID NO: 5257 - RNA, 23 nt, Human
uggaugaauuccaaauucugcuu

SEQ ID NO: 5258 - RNA, 25 nt, Human
uggacaugaucuucuuuauaauucu

SEQ ID NO: 5259 - RNA, 26 nt, Human
ugauaugcuuauacacuuacacuuua

SEQ ID NO: 5260 - RNA, 28 nt, Human
agguggggagcagagaauucucuuaucc

SEQ ID NO: 5261 - RNA, 24 nt, Human
ggacaugaucuucuuuauaauucu

SEQ ID NO: 5262 - RNA, 23 nt, Human
gcaacuuagagguggggagcaga

SEQ ID NO: 5263 - RNA, 30 nt, Human
gauaugcuuauacacuuacacuuuaugcac

SEQ ID NO: 5264 - RNA, 23 nt, Human
gaugggaagggcuuaucuagcca

SEQ ID NO: 5265 - RNA, 23 nt, Human
gccagggacggacgugggccagu

SEQ ID NO: 5266 - RNA, 27 nt, Human
gccagugcgagcccagagggcccgaag

SEQ ID NO: 5267 - RNA, 20 nt, Human
ggagaaggaaaaggcuggca

SEQ ID NO: 5268 - RNA, 24 nt, Human
ggagacacagauggcaccuguggc

SEQ ID NO: 5269 - RNA, 27 nt, Human
ggcagagaagagaccaagcuuguuucc

SEQ ID NO: 5270 - RNA, 21 nt, Human
gcuaguaccuguaagcauuuu

SEQ ID NO: 5271 - RNA, 24 nt, Human
gcgugugucccugugguacccugg

SEQ ID NO: 5272 - RNA, 21 nt, Human
aaccaauaaaacaagaauacu

SEQ ID NO: 5273 - RNA, 28 nt, Human
agggagcugaggccauucccuguaggag

SEQ ID NO: 5274 - RNA, 21 nt, Human
auguugggaaaaacuggcuuu

SEQ ID NO: 5275 - RNA, 23 nt, Human
aucuuaagauuacaagauaaaaa

SEQ ID NO: 5276 - RNA, 21 nt, Human
uuccuacccucucuaauggcc

SEQ ID NO: 5277 - RNA, 26 nt, Human
uucauugucucuaucugaaccacccu

SEQ ID NO: 5278 - RNA, 27 nt, Human
uugaggggagaggaaaucuuaagauua

SEQ ID NO: 5279 - RNA, 23 nt, Human
uuccuguucaugacagcuacuaa

SEQ ID NO: 5280 - RNA, 27 nt, Human
ucuuccuggucauaggcucacucuuuc

SEQ ID NO: 5281 - RNA, 22 nt, Human
ucccuaucaguucuagcauagu

SEQ ID NO: 5282 - RNA, 22 nt, Human
uccagggcauaaaacucaaccc

SEQ ID NO: 5283 - RNA, 20 nt, Human
ucuaguuccugauagcuacc

SEQ ID NO: 5284 - RNA, 22 nt, Human
ugcuaguaccuguaagcauuuu

SEQ ID NO: 5285 - RNA, 23 nt, Human
uuaccucccuaucaguucuagca

SEQ ID NO: 5286 - RNA, 21 nt, Human
uguuauucucggacugugaau

SEQ ID NO: 5287 - RNA, 22 nt, Human
cuuccuacccucucuaauggcc

SEQ ID NO: 5288 - RNA, 26 nt, Human
gaagagaccaagcuuguuucccugcu

SEQ ID NO: 5289 - RNA, 21 nt, Human
gaccacaccuccgugguucac

SEQ ID NO: 5290 - RNA, 23 nt, Human
cuguauuuuuaaauucugcuccu

SEQ ID NO: 5291 - RNA, 22 nt, Human
cuuaacaacagcuucuugcuug

SEQ ID NO: 5292 - RNA, 22 nt, Human
caccauuccuuuaaauucucca

SEQ ID NO: 5293 - RNA, 22 nt, Human
cacugcacuuggugcugcuuug

SEQ ID NO: 5294 - RNA, 25 nt, Human
ccucuccugagaagccaccagcacc

SEQ ID NO: 5295 - RNA, 22 nt, Human
ccccaaaucuuccucuggagcu

SEQ ID NO: 5296 - RNA, 23 nt, Human
ccacugcacuuggugcugcuuug

SEQ ID NO: 5297 - RNA, 21 nt, Human
ccaagcuuguuucccugcugg

SEQ ID NO: 5298 - RNA, 20 nt, Human
uaguaccuguaagcauuuua

SEQ ID NO: 5299 - RNA, 24 nt, Human
ucaguucuagcauaguaaacuacg

SEQ ID NO: 5300 - RNA, 21 nt, Human
gggcuccggaucccagccucu

SEQ ID NO: 5301 - RNA, 27 nt, Human
ggguucucuucauucccacugcacuug

SEQ ID NO: 5302 - RNA, 21 nt, Human
guauuuuuaaauucugcuccu

SEQ ID NO: 5303 - RNA, 26 nt, Human
gucuccauuuuucccaggacaggaaa

SEQ ID NO: 5304 - RNA, 24 nt, Human
gucccauucuccacucacugcauu

SEQ ID NO: 5305 - RNA, 22 nt, Human
gucaguaggagaggaugcacag

SEQ ID NO: 5306 - RNA, 19 nt, Human
guuacuuccuuccugcccc

SEQ ID NO: 5307 - RNA, 23 nt, Human
guuagugggaagagcuggguuuu

SEQ ID NO: 5308 - RNA, 22 nt, Human
uaacacaugaauuucugccaua

SEQ ID NO: 5309 - RNA, 27 nt, Human
guuucacugccuuccuacccucucuaa

SEQ ID NO: 5310 - RNA, 22 nt, Human
gggaaagggugaggacuucaca

SEQ ID NO: 5311 - RNA, 25 nt, Human
ccacauuuugcuuuauaauuucuac

SEQ ID NO: 5312 - RNA, 26 nt, Human
ccacccagacuugggggcaggcgcca

SEQ ID NO: 5313 - RNA, 29 nt, Human
ccaaguucauuaccucccuaucaguucua

SEQ ID NO: 5314 - RNA, 22 nt, Human
accaugaagugaaaaugccaca

SEQ ID NO: 5315 - RNA, 22 nt, Human
acucacugcauuuggggccuuu

SEQ ID NO: 5316 - RNA, 26 nt, Human
acucacugcauuuggggccuuuccca

SEQ ID NO: 5317 - RNA, 21 nt, Human
aaccaacugccuuaaccuucu

SEQ ID NO: 5318 - RNA, 19 nt, Human
aaguauucuucuuuucuua

SEQ ID NO: 5319 - RNA, 24 nt, Human
agggugaggacuucacaauguugg

SEQ ID NO: 5320 - RNA, 20 nt, Human
agccucuccccugcucccgu

SEQ ID NO: 5321 - RNA, 21 nt, Human
agcccggacccgggggcuggc

SEQ ID NO: 5322 - RNA, 22 nt, Human
agacaguggcagcaaaggaaga

SEQ ID NO: 5323 - RNA, 22 nt, Human
auaauuucuacccauguuggga

SEQ ID NO: 5324 - RNA, 23 nt, Human
auucuccaacccaaaguauucuu

SEQ ID NO: 5325 - RNA, 25 nt, Human
augggaaagggugaggacuucacaa

SEQ ID NO: 5326 - RNA, 27 nt, Human
cacucacugcauuuggggccuuuccca

SEQ ID NO: 5327 - RNA, 22 nt, Human
caccacccagacuugggggcag

SEQ ID NO: 5328 - RNA, 27 nt, Human
uucaaagcucuaauagagucacagcuu

SEQ ID NO: 5329 - RNA, 19 nt, Human
uucuacaaguaauuuugca

SEQ ID NO: 5330 - RNA, 24 nt, Human
uucuacaaguaauuuugcacagac

SEQ ID NO: 5331 - RNA, 27 nt, Human
uucuacaaguaauuuugcacagacauc

SEQ ID NO: 5332 - RNA, 20 nt, Human
uguaggaguaaagauaaaag

SEQ ID NO: 5333 - RNA, 26 nt, Human
ugucccugugguacccuggcagagaa

SEQ ID NO: 5334 - RNA, 22 nt, Human
ggaaagggugaggacuucacaa

SEQ ID NO: 5335 - RNA, 23 nt, Human
ggagagggaaauacaaggagggc

SEQ ID NO: 5336 - RNA, 21 nt, Human
ggagaagggagaacagggguc

SEQ ID NO: 5337 - RNA, 22 nt, Human
gauuagcuagacuaggagacca

SEQ ID NO: 5338 - RNA, 22 nt, Human
ggguuccagggacuguaccugu

SEQ ID NO: 5339 - RNA, 26 nt, Human
ccuucaguaucaaggcugccuggaga

SEQ ID NO: 5340 - RNA, 26 nt, Human
ccugccuggauuucuuccuauuaggc

SEQ ID NO: 5341 - RNA, 22 nt, Human
ccggaucccagccucuccccug

SEQ ID NO: 5342 - RNA, 19 nt, Human
cugagucaguuuuuuaucu

SEQ ID NO: 5343 - RNA, 21 nt, Human
cuuuucugugguugcagccug

SEQ ID NO: 5344 - RNA, 24 nt, Human
ucaugacagcuacuaaccuggaga

SEQ ID NO: 5345 - RNA, 26 nt, Human
ucaaugaugaguccucucuggucaga

SEQ ID NO: 5346 - RNA, 20 nt, Human
uaggaggucaucaaccgaug

SEQ ID NO: 5347 - RNA, 19 nt, Human
uaauugccuuugagguuau

SEQ ID NO: 5348 - RNA, 25 nt, Human
cuugucuuaaucguccugcugcugc

SEQ ID NO: 5349 - RNA, 21 nt, Human
cugagcccggcgagggugggg

SEQ ID NO: 5350 - RNA, 22 nt, Human
ccugcugcugcugccguuccgg

SEQ ID NO: 5351 - RNA, 24 nt, Human
cccucacccaaaagaauuaucauc

SEQ ID NO: 5352 - RNA, 30 nt, Human
ggugcgcgcccaucccugcccgcagccccg

SEQ ID NO: 5353 - RNA, 18 nt, Human
ugugccuggaugggggug

SEQ ID NO: 5354 - RNA, 22 nt, Human
agaccuggaaccagagccacag

SEQ ID NO: 5355 - RNA, 20 nt, Human
agccuccuccccucccgcga

SEQ ID NO: 5356 - RNA, 27 nt, Human
aaugaugaguccucucuggucagacau

SEQ ID NO: 5357 - RNA, 18 nt, Human
acaggaagcuuuuuguau

SEQ ID NO: 5358 - RNA, 18 nt, Human
accaacauaaaacaaaac

SEQ ID NO: 5359 - RNA, 25 nt, Human
accggcuaggcugggcgcgcccccc

SEQ ID NO: 5360 - RNA, 22 nt, Human
ccaaaacagaguggauugggcu

SEQ ID NO: 5361 - RNA, 27 nt, Human
caggagaaucagccuggggccugggga

SEQ ID NO: 5362 - RNA, 23 nt, Human
guucucuucucucuucaaucucu

SEQ ID NO: 5363 - RNA, 21 nt, Human
guggguuucucugugcucuga

SEQ ID NO: 5364 - RNA, 26 nt, Human
ucucuguucugcucccagaugccuuc

SEQ ID NO: 5365 - RNA, 27 nt, Human
ucuguucugcucccagaugccuucuag

SEQ ID NO: 5366 - RNA, 19 nt, Human
ccaggguccugugccugga

SEQ ID NO: 5367 - RNA, 27 nt, Human
ccaggaagaguucuauccccaagcugg

SEQ ID NO: 5368 - RNA, 22 nt, Human
cccucccgcgagccuccucccc

SEQ ID NO: 5369 - RNA, 24 nt, Human
ccgcucagucuuugagcgagccca

SEQ ID NO: 5370 - RNA, 21 nt, Human
cgucuguggagccauccuccu

SEQ ID NO: 5371 - RNA, 21 nt, Human
cucccagaugccuucuagauu

SEQ ID NO: 5372 - RNA, 21 nt, Human
uguccccgcucagucuuugag

SEQ ID NO: 5373 - RNA, 27 nt, Human
ucugcucccagaugccuucuagauuca

SEQ ID NO: 5374 - RNA, 22 nt, Human
uugcccaggguccugugccugg

SEQ ID NO: 5375 - RNA, 25 nt, Human
uugcccaggguccugugccuggaug

SEQ ID NO: 5376 - RNA, 26 nt, Human
uugcccaggguccugugccuggaugg

SEQ ID NO: 5377 - RNA, 18 nt, Human
agccagaauucacuagga

SEQ ID NO: 5378 - RNA, 27 nt, Human
aaccaaaacagaguggauugggcugca

SEQ ID NO: 5379 - RNA, 22 nt, Human
gccuucuccccucccgcgagcc

SEQ ID NO: 5380 - RNA, 17 nt, Human
gccagaauucacuagga

SEQ ID NO: 5381 - RNA, 27 nt, Human
gccugagcccggcgaggguggggaggg

SEQ ID NO: 5382 - RNA, 24 nt, Human
gaugguccucacaagccucuucug

SEQ ID NO: 5383 - RNA, 22 nt, Human
gauggcaggagaaucagccugg

SEQ ID NO: 5384 - RNA, 20 nt, Human
aucuacccugcugaccuccc

SEQ ID NO: 5385 - RNA, 26 nt, Human
agggguggggauugggggacaugggc

SEQ ID NO: 5386 - RNA, 20 nt, Human
gacccucugacccuagcucu

SEQ ID NO: 5387 - RNA, 25 nt, Human
ggucuugaggggguaauaaaccucc

SEQ ID NO: 5388 - RNA, 26 nt, Human
agugccuucugcccucccuggagccu

SEQ ID NO: 5389 - RNA, 23 nt, Human
uguguuuuuccuccauaaauuau

SEQ ID NO: 5390 - RNA, 22 nt, Human
gauucaucuacccugcugaccu

SEQ ID NO: 5391 - RNA, 21 nt, Human
gcauuuuucuuacuuuuguaa

SEQ ID NO: 5392 - RNA, 21 nt, Human
ccuucugcccucccuggagcc

SEQ ID NO: 5393 - RNA, 22 nt, Human
ucaccaucuggaagaagauggg

SEQ ID NO: 5394 - RNA, 22 nt, Human
ggccuccucuccuacuuuggga

SEQ ID NO: 5395 - RNA, 22 nt, Human
uaguauuuuaccuagcauuuca

SEQ ID NO: 5396 - RNA, 29 nt, Human
guccaauuuacaggcuggagcagcagcug

SEQ ID NO: 5397 - RNA, 22 nt, Human
uuauguagcugaaacaaaaaug

SEQ ID NO: 5398 - RNA, 25 nt, Human
agauauuaaaauaagcacagaaaau

SEQ ID NO: 5399 - RNA, 31 nt, Human
cuccuugcaaacuuuaccaucuuuguugcag

SEQ ID NO: 5400 - RNA, 27 nt, Human
uuauguagcugaaacaaaaaugccaga

SEQ ID NO: 5401 - RNA, 23 nt, Human
gagauauuaaaauaagcacagaa

SEQ ID NO: 5402 - RNA, 27 nt, Human
gccugguucaauuucuuucuuuccuua

SEQ ID NO: 5403 - RNA, 26 nt, Human
gagggaggguggccuaagaguugagc

SEQ ID NO: 5404 - RNA, 25 nt, Human
gcccuccagcucuuuccuccuucca

SEQ ID NO: 5405 - RNA, 27 nt, Human
uccuagaguagaguggagggagggugg

SEQ ID NO: 5406 - RNA, 27 nt, Human
uuagcauuuuaauuagauguaauuguu

SEQ ID NO: 5407 - RNA, 19 nt, Human
uuccagucuccaccaggaa

SEQ ID NO: 5408 - RNA, 26 nt, Human
gccaaaguuaugcaagggacugugug

SEQ ID NO: 5409 - RNA, 22 nt, Human
ccuuguuccuagaguagagugg

SEQ ID NO: 5410 - RNA, 21 nt, Human
ucaucucuaacagcucaggau

SEQ ID NO: 5411 - RNA, 21 nt, Human
cuccaggccucagcaggugcg

SEQ ID NO: 5412 - RNA, 20 nt, Human
cuaccucaaacuuccaguca

SEQ ID NO: 5413 - RNA, 23 nt, Human
ccuguuccaugaaggcagagcca

SEQ ID NO: 5414 - RNA, 23 nt, Human
cucucauuuugaccuacucucau

SEQ ID NO: 5415 - RNA, 21 nt, Human
gaauuuuuaugauauuccccc

SEQ ID NO: 5416 - RNA, 24 nt, Human
ggcauggucaaaggcucaaaccuu

SEQ ID NO: 5417 - RNA, 20 nt, Human
gucaaugacaguuucuuuuu

SEQ ID NO: 5418 - RNA, 20 nt, Human
ugucaaugacaguuucuuuu

SEQ ID NO: 5419 - RNA, 26 nt, Human
ugguuggcgucgccuugaaaucccag

SEQ ID NO: 5420 - RNA, 23 nt, Human
agcacucagcccgggaggcaggc

SEQ ID NO: 5421 - RNA, 22 nt, Human
agccuguuccaugaaggcagag

SEQ ID NO: 5422 - RNA, 21 nt, Human
accuacucucaugcugcagag

SEQ ID NO: 5423 - RNA, 18 nt, Human
acagcccauuucuccaua

SEQ ID NO: 5424 - RNA, 23 nt, Human
uaacugcauuuuagaccauuuau

SEQ ID NO: 5425 - RNA, 17 nt, Human
cagcccauuucuccaua

SEQ ID NO: 5426 - RNA, 21 nt, Human
ccauuuaucugggauuauggu

SEQ ID NO: 5427 - RNA, 24 nt, Human
uauccguggccacagcugguuggc

SEQ ID NO: 5428 - RNA, 23 nt, Human
uccaugaaggcagagccauggac

SEQ ID NO: 5429 - RNA, 24 nt, Human
aggcaaugauuguuaauuuacagc

SEQ ID NO: 5430 - RNA, 27 nt, Human
cucagcaggugcggagccgucacugca

SEQ ID NO: 5431 - RNA, 23 nt, Human
ccugccucuucccccauucucau

SEQ ID NO: 5432 - RNA, 20 nt, Human
cuuccagucagguaguugca

SEQ ID NO: 5433 - RNA, 18 nt, Human
gcauggucaaaggcucaa

SEQ ID NO: 5434 - RNA, 21 nt, Human
aaacuguugauuauuagccag

SEQ ID NO: 5435 - RNA, 22 nt, Human
aaagcaauaaaugaaugggcug

SEQ ID NO: 5436 - RNA, 22 nt, Human
aaccaacaaccucaacugccua

SEQ ID NO: 5437 - RNA, 21 nt, Human
aaccucaacugccuacuccaa

SEQ ID NO: 5438 - RNA, 23 nt, Human
gccuccaaggaggggcuguaaaa

SEQ ID NO: 5439 - RNA, 21 nt, Human
gaggggcuguaaaauggaggc

SEQ ID NO: 5440 - RNA, 24 nt, Human
gcugccugguauauccaaaagcuu

SEQ ID NO: 5441 - RNA, 22 nt, Human
gaacucaaacugaggaauuuca

SEQ ID NO: 5442 - RNA, 22 nt, Human
cuuuuaaacuguguacauaacu

SEQ ID NO: 5443 - RNA, 23 nt, Human
ccuuuuaauuuuccuggugccaa

SEQ ID NO: 5444 - RNA, 22 nt, Human
cagcaaacucuuuucccacugu

SEQ ID NO: 5445 - RNA, 20 nt, Human
cagcccagggaaaccuccuc

SEQ ID NO: 5446 - RNA, 20 nt, Human
ccaacaaccucaacugccua

SEQ ID NO: 5447 - RNA, 24 nt, Human
uuucagcaaacucuuuucccacug

SEQ ID NO: 5448 - RNA, 27 nt, Human
ucccugccucucaucaacugaaugagg

SEQ ID NO: 5449 - RNA, 27 nt, Human
ucugcuugauuuuugccucuuccaguc

SEQ ID NO: 5450 - RNA, 16 nt, Human
uccaacuaaugccuua

SEQ ID NO: 5451 - RNA, 20 nt, Human
ugccuagacccggcgcagca

SEQ ID NO: 5452 - RNA, 20 nt, Human
ugcugccagaaccuugggga

SEQ ID NO: 5453 - RNA, 21 nt, Human
uacagagucuggugaagcuca

SEQ ID NO: 5454 - RNA, 21 nt, Human
ggucauuuuauguuaagggaa

SEQ ID NO: 5455 - RNA, 21 nt, Human
accaacaaccucaacugccua

SEQ ID NO: 5456 - RNA, 23 nt, Human
aaccuguuaccuacuuugacuuu

SEQ ID NO: 5457 - RNA, 20 nt, Human
aacucugcuugauuuuugcc

SEQ ID NO: 5458 - RNA, 20 nt, Human
acagagucuggugaagcuca

SEQ ID NO: 5459 - RNA, 21 nt, Human
agaaaacauaaucuucugccu

SEQ ID NO: 5460 - RNA, 21 nt, Human
agccugcacaauaaaaauguu

SEQ ID NO: 5461 - RNA, 24 nt, Human
agaugggggaggaggcaguaauaa

SEQ ID NO: 5462 - RNA, 20 nt, Human
auacaagaucuuccuuccuc

SEQ ID NO: 5463 - RNA, 23 nt, Human
uucagcaaacucuuuucccacug

SEQ ID NO: 5464 - RNA, 23 nt, Human
uuagaaaacauaaucuucugccu

SEQ ID NO: 5465 - RNA, 22 nt, Human
uuuucagcaaacucuuuuccca

SEQ ID NO: 5466 - RNA, 23 nt, Human
gcuuuuuauuccuccugcucaua

SEQ ID NO: 5467 - RNA, 26 nt, Human
gauugcugaaauuuuauaugcuuacu

SEQ ID NO: 5468 - RNA, 27 nt, Human
gaggcucccucccagccaccgcccccc

SEQ ID NO: 5469 - RNA, 21 nt, Human
gaaguauuuugcuggaauaag

SEQ ID NO: 5470 - RNA, 22 nt, Human
cugccagaaccuuggggaugug

SEQ ID NO: 5471 - RNA, 24 nt, Human
cugccuacuccaaaauguugguca

SEQ ID NO: 5472 - RNA, 20 nt, Human
ccuuaaagcacagcccaggg

SEQ ID NO: 5473 - RNA, 21 nt, Human
cccugcucaguaaagcacuug

SEQ ID NO: 5474 - RNA, 22 nt, Human
ccucccagccaccgccccccuc

SEQ ID NO: 5475 - RNA, 24 nt, Human
cgggacggccgggcugggagcugg

SEQ ID NO: 5476 - RNA, 22 nt, Human
cuuuggaaauaaaagauaaaag

SEQ ID NO: 5477 - RNA, 27 nt, Human
gcacuguucugauuauguaagcauuug

SEQ ID NO: 5478 - RNA, 32 nt, Human
gcacuguucugauuauguaagcauuuguacau

SEQ ID NO: 5479 - RNA, 23 nt, Human
ucagauugcuuaaaagcauuuuu

SEQ ID NO: 5480 - RNA, 21 nt, Human
uacuguaauacuucuuuguua

SEQ ID NO: 5481 - RNA, 26 nt, Human
aguauacauuuuauaaugaugaacuu

SEQ ID NO: 5482 - RNA, 23 nt, Human
accacuguucuguucauuuccua

SEQ ID NO: 5483 - RNA, 20 nt, Human
acuguaauacuucuuuguua

SEQ ID NO: 5484 - RNA, 24 nt, Human
aagauguuucauuuuacuguauau

SEQ ID NO: 5485 - RNA, 25 nt, Human
aacauaaaagcaccacuguucuguu

SEQ ID NO: 5486 - RNA, 21 nt, Human
acaguaaguugacaccacuua

SEQ ID NO: 5487 - RNA, 25 nt, Human
agggacauuucuauaaaaauacuac

SEQ ID NO: 5488 - RNA, 19 nt, Human
augauccuggaaauugcag

SEQ ID NO: 5489 - RNA, 21 nt, Human
cagauugcuuaaaagcauuuu

SEQ ID NO: 5490 - RNA, 27 nt, Human
cagauugcuuaaaagcauuuuuauuau

SEQ ID NO: 5491 - RNA, 23 nt, Human
cccauuaaaaaugagauuucuua

SEQ ID NO: 5492 - RNA, 20 nt, Human
cuuggaccccaggucuggag

SEQ ID NO: 5493 - RNA, 20 nt, Human
gauugggauacuguaauacu

SEQ ID NO: 5494 - RNA, 26 nt, Human
aacauaaaagcaccacuguucuguuc

SEQ ID NO: 5495 - RNA, 25 nt, Human
gccucaaggggugcggcccucucag

SEQ ID NO: 5496 - RNA, 24 nt, Human
gcgucaggcccagcgcacagccug

SEQ ID NO: 5497 - RNA, 27 nt, Human
gcucagccugucagcugagcacgggcg

SEQ ID NO: 5498 - RNA, 27 nt, Human
caagacgcccauccuggaaaagguccc

SEQ ID NO: 5499 - RNA, 26 nt, Human
caucccugcaccaggacucaccaaga

SEQ ID NO: 5500 - RNA, 27 nt, Human
uggggaagugcggugacugggaaaugc

SEQ ID NO: 5501 - RNA, 26 nt, Human
aggcagcagagccgaggagagcaggu

SEQ ID NO: 5502 - RNA, 20 nt, Human
ggugacugggaaaugcugag

SEQ ID NO: 5503 - RNA, 19 nt, Human
guccgaccucuggaaaugu

SEQ ID NO: 5504 - RNA, 20 nt, Human
ccagcgcacagccugggcag

SEQ ID NO: 5505 - RNA, 21 nt, Human
ugcuccugccacuagguuuca

SEQ ID NO: 5506 - RNA, 24 nt, Human
gcacagccugggcagcucagccug

SEQ ID NO: 5507 - RNA, 21 nt, Human
gagcuaggggcaggaggcaug

SEQ ID NO: 5508 - RNA, 23 nt, Human
gagaaaggaguaggagccuagca

SEQ ID NO: 5509 - RNA, 18 nt, Human
gcuuugagaaaggaguag

SEQ ID NO: 5510 - RNA, 21 nt, Human
ggcucacacccccgcccacac

SEQ ID NO: 5511 - RNA, 25 nt, Human
cgcgucaggcccagcgcacagccug

SEQ ID NO: 5512 - RNA, 24 nt, Human
cccagccucuccccgcucuggauc

SEQ ID NO: 5513 - RNA, 24 nt, Human
agccucuccccgcucuggauccug

SEQ ID NO: 5514 - RNA, 22 nt, Human
aaccaggccccagccuccaggc

SEQ ID NO: 5515 - RNA, 19 nt, Human
accgcaaaaagcaccggga

SEQ ID NO: 5516 - RNA, 16 nt, Human
agaacagaauugcucc

SEQ ID NO: 5517 - RNA, 21 nt, Human
uccaggcccccaacuccgccc

SEQ ID NO: 5518 - RNA, 21 nt, Human
ccccgcucuggauccugcacu

SEQ ID NO: 5519 - RNA, 25 nt, Human
cgcccagccucuccccgcucuggau

SEQ ID NO: 5520 - RNA, 27 nt, Human
ccuuacgggggcaucuugaguccagcu

SEQ ID NO: 5521 - RNA, 18 nt, Human
ccuucucucuuccuugcu

SEQ ID NO: 5522 - RNA, 26 nt, Human
cuggaaaacagcugcuguuagauguc

SEQ ID NO: 5523 - RNA, 21 nt, Human
cugaacuuuggaagcugggga

SEQ ID NO: 5524 - RNA, 21 nt, Human
cagguauuuucaucaaguagc

SEQ ID NO: 5525 - RNA, 26 nt, Human
cagacucuuuaguugauuuaaacucu

SEQ ID NO: 5526 - RNA, 22 nt, Human
ucugaacuuuggaagcugggga

SEQ ID NO: 5527 - RNA, 21 nt, Human
aguugaguuaagggauggcuu

SEQ ID NO: 5528 - RNA, 23 nt, Human
agucccuucucucuuccuugcuu

SEQ ID NO: 5529 - RNA, 22 nt, Human
uuuucuuucuuuuuucucugac

SEQ ID NO: 5530 - RNA, 21 nt, Human
uugaucaugaaucacugcacc

SEQ ID NO: 5531 - RNA, 24 nt, Human
ggacuuagucaugaggagagggug

SEQ ID NO: 5532 - RNA, 21 nt, Human
gcauacaaguuuagccugggg

SEQ ID NO: 5533 - RNA, 22 nt, Human
gcaguguaacccaagcauuugu

SEQ ID NO: 5534 - RNA, 27 nt, Human
gcaguguaacccaagcauuuguggaca

SEQ ID NO: 5535 - RNA, 18 nt, Human
gagaaaacaggcucacag

SEQ ID NO: 5536 - RNA, 27 nt, Human
aacaacaagaaaauguacaguuagucc

SEQ ID NO: 5537 - RNA, 22 nt, Human
aaacccagcugacuuguuuccu

SEQ ID NO: 5538 - RNA, 24 nt, Human
agacaacaggcauuuucuuucuuu

SEQ ID NO: 5539 - RNA, 20 nt, Human
acugaguuugaacacagauc

SEQ ID NO: 5540 - RNA, 20 nt, Human
aaucacugcaccucuuuguc

SEQ ID NO: 5541 - RNA, 25 nt, Human
agggugaggcccacucuguuccuac

SEQ ID NO: 5542 - RNA, 22 nt, Human
aguaauacagccugguuuucaa

SEQ ID NO: 5543 - RNA, 26 nt, Human
uggagaucuuaagauuccauuuugga

SEQ ID NO: 5544 - RNA, 24 nt, Human
ucucucuuccuugcuuucucuucu

SEQ ID NO: 5545 - RNA, 19 nt, Human
guugauuuaaacucuuaga

SEQ ID NO: 5546 - RNA, 22 nt, Human
ggggugugauuugugugcgugc

SEQ ID NO: 5547 - RNA, 26 nt, Human
uggcuaacuuuuauuaucuucuauau

SEQ ID NO: 5548 - RNA, 23 nt, Human
cugcaccucuuugucacagggug

SEQ ID NO: 5549 - RNA, 21 nt, Human
cugaccaccugcagccuguug

SEQ ID NO: 5550 - RNA, 21 nt, Human
ggcggugaggagggcagcugg

SEQ ID NO: 5551 - RNA, 23 nt, Human
gucccuucucucuuccuugcuuu

SEQ ID NO: 5552 - RNA, 23 nt, Human
ggugaagccucugggcuuccuga

SEQ ID NO: 5553 - RNA, 22 nt, Human
ggcuguaacucagcgaccuugg

SEQ ID NO: 5554 - RNA, 26 nt, Human
gcugccucuaccggcuggcggcugua

SEQ ID NO: 5555 - RNA, 19 nt, Human
gccacugccaccugccucc

SEQ ID NO: 5556 - RNA, 24 nt, Human
gcccgaccuggggcugagugcaga

SEQ ID NO: 5557 - RNA, 20 nt, Human
cggcccagagggugggcgcg

SEQ ID NO: 5558 - RNA, 25 nt, Human
ccgaugccaccacagccaucgccac

SEQ ID NO: 5559 - RNA, 27 nt, Human
ccccugccacugccacaacccccgaug

SEQ ID NO: 5560 - RNA, 23 nt, Human
cccgcugaaucuuggcucuuguc

SEQ ID NO: 5561 - RNA, 21 nt, Human
cccuccagagcaggagacugg

SEQ ID NO: 5562 - RNA, 25 nt, Human
cccugccacugccacaacccccgau

SEQ ID NO: 5563 - RNA, 27 nt, Human
ggugaagccucugggcuuccugaagcc

SEQ ID NO: 5564 - RNA, 25 nt, Human
ucccaggaccuggagacaggauugu

SEQ ID NO: 5565 - RNA, 27 nt, Human
uccuccagggggccugcaggccccagc

SEQ ID NO: 5566 - RNA, 27 nt, Human
aggggccagggugugagguuucaccuc

SEQ ID NO: 5567 - RNA, 27 nt, Human
ggcccgaccuggggcugagugcagagg

SEQ ID NO: 5568 - RNA, 22 nt, Human
agcaggagacuggcaagagcuc

SEQ ID NO: 5569 - RNA, 21 nt, Human
ucucaccagcucagccccggc

SEQ ID NO: 5570 - RNA, 22 nt, Human
ucgccacugccaccugccuccc

SEQ ID NO: 5571 - RNA, 24 nt, Human
uccuccagggggccugcaggcccc

SEQ ID NO: 5572 - RNA, 24 nt, Human
cagaggcugagcaggacguuaggc

SEQ ID NO: 5573 - RNA, 22 nt, Human
cagggugugagguuucaccucc

SEQ ID NO: 5574 - RNA, 21 nt, Human
caggaccuggagacaggauug

SEQ ID NO: 5575 - RNA, 22 nt, Human
ccaaugccacagccaagcccac

SEQ ID NO: 5576 - RNA, 20 nt, Human
gagggagagagggagagagc

SEQ ID NO: 5577 - RNA, 23 nt, Human
auagagggagagagggagagagc

SEQ ID NO: 5578 - RNA, 20 nt, Human
acagaagucacucaauuguu

SEQ ID NO: 5579 - RNA, 22 nt, Human
uagagggagagagggagagagc

SEQ ID NO: 5580 - RNA, 21 nt, Human
gggagagagggagagagccua

SEQ ID NO: 5581 - RNA, 27 nt, Human
gggagagagggagagagccuauacccc

SEQ ID NO: 5582 - RNA, 22 nt, Human
uuugaaacaacuuucucuugua

SEQ ID NO: 5583 - RNA, 24 nt, Human
gcugcucuuaugccauuuguuuau

SEQ ID NO: 5584 - RNA, 22 nt, Human
gggagagagggagagagccuau

SEQ ID NO: 5585 - RNA, 26 nt, Human
ucacacucaccuagccaccauggaca

SEQ ID NO: 5586 - RNA, 14 nt, Human
ugcccuuucuugaa

SEQ ID NO: 5587 - RNA, 22 nt, Human
accccucacacucaccuagcca

SEQ ID NO: 5588 - RNA, 23 nt, Human
acaaaagcggaagaugcugcagu

SEQ ID NO: 5589 - RNA, 23 nt, Human
acaaagugcuuuuucacugccua

SEQ ID NO: 5590 - RNA, 24 nt, Human
acagaauaguuuacacacugugug

SEQ ID NO: 5591 - RNA, 22 nt, Human
uggauuuccaguuuuucuuuac

SEQ ID NO: 5592 - RNA, 23 nt, Human
ugacaacuaaacaaggcauucag

SEQ ID NO: 5593 - RNA, 19 nt, Human
ugcaguugggcaaggucag

SEQ ID NO: 5594 - RNA, 20 nt, Human
uaggcuucagguugcauugg

SEQ ID NO: 5595 - RNA, 27 nt, Human
ggcucagacaacaaaagcggaagaugc

SEQ ID NO: 5596 - RNA, 23 nt, Human
gugacaacuaaacaaggcauuca

SEQ ID NO: 5597 - RNA, 24 nt, Human
uuguguauauuacaccaaugccgc

SEQ ID NO: 5598 - RNA, 25 nt, Human
gcguaaggguuaucguuaagcacaa

SEQ ID NO: 5599 - RNA, 20 nt, Human
cugggugugggagcagggca

SEQ ID NO: 5600 - RNA, 20 nt, Human
uuaacuuggaaaucaguaga

SEQ ID NO: 5601 - RNA, 25 nt, Human
ugucaacaaagugcuuuuucacugc

SEQ ID NO: 5602 - RNA, 22 nt, Human
uaaagaagaaaagcgcguugug

SEQ ID NO: 5603 - RNA, 21 nt, Human
guuaacuuggaaaucaguaga

SEQ ID NO: 5604 - RNA, 32 nt, Human
gcucagacaacaaaagcggaagaugcugcagu

SEQ ID NO: 5605 - RNA, 26 nt, Human
gccucccccgacuccuggguguggga

SEQ ID NO: 5606 - RNA, 21 nt, Human
gcauucagcaguuucugacaa

SEQ ID NO: 5607 - RNA, 23 nt, Human
gacggcuucucacgcuuuguuua

SEQ ID NO: 5608 - RNA, 28 nt, Human
gcacagagcguccuucccccuguagacu

SEQ ID NO: 5609 - RNA, 20 nt, Human
gccugugguuacagugcaga

SEQ ID NO: 5610 - RNA, 21 nt, Human
gcgcugggcuggugugcagug

SEQ ID NO: 5611 - RNA, 22 nt, Human
gcugggcugcaggcucucggcu

SEQ ID NO: 5612 - RNA, 25 nt, Human
cccagccugugguuacagugcagac

SEQ ID NO: 5613 - RNA, 31 nt, Human
ccggcaaccgcuccggcaacgccaaccgcuc

SEQ ID NO: 5614 - RNA, 26 nt, Human
cgcgcaggcugggcugcaggcucucg

SEQ ID NO: 5615 - RNA, 22 nt, Human
ugggcuggugugcaguggugcg

SEQ ID NO: 5616 - RNA, 26 nt, Human
ugcaaugucacaaccucucugaucuu

SEQ ID NO: 5617 - RNA, 23 nt, Human
agcgcugggcuggugugcagugg

SEQ ID NO: 5618 - RNA, 27 nt, Human
agcgcugggcuggugugcaguggugcg

SEQ ID NO: 5619 - RNA, 22 nt, Human
uucacguaagauacaaguuuca

SEQ ID NO: 5620 - RNA, 20 nt, Human
agccucccgaguaguggauc

SEQ ID NO: 5621 - RNA, 29 nt, Human
aguuugcaaugucacaaccucucugaucu

SEQ ID NO: 5622 - RNA, 19 nt, Human
cugggcuggugugcagugg

SEQ ID NO: 5623 - RNA, 19 nt, Human
cugguucccaccucagccu

SEQ ID NO: 5624 - RNA, 21 nt, Human
cuccaagcaaguagcuuucca

SEQ ID NO: 5625 - RNA, 26 nt, Human
cccagccugugguuacagugcagaca

SEQ ID NO: 5626 - RNA, 23 nt, Human
ccgcuccgcugcgcgcaggcugg

SEQ ID NO: 5627 - RNA, 22 nt, Human
caaccucucugaucuugugcuc

SEQ ID NO: 5628 - RNA, 20 nt, Human
gcgcaggcugggcugcaggc

SEQ ID NO: 5629 - RNA, 26 nt, Human
ugugagccaccgcugccagcacagag

SEQ ID NO: 5630 - RNA, 21 nt, Human
gggcuggugugcaguggugcg

SEQ ID NO: 5631 - RNA, 23 nt, Human
gggcuggugugcaguggugcgac

SEQ ID NO: 5632 - RNA, 23 nt, Human
cagcgcugggcuggugugcagug

SEQ ID NO: 5633 - RNA, 21 nt, Human
aaccucucugaucuugugcuc

SEQ ID NO: 5634 - RNA, 22 nt, Human
cacaaccucucugaucuugugc

SEQ ID NO: 5635 - RNA, 27 nt, Human
cacaaccucucugaucuugugcucagc

SEQ ID NO: 5636 - RNA, 21 nt, Human
agccugugguuacagugcaga

SEQ ID NO: 5637 - RNA, 22 nt, Human
agcgcugggcuggugugcagug

SEQ ID NO: 5638 - RNA, 27 nt, Human
ccagcuccacaguguugccagagccuu

SEQ ID NO: 5639 - RNA, 26 nt, Human
cucggggacacaggccagcuccacag

SEQ ID NO: 5640 - RNA, 19 nt, Human
ucucggggacacaggccag

SEQ ID NO: 5641 - RNA, 28 nt, Human
gacacaggccagcuccacaguguugcca

SEQ ID NO: 5642 - RNA, 21 nt, Human
ccuuccuacuuugcuucucuc

SEQ ID NO: 5643 - RNA, 20 nt, Human
gucuauguuuucuacuccaa

SEQ ID NO: 5644 - RNA, 22 nt, Human
guacagguacaggcuggagauu

SEQ ID NO: 5645 - RNA, 20 nt, Human
uccuacuuugcuucucucca

SEQ ID NO: 5646 - RNA, 19 nt, Human
ugacuucucacuuccuaag

SEQ ID NO: 5647 - RNA, 20 nt, Human
ucuuccacgauggugcagug

SEQ ID NO: 5648 - RNA, 18 nt, Human
uugaagcagaugugguga

SEQ ID NO: 5649 - RNA, 21 nt, Human
uugucccagggcugaugcugu

SEQ ID NO: 5650 - RNA, 19 nt, Human
cuuccacgauggugcagug

SEQ ID NO: 5651 - RNA, 16 nt, Human
cuucccuucuuugcac

SEQ ID NO: 5652 - RNA, 20 nt, Human
cugacuucucacuuccuaag

SEQ ID NO: 5653 - RNA, 22 nt, Human
cuuccuacuuugcuucucucca

SEQ ID NO: 5654 - RNA, 19 nt, Human
ccuacuuugcuucucucca

SEQ ID NO: 5655 - RNA, 21 nt, Human
caguguaacgaugcacuuugg

SEQ ID NO: 5656 - RNA, 21 nt, Human
gcacccuagaggacuagggua

SEQ ID NO: 5657 - RNA, 21 nt, Human
aauaaaucuagcaccccugau

SEQ ID NO: 5658 - RNA, 21 nt, Human
uccugcucuuccauuucuucc

SEQ ID NO: 5659 - RNA, 25 nt, Human
ucuauucauaagucuuugguacaag

SEQ ID NO: 5660 - RNA, 22 nt, Human
uccucaagguagaaaugucuau

SEQ ID NO: 5661 - RNA, 26 nt, Human
uccauccugcucuuccauuucuucca

SEQ ID NO: 5662 - RNA, 22 nt, Human
uuuccagccgaucacuggagcu

SEQ ID NO: 5663 - RNA, 21 nt, Human
uguaguuaauuucagugccuu

SEQ ID NO: 5664 - RNA, 20 nt, Human
uuacagccacaggcacugug

SEQ ID NO: 5665 - RNA, 27 nt, Human
uauuacugaaagggagggguggagaug

SEQ ID NO: 5666 - RNA, 20 nt, Human
ucauucuucuuggcucacca

SEQ ID NO: 5667 - RNA, 20 nt, Human
ucauaccuggcuugcaggga

SEQ ID NO: 5668 - RNA, 22 nt, Human
uggcggcagugacaggaggcgc

SEQ ID NO: 5669 - RNA, 22 nt, Human
ugcuuuccuagauccacacuuu

SEQ ID NO: 5670 - RNA, 21 nt, Human
ugcuccaguaaaaucuugccu

SEQ ID NO: 5671 - RNA, 20 nt, Human
ccagccaccacugaguccac

SEQ ID NO: 5672 - RNA, 27 nt, Human
ggucaggcaucuucccuucacucaagc

SEQ ID NO: 5673 - RNA, 32 nt, Human
guggaaagucagaggaaaaaugauccagugga

SEQ ID NO: 5674 - RNA, 21 nt, Human
gugggaaaguggaguccaccc

SEQ ID NO: 5675 - RNA, 22 nt, Human
agacauguccccguggcugugg

SEQ ID NO: 5676 - RNA, 21 nt, Human
agaguaagccucuccccucca

SEQ ID NO: 5677 - RNA, 24 nt, Human
agggguggagauggguguggcagu

SEQ ID NO: 5678 - RNA, 21 nt, Human
agugaagccuccaacccuaag

SEQ ID NO: 5679 - RNA, 24 nt, Human
caagaccucccuggaacccuucug

SEQ ID NO: 5680 - RNA, 20 nt, Human
aaauccagaccuuauccaca

SEQ ID NO: 5681 - RNA, 21 nt, Human
aagggagggguggagaugggu

SEQ ID NO: 5682 - RNA, 22 nt, Human
agacccaugugcuuccuugcuc

SEQ ID NO: 5683 - RNA, 23 nt, Human
agagaaaccccuccagaacuccc

SEQ ID NO: 5684 - RNA, 29 nt, Human
agagaaaccccuccagaacucccacccug

SEQ ID NO: 5685 - RNA, 20 nt, Human
gcuccaguaaaaucuugccu

SEQ ID NO: 5686 - RNA, 24 nt, Human
ggaagcaucugucuugucauucca

SEQ ID NO: 5687 - RNA, 21 nt, Human
cauuguccucugagcugcagu

SEQ ID NO: 5688 - RNA, 26 nt, Human
caccccagccaccacugaguccacuc

SEQ ID NO: 5689 - RNA, 27 nt, Human
ccagcuguaguuaauuucagugccuua

SEQ ID NO: 5690 - RNA, 26 nt, Human
cccagccucagccugggacaccuagg

SEQ ID NO: 5691 - RNA, 20 nt, Human
cccacggaaagccucauuug

SEQ ID NO: 5692 - RNA, 30 nt, Human
cccacggaaagccucauuuguguggaaagu

SEQ ID NO: 5693 - RNA, 19 nt, Human
cuugucccagccucagccu

SEQ ID NO: 5694 - RNA, 23 nt, Human
gaagcaucugucuugucauucca

SEQ ID NO: 5695 - RNA, 21 nt, Human
cugccaucgccuccaucagcc

SEQ ID NO: 5696 - RNA, 22 nt, Human
cuucccuucacucaagcuuggc

SEQ ID NO: 5697 - RNA, 27 nt, Human
cugugugacucugggugagucccuuaa

SEQ ID NO: 5698 - RNA, 22 nt, Human
cgguggccagagaugccagcag

SEQ ID NO: 5699 - RNA, 22 nt, Human
cguccugccccuuccuccuuca

SEQ ID NO: 5700 - RNA, 24 nt, Human
cguccugccccuuccuccuucaug

SEQ ID NO: 5701 - RNA, 22 nt, Human
uuggcucaccaacccugcaggc

SEQ ID NO: 5702 - RNA, 22 nt, Human
uuccaggguugaaucuuguccc

SEQ ID NO: 5703 - RNA, 19 nt, Human
agggguggagaugggugug

SEQ ID NO: 5704 - RNA, 21 nt, Human
aguaagccucuccccuccaga

SEQ ID NO: 5705 - RNA, 21 nt, Human
ugaaucuucccugucaggcuc

SEQ ID NO: 5706 - RNA, 26 nt, Human
uggauggaguuaaacuugaugccagu

SEQ ID NO: 5707 - RNA, 24 nt, Human
ugucaucugaguugagcacugguc

SEQ ID NO: 5708 - RNA, 20 nt, Human
uguguggaaagucagaggaa

SEQ ID NO: 5709 - RNA, 19 nt, Human
uguguuccuggagaaggca

SEQ ID NO: 5710 - RNA, 26 nt, Human
gucauuguccucugagcugcaguuuc

SEQ ID NO: 5711 - RNA, 23 nt, Human
gggguggagauggguguggcagu

SEQ ID NO: 5712 - RNA, 21 nt, Human
guccugccccuuccuccuuca

SEQ ID NO: 5713 - RNA, 20 nt, Human
gugaagccuccaacccuaag

SEQ ID NO: 5714 - RNA, 23 nt, Human
gugagggcugggggcauccaggc

SEQ ID NO: 5715 - RNA, 17 nt, Human
guggaaagucagaggaa

SEQ ID NO: 5716 - RNA, 26 nt, Human
gcagcccaguggaauggaaagaaugu

SEQ ID NO: 5717 - RNA, 23 nt, Human
ccuuccuccuucaugccugggcc

SEQ ID NO: 5718 - RNA, 24 nt, Human
cccuuccuccuucaugccugggcc

SEQ ID NO: 5719 - RNA, 23 nt, Human
ccguccugccccuuccuccuuca

SEQ ID NO: 5720 - RNA, 21 nt, Human
cucauucuucuuggcucacca

SEQ ID NO: 5721 - RNA, 23 nt, Human
cccugacagcccaacaccaccuu

SEQ ID NO: 5722 - RNA, 27 nt, Human
cccugcaggccucaucuuucccaaaac

SEQ ID NO: 5723 - RNA, 27 nt, Human
cccuccagagcccugaguuucuuggcu

SEQ ID NO: 5724 - RNA, 30 nt, Human
cccuacccauuuggccucuggagggggcag

SEQ ID NO: 5725 - RNA, 25 nt, Human
ucauuagcugugugacucuggguga

SEQ ID NO: 5726 - RNA, 22 nt, Human
uagaugaaugguuaacacgagc

SEQ ID NO: 5727 - RNA, 24 nt, Human
guugcccugccaucgccuccauca

SEQ ID NO: 5728 - RNA, 19 nt, Human
uauuccugccuuucuucca

SEQ ID NO: 5729 - RNA, 19 nt, Human
ccucuucuaccucuuccag

SEQ ID NO: 5730 - RNA, 22 nt, Human
gaauuccuuggagccacuggga

SEQ ID NO: 5731 - RNA, 22 nt, Human
cucuguccuggcugugcacauu

SEQ ID NO: 5732 - RNA, 21 nt, Human
gcagccucuguccuggcugug

SEQ ID NO: 5733 - RNA, 22 nt, Human
gcucauucauauuccugccuuu

SEQ ID NO: 5734 - RNA, 23 nt, Human
gcucauucauauuccugccuuuc

SEQ ID NO: 5735 - RNA, 26 nt, Human
gggaagggaggucuccucuagacuga

SEQ ID NO: 5736 - RNA, 21 nt, Human
guuagccuggugacaggcaga

SEQ ID NO: 5737 - RNA, 21 nt, Human
guccuccuccuggaucuuuag

SEQ ID NO: 5738 - RNA, 18 nt, Human
ucugucuucacuauucag

SEQ ID NO: 5739 - RNA, 24 nt, Human
ucucccucucugcaccugucucau

SEQ ID NO: 5740 - RNA, 23 nt, Human
agugggaggagagggcagagguc

SEQ ID NO: 5741 - RNA, 20 nt, Human
augccucuucuaccucuucc

SEQ ID NO: 5742 - RNA, 22 nt, Human
uugucucuuccucugcaggaca

SEQ ID NO: 5743 - RNA, 26 nt, Human
cuagcacaucauggcagugggaccaa

SEQ ID NO: 5744 - RNA, 20 nt, Human
cucugcaggacacagaucug

SEQ ID NO: 5745 - RNA, 21 nt, Human
cucccucucugcaccugucuc

SEQ ID NO: 5746 - RNA, 24 nt, Human
ccuuguucuuagagcagauucuag

SEQ ID NO: 5747 - RNA, 20 nt, Human
cuggaggacguggacugggg

SEQ ID NO: 5748 - RNA, 20 nt, Human
cuucucccuagugcugguau

SEQ ID NO: 5749 - RNA, 23 nt, Human
ccucacgcucuccaucauaggcu

SEQ ID NO: 5750 - RNA, 24 nt, Human
cccucacgcucuccaucauaggcu

SEQ ID NO: 5751 - RNA, 20 nt, Human
ggaggaugcugugccuccca

SEQ ID NO: 5752 - RNA, 22 nt, Human
gcuguaagcaccugggcugagg

SEQ ID NO: 5753 - RNA, 25 nt, Human
gacuucaagaugccucuucuaccuc

SEQ ID NO: 5754 - RNA, 22 nt, Human
gccaggcucucccucucugcac

SEQ ID NO: 5755 - RNA, 18 nt, Human
aacugauuuuaaaugcaa

SEQ ID NO: 5756 - RNA, 20 nt, Human
acauugccuugagcuuuuca

SEQ ID NO: 5757 - RNA, 22 nt, Human
agacuucuaggaggaugcugug

SEQ ID NO: 5758 - RNA, 23 nt, Human
acacccuacaaguugaucaugca

SEQ ID NO: 5759 - RNA, 24 nt, Human
acacccuacaaguugaucaugcag

SEQ ID NO: 5760 - RNA, 27 nt, Human
cacaggcaaagaggugcugcuuugcuu

SEQ ID NO: 5761 - RNA, 21 nt, Human
cacauugccuugagcuuuuca

SEQ ID NO: 5762 - RNA, 28 nt, Human
agugggaggagagggcagagguccccug

SEQ ID NO: 5763 - RNA, 20 nt, Human
auauuccugccuuucuucca

SEQ ID NO: 5764 - RNA, 23 nt, Human
aggggggaaggggugggagccaa

SEQ ID NO: 5765 - RNA, 22 nt, Human
gggcugaggaggcaguuuuugu

SEQ ID NO: 5766 - RNA, 22 nt, Human
ggucccggguuagccuggugac

SEQ ID NO: 5767 - RNA, 20 nt, Human
cagccucuguccuggcugug

SEQ ID NO: 5768 - RNA, 20 nt, Human
cagcaucuacuacucugucu

SEQ ID NO: 5769 - RNA, 22 nt, Human
ccaggcucucccucucugcacc

SEQ ID NO: 5770 - RNA, 23 nt, Human
ugcuucuucaauggcaccuucau

SEQ ID NO: 5771 - RNA, 23 nt, Human
ucuuccaggaagcacaggccagg

SEQ ID NO: 5772 - RNA, 20 nt, Human
ucucccucucugcaccuguc

SEQ ID NO: 5773 - RNA, 23 nt, Human
uucauauuccugccuuucuucca

SEQ ID NO: 5774 - RNA, 22 nt, Human
uucaguuaaguugcuguaagca

SEQ ID NO: 5775 - RNA, 26 nt, Human
uucauucuccguugucauugacuuca

SEQ ID NO: 5776 - RNA, 19 nt, Human
uuccucugcaggacacaga

SEQ ID NO: 5777 - RNA, 22 nt, Human
uugccuugagcuuuucaguuaa

SEQ ID NO: 5778 - RNA, 25 nt, Human
uguacuuguucuuuucugguagguu

SEQ ID NO: 5779 - RNA, 17 nt, Human
uguggagguggcugguc

SEQ ID NO: 5780 - RNA, 20 nt, Human
uguuguaggaaaagcuguuc

SEQ ID NO: 5781 - RNA, 22 nt, Human
ugcaugcuuuggaaauuuggaa

SEQ ID NO: 5782 - RNA, 23 nt, Human
gggagccgguuugggagagacca

SEQ ID NO: 5783 - RNA, 24 nt, Human
guggugguuucuauacaugaauca

SEQ ID NO: 5784 - RNA, 23 nt, Human
aggacgcauuccaaaucauacuc

SEQ ID NO: 5785 - RNA, 22 nt, Human
agcaguuucacugccaacuuuu

SEQ ID NO: 5786 - RNA, 21 nt, Human
aucauacucacgggaggaauc

SEQ ID NO: 5787 - RNA, 21 nt, Human
acaggaagccgccuagugcag

SEQ ID NO: 5788 - RNA, 22 nt, Human
acucuuugcaacagcacuugcu

SEQ ID NO: 5789 - RNA, 21 nt, Human
gccugcaggggccacucucua

SEQ ID NO: 5790 - RNA, 27 nt, Human
cccuuguucuaaugcugcacaccaguu

SEQ ID NO: 5791 - RNA, 27 nt, Human
cuuuucugguagguucugucugugcca

SEQ ID NO: 5792 - RNA, 20 nt, Human
ccugcaggggccacucucua

SEQ ID NO: 5793 - RNA, 22 nt, Human
augcagugccuuuccccauuca

SEQ ID NO: 5794 - RNA, 23 nt, Human
aucagugagcucaggagagagcu

SEQ ID NO: 5795 - RNA, 25 nt, Human
aggaaagcguuuggaaaacguauca

SEQ ID NO: 5796 - RNA, 22 nt, Human
ugcggaacucuuccuggaaugc

SEQ ID NO: 5797 - RNA, 20 nt, Human
ugcuuuggaaauuuggaaga

SEQ ID NO: 5798 - RNA, 24 nt, Human
ugcuuuggaaauuuggaagauggu

SEQ ID NO: 5799 - RNA, 22 nt, Human
gggcggcggcgacuggagcuuc

SEQ ID NO: 5800 - RNA, 23 nt, Human
gggccaaucacugaguuuguggu

SEQ ID NO: 5801 - RNA, 22 nt, Human
gcuguucccaugucuaacagga

SEQ ID NO: 5802 - RNA, 27 nt, Human
gcuuuuaaacuggagaggcuaaccuca

SEQ ID NO: 5803 - RNA, 21 nt, Human
gcaguuucacugccaacuuuu

SEQ ID NO: 5804 - RNA, 21 nt, Human
gcggaacucuuccuggaaugc

SEQ ID NO: 5805 - RNA, 23 nt, Human
ccuguuucuaaguggccugcagg

SEQ ID NO: 5806 - RNA, 23 nt, Human
uagguauuauauuuuggccuuac

SEQ ID NO: 5807 - RNA, 19 nt, Human
gcgggaaaagcacgugucc

SEQ ID NO: 5808 - RNA, 24 nt, Human
agaaggcaaggccgguguguuuau

SEQ ID NO: 5809 - RNA, 26 nt, Human
ugcagggcgaagagcaggcggcgagc

SEQ ID NO: 5810 - RNA, 22 nt, Human
ucucacccaggcaaucuugccu

SEQ ID NO: 5811 - RNA, 19 nt, Human
ccaggcuggagugcagugg

SEQ ID NO: 5812 - RNA, 24 nt, Human
ccagggaaagagaaaacucgcccu

SEQ ID NO: 5813 - RNA, 26 nt, Human
ccagccgcccgcgcccuccagccccg

SEQ ID NO: 5814 - RNA, 23 nt, Human
acgaucucagcucacugcaagcu

SEQ ID NO: 5815 - RNA, 22 nt, Human
agccucccaaguagcugggacu

SEQ ID NO: 5816 - RNA, 22 nt, Human
agcucacugcaagcucuaccuc

SEQ ID NO: 5817 - RNA, 22 nt, Human
ugucgcccaggcuggagugcag

SEQ ID NO: 5818 - RNA, 21 nt, Human
gcucacugcaagcucuaccuc

SEQ ID NO: 5819 - RNA, 27 nt, Human
gcucacugcaagcucuaccucuugguu

SEQ ID NO: 5820 - RNA, 27 nt, Human
ggagaggggagcagagccggaguuggg

SEQ ID NO: 5821 - RNA, 19 nt, Human
gcccaggcuggagugcagu

SEQ ID NO: 5822 - RNA, 22 nt, Human
gcccaggcuggagugcaguggc

SEQ ID NO: 5823 - RNA, 20 nt, Human
gcacggcaaccgcgaggccu

SEQ ID NO: 5824 - RNA, 22 nt, Human
aaccaagauuaugugacuugca

SEQ ID NO: 5825 - RNA, 23 nt, Human
uucaacacagagaaguugcugcu

SEQ ID NO: 5826 - RNA, 23 nt, Human
ugucgcccaggcuggagugcagu

SEQ ID NO: 5827 - RNA, 18 nt, Human
ucgcccaggcuggagugc

SEQ ID NO: 5828 - RNA, 21 nt, Human
ucgcccaggcuggagugcagu

SEQ ID NO: 5829 - RNA, 22 nt, Human
ucgcccaggcuggagugcagug

SEQ ID NO: 5830 - RNA, 21 nt, Human
ucuguaaccucccguugcguc

SEQ ID NO: 5831 - RNA, 22 nt, Human
aguggcacgaucucagcucacu

SEQ ID NO: 5832 - RNA, 23 nt, Human
aggcuggagugcaguggcacgau

SEQ ID NO: 5833 - RNA, 20 nt, Human
uuucucucacugucuauuua

SEQ ID NO: 5834 - RNA, 27 nt, Human
agcucacugcaagcucuaccucuuggu

SEQ ID NO: 5835 - RNA, 22 nt, Human
uuugucgcccaggcuggagugc

SEQ ID NO: 5836 - RNA, 26 nt, Human
uuugucgcccaggcuggagugcagug

SEQ ID NO: 5837 - RNA, 20 nt, Human
cgcccaggcuggagugcagu

SEQ ID NO: 5838 - RNA, 21 nt, Human
cgcccaggcuggagugcagug

SEQ ID NO: 5839 - RNA, 22 nt, Human
cgccccggagggaggccgaggg

SEQ ID NO: 5840 - RNA, 26 nt, Human
cugaaaacugugucuuccuggagacu

SEQ ID NO: 5841 - RNA, 26 nt, Human
cccuccagccccguccgggagucccc

SEQ ID NO: 5842 - RNA, 19 nt, Human
cccaggcuggagugcagug

SEQ ID NO: 5843 - RNA, 22 nt, Human
cccaaguagcugggacuacagg

SEQ ID NO: 5844 - RNA, 23 nt, Human
ccauucuccugccccagccuccc

SEQ ID NO: 5845 - RNA, 22 nt, Human
ccaaguagcugggacuacaggu

SEQ ID NO: 5846 - RNA, 22 nt, Human
caggcuggagugcaguggcacg

SEQ ID NO: 5847 - RNA, 27 nt, Human
caggcuggagugcaguggcacgaucuc

SEQ ID NO: 5848 - RNA, 23 nt, Human
uacagguugcugaaaagccagga

SEQ ID NO: 5849 - RNA, 21 nt, Human
ucacugcaagcucuaccucuu

SEQ ID NO: 5850 - RNA, 20 nt, Human
ccuucugguuucuuccagcc

SEQ ID NO: 5851 - RNA, 26 nt, Human
cucacacacagauuuuuauguuuucu

SEQ ID NO: 5852 - RNA, 22 nt, Human
cgcccaggcuggagugcagugg

SEQ ID NO: 5853 - RNA, 21 nt, Human
cuuucucucacugucuauuua

SEQ ID NO: 5854 - RNA, 20 nt, Human
cccaggcuggagugcagugg

SEQ ID NO: 5855 - RNA, 22 nt, Human
cccagccucccaaguagcuggg

SEQ ID NO: 5856 - RNA, 25 nt, Human
gcccaggcuggagugcaguggcacg

SEQ ID NO: 5857 - RNA, 16 nt, Human
gcugcuugugaucuca

SEQ ID NO: 5858 - RNA, 22 nt, Human
gcucacugcaagcucuaccucu

SEQ ID NO: 5859 - RNA, 32 nt, Human
gcucacugcaagcucuaccucuugguucacgc

SEQ ID NO: 5860 - RNA, 21 nt, Human
ggagaggggagcagagccgga

SEQ ID NO: 5861 - RNA, 22 nt, Human
gucgcccaggcuggagugcagu

SEQ ID NO: 5862 - RNA, 23 nt, Human
gucgcccaggcuggagugcagug

SEQ ID NO: 5863 - RNA, 22 nt, Human
gggcugagaagauccugaguac

SEQ ID NO: 5864 - RNA, 24 nt, Human
ggguaaaagcccacccuacagaaa

SEQ ID NO: 5865 - RNA, 20 nt, Human
gcuggcuuuggaaugagguu

SEQ ID NO: 5866 - RNA, 19 nt, Human
gcagacagaccaggaacac

SEQ ID NO: 5867 - RNA, 20 nt, Human
cugagcugcugguucacucu

SEQ ID NO: 5868 - RNA, 26 nt, Human
cugagcugcugguucacucuucagca

SEQ ID NO: 5869 - RNA, 22 nt, Human
ucaucccaagguccgucccaug

SEQ ID NO: 5870 - RNA, 21 nt, Human
guugggggagagaagggcagc

SEQ ID NO: 5871 - RNA, 27 nt, Human
caugcucuguggccuucuuacacuucu

SEQ ID NO: 5872 - RNA, 23 nt, Human
caaagcccuccagccuguuugug

SEQ ID NO: 5873 - RNA, 27 nt, Human
ccccagccaacuucaugggucacuuuu

SEQ ID NO: 5874 - RNA, 19 nt, Human
cuugcagaaucaccacacg

SEQ ID NO: 5875 - RNA, 22 nt, Human
uuuucucaaauccuggagagag

SEQ ID NO: 5876 - RNA, 21 nt, Human
agcaguuucccacuugccaaa

SEQ ID NO: 5877 - RNA, 22 nt, Human
agcaguuucccacuugccaaag

SEQ ID NO: 5878 - RNA, 25 nt, Human
uucacucuucagcauuuaugaaaca

SEQ ID NO: 5879 - RNA, 21 nt, Human
agggcagcagcuuauuggugg

SEQ ID NO: 5880 - RNA, 23 nt, Human
uguguaguguggucugggcaggc

SEQ ID NO: 5881 - RNA, 23 nt, Human
ugccuucagaaauaaguccuaga

SEQ ID NO: 5882 - RNA, 20 nt, Human
gcaguuucccacuugccaaa

SEQ ID NO: 5883 - RNA, 26 nt, Human
gcaguuucccacuugccaaagauccc

SEQ ID NO: 5884 - RNA, 18 nt, Human
gcccuucaucagccuggg

SEQ ID NO: 5885 - RNA, 28 nt, Human
gcccggaccugaugugaaaggaccacgg

SEQ ID NO: 5886 - RNA, 19 nt, Human
gcuguuguaaaaugccuuc

SEQ ID NO: 5887 - RNA, 24 nt, Human
ugguugucauuuggcaaaggagau

SEQ ID NO: 5888 - RNA, 28 nt, Human
uguaguguggucugggcaggcagaccuu

SEQ ID NO: 5889 - RNA, 21 nt, Human
ugggggagagaagggcagcag

SEQ ID NO: 5890 - RNA, 27 nt, Human
agcaguuucccacuugccaaagauccc

SEQ ID NO: 5891 - RNA, 17 nt, Human
auuggcagaaacaguga

SEQ ID NO: 5892 - RNA, 24 nt, Human
caaagcccuccagccuguuugugg

SEQ ID NO: 5893 - RNA, 17 nt, Human
agaaauucugcaguggc

SEQ ID NO: 5894 - RNA, 24 nt, Human
aagugaucucagaggggcccaugg

SEQ ID NO: 5895 - RNA, 24 nt, Human
aaugguugggggagagaagggcag

SEQ ID NO: 5896 - RNA, 26 nt, Human
caguguccguguuaauguauuuggcu

SEQ ID NO: 5897 - RNA, 24 nt, Human
ccagcccuucaucagccugggcag

SEQ ID NO: 5898 - RNA, 22 nt, Human
gggagagaagggcagcagcuua

SEQ ID NO: 5899 - RNA, 25 nt, Human
gucauuuggcaaaggagaugacuua

SEQ ID NO: 5900 - RNA, 23 nt, Human
uccuagacuggacucuugaggga

SEQ ID NO: 5901 - RNA, 22 nt, Human
ucugacauuaacaguuuuccau

SEQ ID NO: 5902 - RNA, 24 nt, Human
gugucucuuuucucuuucuccuua

SEQ ID NO: 5903 - RNA, 21 nt, Human
caggccugggucugugucucu

SEQ ID NO: 5904 - RNA, 27 nt, Human
acacuucagagagcugguaguuaguag

SEQ ID NO: 5905 - RNA, 27 nt, Human
uguucugacauuaacaguuuuccauga

SEQ ID NO: 5906 - RNA, 22 nt, Human
gcccgagcuggugcauuacaga

SEQ ID NO: 5907 - RNA, 26 nt, Human
gagaaacacaucuucccuagaggguu

SEQ ID NO: 5908 - RNA, 23 nt, Human
gaguguguauuguucccagugac

SEQ ID NO: 5909 - RNA, 23 nt, Human
ugcuucacagcgcccaccugucu

SEQ ID NO: 5910 - RNA, 21 nt, Human
ugagccaggccugggucugug

SEQ ID NO: 5911 - RNA, 23 nt, Human
aggguuccuguagaccuagggag

SEQ ID NO: 5912 - RNA, 27 nt, Human
aggcagccggcacccacaagugccacu

SEQ ID NO: 5913 - RNA, 22 nt, Human
auuuaagcauuguuugcuuauu

SEQ ID NO: 5914 - RNA, 23 nt, Human
uuccuggcaauaguguguucuga

SEQ ID NO: 5915 - RNA, 24 nt, Human
agcagugaccgugcuccuacccag

SEQ ID NO: 5916 - RNA, 21 nt, Human
cuuuucucuuucuccuuaguc

SEQ ID NO: 5917 - RNA, 22 nt, Human
gaauguucugacauuaacaguu

SEQ ID NO: 5918 - RNA, 22 nt, Human
ccggcacccacaagugccacug

SEQ ID NO: 5919 - RNA, 23 nt, Human
caauguucauuguaauguuacug

SEQ ID NO: 5920 - RNA, 23 nt, Human
cacaccaggcugugggccucaag

SEQ ID NO: 5921 - RNA, 20 nt, Human
uaucugugcgugaaacacac

SEQ ID NO: 5922 - RNA, 24 nt, Human
ggucugugucucuuuucucuuucu

SEQ ID NO: 5923 - RNA, 22 nt, Human
gcacccacugcauuugcagccu

SEQ ID NO: 5924 - RNA, 19 nt, Human
gcauuuucuacauguauua

SEQ ID NO: 5925 - RNA, 21 nt, Human
ccucuaucacgaagauauuga

SEQ ID NO: 5926 - RNA, 21 nt, Human
uaaugccaguuccagcuucau

SEQ ID NO: 5927 - RNA, 21 nt, Human
cauuccugccugacaggacca

SEQ ID NO: 5928 - RNA, 23 nt, Human
ccuacccuaaugccaguuccagc

SEQ ID NO: 5929 - RNA, 22 nt, Human
ccagagagaggccaaggcugau

SEQ ID NO: 5930 - RNA, 25 nt, Human
gacacaaaauauuggaagaguggca

SEQ ID NO: 5931 - RNA, 20 nt, Human
uugcauuuuaucaaaugcau

SEQ ID NO: 5932 - RNA, 25 nt, Human
auggauuugcacccacugcauuugc

SEQ ID NO: 5933 - RNA, 23 nt, Human
uggugagagaaagugaaaugaaa

SEQ ID NO: 5934 - RNA, 25 nt, Human
uuugcacccacugcauuugcagccu

SEQ ID NO: 5935 - RNA, 22 nt, Human
acacuccuaaauuuagagucaa

SEQ ID NO: 5936 - RNA, 23 nt, Human
aauaaaccacacuuaguccugau

SEQ ID NO: 5937 - RNA, 24 nt, Human
cacagguuguagagauagagaugg

SEQ ID NO: 5938 - RNA, 24 nt, Human
agagguggggaacaaguaaaagcu

SEQ ID NO: 5939 - RNA, 22 nt, Human
ccacugcauuugcagccuugag

SEQ ID NO: 5940 - RNA, 27 nt, Human
ccacugcauuugcagccuugaggucau

SEQ ID NO: 5941 - RNA, 23 nt, Human
ggcucuggcugugcauucagcag

SEQ ID NO: 5942 - RNA, 24 nt, Human
cccacugcauuugcagccuugagg

SEQ ID NO: 5943 - RNA, 28 nt, Human
guuauaucagacuggagcaccagagaga

SEQ ID NO: 5944 - RNA, 18 nt, Human
ucucugaaaaggaauuga

SEQ ID NO: 5945 - RNA, 23 nt, Human
ugcacccacugcauuugcagccu

SEQ ID NO: 5946 - RNA, 24 nt, Human
uagguuuuuuauagcuauuaaaaa

SEQ ID NO: 5947 - RNA, 22 nt, Human
agccuccugggcauguuugucu

SEQ ID NO: 5948 - RNA, 21 nt, Human
uguuugucugugugcuguaac

SEQ ID NO: 5949 - RNA, 26 nt, Human
cuccugggcauguuugucugugugcu

SEQ ID NO: 5950 - RNA, 18 nt, Human
ccuguucucuuugccuug

SEQ ID NO: 5951 - RNA, 23 nt, Human
ccuguguagcugggauuauagau

SEQ ID NO: 5952 - RNA, 21 nt, Human
cugccaccugcugcugcugcu

SEQ ID NO: 5953 - RNA, 23 nt, Human
cucuuccuugcugugucauacca

SEQ ID NO: 5954 - RNA, 24 nt, Human
cugcugcugcugcugcuaaucuuc

SEQ ID NO: 5955 - RNA, 19 nt, Human
cccucccuccucugucccu

SEQ ID NO: 5956 - RNA, 25 nt, Human
gcugggagggauagaggggggcugc

SEQ ID NO: 5957 - RNA, 20 nt, Human
gcugccuggcccccagcugu

SEQ ID NO: 5958 - RNA, 22 nt, Human
gcuugcguuagaaugaggagga

SEQ ID NO: 5959 - RNA, 24 nt, Human
gcuuugacugagcagacuggugag

SEQ ID NO: 5960 - RNA, 27 nt, Human
ggagagggaugaggugcugggagggau

SEQ ID NO: 5961 - RNA, 26 nt, Human
ggagagaaaggggauguauccauggg

SEQ ID NO: 5962 - RNA, 24 nt, Human
ggcugaccuugaacuccugggcuc

SEQ ID NO: 5963 - RNA, 27 nt, Human
guaaaacugaggcacgagcaaagugaa

SEQ ID NO: 5964 - RNA, 27 nt, Human
gggggaucuguuguguacguggagagg

SEQ ID NO: 5965 - RNA, 19 nt, Human
uagagauggaggaggaggc

SEQ ID NO: 5966 - RNA, 23 nt, Human
ucagcacuugggggaucuguugu

SEQ ID NO: 5967 - RNA, 19 nt, Human
cuccgccucugcuggcaca

SEQ ID NO: 5968 - RNA, 24 nt, Human
cuccgccucugcuggcacauuucc

SEQ ID NO: 5969 - RNA, 19 nt, Human
cguccugccaccuggggca

SEQ ID NO: 5970 - RNA, 26 nt, Human
ccuugaacuccugggcucaagcaguc

SEQ ID NO: 5971 - RNA, 22 nt, Human
ccuuugaguuuccucaggcugc

SEQ ID NO: 5972 - RNA, 27 nt, Human
ccuuugaguuuccucaggcugcuggag

SEQ ID NO: 5973 - RNA, 18 nt, Human
ccugccaccugcugcugc

SEQ ID NO: 5974 - RNA, 27 nt, Human
ccuguguagcugggauuauagauugga

SEQ ID NO: 5975 - RNA, 28 nt, Human
ccugcugcugcugcugcugcuaaucuuc

SEQ ID NO: 5976 - RNA, 22 nt, Human
gaacuccugggcucaagcaguc

SEQ ID NO: 5977 - RNA, 21 nt, Human
cugcugcugcugcuaaucuuc

SEQ ID NO: 5978 - RNA, 22 nt, Human
cugcuccccucccuccucuguc

SEQ ID NO: 5979 - RNA, 23 nt, Human
cugugggcaggugggagcuugau

SEQ ID NO: 5980 - RNA, 22 nt, Human
cugccaccugcugcugcugcug

SEQ ID NO: 5981 - RNA, 27 nt, Human
ccuaggcugaccuugaacuccugggcu

SEQ ID NO: 5982 - RNA, 25 nt, Human
ccuccugccaccugcugcugcugcu

SEQ ID NO: 5983 - RNA, 24 nt, Human
cccucccuccucugucccuagguc

SEQ ID NO: 5984 - RNA, 20 nt, Human
uggagccaccaugcccagcu

SEQ ID NO: 5985 - RNA, 21 nt, Human
ugccaccugcugcugcugcug

SEQ ID NO: 5986 - RNA, 21 nt, Human
ucuccucuccccucuaaggcc

SEQ ID NO: 5987 - RNA, 19 nt, Human
uccucuugaagaugcugaa

SEQ ID NO: 5988 - RNA, 20 nt, Human
agggcacugcugcugccuuu

SEQ ID NO: 5989 - RNA, 26 nt, Human
gccacugccacacgucugacccucuc

SEQ ID NO: 5990 - RNA, 21 nt, Human
gcuugauucucagcacuuggg

SEQ ID NO: 5991 - RNA, 25 nt, Human
gcuugauucucagcacuugggggau

SEQ ID NO: 5992 - RNA, 25 nt, Human
gcugcugcugcugcugcuaaucuuc

SEQ ID NO: 5993 - RNA, 21 nt, Human
gcugaccuugaacuccugggc

SEQ ID NO: 5994 - RNA, 23 nt, Human
gcugaccuugaacuccugggcuc

SEQ ID NO: 5995 - RNA, 22 nt, Human
uucuccucuccccucuaaggcc

SEQ ID NO: 5996 - RNA, 22 nt, Human
agccuccuguguagcugggauu

SEQ ID NO: 5997 - RNA, 21 nt, Human
aggaaaacugagacucagaca

SEQ ID NO: 5998 - RNA, 27 nt, Human
augacuuugucccauuucuaaaggccu

SEQ ID NO: 5999 - RNA, 18 nt, Human
agaccugagcuccccacc

SEQ ID NO: 6000 - RNA, 21 nt, Human
acugggagggcccacuucagg

SEQ ID NO: 6001 - RNA, 20 nt, Human
acgcugguagagauggagga

SEQ ID NO: 6002 - RNA, 22 nt, Human
acccugaucagucuaagauggg

SEQ ID NO: 6003 - RNA, 22 nt, Human
acccaccucagccuccugugua

SEQ ID NO: 6004 - RNA, 22 nt, Human
ugaacuccugggcucaagcagu

SEQ ID NO: 6005 - RNA, 22 nt, Human
gggagcuugauucucagcacuu

SEQ ID NO: 6006 - RNA, 21 nt, Human
ggggcagucaccugcccagau

SEQ ID NO: 6007 - RNA, 23 nt, Human
ggggcagucuggaggggcauggc

SEQ ID NO: 6008 - RNA, 26 nt, Human
ggcugcuggaggaaaacugagacuca

SEQ ID NO: 6009 - RNA, 20 nt, Human
ccagggaugccaucuguggg

SEQ ID NO: 6010 - RNA, 24 nt, Human
caggcugcuggaggaaaacugaga

SEQ ID NO: 6011 - RNA, 21 nt, Human
caguccaccugagcugccauc

SEQ ID NO: 6012 - RNA, 20 nt, Human
gggaacaccuuccaccauga

SEQ ID NO: 6013 - RNA, 21 nt, Human
ggggugcaccuguccaauagg

SEQ ID NO: 6014 - RNA, 18 nt, Human
guccccuucuccaucgcc

SEQ ID NO: 6015 - RNA, 21 nt, Human
uggagaaggugggcacuggau

SEQ ID NO: 6016 - RNA, 25 nt, Human
uccacgaagaaagcaacgaaugaaa

SEQ ID NO: 6017 - RNA, 20 nt, Human
agaccugacguacucugguu

SEQ ID NO: 6018 - RNA, 26 nt, Human
aaagaagaaaagguucuuacugcuug

SEQ ID NO: 6019 - RNA, 22 nt, Human
aacacuuguaauuuuguaucuu

SEQ ID NO: 6020 - RNA, 22 nt, Human
auccaggucacggggcaccaaa

SEQ ID NO: 6021 - RNA, 23 nt, Human
auaauaaggaauaaaccccaccu

SEQ ID NO: 6022 - RNA, 20 nt, Human
aggccagcugugguuuucuu

SEQ ID NO: 6023 - RNA, 24 nt, Human
agaccuuaacccaccaaccugccu

SEQ ID NO: 6024 - RNA, 22 nt, Human
uucauuucaucuaccauuuucu

SEQ ID NO: 6025 - RNA, 20 nt, Human
uucccccucucccaguuguc

SEQ ID NO: 6026 - RNA, 24 nt, Human
uuaauuucuucacaccuacccucc

SEQ ID NO: 6027 - RNA, 21 nt, Human
gcgaccagcggggauccuccc

SEQ ID NO: 6028 - RNA, 24 nt, Human
aaagaagaaaagguucuuacugcu

SEQ ID NO: 6029 - RNA, 22 nt, Human
aauuuuguaucuugaugucuuu

SEQ ID NO: 6030 - RNA, 20 nt, Human
auaguauuuuuauauuuaaa

SEQ ID NO: 6031 - RNA, 23 nt, Human
uuccauuuaauggggugcaccug

SEQ ID NO: 6032 - RNA, 28 nt, Human
agcaguacugcggccuccucuccucucc

SEQ ID NO: 6033 - RNA, 20 nt, Human
ucuggagaaggugggcacug

SEQ ID NO: 6034 - RNA, 21 nt, Human
ugcuuguuugcuucaacuguc

SEQ ID NO: 6035 - RNA, 19 nt, Human
uguccccuucuccaucgcc

SEQ ID NO: 6036 - RNA, 20 nt, Human
uguguaacugcccaaagcag

SEQ ID NO: 6037 - RNA, 22 nt, Human
caguuaaucuugcuuucuuugu

SEQ ID NO: 6038 - RNA, 27 nt, Human
caguuaaucuugcuuucuuuguuuggc

SEQ ID NO: 6039 - RNA, 21 nt, Human
cuccuaguucuucaucccacu

SEQ ID NO: 6040 - RNA, 20 nt, Human
uaacccaccaaccugccugu

SEQ ID NO: 6041 - RNA, 20 nt, Human
ggagagaagguagggguugg

SEQ ID NO: 6042 - RNA, 21 nt, Human
gccuacucugugaacuccggg

SEQ ID NO: 6043 - RNA, 25 nt, Human
gaggagauggggacagggcuggagu

SEQ ID NO: 6044 - RNA, 27 nt, Human
cuguggcaggccagcugugguuuucuu

SEQ ID NO: 6045 - RNA, 23 nt, Human
cucugcucuuggaggagaugggg

SEQ ID NO: 6046 - RNA, 21 nt, Human
gaaagcuccggugcuuggacc

SEQ ID NO: 6047 - RNA, 21 nt, Human
cuucccccucucccaguuguc

SEQ ID NO: 6048 - RNA, 21 nt, Human
ccuaccucugcucuuggagga

SEQ ID NO: 6049 - RNA, 23 nt, Human
ggccuccucuccucuccuaaccu

SEQ ID NO: 6050 - RNA, 16 nt, Human
aagagagugaucaugu

SEQ ID NO: 6051 - RNA, 23 nt, Human
uucuucugugggagaacuuaaug

SEQ ID NO: 6052 - RNA, 20 nt, Human
ugucaguguuugggaaauua

SEQ ID NO: 6053 - RNA, 21 nt, Human
gaguccuugcaaaauugucua

SEQ ID NO: 6054 - RNA, 22 nt, Human
ggagaaggaaaaagaacuuacg

SEQ ID NO: 6055 - RNA, 20 nt, Human
gugaaaaauuaacaugugga

SEQ ID NO: 6056 - RNA, 22 nt, Human
ucaugaucucaggauguaugga

SEQ ID NO: 6057 - RNA, 25 nt, Human
uauuaauaaaacuuuggaaauugcu

SEQ ID NO: 6058 - RNA, 22 nt, Human
uguuuuuuaaaaguaauuuuua

SEQ ID NO: 6059 - RNA, 21 nt, Human
agaauggaguccucaugaccu

SEQ ID NO: 6060 - RNA, 31 nt, Human
agggcauggcacugacaucugccuuguaacu

SEQ ID NO: 6061 - RNA, 21 nt, Human
aucccggagaaggaaaaagaa

SEQ ID NO: 6062 - RNA, 22 nt, Human
cacucacugaagcuucgauuuc

SEQ ID NO: 6063 - RNA, 22 nt, Human
aaagaaauuuauuuucuuccua

SEQ ID NO: 6064 - RNA, 22 nt, Human
acacauuuaucauuuaaugcau

SEQ ID NO: 6065 - RNA, 20 nt, Human
aauucuuuaaucuguccagu

SEQ ID NO: 6066 - RNA, 20 nt, Human
acacacacauuuaucauuua

SEQ ID NO: 6067 - RNA, 21 nt, Human
acuucuauauaugaaugucuu

SEQ ID NO: 6068 - RNA, 21 nt, Human
acucacugaagcuucgauuuc

SEQ ID NO: 6069 - RNA, 20 nt, Human
ucccggagaaggaaaaagaa

SEQ ID NO: 6070 - RNA, 26 nt, Human
uccaauaaauuauauaccugccuaag

SEQ ID NO: 6071 - RNA, 21 nt, Human
ugaagcuucgauuucccacug

SEQ ID NO: 6072 - RNA, 21 nt, Human
cagucccaguuucucuuauua

SEQ ID NO: 6073 - RNA, 27 nt, Human
caguagaacuaugucggagcacucacu

SEQ ID NO: 6074 - RNA, 32 nt, Human
aagucaaagacaggaagagaucagagugaaug

SEQ ID NO: 6075 - RNA, 24 nt, Human
ggaggcugggaaggcgaagggcau

SEQ ID NO: 6076 - RNA, 24 nt, Human
gcauggcacugacaucugccuugu

SEQ ID NO: 6077 - RNA, 17 nt, Human
gacuauacagugucacu

SEQ ID NO: 6078 - RNA, 28 nt, Human
ccggacaugcaggugaauauuuuaauag

SEQ ID NO: 6079 - RNA, 18 nt, Human
ugcuaaaguaauuuacaa

SEQ ID NO: 6080 - RNA, 22 nt, Human
ucuuugguaguuuuuugcacua

SEQ ID NO: 6081 - RNA, 26 nt, Human
ugauuacuauauuuuguucacacuaa

SEQ ID NO: 6082 - RNA, 32 nt, Human
uccuaucauucauuccuucauucugaacaggc

SEQ ID NO: 6083 - RNA, 22 nt, Human
uucaccaaaccaaauguggaaa

SEQ ID NO: 6084 - RNA, 25 nt, Human
agugucacucauuuguaguaaaacu

SEQ ID NO: 6085 - RNA, 23 nt, Human
agggcauggcacugacaucugcc

SEQ ID NO: 6086 - RNA, 22 nt, Human
ucugcccuuccuuucccugggg

SEQ ID NO: 6087 - RNA, 22 nt, Human
agcuugggaggaagcccaguag

SEQ ID NO: 6088 - RNA, 21 nt, Human
ggggccauucguaugcagccu

SEQ ID NO: 6089 - RNA, 22 nt, Human
gggggagcugaaagggagcccc

SEQ ID NO: 6090 - RNA, 27 nt, Human
gggggagcugaaagggagccccugcuc

SEQ ID NO: 6091 - RNA, 20 nt, Human
ggggcagcaggagcgguaga

SEQ ID NO: 6092 - RNA, 19 nt, Human
gggcagcaggagcgguaga

SEQ ID NO: 6093 - RNA, 26 nt, Human
gggagagacugugaggcggcagcugg

SEQ ID NO: 6094 - RNA, 29 nt, Human
gguuguugccagguugcagcugcucuugc

SEQ ID NO: 6095 - RNA, 20 nt, Human
gucuuccucuuguuuacgac

SEQ ID NO: 6096 - RNA, 27 nt, Human
gugagcaggcuuugggaacacuggccu

SEQ ID NO: 6097 - RNA, 19 nt, Human
guccacccucauuucugcc

SEQ ID NO: 6098 - RNA, 26 nt, Human
guugcagcugcucuugcaucugggcc

SEQ ID NO: 6099 - RNA, 24 nt, Human
gcugacaucuugcacggugacccc

SEQ ID NO: 6100 - RNA, 27 nt, Human
ggcuggcuguuggccccucugcugucc

SEQ ID NO: 6101 - RNA, 23 nt, Human
ggagcucgggacggauaguagac

SEQ ID NO: 6102 - RNA, 25 nt, Human
ggccaggguagacuuggagcugucc

SEQ ID NO: 6103 - RNA, 24 nt, Human
gaucguggccaacguggaccugcc

SEQ ID NO: 6104 - RNA, 18 nt, Human
gcagguggccacagcagg

SEQ ID NO: 6105 - RNA, 22 nt, Human
ccguugcgggguggagugaggu

SEQ ID NO: 6106 - RNA, 23 nt, Human
ccuccugggaaggagggagcugc

SEQ ID NO: 6107 - RNA, 21 nt, Human
ccugggaaggagggagcugcu

SEQ ID NO: 6108 - RNA, 22 nt, Human
cgguucuuccuggaaguugacu

SEQ ID NO: 6109 - RNA, 20 nt, Human
cucccuucucucuuuucuuc

SEQ ID NO: 6110 - RNA, 20 nt, Human
gaacccccuccagacaccca

SEQ ID NO: 6111 - RNA, 23 nt, Human
cuccuguuucucauccuagcuuu

SEQ ID NO: 6112 - RNA, 25 nt, Human
uagacacaucuauaauuuuacacac

SEQ ID NO: 6113 - RNA, 23 nt, Human
guuguugccagguugcagcugcu

SEQ ID NO: 6114 - RNA, 20 nt, Human
agggagcugcucagaaugcc

SEQ ID NO: 6115 - RNA, 20 nt, Human
aguggggccuccuugcccag

SEQ ID NO: 6116 - RNA, 23 nt, Human
augaggcuuuucccaccagcucc

SEQ ID NO: 6117 - RNA, 24 nt, Human
aucguauuauccaaauuuuguugc

SEQ ID NO: 6118 - RNA, 22 nt, Human
acgaggcaggggcucugcuucc

SEQ ID NO: 6119 - RNA, 26 nt, Human
accugccuacggagggugggcucuga

SEQ ID NO: 6120 - RNA, 21 nt, Human
acagaggccucccccagccag

SEQ ID NO: 6121 - RNA, 22 nt, Human
aaaaugugaagcugaacccccu

SEQ ID NO: 6122 - RNA, 24 nt, Human
cagggcugugaugggcgagucccg

SEQ ID NO: 6123 - RNA, 25 nt, Human
ggcuccuguuucucauccuagcuuu

SEQ ID NO: 6124 - RNA, 22 nt, Human
ggcucugcuuccucagcccuag

SEQ ID NO: 6125 - RNA, 23 nt, Human
ggcgacugucauguggcuugguu

SEQ ID NO: 6126 - RNA, 21 nt, Human
cccacccccaaagaccugccu

SEQ ID NO: 6127 - RNA, 24 nt, Human
guguuucuuucccaaaaugugccu

SEQ ID NO: 6128 - RNA, 22 nt, Human
guggcggggcagcaggagcggu

SEQ ID NO: 6129 - RNA, 22 nt, Human
uaaaguauccaugcaugugcau

SEQ ID NO: 6130 - RNA, 28 nt, Human
ggguagaauuguuuggcaaugcacugaa

SEQ ID NO: 6131 - RNA, 30 nt, Human
ggguagaauuguuuggcaaugcacugaagc

SEQ ID NO: 6132 - RNA, 27 nt, Human
gucagagggacugucagcugagcuuga

SEQ ID NO: 6133 - RNA, 26 nt, Human
gguggguggagucaggcuucucuugc

SEQ ID NO: 6134 - RNA, 24 nt, Human
ugaaaccaggguagaauuguuugg

SEQ ID NO: 6135 - RNA, 20 nt, Human
ugagaagaaggaagaucuug

SEQ ID NO: 6136 - RNA, 21 nt, Human
uggcggggcagcaggagcggu

SEQ ID NO: 6137 - RNA, 26 nt, Human
uggccaggguagacuuggagcugucc

SEQ ID NO: 6138 - RNA, 26 nt, Human
ugccuaggagcuggcuggcagguguu

SEQ ID NO: 6139 - RNA, 22 nt, Human
ucaggauuuaaaauuuaauuau

SEQ ID NO: 6140 - RNA, 21 nt, Human
uagcuuuuuccuggaaaagcc

SEQ ID NO: 6141 - RNA, 23 nt, Human
uagcuuuuuccuggaaaagcccg

SEQ ID NO: 6142 - RNA, 24 nt, Human
ucccccaugugccugucacgcucu

SEQ ID NO: 6143 - RNA, 24 nt, Human
ucuauguaggugauguuuccagcu

SEQ ID NO: 6144 - RNA, 23 nt, Human
uguugccagguugcagcugcucu

SEQ ID NO: 6145 - RNA, 28 nt, Human
ugucugguggguggagucaggcuucucu

SEQ ID NO: 6146 - RNA, 23 nt, Human
uguccacccucauuucugccagc

SEQ ID NO: 6147 - RNA, 26 nt, Human
ugucccccacccccaaagaccugccu

SEQ ID NO: 6148 - RNA, 22 nt, Human
uucucccuucucucuuuucuuc

SEQ ID NO: 6149 - RNA, 27 nt, Human
uucucccuucucucuuuucuucucagg

SEQ ID NO: 6150 - RNA, 22 nt, Human
uugcccaggucucacugcuuug

SEQ ID NO: 6151 - RNA, 27 nt, Human
uugcccaggucucacugcuuugcaccg

SEQ ID NO: 6152 - RNA, 25 nt, Human
uugcgggguggagugagguuaguuc

SEQ ID NO: 6153 - RNA, 20 nt, Human
uuuagucaggagagugcaga

SEQ ID NO: 6154 - RNA, 25 nt, Human
ucuugcacggugaccccuuuuaguc

SEQ ID NO: 6155 - RNA, 22 nt, Human
ugcauucacaaggugacuggga

SEQ ID NO: 6156 - RNA, 27 nt, Human
ugaggccuuccagaaagcaggagcagc

SEQ ID NO: 6157 - RNA, 22 nt, Human
uccucuuggagcugagaugagc

SEQ ID NO: 6158 - RNA, 23 nt, Human
uccucuuggagcugagaugagcc

SEQ ID NO: 6159 - RNA, 23 nt, Human
uccagaggggucacguguaggag

SEQ ID NO: 6160 - RNA, 23 nt, Human
ucucucuuuucuucucaggauuu

SEQ ID NO: 6161 - RNA, 22 nt, Human
ugcccccguuccagcugacauc

SEQ ID NO: 6162 - RNA, 21 nt, Human
ugcccuugugcccugccucca

SEQ ID NO: 6163 - RNA, 23 nt, Human
uguacauccaaauuaaagggaaa

SEQ ID NO: 6164 - RNA, 21 nt, Human
agcuggggagcagcugagaug

SEQ ID NO: 6165 - RNA, 24 nt, Human
uuccagcugacaucuugcacggug

SEQ ID NO: 6166 - RNA, 25 nt, Human
uugcagcugcucuugcaucugggcc

SEQ ID NO: 6167 - RNA, 22 nt, Human
agcaggacugaggacaggcccc

SEQ ID NO: 6168 - RNA, 22 nt, Human
ccuaugggcuuccgcacaugcc

SEQ ID NO: 6169 - RNA, 20 nt, Human
ccagagacaugggccuccca

SEQ ID NO: 6170 - RNA, 22 nt, Human
ccacuggcgaagauggucucca

SEQ ID NO: 6171 - RNA, 23 nt, Human
caugacaacugaaggcaaccugg

SEQ ID NO: 6172 - RNA, 24 nt, Human
cacuggcgaagauggucuccauau

SEQ ID NO: 6173 - RNA, 28 nt, Human
gacagcagccucccugucacucagcuga

SEQ ID NO: 6174 - RNA, 21 nt, Human
cuuggagcuguccuccagagg

SEQ ID NO: 6175 - RNA, 26 nt, Human
ccuucccagcagacauccucaucggg

SEQ ID NO: 6176 - RNA, 24 nt, Human
cgccuuccccucaguuguuucuaa

SEQ ID NO: 6177 - RNA, 25 nt, Human
gccagcccucccuggcugugagcag

SEQ ID NO: 6178 - RNA, 21 nt, Human
gagugucacugagcuguguuu

SEQ ID NO: 6179 - RNA, 21 nt, Human
gcaccauucucccuucucucu

SEQ ID NO: 6180 - RNA, 24 nt, Human
gagcagccuccacuguguccagag

SEQ ID NO: 6181 - RNA, 19 nt, Human
ggagugagaagaaggaaga

SEQ ID NO: 6182 - RNA, 21 nt, Human
ggcagggagugucugcagucc

SEQ ID NO: 6183 - RNA, 25 nt, Human
ggccucccacuccuguuccuugcua

SEQ ID NO: 6184 - RNA, 24 nt, Human
gcgcucaacugcagccccuccucc

SEQ ID NO: 6185 - RNA, 26 nt, Human
gcucuuuguggcaguggccaggcagg

SEQ ID NO: 6186 - RNA, 21 nt, Human
gcuggauuugggagcucugcu

SEQ ID NO: 6187 - RNA, 22 nt, Human
ggaggcugagaugggaggauca

SEQ ID NO: 6188 - RNA, 25 nt, Human
gcaauugcuucucuaaaacagcacu

SEQ ID NO: 6189 - RNA, 25 nt, Human
gccguggcaacuguggaaggcacac

SEQ ID NO: 6190 - RNA, 21 nt, Human
aaauguucugacagcauuuca

SEQ ID NO: 6191 - RNA, 22 nt, Human
cuguggucccagcuacagggga

SEQ ID NO: 6192 - RNA, 23 nt, Human
caccacugccauuuccuccuggg

SEQ ID NO: 6193 - RNA, 22 nt, Human
cagaagcucaaggcugcaguga

SEQ ID NO: 6194 - RNA, 19 nt, Human
caaggugaauggugagcag

SEQ ID NO: 6195 - RNA, 19 nt, Human
ccagaagcucaaggcugca

SEQ ID NO: 6196 - RNA, 23 nt, Human
ccagaagcucaaggcugcaguga

SEQ ID NO: 6197 - RNA, 25 nt, Human
uuuugaaauauucacaagguugcug

SEQ ID NO: 6198 - RNA, 20 nt, Human
uuucagcugugagcuuucug

SEQ ID NO: 6199 - RNA, 22 nt, Human
aggcugagacgcaaggaucacu

SEQ ID NO: 6200 - RNA, 21 nt, Human
ugguagaguccuaggacaucu

SEQ ID NO: 6201 - RNA, 24 nt, Human
uguucugacagcauuucagcugug

SEQ ID NO: 6202 - RNA, 24 nt, Human
uucacaccacugccauuuccuccu

SEQ ID NO: 6203 - RNA, 25 nt, Human
ugcuucucuaaaacagcacuaucga

SEQ ID NO: 6204 - RNA, 17 nt, Human
uggaaaccuugcugcua

SEQ ID NO: 6205 - RNA, 21 nt, Human
ugagccaaguucacaccacug

SEQ ID NO: 6206 - RNA, 25 nt, Human
uucucagaagugaaaaagacuucaa

SEQ ID NO: 6207 - RNA, 22 nt, Human
ugcauguaauccuagcacuuug

SEQ ID NO: 6208 - RNA, 23 nt, Human
ugcuggcauuugcugcauuucaa

SEQ ID NO: 6209 - RNA, 22 nt, Human
ugcagugagccaaguucacacc

SEQ ID NO: 6210 - RNA, 20 nt, Human
gguauuugguaacuugcugu

SEQ ID NO: 6211 - RNA, 13 nt, Human
accaaaugccuuu

SEQ ID NO: 6212 - RNA, 22 nt, Human
agaccaaccuggguaacaaagu

SEQ ID NO: 6213 - RNA, 19 nt, Human
acugccauuuccuccuggg

SEQ ID NO: 6214 - RNA, 27 nt, Human
acuauugcugcuuucucuucuacuucu

SEQ ID NO: 6215 - RNA, 29 nt, Human
augggaggaucacuugaggccaagaguuu

SEQ ID NO: 6216 - RNA, 26 nt, Human
auugcugcuuucucuucuacuucuug

SEQ ID NO: 6217 - RNA, 21 nt, Human
aguguuacagaguguggguac

SEQ ID NO: 6218 - RNA, 23 nt, Human
cacugccauuuccuccugggcaa

SEQ ID NO: 6219 - RNA, 27 nt, Human
aggcucgugcauguaauccuagcacuu

SEQ ID NO: 6220 - RNA, 22 nt, Human
aggcugagaugggaggaucacu

SEQ ID NO: 6221 - RNA, 20 nt, Human
cucagguuuccggcuacuga

SEQ ID NO: 6222 - RNA, 22 nt, Human
aaaauguucugacagcauuuca

SEQ ID NO: 6223 - RNA, 21 nt, Human
gcagugagccaaguucacacc

SEQ ID NO: 6224 - RNA, 22 nt, Human
gcauguaauccuagcacuuugg

SEQ ID NO: 6225 - RNA, 22 nt, Human
ggaggcugagacgcaaggauca

SEQ ID NO: 6226 - RNA, 21 nt, Human
ggcucgugcauguaauccuag

SEQ ID NO: 6227 - RNA, 21 nt, Human
ggugacuuuccuaugacacuc

SEQ ID NO: 6228 - RNA, 21 nt, Human
gguuuugaucucagcauccug

SEQ ID NO: 6229 - RNA, 20 nt, Human
gucagugagucagaggcaga

SEQ ID NO: 6230 - RNA, 25 nt, Human
ggcagaaccuagucuuguuguucau

SEQ ID NO: 6231 - RNA, 23 nt, Human
gcugcagcuaauuugugaaagug

SEQ ID NO: 6232 - RNA, 20 nt, Human
gcuuugcaaccuuguacuuu

SEQ ID NO: 6233 - RNA, 20 nt, Human
cucacagcacauuuguuaau

SEQ ID NO: 6234 - RNA, 27 nt, Human
cgcuaguggguuaucagcuaacacccg

SEQ ID NO: 6235 - RNA, 24 nt, Human
ccugccuugccccuuaccugccga

SEQ ID NO: 6236 - RNA, 20 nt, Human
gaaguagugugaguguuaga

SEQ ID NO: 6237 - RNA, 23 nt, Human
cuucaaaaacaacuaaaggauga

SEQ ID NO: 6238 - RNA, 21 nt, Human
cuuacacaccugagaaugugc

SEQ ID NO: 6239 - RNA, 27 nt, Human
uacaaguguuucuaguaacaguauuuc

SEQ ID NO: 6240 - RNA, 19 nt, Human
ucagugagucagaggcaga

SEQ ID NO: 6241 - RNA, 22 nt, Human
aggacugaagaaaauccuucag

SEQ ID NO: 6242 - RNA, 20 nt, Human
cagcauccuggaaauuugug

SEQ ID NO: 6243 - RNA, 24 nt, Human
acaaguguuucuaguaacaguauu

SEQ ID NO: 6244 - RNA, 26 nt, Human
acaaguguuucuaguaacaguauuuc

SEQ ID NO: 6245 - RNA, 20 nt, Human
aauuaaaaagacacuuuuac

SEQ ID NO: 6246 - RNA, 26 nt, Human
aacauagugguauuuuaacauagcag

SEQ ID NO: 6247 - RNA, 23 nt, Human
acacaguaagauagguucugcuu

SEQ ID NO: 6248 - RNA, 25 nt, Human
uacaaguguuucuaguaacaguauu

SEQ ID NO: 6249 - RNA, 20 nt, Human
guuuugaucucagcauccug

SEQ ID NO: 6250 - RNA, 22 nt, Human
caugcauucagaucugaaguag

SEQ ID NO: 6251 - RNA, 21 nt, Human
uggaaacaucugauuucugaa

SEQ ID NO: 6252 - RNA, 16 nt, Human
ugccccuuaccugccg

SEQ ID NO: 6253 - RNA, 24 nt, Human
uuugguugcuuaagacugaagcaa

SEQ ID NO: 6254 - RNA, 22 nt, Human
ugaguguuagaaaaaacuggaa

SEQ ID NO: 6255 - RNA, 23 nt, Human
ucuucugucuguacaucguuguc

SEQ ID NO: 6256 - RNA, 22 nt, Human
ugugugcagaguauacaagugu

SEQ ID NO: 6257 - RNA, 24 nt, Human
aggcgcgagguugcggcgcgcagc

SEQ ID NO: 6258 - RNA, 20 nt, Human
agcuuugcaaccuuguacuu

SEQ ID NO: 6259 - RNA, 22 nt, Human
agucaagucuaccugccuugcc

SEQ ID NO: 6260 - RNA, 23 nt, Human
aguugaaugauaauagcucacag

SEQ ID NO: 6261 - RNA, 24 nt, Human
aucgcgccgagcucccuccauucc

SEQ ID NO: 6262 - RNA, 20 nt, Human
uuguacuuuacaaucaugcc

SEQ ID NO: 6263 - RNA, 23 nt, Human
uucuugcucugcucaucuacaca

SEQ ID NO: 6264 - RNA, 29 nt, Human
ccgccgaggcgcgagguugcggcgcgcag

SEQ ID NO: 6265 - RNA, 27 nt, Human
ccgaggcgcgagguugcggcgcgcagc

SEQ ID NO: 6266 - RNA, 22 nt, Human
cacacaacuguggauaaauuuu

SEQ ID NO: 6267 - RNA, 19 nt, Human
cagcauccuggaaauuugu

SEQ ID NO: 6268 - RNA, 25 nt, Human
cagcauccuggaaauuugugugcuu

SEQ ID NO: 6269 - RNA, 26 nt, Human
cugccuggucuuccucccggacgcua

SEQ ID NO: 6270 - RNA, 24 nt, Human
gacgccauccuucaaaaacaacua

SEQ ID NO: 6271 - RNA, 21 nt, Human
gaagaagaaagaagacgcgau

SEQ ID NO: 6272 - RNA, 21 nt, Human
ccuuugucaaaugguauuuuu

SEQ ID NO: 6273 - RNA, 22 nt, Human
ccuuucucucuuucuuuugugc

SEQ ID NO: 6274 - RNA, 22 nt, Human
aaggauuagcaguguguggaaa

SEQ ID NO: 6275 - RNA, 21 nt, Human
aauauaaaucacagauuucca

SEQ ID NO: 6276 - RNA, 23 nt, Human
gauugcuagccuuggcugcucca

SEQ ID NO: 6277 - RNA, 22 nt, Human
ggcaggagaaucgcuugaaccc

SEQ ID NO: 6278 - RNA, 20 nt, Human
ggaggcggagguugcaguga

SEQ ID NO: 6279 - RNA, 21 nt, Human
ggaggcggagguugcagugag

SEQ ID NO: 6280 - RNA, 21 nt, Human
aaggucaggaguucgagacca

SEQ ID NO: 6281 - RNA, 22 nt, Human
ccuguaaucccagcuacucagg

SEQ ID NO: 6282 - RNA, 22 nt, Human
cuuucagcaaaccucagucaua

SEQ ID NO: 6283 - RNA, 22 nt, Human
ccaacguggugaaacccugucu

SEQ ID NO: 6284 - RNA, 21 nt, Human
ccagccuggguggcagaguga

SEQ ID NO: 6285 - RNA, 23 nt, Human
ccaggaggcggagguugcaguga

SEQ ID NO: 6286 - RNA, 23 nt, Human
uucauuguguguuagcagcagug

SEQ ID NO: 6287 - RNA, 21 nt, Human
uuuguugugcuugcugguacu

SEQ ID NO: 6288 - RNA, 22 nt, Human
aucgcuugaacccaggaggcgg

SEQ ID NO: 6289 - RNA, 23 nt, Human
auugcaccacugcacuccagccu

SEQ ID NO: 6290 - RNA, 21 nt, Human
aguggcuuucagcaaaccuca

SEQ ID NO: 6291 - RNA, 21 nt, Human
aggaggcggagguugcaguga

SEQ ID NO: 6292 - RNA, 22 nt, Human
aggcuaaggcaggagaaucgcu

SEQ ID NO: 6293 - RNA, 23 nt, Human
ugugccuguaaucccagcuacuc

SEQ ID NO: 6294 - RNA, 22 nt, Human
ugccuguagucccggcacuuug

SEQ ID NO: 6295 - RNA, 23 nt, Human
ugccuguaaucccagcuacucag

SEQ ID NO: 6296 - RNA, 27 nt, Human
ugccuguaaucccagcuacucaggagg

SEQ ID NO: 6297 - RNA, 25 nt, Human
uggugacaugugccuguaaucccag

SEQ ID NO: 6298 - RNA, 27 nt, Human
ugucuucaauuaaaagaccacagacuu

SEQ ID NO: 6299 - RNA, 27 nt, Human
ugaccaacguggugaaacccugucucu

SEQ ID NO: 6300 - RNA, 21 nt, Human
uccagccuggguggcagagug

SEQ ID NO: 6301 - RNA, 21 nt, Human
caggaggcggagguugcagug

SEQ ID NO: 6302 - RNA, 22 nt, Human
caggaggcggagguugcaguga

SEQ ID NO: 6303 - RNA, 22 nt, Human
ccacugcacuccagccugggug

SEQ ID NO: 6304 - RNA, 22 nt, Human
ccaggaggcggagguugcagug

SEQ ID NO: 6305 - RNA, 19 nt, Human
uaaggacaauguaacucua

SEQ ID NO: 6306 - RNA, 22 nt, Human
aagcaaauuaguaauugucaau

SEQ ID NO: 6307 - RNA, 22 nt, Human
accagccugaccaacgugguga

SEQ ID NO: 6308 - RNA, 22 nt, Human
acuccagccuggguggcagagu

SEQ ID NO: 6309 - RNA, 20 nt, Human
accuauaucucaguggcaca

SEQ ID NO: 6310 - RNA, 21 nt, Human
agaaaauuaguaauuguaagu

SEQ ID NO: 6311 - RNA, 22 nt, Human
cacugcacuccagccugggugg

SEQ ID NO: 6312 - RNA, 22 nt, Human
caccacugcacuccagccuggg

SEQ ID NO: 6313 - RNA, 22 nt, Human
cacaaggucaggaguucgagac

SEQ ID NO: 6314 - RNA, 23 nt, Human
augggcauccugaagcugcaagu

SEQ ID NO: 6315 - RNA, 22 nt, Human
aggccgaggcaggcagaucaca

SEQ ID NO: 6316 - RNA, 22 nt, Human
agaccagccugaccaacguggu

SEQ ID NO: 6317 - RNA, 28 nt, Human
agauugcaccacugcacuccagccuggg

SEQ ID NO: 6318 - RNA, 22 nt, Human
gaacccaggaggcggagguugc

SEQ ID NO: 6319 - RNA, 21 nt, Human
ccuguagucccggcacuuugg

SEQ ID NO: 6320 - RNA, 22 nt, Human
cuaaggcaggagaaucgcuuga

SEQ ID NO: 6321 - RNA, 23 nt, Human
cccaggaggcggagguugcagug

SEQ ID NO: 6322 - RNA, 23 nt, Human
gccuguaaucccagcuacucagg

SEQ ID NO: 6323 - RNA, 22 nt, Human
gccuguagucccggcacuuugg

SEQ ID NO: 6324 - RNA, 22 nt, Human
gaccagccugaccaacguggug

SEQ ID NO: 6325 - RNA, 20 nt, Human
guggcuuucagcaaaccuca

SEQ ID NO: 6326 - RNA, 27 nt, Human
agagccuaagaaaaucaucuuggccac

SEQ ID NO: 6327 - RNA, 24 nt, Human
cggugaucccggcgacugcgcugg

SEQ ID NO: 6328 - RNA, 23 nt, Human
aagaaaaucaucuuggccacuuu

SEQ ID NO: 6329 - RNA, 20 nt, Human
aaggagcaaccaaaauguca

SEQ ID NO: 6330 - RNA, 25 nt, Human
aauauuaucuuucuuaacuuuuucc

SEQ ID NO: 6331 - RNA, 23 nt, Human
aauucagagcagauuagagccug

SEQ ID NO: 6332 - RNA, 21 nt, Human
aauugcugggauuacaggcau

SEQ ID NO: 6333 - RNA, 22 nt, Human
aaauugcugggauuacaggcau

SEQ ID NO: 6334 - RNA, 24 nt, Human
aaccggagcugaauuaccuuucac

SEQ ID NO: 6335 - RNA, 27 nt, Human
aaccggagcugaauuaccuuucacuuu

SEQ ID NO: 6336 - RNA, 22 nt, Human
aacucucaguccaacauuauuu

SEQ ID NO: 6337 - RNA, 24 nt, Human
aaacaguauguaaaacucuguuuu

SEQ ID NO: 6338 - RNA, 23 nt, Human
gcuuuauuuuuccacaucaugcu

SEQ ID NO: 6339 - RNA, 22 nt, Human
ggaacaaugcuuuuguuuuuua

SEQ ID NO: 6340 - RNA, 22 nt, Human
ggacucaaacuccugaccuugu

SEQ ID NO: 6341 - RNA, 22 nt, Human
ggcaagucacuucaccucucug

SEQ ID NO: 6342 - RNA, 25 nt, Human
ggcaauauaaggaaagugauccaaa

SEQ ID NO: 6343 - RNA, 22 nt, Human
gcucacugcaaccuccaccucc

SEQ ID NO: 6344 - RNA, 21 nt, Human
gcuccaggguuucuguuacua

SEQ ID NO: 6345 - RNA, 22 nt, Human
gcacuugggagaaggcuuagaa

SEQ ID NO: 6346 - RNA, 24 nt, Human
gcagaaggcuaggaauuuuagcag

SEQ ID NO: 6347 - RNA, 26 nt, Human
gacucugaaaccucaagcugucuacu

SEQ ID NO: 6348 - RNA, 22 nt, Human
cgggcuguuuguuuuacagugu

SEQ ID NO: 6349 - RNA, 22 nt, Human
cucagccucccaaauugcuggg

SEQ ID NO: 6350 - RNA, 26 nt, Human
cucuccucagaagaaagaaucuuucc

SEQ ID NO: 6351 - RNA, 20 nt, Human
cucucaguccaacauuauuu

SEQ ID NO: 6352 - RNA, 25 nt, Human
cucauguauuuuuaucacacuuaua

SEQ ID NO: 6353 - RNA, 25 nt, Human
gaaagagauggcuaacaaucuguga

SEQ ID NO: 6354 - RNA, 22 nt, Human
cucuggauuuccuuuugcuuca

SEQ ID NO: 6355 - RNA, 22 nt, Human
cugaguagcugggauuacaggc

SEQ ID NO: 6356 - RNA, 21 nt, Human
cuucaccucucugugccucag

SEQ ID NO: 6357 - RNA, 24 nt, Human
cugucccccaggcuggagugcagu

SEQ ID NO: 6358 - RNA, 22 nt, Human
cugugccucaguuuccucaucu

SEQ ID NO: 6359 - RNA, 22 nt, Human
ccaccuccuggguuuaagcgau

SEQ ID NO: 6360 - RNA, 22 nt, Human
cccaaauugcugggauuacagg

SEQ ID NO: 6361 - RNA, 17 nt, Human
cccucugccuguuuucc

SEQ ID NO: 6362 - RNA, 21 nt, Human
cccccaggcuggagugcagug

SEQ ID NO: 6363 - RNA, 22 nt, Human
cccccaggcuggagugcagugg

SEQ ID NO: 6364 - RNA, 22 nt, Human
ccaaauugcugggauuacaggc

SEQ ID NO: 6365 - RNA, 19 nt, Human
caucugccagcugugucau

SEQ ID NO: 6366 - RNA, 20 nt, Human
cauggacucaccacugugug

SEQ ID NO: 6367 - RNA, 21 nt, Human
caguuuuucucccacuggguc

SEQ ID NO: 6368 - RNA, 20 nt, Human
cauaauccucuccaacugga

SEQ ID NO: 6369 - RNA, 22 nt, Human
caggcuggagugcaguggcaug

SEQ ID NO: 6370 - RNA, 22 nt, Human
cacuucaccucucugugccuca

SEQ ID NO: 6371 - RNA, 27 nt, Human
cacaaugauuccuucuuuucuaggcaa

SEQ ID NO: 6372 - RNA, 22 nt, Human
caaguauuuuaacucucagucc

SEQ ID NO: 6373 - RNA, 24 nt, Human
auucugcccccaucccaacccagc

SEQ ID NO: 6374 - RNA, 21 nt, Human
caaccaaaacuuuacaagcuu

SEQ ID NO: 6375 - RNA, 27 nt, Human
caaccaaaaugucacaaccaaaacuuu

SEQ ID NO: 6376 - RNA, 17 nt, Human
ugcccaaaaugcacuga

SEQ ID NO: 6377 - RNA, 27 nt, Human
uggacucaaacuccugaccuugugauu

SEQ ID NO: 6378 - RNA, 22 nt, Human
ugggauuacaggcaugagccac

SEQ ID NO: 6379 - RNA, 20 nt, Human
ugucccccaggcuggagugc

SEQ ID NO: 6380 - RNA, 24 nt, Human
ugucccccaggcuggagugcagug

SEQ ID NO: 6381 - RNA, 27 nt, Human
uggguuuaagcgauucuccugccucag

SEQ ID NO: 6382 - RNA, 20 nt, Human
ugguccuggaguugguagau

SEQ ID NO: 6383 - RNA, 21 nt, Human
uguguagaugaaaccaucuca

SEQ ID NO: 6384 - RNA, 23 nt, Human
uuagcacucacugacucuucuau

SEQ ID NO: 6385 - RNA, 24 nt, Human
ucuuuuaucugugucuguguauca

SEQ ID NO: 6386 - RNA, 22 nt, Human
ugcaaccuccaccuccuggguu

SEQ ID NO: 6387 - RNA, 28 nt, Human
ucuuuauucugcccccaucccaacccag

SEQ ID NO: 6388 - RNA, 22 nt, Human
ucucccacugggucaccucaag

SEQ ID NO: 6389 - RNA, 22 nt, Human
ucccccaggcuggagugcagug

SEQ ID NO: 6390 - RNA, 19 nt, Human
uccucuuuuuauuuuuucc

SEQ ID NO: 6391 - RNA, 18 nt, Human
ucccacugggucaccuca

SEQ ID NO: 6392 - RNA, 22 nt, Human
aguaaacauuccaacauugucu

SEQ ID NO: 6393 - RNA, 22 nt, Human
augugggaagcauuugauuuuc

SEQ ID NO: 6394 - RNA, 22 nt, Human
auucaaaucacauggcuuucca

SEQ ID NO: 6395 - RNA, 22 nt, Human
uuuuuaaucuuaaaagauugug

SEQ ID NO: 6396 - RNA, 22 nt, Human
agccucccaaauugcugggauu

SEQ ID NO: 6397 - RNA, 21 nt, Human
uuguuucuuuaagaaaguacu

SEQ ID NO: 6398 - RNA, 22 nt, Human
uuuaagcgauucuccugccuca

SEQ ID NO: 6399 - RNA, 22 nt, Human
uucagaucuuucuagucaccuu

SEQ ID NO: 6400 - RNA, 22 nt, Human
uucuauaaauaacccauucaua

SEQ ID NO: 6401 - RNA, 21 nt, Human
uucucucuugcccaaauaaua

SEQ ID NO: 6402 - RNA, 26 nt, Human
uugcaaaaaugguccuggaguuggua

SEQ ID NO: 6403 - RNA, 23 nt, Human
agauagauggcuuaauaaaauag

SEQ ID NO: 6404 - RNA, 21 nt, Human
agagucuggccaaaacgguaa

SEQ ID NO: 6405 - RNA, 20 nt, Human
agagauuggugaauugaaug

SEQ ID NO: 6406 - RNA, 22 nt, Human
agccuccugaguagcugggauu

SEQ ID NO: 6407 - RNA, 23 nt, Human
aggcuggagugcaguggcaugau

SEQ ID NO: 6408 - RNA, 22 nt, Human
aguggcaugaucucggcucacu

SEQ ID NO: 6409 - RNA, 22 nt, Human
augaucucggcucacugcaacc

SEQ ID NO: 6410 - RNA, 23 nt, Human
auugguaagaaugagcuuucaac

SEQ ID NO: 6411 - RNA, 20 nt, Human
aguuuuucucccacuggguc

SEQ ID NO: 6412 - RNA, 22 nt, Human
aguuuaugccccucccuugcaa

SEQ ID NO: 6413 - RNA, 21 nt, Human
cacauggcuuuccaccaauau

SEQ ID NO: 6414 - RNA, 26 nt, Human
caauauuaucuuucuuaacuuuuucc

SEQ ID NO: 6415 - RNA, 22 nt, Human
cacucacugacucuucuaugca

SEQ ID NO: 6416 - RNA, 21 nt, Human
caccuccuggguuuaagcgau

SEQ ID NO: 6417 - RNA, 22 nt, Human
caccuccuggguuuaagcgauu

SEQ ID NO: 6418 - RNA, 27 nt, Human
cacugucccccaggcuggagugcagug

SEQ ID NO: 6419 - RNA, 31 nt, Human
agaauaaaagauguagcacauuuugcuuucc

SEQ ID NO: 6420 - RNA, 24 nt, Human
accuugugauuugcccgccucagc

SEQ ID NO: 6421 - RNA, 26 nt, Human
acucacugacucuucuaugcaguuac

SEQ ID NO: 6422 - RNA, 24 nt, Human
acucauagcaaagucacuucuguu

SEQ ID NO: 6423 - RNA, 22 nt, Human
acccauucauagcauagcuaga

SEQ ID NO: 6424 - RNA, 27 nt, Human
acucuucuaugcaguuacuacauaucu

SEQ ID NO: 6425 - RNA, 22 nt, Human
acucaaacuccugaccuuguga

SEQ ID NO: 6426 - RNA, 26 nt, Human
acuuucaaaaacaugaccuuccacaa

SEQ ID NO: 6427 - RNA, 25 nt, Human
acugucccccaggcuggagugcagu

SEQ ID NO: 6428 - RNA, 22 nt, Human
acugcaaccuccaccuccuggg

SEQ ID NO: 6429 - RNA, 26 nt, Human
accacuaugcccggcuaauuuuuugg

SEQ ID NO: 6430 - RNA, 23 nt, Human
acaaguauuuuaacucucagucc

SEQ ID NO: 6431 - RNA, 22 nt, Human
aacaccauccauuugggaaaga

SEQ ID NO: 6432 - RNA, 26 nt, Human
aacaucuucaguuuuucucccacugg

SEQ ID NO: 6433 - RNA, 27 nt, Human
aacuauacaucauuuuugcccucugcc

SEQ ID NO: 6434 - RNA, 20 nt, Human
acacuuuucaaaauaugugg

SEQ ID NO: 6435 - RNA, 27 nt, Human
aaagaacaguaaacauugguaagaaug

SEQ ID NO: 6436 - RNA, 26 nt, Human
aaacuuagcaaaauuagcaauauauu

SEQ ID NO: 6437 - RNA, 22 nt, Human
uaacaucuucaguuuuucuccc

SEQ ID NO: 6438 - RNA, 22 nt, Human
uacuaguccaucauagccuaga

SEQ ID NO: 6439 - RNA, 21 nt, Human
uacugaaaacaccauccauuu

SEQ ID NO: 6440 - RNA, 17 nt, Human
uaaaagaguuaaugaac

SEQ ID NO: 6441 - RNA, 23 nt, Human
gucccccaggcuggagugcagug

SEQ ID NO: 6442 - RNA, 24 nt, Human
gugcaaccuaauuaguaacuuucc

SEQ ID NO: 6443 - RNA, 22 nt, Human
gggguuuuaccauguuggccag

SEQ ID NO: 6444 - RNA, 19 nt, Human
ccaggcuggagugcagugg

SEQ ID NO: 6445 - RNA, 22 nt, Human
gggauuacaggcaugagccacc

SEQ ID NO: 6446 - RNA, 27 nt, Human
caggcuggagugcaguggcaugaucuc

SEQ ID NO: 6447 - RNA, 20 nt, Human
cauaaaguccagaucuggua

SEQ ID NO: 6448 - RNA, 27 nt, Human
uccagagaggaaacuguggaauggaaa

SEQ ID NO: 6449 - RNA, 27 nt, Human
ucucaacaaaacuuuauaggcagucuu

SEQ ID NO: 6450 - RNA, 23 nt, Human
uagauccaguugcacuaaauucc

SEQ ID NO: 6451 - RNA, 24 nt, Human
ucagaucuuucuagucaccuuaga

SEQ ID NO: 6452 - RNA, 18 nt, Human
ucagaucuuuuugguaaa

SEQ ID NO: 6453 - RNA, 26 nt, Human
uauacagucuuuaugaauuucuuaau

SEQ ID NO: 6454 - RNA, 23 nt, Human
ucaugcaaauucuauauuuuaca

SEQ ID NO: 6455 - RNA, 29 nt, Human
ugcaggagggacucugaaaccucaagcug

SEQ ID NO: 6456 - RNA, 23 nt, Human
ugaguagcugggauuacaggcac

SEQ ID NO: 6457 - RNA, 22 nt, Human
ucucucuggauuuccuuuugcu

SEQ ID NO: 6458 - RNA, 22 nt, Human
ucucccaucucucuggauuucc

SEQ ID NO: 6459 - RNA, 23 nt, Human
ucuuuuaucugugucuguguauc

SEQ ID NO: 6460 - RNA, 20 nt, Human
ugcucuguggcuccaggguu

SEQ ID NO: 6461 - RNA, 23 nt, Human
ugcuggagccauucauucagcaa

SEQ ID NO: 6462 - RNA, 27 nt, Human
uggaauaaaguccucaaaauugaaaug

SEQ ID NO: 6463 - RNA, 20 nt, Human
uggagccagcaauccuguuc

SEQ ID NO: 6464 - RNA, 22 nt, Human
uggacucaaacuccugaccuug

SEQ ID NO: 6465 - RNA, 22 nt, Human
ugucccccaggcuggagugcag

SEQ ID NO: 6466 - RNA, 23 nt, Human
ugucccccaggcuggagugcagu

SEQ ID NO: 6467 - RNA, 25 nt, Human
uucuauauuuuacauucuuggaaag

SEQ ID NO: 6468 - RNA, 21 nt, Human
uuauuuuaaaacagaagaauu

SEQ ID NO: 6469 - RNA, 21 nt, Human
uuacucuuauucuuagcugua

SEQ ID NO: 6470 - RNA, 21 nt, Human
uuagguauuagaaagugauac

SEQ ID NO: 6471 - RNA, 21 nt, Human
uucauaaccuuuauauuugcc

SEQ ID NO: 6472 - RNA, 22 nt, Human
uucaaugcuaguguuuaauccu

SEQ ID NO: 6473 - RNA, 19 nt, Human
uucacuuucaaaaacauga

SEQ ID NO: 6474 - RNA, 23 nt, Human
uuugugcacucugcucuaaaaca

SEQ ID NO: 6475 - RNA, 22 nt, Human
uuuuccauauagagcacuaugu

SEQ ID NO: 6476 - RNA, 20 nt, Human
uuuuaguauaauggugcuau

SEQ ID NO: 6477 - RNA, 24 nt, Human
uuugaaaaacacaaugauuccuuc

SEQ ID NO: 6478 - RNA, 22 nt, Human
gucccccaggcuggagugcagu

SEQ ID NO: 6479 - RNA, 27 nt, Human
ggggcaauaugucaucuaccuaccuca

SEQ ID NO: 6480 - RNA, 27 nt, Human
gaguagcugggauuacaggcacccacc

SEQ ID NO: 6481 - RNA, 25 nt, Human
gaguccagagaggaaacuguggaau

SEQ ID NO: 6482 - RNA, 27 nt, Human
gauuacaucauguauuuugccucaugu

SEQ ID NO: 6483 - RNA, 24 nt, Human
gcaaaaacuuccaucacaacaaga

SEQ ID NO: 6484 - RNA, 21 nt, Human
gcaaccuccaccuccuggguu

SEQ ID NO: 6485 - RNA, 24 nt, Human
gcaauaugucaucuaccuaccuca

SEQ ID NO: 6486 - RNA, 22 nt, Human
gcaccuugcaaaaaugguccug

SEQ ID NO: 6487 - RNA, 27 nt, Human
gcacugucccccaggcuggagugcagu

SEQ ID NO: 6488 - RNA, 22 nt, Human
gcaugagccaccacacccugcc

SEQ ID NO: 6489 - RNA, 27 nt, Human
ggacucaaacuccugaccuugugauuu

SEQ ID NO: 6490 - RNA, 21 nt, Human
ggcucacugcaaccuccaccu

SEQ ID NO: 6491 - RNA, 22 nt, Human
ggcucacugcaaccuccaccuc

SEQ ID NO: 6492 - RNA, 25 nt, Human
ggcaauaugucaucuaccuaccuca

SEQ ID NO: 6493 - RNA, 23 nt, Human
ggcuaauuuuuuggauuuuuaau

SEQ ID NO: 6494 - RNA, 22 nt, Human
ccccaggcuggagugcaguggc

SEQ ID NO: 6495 - RNA, 25 nt, Human
ccccaggcuggagugcaguggcaug

SEQ ID NO: 6496 - RNA, 20 nt, Human
cccccaggcuggagugcagu

SEQ ID NO: 6497 - RNA, 22 nt, Human
ccugaguagcugggauuacagg

SEQ ID NO: 6498 - RNA, 26 nt, Human
ccuccaccuccuggguuuaagcgauu

SEQ ID NO: 6499 - RNA, 22 nt, Human
cuuuauuuuuccacaucaugcu

SEQ ID NO: 6500 - RNA, 22 nt, Human
gacacaaaaguccacugaugca

SEQ ID NO: 6501 - RNA, 27 nt, Human
cugugugaccuugggcaagucacuuca

SEQ ID NO: 6502 - RNA, 22 nt, Human
cuuaauguucaaaaugacuugg

SEQ ID NO: 6503 - RNA, 21 nt, Human
cuuagaauaaaagauguagca

SEQ ID NO: 6504 - RNA, 19 nt, Human
cuuagcaauguucuaauca

SEQ ID NO: 6505 - RNA, 27 nt, Human
cuccugaccuugugauuugcccgccuc

SEQ ID NO: 6506 - RNA, 22 nt, Human
cugcaaccuccaccuccugggu

SEQ ID NO: 6507 - RNA, 21 nt, Human
cugucccccaggcuggagugc

SEQ ID NO: 6508 - RNA, 25 nt, Human
cugucccccaggcuggagugcagug

SEQ ID NO: 6509 - RNA, 23 nt, Human
ucauuuucagacuuuguacuuca

SEQ ID NO: 6510 - RNA, 27 nt, Human
ucagauuucauagaaaggagcaaccaa

SEQ ID NO: 6511 - RNA, 21 nt, Human
uaggagugauuugcaccuugc

SEQ ID NO: 6512 - RNA, 26 nt, Human
uauucccucucaacaaaacuuuauag

SEQ ID NO: 6513 - RNA, 25 nt, Human
uuuugugcacucugcucuaaaacag

SEQ ID NO: 6514 - RNA, 23 nt, Human
cugggaccucaguuuuaucauuu

SEQ ID NO: 6515 - RNA, 24 nt, Human
ccuucuucuacagaagacacaccu

SEQ ID NO: 6516 - RNA, 21 nt, Human
cccauagccaggaaacucugc

SEQ ID NO: 6517 - RNA, 25 nt, Human
ggcuucuggcugaggccuuacgcau

SEQ ID NO: 6518 - RNA, 28 nt, Human
gccaaguauucugccaauucacccugga

SEQ ID NO: 6519 - RNA, 20 nt, Human
gacuauggcuaccaaaaaga

SEQ ID NO: 6520 - RNA, 23 nt, Human
ucucuccugaagcuccauccccu

SEQ ID NO: 6521 - RNA, 20 nt, Human
ucauuuucaaaauggaggga

SEQ ID NO: 6522 - RNA, 24 nt, Human
ccaaucauuuuaauuauuauucuu

SEQ ID NO: 6523 - RNA, 22 nt, Human
cauuuugguaaaauacuucuug

SEQ ID NO: 6524 - RNA, 24 nt, Human
guucucuucucuacccugcccuaa

SEQ ID NO: 6525 - RNA, 21 nt, Human
aauacaaaacugaauucuucc

SEQ ID NO: 6526 - RNA, 22 nt, Human
acagaugggcaaauuaaggcau

SEQ ID NO: 6527 - RNA, 22 nt, Human
agaaaacuaagaaauaugcaca

SEQ ID NO: 6528 - RNA, 19 nt, Human
acuauggcuaccaaaaaga

SEQ ID NO: 6529 - RNA, 23 nt, Human
cagaagaguaagaggaucaagac

SEQ ID NO: 6530 - RNA, 20 nt, Human
caacaccauugaaggcucau

SEQ ID NO: 6531 - RNA, 24 nt, Human
auuugcugagcauguacugagccu

SEQ ID NO: 6532 - RNA, 30 nt, Human
agaagaccaggcuucucucugguccuuggu

SEQ ID NO: 6533 - RNA, 21 nt, Human
uugcacacaccuucuucuaca

SEQ ID NO: 6534 - RNA, 19 nt, Human
uugguaaaauacuucuuga

SEQ ID NO: 6535 - RNA, 19 nt, Human
uugucucacuugugcagug

SEQ ID NO: 6536 - RNA, 24 nt, Human
aucauuuucaaaauggagggaaua

SEQ ID NO: 6537 - RNA, 26 nt, Human
aggaucaagacuucuuugugcucaaa

SEQ ID NO: 6538 - RNA, 19 nt, Human
uccaugccuuccuuucucc

SEQ ID NO: 6539 - RNA, 29 nt, Human
ucuacuuuuaaguugcugaugaacucuua

SEQ ID NO: 6540 - RNA, 21 nt, Human
ugaauaaaugaaccaaaucaa

SEQ ID NO: 6541 - RNA, 22 nt, Human
cauuuugguccaaguugugcuu

SEQ ID NO: 6542 - RNA, 23 nt, Human
cccguuuugacgacgcacuugua

SEQ ID NO: 6543 - RNA, 20 nt, Human
cccuggagcacaaucaacaa

SEQ ID NO: 6544 - RNA, 20 nt, Human
cuguucucuucucuacccug

SEQ ID NO: 6545 - RNA, 22 nt, Human
cuugcacacaccuucuucuaca

SEQ ID NO: 6546 - RNA, 20 nt, Human
cuucccuuuuucuaagacua

SEQ ID NO: 6547 - RNA, 23 nt, Human
ccuuucucccaaucuccauuccc

SEQ ID NO: 6548 - RNA, 23 nt, Human
cgauuucucccuuccuccuagaa

SEQ ID NO: 6549 - RNA, 17 nt, Human
gacuucuuugugcucaa

SEQ ID NO: 6550 - RNA, 22 nt, Human
gcugcucugggauucucuucag

SEQ ID NO: 6551 - RNA, 24 nt, Human
aauuuggacuggugugcucucuuu

SEQ ID NO: 6552 - RNA, 21 nt, Human
aagcucagauuauuuaaaugg

SEQ ID NO: 6553 - RNA, 22 nt, Human
ccucucucaccucuccuacuca

SEQ ID NO: 6554 - RNA, 27 nt, Human
ccaaugcccaacugccugccuuagggu

SEQ ID NO: 6555 - RNA, 21 nt, Human
ugguucuaagaaacccucugu

SEQ ID NO: 6556 - RNA, 21 nt, Human
aguccugugcugaauguggac

SEQ ID NO: 6557 - RNA, 22 nt, Human
uugagccaggccucucucaccu

SEQ ID NO: 6558 - RNA, 27 nt, Human
agagcuguacccagagaguccugugcu

SEQ ID NO: 6559 - RNA, 23 nt, Human
aagagccuaguuuuuaauagcua

SEQ ID NO: 6560 - RNA, 23 nt, Human
uuuggacuggugugcucucuuua

SEQ ID NO: 6561 - RNA, 25 nt, Human
gcacaaggcacaacaggcugcucug

SEQ ID NO: 6562 - RNA, 24 nt, Human
gcuaagaggaucuccuguccauca

SEQ ID NO: 6563 - RNA, 26 nt, Human
gccugacagaaaccacggccacauuu

SEQ ID NO: 6564 - RNA, 22 nt, Human
ccuguugucuacaccaaugccc

SEQ ID NO: 6565 - RNA, 22 nt, Human
ccggggagggggaaagagcagc

SEQ ID NO: 6566 - RNA, 21 nt, Human
cggggagggggaaagagcagc

SEQ ID NO: 6567 - RNA, 21 nt, Human
cccagccccaacuccaggggc

SEQ ID NO: 6568 - RNA, 27 nt, Human
gcggaaacaaggggagcccccagagcu

SEQ ID NO: 6569 - RNA, 19 nt, Human
gggaagggagaguucuuug

SEQ ID NO: 6570 - RNA, 21 nt, Human
ggagagaaguagcaggaccag

SEQ ID NO: 6571 - RNA, 24 nt, Human
gcuugcccgcucccacagcuuccu

SEQ ID NO: 6572 - RNA, 22 nt, Human
gggagacaggcagggagggcuu

SEQ ID NO: 6573 - RNA, 20 nt, Human
gggugagguaggcgggaaag

SEQ ID NO: 6574 - RNA, 21 nt, Human
gugggccacacccaggaaggg

SEQ ID NO: 6575 - RNA, 21 nt, Human
aagccuccugcccccugccgg

SEQ ID NO: 6576 - RNA, 16 nt, Human
agcaggaccagagggg

SEQ ID NO: 6577 - RNA, 23 nt, Human
auaauuuuugcugaauucuuuac

SEQ ID NO: 6578 - RNA, 23 nt, Human
gugagguaggcgggaaaggaugg

SEQ ID NO: 6579 - RNA, 23 nt, Human
ccacugggagagcugguggugca

SEQ ID NO: 6580 - RNA, 22 nt, Human
ccauccccucccugccugcucc

SEQ ID NO: 6581 - RNA, 27 nt, Human
ucaagcccccuccaaaggcuccccuac

SEQ ID NO: 6582 - RNA, 21 nt, Human
uccaggcccaugcacugagga

SEQ ID NO: 6583 - RNA, 22 nt, Human
uuggauuucggggcagggggcg

SEQ ID NO: 6584 - RNA, 21 nt, Human
ugggugagguaggcgggaaag

SEQ ID NO: 6585 - RNA, 19 nt, Human
uuacaacuaaauaacacag

SEQ ID NO: 6586 - RNA, 22 nt, Human
ugccuucagggagacaggcagg

SEQ ID NO: 6587 - RNA, 27 nt, Human
cccagccccaacuccaggggcaccuau

SEQ ID NO: 6588 - RNA, 27 nt, Human
ccccaacuccaggggcaccuaugagau

SEQ ID NO: 6589 - RNA, 27 nt, Human
caggaagggaaagcgggcagccccguu

SEQ ID NO: 6590 - RNA, 23 nt, Human
ccuucccuggccccgccggaugu

SEQ ID NO: 6591 - RNA, 26 nt, Human
ccugucuggaagacguggcucugggu

SEQ ID NO: 6592 - RNA, 27 nt, Human
cuccagccuccccuccccuggggacgc

SEQ ID NO: 6593 - RNA, 28 nt, Human
cuuugccaaggcucuccccucucgcccc

SEQ ID NO: 6594 - RNA, 21 nt, Human
gacaggcccucccugucucca

SEQ ID NO: 6595 - RNA, 20 nt, Human
gaaaucaccuguccaucguu

SEQ ID NO: 6596 - RNA, 27 nt, Human
cugcccuuuuaaauggcaugacaaggu

SEQ ID NO: 6597 - RNA, 24 nt, Human
cucagaucuucacuauggcaacuu

SEQ ID NO: 6598 - RNA, 23 nt, Human
ccuuucagaaccaaacacaugcc

SEQ ID NO: 6599 - RNA, 25 nt, Human
caggcccaucucagaucuucacuau

SEQ ID NO: 6600 - RNA, 27 nt, Human
ccaacagcaggcccaucucagaucuuc

SEQ ID NO: 6601 - RNA, 22 nt, Human
cauccagcaugugugugucucu

SEQ ID NO: 6602 - RNA, 27 nt, Human
ccuccaacucuucuucauccuccuagc

SEQ ID NO: 6603 - RNA, 21 nt, Human
ucuuuaccaguauccuuaauc

SEQ ID NO: 6604 - RNA, 25 nt, Human
agcauuuucuuuaccaguauccuua

SEQ ID NO: 6605 - RNA, 27 nt, Human
uuuuacaaauuuccuuuuuuguccuca

SEQ ID NO: 6606 - RNA, 22 nt, Human
aggagaugaugugauggaacac

SEQ ID NO: 6607 - RNA, 25 nt, Human
agcucucuaaauugacucagcucca

SEQ ID NO: 6608 - RNA, 23 nt, Human
aagcuguuuaguuuguuaauuga

SEQ ID NO: 6609 - RNA, 21 nt, Human
ggagaugaugugauggaacac

SEQ ID NO: 6610 - RNA, 22 nt, Human
gagaaauggcguggcaggggac

SEQ ID NO: 6611 - RNA, 21 nt, Human
gauuaaacuguaugucuuaua

SEQ ID NO: 6612 - RNA, 27 nt, Human
uccucaccccucaauuccuaggggcuu

SEQ ID NO: 6613 - RNA, 29 nt, Human
ucuugcaucuaccugcuccuuggccuagu

SEQ ID NO: 6614 - RNA, 25 nt, Human
uggaucucuacagugccgcguauga

SEQ ID NO: 6615 - RNA, 20 nt, Human
uggccauuaagaagcucagc

SEQ ID NO: 6616 - RNA, 27 nt, Human
gguggugcuugcuauaugcuuaccuuu

SEQ ID NO: 6617 - RNA, 27 nt, Human
ggugcagcagugacagcagugagaguc

SEQ ID NO: 6618 - RNA, 22 nt, Human
agccugcuucuuccccaggguu

SEQ ID NO: 6619 - RNA, 18 nt, Human
aauguauauuuaacuucu

SEQ ID NO: 6620 - RNA, 18 nt, Human
accauaaaaacuuacuua

SEQ ID NO: 6621 - RNA, 21 nt, Human
accggcaaccuguaacugccc

SEQ ID NO: 6622 - RNA, 20 nt, Human
agacccuugaagauguagcu

SEQ ID NO: 6623 - RNA, 23 nt, Human
accccuguauuucacgcagcucu

SEQ ID NO: 6624 - RNA, 19 nt, Human
ugucauauauugccaaaca

SEQ ID NO: 6625 - RNA, 25 nt, Human
guggaugugucauauauugccaaac

SEQ ID NO: 6626 - RNA, 19 nt, Human
gguggugcuugcuauaugc

SEQ ID NO: 6627 - RNA, 23 nt, Human
ggcacggaauggcuagugugaga

SEQ ID NO: 6628 - RNA, 25 nt, Human
gccgcugcuuccucuaccccuguau

SEQ ID NO: 6629 - RNA, 32 nt, Human
gagaaauggcguggcaggggacccagcgagcc

SEQ ID NO: 6630 - RNA, 25 nt, Human
gaucaggaucguaguucucaggcac

SEQ ID NO: 6631 - RNA, 27 nt, Human
cuugacagaaauguggccauuaagaag

SEQ ID NO: 6632 - RNA, 27 nt, Human
ucacuuuuuauuuuuaugggggugggu

SEQ ID NO: 6633 - RNA, 21 nt, Human
ucagugaugggaguaagagca

SEQ ID NO: 6634 - RNA, 17 nt, Human
uagagggagggagcagc

SEQ ID NO: 6635 - RNA, 27 nt, Human
cugggccacuggcaucucuggagugug

SEQ ID NO: 6636 - RNA, 28 nt, Human
cugggacucguguggccuguguggugcc

SEQ ID NO: 6637 - RNA, 25 nt, Human
cucugggaucucccccuuguggggc

SEQ ID NO: 6638 - RNA, 19 nt, Human
cuaagcccacaaucaugcc

SEQ ID NO: 6639 - RNA, 24 nt, Human
cccugcucuucagcaccaugggcc

SEQ ID NO: 6640 - RNA, 26 nt, Human
ccccgucugcgccgcugugcuguugu

SEQ ID NO: 6641 - RNA, 26 nt, Human
gaggaugguucucucuggucauagcc

SEQ ID NO: 6642 - RNA, 27 nt, Human
gagcccaaucacugccuauaccccuca

SEQ ID NO: 6643 - RNA, 21 nt, Human
gcagaggggaggaggaagcac

SEQ ID NO: 6644 - RNA, 23 nt, Human
gcagaggggaggaggaagcacaa

SEQ ID NO: 6645 - RNA, 24 nt, Human
gcgagggcagaggugaucaccugc

SEQ ID NO: 6646 - RNA, 21 nt, Human
ggcaggggcugggcagagggg

SEQ ID NO: 6647 - RNA, 23 nt, Human
gucaggagacacuguucccaaag

SEQ ID NO: 6648 - RNA, 21 nt, Human
guggugagacuguauccuguu

SEQ ID NO: 6649 - RNA, 27 nt, Human
gugagugugacggggguuggggugggg

SEQ ID NO: 6650 - RNA, 21 nt, Human
ugguggcaccaggauggaagg

SEQ ID NO: 6651 - RNA, 27 nt, Human
uucaugauuucaaccacauuugcuaga

SEQ ID NO: 6652 - RNA, 21 nt, Human
uucggcugcauuucuucacgc

SEQ ID NO: 6653 - RNA, 23 nt, Human
uuucccaggcagcuggcuaguuc

SEQ ID NO: 6654 - RNA, 27 nt, Human
accaggauggcugagccccgccaggag

SEQ ID NO: 6655 - RNA, 19 nt, Human
accuacuccauacugaggg

SEQ ID NO: 6656 - RNA, 20 nt, Human
aaacuucugauuucucuuca

SEQ ID NO: 6657 - RNA, 21 nt, Human
aaaacuucugauuucucuuca

SEQ ID NO: 6658 - RNA, 19 nt, Human
aagagggagaaggagaggc

SEQ ID NO: 6659 - RNA, 22 nt, Human
aacuucugauuucucuucagcu

SEQ ID NO: 6660 - RNA, 23 nt, Human
agcagcaggcugggugucuuggu

SEQ ID NO: 6661 - RNA, 24 nt, Human
agaaggagaaggaaauguggggua

SEQ ID NO: 6662 - RNA, 21 nt, Human
agggcgccugagccuaggcgg

SEQ ID NO: 6663 - RNA, 21 nt, Human
aggccuggccccuuccugugc

SEQ ID NO: 6664 - RNA, 24 nt, Human
cacugggacucguguggccugugu

SEQ ID NO: 6665 - RNA, 26 nt, Human
cacuuaaccugcuuuugucacucggc

SEQ ID NO: 6666 - RNA, 23 nt, Human
guccuaagcccacaaucaugccu

SEQ ID NO: 6667 - RNA, 24 nt, Human
gggacuucaaaaucagugauggga

SEQ ID NO: 6668 - RNA, 21 nt, Human
ccaacagcagcgccgcugcca

SEQ ID NO: 6669 - RNA, 18 nt, Human
caggcagcuggcuaguuc

SEQ ID NO: 6670 - RNA, 23 nt, Human
uggaggggcagcgcagccuccca

SEQ ID NO: 6671 - RNA, 21 nt, Human
ugccgccgccaccacagccac

SEQ ID NO: 6672 - RNA, 27 nt, Human
ugcccccagcugcuccucgcaguucgg

SEQ ID NO: 6673 - RNA, 19 nt, Human
ugccaugagaaaagggaag

SEQ ID NO: 6674 - RNA, 25 nt, Human
ucuuggggccagccuaagaucaugg

SEQ ID NO: 6675 - RNA, 22 nt, Human
ucugguugcuuuggccugcugc

SEQ ID NO: 6676 - RNA, 26 nt, Human
gagugugugggggucugggaggcagg

SEQ ID NO: 6677 - RNA, 22 nt, Human
gcaauuccuuuugauucuuuuu

SEQ ID NO: 6678 - RNA, 21 nt, Human
gaccccagccucucacucuca

SEQ ID NO: 6679 - RNA, 25 nt, Human
ggacaugaaaucaucuuagcuuagc

SEQ ID NO: 6680 - RNA, 25 nt, Human
ggcccuugggguuucucuuuuccac

SEQ ID NO: 6681 - RNA, 26 nt, Human
ggccgaggcaggggcugggcagaggg

SEQ ID NO: 6682 - RNA, 21 nt, Human
aacccuguuuuauugaguucu

SEQ ID NO: 6683 - RNA, 19 nt, Human
aacuccaucugcugccaug

SEQ ID NO: 6684 - RNA, 20 nt, Human
aacuccaucugcugccauga

SEQ ID NO: 6685 - RNA, 22 nt, Human
aggcaggggcugggcagagggg

SEQ ID NO: 6686 - RNA, 21 nt, Human
agggugaucagugcuggcaga

SEQ ID NO: 6687 - RNA, 27 nt, Human
auccuguuugcuauugcuuguugugcu

SEQ ID NO: 6688 - RNA, 26 nt, Human
uuugaaccaggauggcugagccccgc

SEQ ID NO: 6689 - RNA, 23 nt, Human
uucgguucccugucuccuccucc

SEQ ID NO: 6690 - RNA, 21 nt, Human
uuccucccucccugcagggua

SEQ ID NO: 6691 - RNA, 24 nt, Human
uucaugauuucaaccacauuugcu

SEQ ID NO: 6692 - RNA, 25 nt, Human
ucuugugcccugcucuucagcacca

SEQ ID NO: 6693 - RNA, 20 nt, Human
uccccccagggcugggcacu

SEQ ID NO: 6694 - RNA, 28 nt, Human
uccuccucccgucacagaugugagccag

SEQ ID NO: 6695 - RNA, 27 nt, Human
ugggaccccagccucucacucucaguu

SEQ ID NO: 6696 - RNA, 25 nt, Human
uggacaucugguugcuuuggccugc

SEQ ID NO: 6697 - RNA, 21 nt, Human
uggcauccuucccucuaagcc

SEQ ID NO: 6698 - RNA, 27 nt, Human
ccccagccaggugcaggcguaggaaua

SEQ ID NO: 6699 - RNA, 20 nt, Human
cccuacuuccccuuggggcu

SEQ ID NO: 6700 - RNA, 25 nt, Human
ccccugagaaggccuggccccuucc

SEQ ID NO: 6701 - RNA, 22 nt, Human
ccacagaaacccuguuuuauug

SEQ ID NO: 6702 - RNA, 22 nt, Human
caggcugggugucuugguuguc

SEQ ID NO: 6703 - RNA, 25 nt, Human
cacagacuaggucuuguggcugguc

SEQ ID NO: 6704 - RNA, 22 nt, Human
cacagccaccuucuccuccucc

SEQ ID NO: 6705 - RNA, 26 nt, Human
ccuuggggcucccugugucagggcac

SEQ ID NO: 6706 - RNA, 20 nt, Human
ccucugugccaccucucaca

SEQ ID NO: 6707 - RNA, 20 nt, Human
gaagagggagaaggagaggc

SEQ ID NO: 6708 - RNA, 21 nt, Human
gacucacuuuaucaauaguuc

SEQ ID NO: 6709 - RNA, 19 nt, Human
cuuucugucugugaauguc

SEQ ID NO: 6710 - RNA, 19 nt, Human
cuuuaggguaaaaauugcg

SEQ ID NO: 6711 - RNA, 21 nt, Human
cuuguugccacagcuggagcu

SEQ ID NO: 6712 - RNA, 22 nt, Human
gaacaacaacuauccugacuuc

SEQ ID NO: 6713 - RNA, 20 nt, Human
cugcauguuaccaucuuacu

SEQ ID NO: 6714 - RNA, 25 nt, Human
cugucucccaguuaugaaucagugg

SEQ ID NO: 6715 - RNA, 21 nt, Human
cuggcuucuuucucucagccu

SEQ ID NO: 6716 - RNA, 19 nt, Human
ccugagagugucucugaua

SEQ ID NO: 6717 - RNA, 20 nt, Human
cuccugacagggugaccuug

SEQ ID NO: 6718 - RNA, 21 nt, Human
cagcucuaauaaaacagcugu

SEQ ID NO: 6719 - RNA, 20 nt, Human
cauucuuguugccacagcug

SEQ ID NO: 6720 - RNA, 21 nt, Human
cauugccuaacuacuaguuuu

SEQ ID NO: 6721 - RNA, 24 nt, Human
ugucuucaaaagaagcauugcagc

SEQ ID NO: 6722 - RNA, 21 nt, Human
uucauucugugaucauuuauu

SEQ ID NO: 6723 - RNA, 23 nt, Human
uugggccucugcuucucucaccu

SEQ ID NO: 6724 - RNA, 25 nt, Human
uugaccgagagcaggcuggagcagc

SEQ ID NO: 6725 - RNA, 23 nt, Human
uuuaagugucugaaucgagugag

SEQ ID NO: 6726 - RNA, 18 nt, Human
uuuuauuuccaucauguc

SEQ ID NO: 6727 - RNA, 22 nt, Human
auuuccauaguucccugcggcc

SEQ ID NO: 6728 - RNA, 23 nt, Human
augggcccuaggggucacuguac

SEQ ID NO: 6729 - RNA, 22 nt, Human
agcucugcaucuccugucuuuu

SEQ ID NO: 6730 - RNA, 23 nt, Human
aaacucauuuuugccauacauca

SEQ ID NO: 6731 - RNA, 21 nt, Human
aaugcugccuucccaugaauc

SEQ ID NO: 6732 - RNA, 20 nt, Human
gaugaaagcagggaauuucu

SEQ ID NO: 6733 - RNA, 19 nt, Human
gcagccgcccaacuccugg

SEQ ID NO: 6734 - RNA, 28 nt, Human
gccacuagacucuucacuguuagcuuuu

SEQ ID NO: 6735 - RNA, 21 nt, Human
ucucucagccuuacauuugug

SEQ ID NO: 6736 - RNA, 20 nt, Human
ugcaccuauguagcucugca

SEQ ID NO: 6737 - RNA, 22 nt, Human
ugaaucugucucccaguuauga

SEQ ID NO: 6738 - RNA, 23 nt, Human
ugcggccucugccuuggggaguu

SEQ ID NO: 6739 - RNA, 22 nt, Human
uccauuuuggcgcuauuacaaa

SEQ ID NO: 6740 - RNA, 26 nt, Human
uccugacagggugaccuuggguauuu

SEQ ID NO: 6741 - RNA, 24 nt, Human
uccuuuaucacaaccaccguuaca

SEQ ID NO: 6742 - RNA, 26 nt, Human
ccagaagaagaguaggugacacuaua

SEQ ID NO: 6743 - RNA, 27 nt, Human
gucggcucagcagccuccaacuucucc

SEQ ID NO: 6744 - RNA, 28 nt, Human
gugaaccaagaucuauaaagcgauauac

SEQ ID NO: 6745 - RNA, 19 nt, Human
guuauucauucugugauca

SEQ ID NO: 6746 - RNA, 25 nt, Human
gucacuuuauuacucccagaacaac

SEQ ID NO: 6747 - RNA, 20 nt, Human
ggggaguuauguuuuguuac

SEQ ID NO: 6748 - RNA, 22 nt, Human
auacuauaacauauguacauaa

SEQ ID NO: 6749 - RNA, 27 nt, Human
auacuauaacauauguacauaaauugc

SEQ ID NO: 6750 - RNA, 23 nt, Human
auuguggaucuuuucauucucau

SEQ ID NO: 6751 - RNA, 27 nt, Human
aggcgcuuggcugggcucucagcccgc

SEQ ID NO: 6752 - RNA, 27 nt, Human
agcucugcaucuccugucuuuucaggu

SEQ ID NO: 6753 - RNA, 26 nt, Human
aguauguguccaaugcugccuuccca

SEQ ID NO: 6754 - RNA, 22 nt, Human
aaauuauaguuucaagccaacu

SEQ ID NO: 6755 - RNA, 23 nt, Human
aaguggggcaaaaccuugcuaau

SEQ ID NO: 6756 - RNA, 20 nt, Human
acuauccugacuucuaauau

SEQ ID NO: 6757 - RNA, 23 nt, Human
acuuauuuuauuuccaucauguc

SEQ ID NO: 6758 - RNA, 22 nt, Human
acucuucacuguuagcuuuuua

SEQ ID NO: 6759 - RNA, 23 nt, Human
acugaacaauggcccuguagcca

SEQ ID NO: 6760 - RNA, 24 nt, Human
uuguaccugcuuugacugaugcug

SEQ ID NO: 6761 - RNA, 29 nt, Human
uugccauucugcuguacagacacugauuu

SEQ ID NO: 6762 - RNA, 25 nt, Human
uucuuguugccacagcuggagcucu

SEQ ID NO: 6763 - RNA, 20 nt, Human
uucuuucucucagccuuaca

SEQ ID NO: 6764 - RNA, 27 nt, Human
uucauucugugaucauuuauuuuaagc

SEQ ID NO: 6765 - RNA, 24 nt, Human
gugagacaaaauuuuaguccaaau

SEQ ID NO: 6766 - RNA, 21 nt, Human
gguagaccaggauuucuaauc

SEQ ID NO: 6767 - RNA, 26 nt, Human
ggcuuccugcaauuuucuaagcaauu

SEQ ID NO: 6768 - RNA, 23 nt, Human
ggaauuugccauucugcuguaca

SEQ ID NO: 6769 - RNA, 21 nt, Human
ggaacaacucuccagugccug

SEQ ID NO: 6770 - RNA, 17 nt, Human
gcucuaaaagcaccucc

SEQ ID NO: 6771 - RNA, 20 nt, Human
gacugugacaacugucuaac

SEQ ID NO: 6772 - RNA, 21 nt, Human
gaguucuggucaaagaaagaa

SEQ ID NO: 6773 - RNA, 28 nt, Human
gauacccuuacccuuuccuccuuuauca

SEQ ID NO: 6774 - RNA, 26 nt, Human
aaaacaaugcaaaaccuuugagguag

SEQ ID NO: 6775 - RNA, 22 nt, Human
ccucacacauccagacaucaug

SEQ ID NO: 6776 - RNA, 25 nt, Human
ccuuacccuuuccuccuuuaucaca

SEQ ID NO: 6777 - RNA, 22 nt, Human
ccuuugagguagaccaggauuu

SEQ ID NO: 6778 - RNA, 27 nt, Human
cugucucuugaaaaaugcccauuugcc

SEQ ID NO: 6779 - RNA, 21 nt, Human
cuuacuugagccuuuaaugga

SEQ ID NO: 6780 - RNA, 21 nt, Human
cuuauuucuucaaauccuucc

SEQ ID NO: 6781 - RNA, 22 nt, Human
cuuauuuuauuuccaucauguc

SEQ ID NO: 6782 - RNA, 22 nt, Human
gaauuugccauucugcuguaca

SEQ ID NO: 6783 - RNA, 22 nt, Human
uagaaaacaaugcaaaaccuuu

SEQ ID NO: 6784 - RNA, 20 nt, Human
ucaguuauucauucugugau

SEQ ID NO: 6785 - RNA, 23 nt, Human
ucaaguuugggucugugcugcug

SEQ ID NO: 6786 - RNA, 27 nt, Human
uaaaugaugaguauuaguucccugucu

SEQ ID NO: 6787 - RNA, 26 nt, Human
cuuguaaauuacaucugucaugguuu

SEQ ID NO: 6788 - RNA, 21 nt, Human
cugaguauguggaaggcagca

SEQ ID NO: 6789 - RNA, 28 nt, Human
cugaguauguggaaggcagcagagcgga

SEQ ID NO: 6790 - RNA, 23 nt, Human
ccucugguucuucauuuauugag

SEQ ID NO: 6791 - RNA, 27 nt, Human
gagcaaauuacccuccuuaaacaagag

SEQ ID NO: 6792 - RNA, 23 nt, Human
gcccagcccuguucugggugcag

SEQ ID NO: 6793 - RNA, 21 nt, Human
gcucaggaacuagacugccug

SEQ ID NO: 6794 - RNA, 22 nt, Human
ggagaagagagauggggguucc

SEQ ID NO: 6795 - RNA, 27 nt, Human
ggccagguaagggggugcagcagugag

SEQ ID NO: 6796 - RNA, 21 nt, Human
ggaggugggguccuuggaagc

SEQ ID NO: 6797 - RNA, 24 nt, Human
gggccuguugcccuuucuguacca

SEQ ID NO: 6798 - RNA, 20 nt, Human
ggugagcuguggaggugggg

SEQ ID NO: 6799 - RNA, 23 nt, Human
acagcucaggaacuagacugccu

SEQ ID NO: 6800 - RNA, 23 nt, Human
aucuguguccugguuagcagagc

SEQ ID NO: 6801 - RNA, 21 nt, Human
gggaagccuccuaaggccagg

SEQ ID NO: 6802 - RNA, 25 nt, Human
ggcuccccuuuuucuuccucacccu

SEQ ID NO: 6803 - RNA, 23 nt, Human
uccuugcccuagaugagcccagc

SEQ ID NO: 6804 - RNA, 25 nt, Human
ucaggugagcuguggaggugggguc

SEQ ID NO: 6805 - RNA, 22 nt, Human
uauugagcaccuacuacaugca

SEQ ID NO: 6806 - RNA, 22 nt, Human
ggagcacagcucaggaacuaga

SEQ ID NO: 6807 - RNA, 21 nt, Human
gcugggcugugugguugacuu

SEQ ID NO: 6808 - RNA, 20 nt, Human
gcuccccuuuuucuuccuca

SEQ ID NO: 6809 - RNA, 23 nt, Human
aaggcagcagagcggacugguga

SEQ ID NO: 6810 - RNA, 22 nt, Human
aggcagcagagcggacugguga

SEQ ID NO: 6811 - RNA, 21 nt, Human
agggcccacuuguauccucug

SEQ ID NO: 6812 - RNA, 20 nt, Human
uuuauccauagacagggccc

SEQ ID NO: 6813 - RNA, 22 nt, Human
uccucacccugauuucuugcuu

SEQ ID NO: 6814 - RNA, 22 nt, Human
cagcucaggaacuagacugccu

SEQ ID NO: 6815 - RNA, 17 nt, Human
cccucaaggaggucugg

SEQ ID NO: 6816 - RNA, 16 nt, Human
ccucaaggaggucugg

SEQ ID NO: 6817 - RNA, 23 nt, Human
ccugguguucccuuucccugcug

SEQ ID NO: 6818 - RNA, 21 nt, Human
ccagcugcugcucuccucgac

SEQ ID NO: 6819 - RNA, 22 nt, Human
gcugcucuccucgacauggacc

SEQ ID NO: 6820 - RNA, 24 nt, Human
ccugguguucccuuucccugcuga

SEQ ID NO: 6821 - RNA, 25 nt, Human
cguucaccgccuccagcugcugcuc

SEQ ID NO: 6822 - RNA, 23 nt, Human
ccuggcugcugccauaguuucug

SEQ ID NO: 6823 - RNA, 22 nt, Human
ccuguaaucccagcuacucagg

SEQ ID NO: 6824 - RNA, 21 nt, Human
ccuguaaucucagcacuuugg

SEQ ID NO: 6825 - RNA, 20 nt, Human
ccgagaucgcgccaguacau

SEQ ID NO: 6826 - RNA, 27 nt, Human
cuugacagaugucugggaaagcagagu

SEQ ID NO: 6827 - RNA, 25 nt, Human
gaaagagaauuuuauuuauaaauga

SEQ ID NO: 6828 - RNA, 22 nt, Human
gcucacaccuguaaucucagca

SEQ ID NO: 6829 - RNA, 23 nt, Human
gccuguaaucccagcuacucagg

SEQ ID NO: 6830 - RNA, 22 nt, Human
gagccccagaggcagagguugu

SEQ ID NO: 6831 - RNA, 22 nt, Human
gcacacgccuguaaucccagcu

SEQ ID NO: 6832 - RNA, 21 nt, Human
ggggugagaguaagcugcuga

SEQ ID NO: 6833 - RNA, 31 nt, Human
ucaguuaauggcucaucaacaaucacaacca

SEQ ID NO: 6834 - RNA, 21 nt, Human
ccagaggcagagguuguggug

SEQ ID NO: 6835 - RNA, 19 nt, Human
uaaaugagugccacaaaag

SEQ ID NO: 6836 - RNA, 22 nt, Human
ucagcuggcagaguuagcauug

SEQ ID NO: 6837 - RNA, 26 nt, Human
ucagcacuuugggaggcugagguggg

SEQ ID NO: 6838 - RNA, 27 nt, Human
ucagcacuuugggaggcugaggugggc

SEQ ID NO: 6839 - RNA, 23 nt, Human
ucccuugagccccagaggcagag

SEQ ID NO: 6840 - RNA, 21 nt, Human
cagaggcagagguugugguga

SEQ ID NO: 6841 - RNA, 22 nt, Human
caccuguaaucucagcacuuug

SEQ ID NO: 6842 - RNA, 23 nt, Human
cacgccuguaaucccagcuacuc

SEQ ID NO: 6843 - RNA, 22 nt, Human
acaccuguaaucucagcacuuu

SEQ ID NO: 6844 - RNA, 27 nt, Human
accacaaccaacaccacaaaccuuuca

SEQ ID NO: 6845 - RNA, 25 nt, Human
acaaaagggguaauugcauucuucu

SEQ ID NO: 6846 - RNA, 21 nt, Human
accuguaaucucagcacuuug

SEQ ID NO: 6847 - RNA, 22 nt, Human
accuguaaucucagcacuuugg

SEQ ID NO: 6848 - RNA, 24 nt, Human
uggugcacacgccuguaaucccag

SEQ ID NO: 6849 - RNA, 27 nt, Human
uuaauggcucaucaacaaucacaacca

SEQ ID NO: 6850 - RNA, 21 nt, Human
cgcucacaccuguaaucucag

SEQ ID NO: 6851 - RNA, 25 nt, Human
cucgcucuugacagaugucugggaa

SEQ ID NO: 6852 - RNA, 20 nt, Human
cuggcugcugccauaguuuc

SEQ ID NO: 6853 - RNA, 26 nt, Human
ccacaaccaacaccacaaaccuuuca

SEQ ID NO: 6854 - RNA, 22 nt, Human
ccagaggcagagguugugguga

SEQ ID NO: 6855 - RNA, 16 nt, Human
cauaggccgggcacag

SEQ ID NO: 6856 - RNA, 22 nt, Human
cacaccuguaaucucagcacuu

SEQ ID NO: 6857 - RNA, 21 nt, Human
caccuguaaucucagcacuuu

SEQ ID NO: 6858 - RNA, 22 nt, Human
uguggugagccgagaucgcgcc

SEQ ID NO: 6859 - RNA, 22 nt, Human
aguaagcugcugaaugcauuca

SEQ ID NO: 6860 - RNA, 23 nt, Human
aggcugaggugggcagaucaacu

SEQ ID NO: 6861 - RNA, 23 nt, Human
aaugcgguucagggcugggguga

SEQ ID NO: 6862 - RNA, 26 nt, Human
gccuguaaucccagcuacucaggaga

SEQ ID NO: 6863 - RNA, 22 nt, Human
gcuggggugagaguaagcugcu

SEQ ID NO: 6864 - RNA, 22 nt, Human
ggaggcugaggugggcagauca

SEQ ID NO: 6865 - RNA, 17 nt, Human
gcgggaggggaggaggc

SEQ ID NO: 6866 - RNA, 27 nt, Human
aaauacuguaacacuguauaacauuua

SEQ ID NO: 6867 - RNA, 26 nt, Human
uucuaagagcagcagcauauguuguu

SEQ ID NO: 6868 - RNA, 30 nt, Human
uuagaagcagaucauuucccaaaauucuaa

SEQ ID NO: 6869 - RNA, 26 nt, Human
caacauuggaugugcauuucugugau

SEQ ID NO: 6870 - RNA, 26 nt, Human
caugucgcgcucagugcugcagccca

SEQ ID NO: 6871 - RNA, 23 nt, Human
cccaaaauucuaagagcagcagc

SEQ ID NO: 6872 - RNA, 26 nt, Human
accaugucgcgcucagugcugcagcc

SEQ ID NO: 6873 - RNA, 30 nt, Human
ugcacauucacugaauucacugagauuauu

SEQ ID NO: 6874 - RNA, 22 nt, Human
uaaggcggaggucgcgggcggg

SEQ ID NO: 6875 - RNA, 18 nt, Human
gugcauuucugugauguu

SEQ ID NO: 6876 - RNA, 18 nt, Human
ccagcaccaccaugucgc

SEQ ID NO: 6877 - RNA, 22 nt, Human
uagggaagaguucugaucugua

SEQ ID NO: 6878 - RNA, 21 nt, Human
gguuguauuuucugaucauug

SEQ ID NO: 6879 - RNA, 23 nt, Human
ggaaggcaggaggcugccggggc

SEQ ID NO: 6880 - RNA, 27 nt, Human
cggaaggcaggaggcugccggggcgcg

SEQ ID NO: 6881 - RNA, 21 nt, Human
gccagauuuugggauuacaaa

SEQ ID NO: 6882 - RNA, 20 nt, Human
ccagauuuugggauuacaaa

SEQ ID NO: 6883 - RNA, 23 nt, Human
cccaccccuguacccagccaccu

SEQ ID NO: 6884 - RNA, 17 nt, Human
cacuuccuagagcaucu

SEQ ID NO: 6885 - RNA, 22 nt, Human
auugccucccuuccuccgcucc

SEQ ID NO: 6886 - RNA, 23 nt, Human
uuaacucccuaguuacccacccu

SEQ ID NO: 6887 - RNA, 23 nt, Human
uggguaucccaccuccagcccac

SEQ ID NO: 6888 - RNA, 26 nt, Human
uugccucccuuccuccgcuccccuuu

SEQ ID NO: 6889 - RNA, 18 nt, Human
uuucuugccagcucagca

SEQ ID NO: 6890 - RNA, 23 nt, Human
ccccugaggacaggggcaucucu

SEQ ID NO: 6891 - RNA, 24 nt, Human
cacaaccacuaauuugucacugga

SEQ ID NO: 6892 - RNA, 22 nt, Human
cacgaacuuccggucucuuagg

SEQ ID NO: 6893 - RNA, 25 nt, Human
cacuggaaccucccugggccugucu

SEQ ID NO: 6894 - RNA, 30 nt, Human
cacuggaaccucccugggccugucucagau

SEQ ID NO: 6895 - RNA, 24 nt, Human
cuggaaccucccugggccugucuc

SEQ ID NO: 6896 - RNA, 16 nt, Human
agcuucuugcuccugu

SEQ ID NO: 6897 - RNA, 27 nt, Human
aggagagagucuuaccuccccuggccc

SEQ ID NO: 6898 - RNA, 19 nt, Human
uugcucugugcugacugug

SEQ ID NO: 6899 - RNA, 25 nt, Human
ugugugccaguacucaggcagcugg

SEQ ID NO: 6900 - RNA, 21 nt, Human
ucugcugggaacucccugacu

SEQ ID NO: 6901 - RNA, 29 nt, Human
cuggagggggcgggggccguggcggcuuu

SEQ ID NO: 6902 - RNA, 27 nt, Human
cuuaccuccccuggcccuccuuucugg

SEQ ID NO: 6903 - RNA, 21 nt, Human
cgcaggagagagucuuaccuc

SEQ ID NO: 6904 - RNA, 27 nt, Human
caggcagcuggagagaagagaaggcag

SEQ ID NO: 6905 - RNA, 27 nt, Human
cccucauucagcacuucugcugggaac

SEQ ID NO: 6906 - RNA, 23 nt, Human
ccuccccuggcccuccuuucugg

SEQ ID NO: 6907 - RNA, 21 nt, Human
aaugggucucauuugagucuc

SEQ ID NO: 6908 - RNA, 21 nt, Human
gccuucuguccugccugccca

SEQ ID NO: 6909 - RNA, 23 nt, Human
gcugcaggaacccagcuagcugg

SEQ ID NO: 6910 - RNA, 30 nt, Human
gcugcaggaacccagcuagcuggccaggug

SEQ ID NO: 6911 - RNA, 22 nt, Human
gagagaagagaaggcagcagca

SEQ ID NO: 6912 - RNA, 20 nt, Human
uuugcucugugcugacugug

SEQ ID NO: 6913 - RNA, 22 nt, Human
uuugcucugugcugacuguggu

SEQ ID NO: 6914 - RNA, 20 nt, Human
ugguggcagaggugggauga

SEQ ID NO: 6915 - RNA, 23 nt, Human
ugucugucuguuggccuguaucu

SEQ ID NO: 6916 - RNA, 16 nt, Human
auggggcagggcuggg

SEQ ID NO: 6917 - RNA, 24 nt, Human
aggaacccagcuagcuggccaggu

SEQ ID NO: 6918 - RNA, 23 nt, Human
ccauccaucugugucugucuguu

SEQ ID NO: 6919 - RNA, 23 nt, Human
ccagguggggaggggcuggggac

SEQ ID NO: 6920 - RNA, 22 nt, Human
ccagccaucugcacuuguacca

SEQ ID NO: 6921 - RNA, 25 nt, Human
ccaagcuucccugcaucuugguccu

SEQ ID NO: 6922 - RNA, 28 nt, Human
ccaagcuucccugcaucuugguccuugu

SEQ ID NO: 6923 - RNA, 27 nt, Human
ggugauggggcagggcugggucucagu

SEQ ID NO: 6924 - RNA, 20 nt, Human
ucugucuguccugcuucuuc

SEQ ID NO: 6925 - RNA, 25 nt, Human
uggagagaagagaaggcagcagcag

SEQ ID NO: 6926 - RNA, 28 nt, Human
ugcuucuucaggugagugcaggccaagg

SEQ ID NO: 6927 - RNA, 26 nt, Human
uagccucuuucuugcguuucuuuuua

SEQ ID NO: 6928 - RNA, 23 nt, Human
gcuagcuggccagguggggaggg

SEQ ID NO: 6929 - RNA, 19 nt, Human
gaggggugacuucauccca

SEQ ID NO: 6930 - RNA, 24 nt, Human
ggagagaagagaaggcagcagcag

SEQ ID NO: 6931 - RNA, 21 nt, Human
ggaggugggagaggauggggc

SEQ ID NO: 6932 - RNA, 19 nt, Human
gguggcagaggugggauga

SEQ ID NO: 6933 - RNA, 23 nt, Human
guggggaggggcuggggaccggc

SEQ ID NO: 6934 - RNA, 28 nt, Human
ccuccccuggcccuccuuucuggcucag

SEQ ID NO: 6935 - RNA, 23 nt, Human
cuucugcugggaacucccugacu

SEQ ID NO: 6936 - RNA, 22 nt, Human
cuggccgcgcgccuuuucucuc

SEQ ID NO: 6937 - RNA, 26 nt, Human
ccccauccaucugugucugucuguug

SEQ ID NO: 6938 - RNA, 21 nt, Human
cccagcaccucagccugcaca

SEQ ID NO: 6939 - RNA, 22 nt, Human
cggcccccugcccguucuugaa

SEQ ID NO: 6940 - RNA, 26 nt, Human
cgcagcccuggcagggggcaugcggu

SEQ ID NO: 6941 - RNA, 23 nt, Human
gggaggcgggggcugcccuuggg

SEQ ID NO: 6942 - RNA, 25 nt, Human
ggcggccccagcaccucagccugca

SEQ ID NO: 6943 - RNA, 27 nt, Human
gagacuugccagagccgggcacauuga

SEQ ID NO: 6944 - RNA, 21 nt, Human
gccugcacagugucccccagg

SEQ ID NO: 6945 - RNA, 26 nt, Human
aacugauuugcaauaaaaaugauacu

SEQ ID NO: 6946 - RNA, 27 nt, Human
aacugauuugcaauaaaaaugauacug

SEQ ID NO: 6947 - RNA, 20 nt, Human
accucagccugcacaguguc

SEQ ID NO: 6948 - RNA, 22 nt, Human
agaaaacaagcaaguucugaga

SEQ ID NO: 6949 - RNA, 27 nt, Human
acuguggcacuugccugggucacacac

SEQ ID NO: 6950 - RNA, 27 nt, Human
gccccagguagaaacuuuuaucuauuc

SEQ ID NO: 6951 - RNA, 20 nt, Human
aagcaaguucugagagccag

SEQ ID NO: 6952 - RNA, 27 nt, Human
cccagcaccucagccugcacagugucc

SEQ ID NO: 6953 - RNA, 25 nt, Human
cgggcaggggcuggagggaggcggg

SEQ ID NO: 6954 - RNA, 19 nt, Human
ccugcacuccucagggcag

SEQ ID NO: 6955 - RNA, 23 nt, Human
ucuugaaauguaggcaucaugca

SEQ ID NO: 6956 - RNA, 19 nt, Human
uccagcaacacagccuggg

SEQ ID NO: 6957 - RNA, 22 nt, Human
ucugagaaaacaagcaaguucu

SEQ ID NO: 6958 - RNA, 23 nt, Human
agggcagccucccccggcucuac

SEQ ID NO: 6959 - RNA, 22 nt, Human
aguuuacagaaaaagacuuuaa

SEQ ID NO: 6960 - RNA, 30 nt, Human
auagaguguaguuuacagaaaaagacuuua

SEQ ID NO: 6961 - RNA, 19 nt, Human
uugcucucuggccuuuucc

SEQ ID NO: 6962 - RNA, 24 nt, Human
gaaaugagacuugcucucuggccu

SEQ ID NO: 6963 - RNA, 27 nt, Human
ccccucggagacgcucgcccgacagca

SEQ ID NO: 6964 - RNA, 21 nt, Human
acugugcugaauucugcaaug

SEQ ID NO: 6965 - RNA, 28 nt, Human
gggaaaugagacuugcucucuggccuuu

SEQ ID NO: 6966 - RNA, 23 nt, Human
gugcugaauucugcaauguuuuc

SEQ ID NO: 6967 - RNA, 21 nt, Human
guuuaaauaaaguaucaugca

SEQ ID NO: 6968 - RNA, 21 nt, Human
gguugcuugggccacugcccu

SEQ ID NO: 6969 - RNA, 20 nt, Human
ggagcaggaggaggaaaggu

SEQ ID NO: 6970 - RNA, 22 nt, Human
gccccacccacccuccugggcc

SEQ ID NO: 6971 - RNA, 22 nt, Human
ccuuggggaggggucagcucug

SEQ ID NO: 6972 - RNA, 25 nt, Human
ccuccccaccagucucacccacuag

SEQ ID NO: 6973 - RNA, 20 nt, Human
ccguccuccucgcugugcca

SEQ ID NO: 6974 - RNA, 22 nt, Human
ccuguuaacccuccaccuccuc

SEQ ID NO: 6975 - RNA, 20 nt, Human
ccccucccucugcucucaua

SEQ ID NO: 6976 - RNA, 24 nt, Human
agaucugauuuauuuauuuugguu

SEQ ID NO: 6977 - RNA, 26 nt, Human
auggcuggcagagguuucuagggugg

SEQ ID NO: 6978 - RNA, 22 nt, Human
gggcagcuucagucucugcagu

SEQ ID NO: 6979 - RNA, 27 nt, Human
ccauggcuggcagagguuucuagggug

SEQ ID NO: 6980 - RNA, 20 nt, Human
cccacccuccugggcccagg

SEQ ID NO: 6981 - RNA, 22 nt, Human
cccacagagucuguguguagcc

SEQ ID NO: 6982 - RNA, 21 nt, Human
uggggaggggucagcucuggc

SEQ ID NO: 6983 - RNA, 25 nt, Human
uggcuggcagagguuucuagggugg

SEQ ID NO: 6984 - RNA, 22 nt, Human
cccucauuuaucacucugaccu

SEQ ID NO: 6985 - RNA, 27 nt, Human
cccucauuuaucacucugaccuucaca

SEQ ID NO: 6986 - RNA, 26 nt, Human
cccuccaccuccucucuuggacuccc

SEQ ID NO: 6987 - RNA, 21 nt, Human
cccacaccaccguccuccucg

SEQ ID NO: 6988 - RNA, 27 nt, Human
ccaggaggccggggggagcaggaggag

SEQ ID NO: 6989 - RNA, 25 nt, Human
caggcuguguguggggcccaagcau

SEQ ID NO: 6990 - RNA, 28 nt, Human
cuguuaacccuccaccuccucucuugga

SEQ ID NO: 6991 - RNA, 22 nt, Human
cguuuucuuugcugugccaaag

SEQ ID NO: 6992 - RNA, 20 nt, Human
cucccuccccaccccaacca

SEQ ID NO: 6993 - RNA, 23 nt, Human
uucaucuugagccugagccuuag

SEQ ID NO: 6994 - RNA, 20 nt, Human
ucguuuucuuugcugugcca

SEQ ID NO: 6995 - RNA, 22 nt, Human
ugacugccccuugcuucucaac

SEQ ID NO: 6996 - RNA, 23 nt, Human
gccccuugcuucucaacuaaaga

SEQ ID NO: 6997 - RNA, 22 nt, Human
gcagcaccuggagcccacagag

SEQ ID NO: 6998 - RNA, 26 nt, Human
gagcaguuuuccaggaggccgggggg

SEQ ID NO: 6999 - RNA, 27 nt, Human
gcugucgucccccuccagugcuuggcu

SEQ ID NO: 7000 - RNA, 23 nt, Human
gcuggcagagguuucuagggugg

SEQ ID NO: 7001 - RNA, 23 nt, Human
gcuucacucucucauucuuagcu

SEQ ID NO: 7002 - RNA, 22 nt, Human
ugcacacaaucuagcaggaauc

SEQ ID NO: 7003 - RNA, 26 nt, Human
ugggacaaguggggagcccaagaaag

SEQ ID NO: 7004 - RNA, 21 nt, Human
ugcuuuuguuaaaagcuuuau

SEQ ID NO: 7005 - RNA, 22 nt, Human
uuuaguuuugggauauuacaaa

SEQ ID NO: 7006 - RNA, 25 nt, Human
cgaaaucaagaaacucauguucuua

SEQ ID NO: 7007 - RNA, 26 nt, Human
ugggauguguggcccagagguaagaa

SEQ ID NO: 7008 - RNA, 22 nt, Human
uugcuuuuguuaaaagcuuuau

SEQ ID NO: 7009 - RNA, 20 nt, Human
ccaucaucccucaaaguguc

SEQ ID NO: 7010 - RNA, 25 nt, Human
ggcucuggaagaaaaggaaaaaguc

SEQ ID NO: 7011 - RNA, 22 nt, Human
gguccaucuccagacucuacca

SEQ ID NO: 7012 - RNA, 19 nt, Human
gucccaagcuucccugcca

SEQ ID NO: 7013 - RNA, 29 nt, Human
uaccacuuccugaaucaguuauuauuucu

SEQ ID NO: 7014 - RNA, 21 nt, Human
guucuuguuagaaucauggga

SEQ ID NO: 7015 - RNA, 22 nt, Human
uccaucaucccucaaaguguca

SEQ ID NO: 7016 - RNA, 21 nt, Human
uccacccacucuucacaggcu

SEQ ID NO: 7017 - RNA, 22 nt, Human
ugcuucacucucucauucuuag

SEQ ID NO: 7018 - RNA, 26 nt, Human
ucuggcuucuuucacuuugcauaauu

SEQ ID NO: 7019 - RNA, 20 nt, Human
cacuuccugaaucaguuauu

SEQ ID NO: 7020 - RNA, 22 nt, Human
agaacauggagaacuugcucaa

SEQ ID NO: 7021 - RNA, 23 nt, Human
agaacuccuuugcagaaacuggg

SEQ ID NO: 7022 - RNA, 21 nt, Human
aacugugguccaucuccagac

SEQ ID NO: 7023 - RNA, 22 nt, Human
aacaaacuaagccagguaugca

SEQ ID NO: 7024 - RNA, 22 nt, Human
cuguaagcuaauccacaaccug

SEQ ID NO: 7025 - RNA, 24 nt, Human
gucuggcuucuuucacuuugcaua

SEQ ID NO: 7026 - RNA, 24 nt, Human
gucugggaaaaagugcacgugaag

SEQ ID NO: 7027 - RNA, 27 nt, Human
gagggaagauggcggacgaggagaagc

SEQ ID NO: 7028 - RNA, 26 nt, Human
gaggcucccagacccagggcagugug

SEQ ID NO: 7029 - RNA, 22 nt, Human
ucacccccaauuaaacccagaa

SEQ ID NO: 7030 - RNA, 24 nt, Human
cacacaguauuuauuguucccaca

SEQ ID NO: 7031 - RNA, 21 nt, Human
gggggcccuuccagauugggg

SEQ ID NO: 7032 - RNA, 25 nt, Human
ugcaugggcucgaagggagagccag

SEQ ID NO: 7033 - RNA, 19 nt, Human
agaugucccuuucuuggcc

SEQ ID NO: 7034 - RNA, 20 nt, Human
agugaucaauaaaaugugau

SEQ ID NO: 7035 - RNA, 26 nt, Human
acuggguggggugaggaccacuccuu

SEQ ID NO: 7036 - RNA, 27 nt, Human
acuggguggggugaggaccacuccuua

SEQ ID NO: 7037 - RNA, 20 nt, Human
accugugaccagcacugucu

SEQ ID NO: 7038 - RNA, 19 nt, Human
agagacacuaacgacuuca

SEQ ID NO: 7039 - RNA, 20 nt, Human
ugugcaugggcucgaaggga

SEQ ID NO: 7040 - RNA, 25 nt, Human
uguguguguauguuugcacacuugu

SEQ ID NO: 7041 - RNA, 22 nt, Human
ccugugaccagcacugucucag

SEQ ID NO: 7042 - RNA, 21 nt, Human
agguuauaggucacuccuggg

SEQ ID NO: 7043 - RNA, 25 nt, Human
ugguugagaaaugaauaauuuccca

SEQ ID NO: 7044 - RNA, 19 nt, Human
ucuggacugaagccugcag

SEQ ID NO: 7045 - RNA, 21 nt, Human
aagugaucaauaaaaugugau

SEQ ID NO: 7046 - RNA, 23 nt, Human
aaagggcagggcaucuccugugc

SEQ ID NO: 7047 - RNA, 22 nt, Human
ucauccaauccucacugggugg

SEQ ID NO: 7048 - RNA, 23 nt, Human
ggagagguuauaggucacuccug

SEQ ID NO: 7049 - RNA, 20 nt, Human
gucucaguuucacuuucaca

SEQ ID NO: 7050 - RNA, 25 nt, Human
ccucuggccaggauggagggguggu

SEQ ID NO: 7051 - RNA, 17 nt, Human
gcccagucccuggagcu

SEQ ID NO: 7052 - RNA, 16 nt, Human
ucuccacccuccggcc

SEQ ID NO: 7053 - RNA, 26 nt, Human
aggacuagcuggaggaacccaguggg

SEQ ID NO: 7054 - RNA, 21 nt, Human
ccugcucccagccucuugcuc

SEQ ID NO: 7055 - RNA, 27 nt, Human
ccugcucccagccucuugcucagagcu

SEQ ID NO: 7056 - RNA, 23 nt, Human
ccccugagugggcugggcccucu

SEQ ID NO: 7057 - RNA, 22 nt, Human
aacauagugucugcugcugccu

SEQ ID NO: 7058 - RNA, 27 nt, Human
uagcccagucccuggagcuguccuuca

SEQ ID NO: 7059 - RNA, 21 nt, Human
uccaguuuuuugccacugcaa

SEQ ID NO: 7060 - RNA, 27 nt, Human
ucuagaucagagagcaagaaaaaagua

SEQ ID NO: 7061 - RNA, 23 nt, Human
ugcagccucugccucccaggcuc

SEQ ID NO: 7062 - RNA, 24 nt, Human
ugagccaccacgcccugccuacuc

SEQ ID NO: 7063 - RNA, 22 nt, Human
ucuguugcccaggcuggagugc

SEQ ID NO: 7064 - RNA, 18 nt, Human
uggaacaacagcuaucua

SEQ ID NO: 7065 - RNA, 20 nt, Human
ugcccaggcuggagugcaac

SEQ ID NO: 7066 - RNA, 22 nt, Human
ugcccaggcuggagugcaacgg

SEQ ID NO: 7067 - RNA, 20 nt, Human
ugcccaggcuggagugcagu

SEQ ID NO: 7068 - RNA, 22 nt, Human
ugcccaggcuggagugcagugg

SEQ ID NO: 7069 - RNA, 20 nt, Human
gggguggaauaaaggcugag

SEQ ID NO: 7070 - RNA, 18 nt, Human
gguuuucugcucugucca

SEQ ID NO: 7071 - RNA, 22 nt, Human
ggucuugaacuccugaccucag

SEQ ID NO: 7072 - RNA, 23 nt, Human
guugcccaggcuggagugcaacg

SEQ ID NO: 7073 - RNA, 23 nt, Human
guugcccaggcuggagugcagug

SEQ ID NO: 7074 - RNA, 19 nt, Human
ggcuucugaauuauucugg

SEQ ID NO: 7075 - RNA, 22 nt, Human
ggcucacugcagccucugccuc

SEQ ID NO: 7076 - RNA, 23 nt, Human
ggcucacugcagccucugccucc

SEQ ID NO: 7077 - RNA, 22 nt, Human
gggauuacaggugcccaccacc

SEQ ID NO: 7078 - RNA, 22 nt, Human
gggauuacaggugugagccacc

SEQ ID NO: 7079 - RNA, 25 nt, Human
gggauuacaggugugugccaucaug

SEQ ID NO: 7080 - RNA, 22 nt, Human
cccaaagugcugggauuacagg

SEQ ID NO: 7081 - RNA, 22 nt, Human
ccaaagugcugggauuacaggu

SEQ ID NO: 7082 - RNA, 24 nt, Human
caugauuuuggcucacugcagccu

SEQ ID NO: 7083 - RNA, 22 nt, Human
caggcuggagugcaguggcgug

SEQ ID NO: 7084 - RNA, 20 nt, Human
caggcuggagugcaacggca

SEQ ID NO: 7085 - RNA, 22 nt, Human
aaagugcugggauuacaggugu

SEQ ID NO: 7086 - RNA, 21 nt, Human
aagaaagagaaaguacucaga

SEQ ID NO: 7087 - RNA, 22 nt, Human
aacggcaugauuuuggcucacu

SEQ ID NO: 7088 - RNA, 29 nt, Human
aaacccacgcguguucugaaggugcccag

SEQ ID NO: 7089 - RNA, 19 nt, Human
aaagugacaugaaaauuac

SEQ ID NO: 7090 - RNA, 22 nt, Human
acuacaaccuccaccuuccagg

SEQ ID NO: 7091 - RNA, 20 nt, Human
acucuuguugcccaggcugg

SEQ ID NO: 7092 - RNA, 21 nt, Human
acucagaggcugacacugaca

SEQ ID NO: 7093 - RNA, 22 nt, Human
aguggcgugaucuuggcucacu

SEQ ID NO: 7094 - RNA, 23 nt, Human
aggugcccaccaccaagcccugc

SEQ ID NO: 7095 - RNA, 23 nt, Human
aggcuggagugcaguggcgugau

SEQ ID NO: 7096 - RNA, 23 nt, Human
aggcuggagugcaacggcaugau

SEQ ID NO: 7097 - RNA, 24 nt, Human
aggcuccaccuuaacugugcucag

SEQ ID NO: 7098 - RNA, 20 nt, Human
agagacaguguuuugccaug

SEQ ID NO: 7099 - RNA, 24 nt, Human
agcuccauguuuagaaauaaauga

SEQ ID NO: 7100 - RNA, 22 nt, Human
agccuuccgaguagcugggauu

SEQ ID NO: 7101 - RNA, 22 nt, Human
cagagcugucuggugaucacuu

SEQ ID NO: 7102 - RNA, 18 nt, Human
auguuggccaggcugguc

SEQ ID NO: 7103 - RNA, 22 nt, Human
uguugcccaggcuggagugcag

SEQ ID NO: 7104 - RNA, 21 nt, Human
uguuggccaggcuggucucga

SEQ ID NO: 7105 - RNA, 21 nt, Human
uugcccaggcuggagugcaac

SEQ ID NO: 7106 - RNA, 22 nt, Human
uugcccaggcuggagugcaacg

SEQ ID NO: 7107 - RNA, 27 nt, Human
uugcccaggcuggagugcaacggcaug

SEQ ID NO: 7108 - RNA, 22 nt, Human
uugcccaggcuggagugcagug

SEQ ID NO: 7109 - RNA, 27 nt, Human
uugcccaggcuggagugcaguggcgug

SEQ ID NO: 7110 - RNA, 22 nt, Human
ccgaguagcugggauuacaggu

SEQ ID NO: 7111 - RNA, 27 nt, Human
ccaggaggcuggcaguacagagugcag

SEQ ID NO: 7112 - RNA, 22 nt, Human
ccaaguaggugggauuacaggu

SEQ ID NO: 7113 - RNA, 22 nt, Human
cccaaguaggugggauuacagg

SEQ ID NO: 7114 - RNA, 19 nt, Human
cccaggcuggagugcagug

SEQ ID NO: 7115 - RNA, 27 nt, Human
caggcuggagugcaguggcgugaucuu

SEQ ID NO: 7116 - RNA, 23 nt, Human
cagccuuacacugggcacaugga

SEQ ID NO: 7117 - RNA, 22 nt, Human
cagauacacaagugagggcuuu

SEQ ID NO: 7118 - RNA, 25 nt, Human
auuugcguauguaaacauucauauu

SEQ ID NO: 7119 - RNA, 23 nt, Human
cgaguagcugggauuacaggugu

SEQ ID NO: 7120 - RNA, 22 nt, Human
cgaacuccugacaucaggugau

SEQ ID NO: 7121 - RNA, 22 nt, Human
cucggccucccaaagugcuggg

SEQ ID NO: 7122 - RNA, 24 nt, Human
cugccucccaggcucaagcacuuu

SEQ ID NO: 7123 - RNA, 22 nt, Human
gaacuccugacaucaggugauc

SEQ ID NO: 7124 - RNA, 22 nt, Human
gaacuccugaccucaggugauc

SEQ ID NO: 7125 - RNA, 26 nt, Human
agucucucauuucuuucaagacagcc

SEQ ID NO: 7126 - RNA, 18 nt, Human
aguguuugcuguuucccc

SEQ ID NO: 7127 - RNA, 22 nt, Human
augauuuuggcucacugcagcc

SEQ ID NO: 7128 - RNA, 21 nt, Human
uuuaguuuuucacuuuagcaa

SEQ ID NO: 7129 - RNA, 21 nt, Human
uuguugcccaggcuggagugc

SEQ ID NO: 7130 - RNA, 23 nt, Human
agcaggaguugauacaccaccuu

SEQ ID NO: 7131 - RNA, 18 nt, Human
uugcccaggcuggagugc

SEQ ID NO: 7132 - RNA, 26 nt, Human
uuggaacaacagcuaucuagauagcu

SEQ ID NO: 7133 - RNA, 21 nt, Human
ucuccgucacuccauucucag

SEQ ID NO: 7134 - RNA, 23 nt, Human
ucucauucuguugcccaggcugg

SEQ ID NO: 7135 - RNA, 22 nt, Human
uccgaguagcugggauuacagg

SEQ ID NO: 7136 - RNA, 20 nt, Human
ucugccucccaggcucaagc

SEQ ID NO: 7137 - RNA, 23 nt, Human
ucuugaacuccugaccucaggug

SEQ ID NO: 7138 - RNA, 28 nt, Human
ucuugaacuccugaccucaggugaucca

SEQ ID NO: 7139 - RNA, 21 nt, Human
ucuguuuuaaauuuaaaacaa

SEQ ID NO: 7140 - RNA, 21 nt, Human
ucuuagagguagguguauucc

SEQ ID NO: 7141 - RNA, 22 nt, Human
ugaacuccugaccucaggugau

SEQ ID NO: 7142 - RNA, 22 nt, Human
uguugcccaggcuggagugcaa

SEQ ID NO: 7143 - RNA, 23 nt, Human
uguugcccaggcuggagugcaac

SEQ ID NO: 7144 - RNA, 23 nt, Human
uguugcccaggcuggagugcagu

SEQ ID NO: 7145 - RNA, 27 nt, Human
aacagccuuacacugggcacauggagg

SEQ ID NO: 7146 - RNA, 24 nt, Human
gcugaguuuaguuuuucacuuuag

SEQ ID NO: 7147 - RNA, 23 nt, Human
gcucaaguugaugaaucaugggg

SEQ ID NO: 7148 - RNA, 22 nt, Human
ggccucccauagugcugggauu

SEQ ID NO: 7149 - RNA, 22 nt, Human
ggccucccaaagugcugggauu

SEQ ID NO: 7150 - RNA, 22 nt, Human
gaguagcugggauuacaggugu

SEQ ID NO: 7151 - RNA, 20 nt, Human
gcaggaugugccuguggcau

SEQ ID NO: 7152 - RNA, 24 nt, Human
gcccaggcuggagugcaacggcau

SEQ ID NO: 7153 - RNA, 25 nt, Human
gcccaggcuggagugcaacggcaug

SEQ ID NO: 7154 - RNA, 22 nt, Human
gcccaggcuggagugcaguggc

SEQ ID NO: 7155 - RNA, 25 nt, Human
gcccaggcuggagugcaguggcgug

SEQ ID NO: 7156 - RNA, 19 nt, Human
gcccaggcuggagugcagu

SEQ ID NO: 7157 - RNA, 22 nt, Human
gcccaggcuggagugcaacggc

SEQ ID NO: 7158 - RNA, 24 nt, Human
gccacucucagagacucccaggag

SEQ ID NO: 7159 - RNA, 25 nt, Human
gcaugauuuuggcucacugcagccu

SEQ ID NO: 7160 - RNA, 21 nt, Human
gacuaauuuuguauuuuuagu

SEQ ID NO: 7161 - RNA, 23 nt, Human
ggaguuguugaacuauauuugga

SEQ ID NO: 7162 - RNA, 23 nt, Human
ggcccagaaaucauacuguaagg

SEQ ID NO: 7163 - RNA, 24 nt, Human
gggacugugcagcucgaggcucca

SEQ ID NO: 7164 - RNA, 21 nt, Human
ggcucacugcagccucugccu

SEQ ID NO: 7165 - RNA, 23 nt, Human
ggcuccaccuuaacugugcucag

SEQ ID NO: 7166 - RNA, 17 nt, Human
ggaacaacagcuaucua

SEQ ID NO: 7167 - RNA, 22 nt, Human
gcucacugcagccucugccucc

SEQ ID NO: 7168 - RNA, 22 nt, Human
gucucgaacuccugacaucagg

SEQ ID NO: 7169 - RNA, 22 nt, Human
gucuugaacuccugaccucagg

SEQ ID NO: 7170 - RNA, 19 nt, Human
gugcccaggagcggcgaug

SEQ ID NO: 7171 - RNA, 22 nt, Human
gugugagccaccacgcccugcc

SEQ ID NO: 7172 - RNA, 18 nt, Human
gugugugccaucaugccu

SEQ ID NO: 7173 - RNA, 22 nt, Human
guugcccaggcuggagugcaac

SEQ ID NO: 7174 - RNA, 27 nt, Human
guugcccaggcuggagugcaacggcau

SEQ ID NO: 7175 - RNA, 22 nt, Human
guugcccaggcuggagugcagu

SEQ ID NO: 7176 - RNA, 22 nt, Human
ggucucgaacuccugacaucag

SEQ ID NO: 7177 - RNA, 26 nt, Human
ccucaggugauccacccaccugggcc

SEQ ID NO: 7178 - RNA, 22 nt, Human
cucauccucccaaguagguggg

SEQ ID NO: 7179 - RNA, 22 nt, Human
cuccagagagagccaagguucu

SEQ ID NO: 7180 - RNA, 21 nt, Human
cugccucccaggcucaagcac

SEQ ID NO: 7181 - RNA, 26 nt, Human
cucugccucccaggcucaagcacuuu

SEQ ID NO: 7182 - RNA, 22 nt, Human
cucuuuggaacaacagcuaucu

SEQ ID NO: 7183 - RNA, 22 nt, Human
cuucugcuuccacgguccuguu

SEQ ID NO: 7184 - RNA, 24 nt, Human
cuguugcccaggcuggagugcagu

SEQ ID NO: 7185 - RNA, 23 nt, Human
gacaggguuucaccauguuggcc

SEQ ID NO: 7186 - RNA, 20 nt, Human
uauuaucauuucuccuuuaa

SEQ ID NO: 7187 - RNA, 26 nt, Human
uaguuuuucacuuuagcaaaggggca

SEQ ID NO: 7188 - RNA, 23 nt, Human
uaacagcaaauaaccauugguua

SEQ ID NO: 7189 - RNA, 20 nt, Human
gggcuacacagcagcuguuc

SEQ ID NO: 7190 - RNA, 26 nt, Human
uguuuagagcaguuaacaucugaagu

SEQ ID NO: 7191 - RNA, 23 nt, Human
uugggaugcaggcucagcccgcu

SEQ ID NO: 7192 - RNA, 17 nt, Human
agguuggagaugacaga

SEQ ID NO: 7193 - RNA, 21 nt, Human
aguaugggcuacacagcagcu

SEQ ID NO: 7194 - RNA, 26 nt, Human
agcucuguguguaccgagaacugggg

SEQ ID NO: 7195 - RNA, 24 nt, Human
cuccucuccucacgaccgaggcag

SEQ ID NO: 7196 - RNA, 22 nt, Human
cggauaggcuaaucaauacccu

SEQ ID NO: 7197 - RNA, 21 nt, Human
uugccuggauaccucuggcuc

SEQ ID NO: 7198 - RNA, 22 nt, Human
uuccuguuuucaccaucuuucu

SEQ ID NO: 7199 - RNA, 26 nt, Human
augugggaaacccuuuugcguggucc

SEQ ID NO: 7200 - RNA, 26 nt, Human
agcccuuuuagugguggugucucacu

SEQ ID NO: 7201 - RNA, 23 nt, Human
agaccugagaugcuggucaagcc

SEQ ID NO: 7202 - RNA, 22 nt, Human
caguaugggcuacacagcagcu

SEQ ID NO: 7203 - RNA, 23 nt, Human
ggcuaaaacaaaucucagaacag

SEQ ID NO: 7204 - RNA, 27 nt, Human
guaauuaaaaaauggucagugugcaaa

SEQ ID NO: 7205 - RNA, 21 nt, Human
gucaccuagcagauauguauu

SEQ ID NO: 7206 - RNA, 27 nt, Human
gucaccuagcagauauguauuacuuuu

SEQ ID NO: 7207 - RNA, 29 nt, Human
gucacaggacgauuucacugacacugcga

SEQ ID NO: 7208 - RNA, 23 nt, Human
uaaagaagaguaaaauggcuguu

SEQ ID NO: 7209 - RNA, 21 nt, Human
guggaggcugggaugggugag

SEQ ID NO: 7210 - RNA, 22 nt, Human
gugacucuuguguuugcugcug

SEQ ID NO: 7211 - RNA, 20 nt, Human
gggaaaugcuguuugcucga

SEQ ID NO: 7212 - RNA, 20 nt, Human
cagccaguaaggcagcucug

SEQ ID NO: 7213 - RNA, 21 nt, Human
ucugaacuggaguggaguagg

SEQ ID NO: 7214 - RNA, 28 nt, Human
ucuacuuugccacagauuaucuuguaca

SEQ ID NO: 7215 - RNA, 19 nt, Human
uccucauucuucucuccca

SEQ ID NO: 7216 - RNA, 16 nt, Human
ucauucuucucuccca

SEQ ID NO: 7217 - RNA, 23 nt, Human
agagcaggcaccagcagcagaau

SEQ ID NO: 7218 - RNA, 24 nt, Human
agguacugugaggaagagcaggca

SEQ ID NO: 7219 - RNA, 22 nt, Human
aguggaggcugggaugggugag

SEQ ID NO: 7220 - RNA, 26 nt, Human
aguggaggcugggaugggugagagaa

SEQ ID NO: 7221 - RNA, 27 nt, Human
auccuuuuuaaaugagacuuguuuucc

SEQ ID NO: 7222 - RNA, 21 nt, Human
cagauuaucuuguacagccuu

SEQ ID NO: 7223 - RNA, 21 nt, Human
caccuugcacuauuggacuuu

SEQ ID NO: 7224 - RNA, 22 nt, Human
cacguugaaaaucaacccaaua

SEQ ID NO: 7225 - RNA, 25 nt, Human
acgauuucacugacacugcgaacuc

SEQ ID NO: 7226 - RNA, 26 nt, Human
acuugccccagaugccuccucugucc

SEQ ID NO: 7227 - RNA, 26 nt, Human
ugugaggaagagcaggcaccagcagc

SEQ ID NO: 7228 - RNA, 27 nt, Human
cuauagaaaacgauuuugaacauacuu

SEQ ID NO: 7229 - RNA, 20 nt, Human
cucaagcacugacacucauu

SEQ ID NO: 7230 - RNA, 20 nt, Human
cuccgcgccucacgccccgg

SEQ ID NO: 7231 - RNA, 21 nt, Human
cucagguuccaaauucaguaa

SEQ ID NO: 7232 - RNA, 27 nt, Human
ccugcugucagaccuucuuccacagca

SEQ ID NO: 7233 - RNA, 21 nt, Human
cuucccuuugauuuuuugcug

SEQ ID NO: 7234 - RNA, 20 nt, Human
cucuuccaaucuccaucacc

SEQ ID NO: 7235 - RNA, 20 nt, Human
cagaauggggaauggagagg

SEQ ID NO: 7236 - RNA, 25 nt, Human
caggcagcuccgggguccgcgguuu

SEQ ID NO: 7237 - RNA, 22 nt, Human
ccaccuugcacuauuggacuuu

SEQ ID NO: 7238 - RNA, 23 nt, Human
uuccaagucuuccugaccaccuu

SEQ ID NO: 7239 - RNA, 20 nt, Human
uuugcugcugcuucccucuc

SEQ ID NO: 7240 - RNA, 19 nt, Human
uuucuucuuugacuauaac

SEQ ID NO: 7241 - RNA, 25 nt, Human
ugugucccucggugcagaaacuacc

SEQ ID NO: 7242 - RNA, 28 nt, Human
ugguugguaaagccucagcaacagccag

SEQ ID NO: 7243 - RNA, 19 nt, Human
uggugaagacccagaggaa

SEQ ID NO: 7244 - RNA, 23 nt, Human
uggggaauggagaggugggcagg

SEQ ID NO: 7245 - RNA, 23 nt, Human
ugagggacgaggucaaggagaua

SEQ ID NO: 7246 - RNA, 27 nt, Human
ucuagggucuuacucuuuguaugauga

SEQ ID NO: 7247 - RNA, 22 nt, Human
gccgucugaacuggaguggagu

SEQ ID NO: 7248 - RNA, 19 nt, Human
gcauugccagcucuuccaa

SEQ ID NO: 7249 - RNA, 27 nt, Human
gcacugacacucauuaccgucugugau

SEQ ID NO: 7250 - RNA, 25 nt, Human
gagguacugugaggaagagcaggca

SEQ ID NO: 7251 - RNA, 21 nt, Human
gaggaagagcaggcaccagca

SEQ ID NO: 7252 - RNA, 21 nt, Human
gcaacuggugaaacuccgcgc

SEQ ID NO: 7253 - RNA, 28 nt, Human
gcagaauggggaauggagaggugggcag

SEQ ID NO: 7254 - RNA, 25 nt, Human
aacuggaguggaguaggagaaagag

SEQ ID NO: 7255 - RNA, 27 nt, Human
ggggucugaucuuucuccuuggucggg

SEQ ID NO: 7256 - RNA, 18 nt, Human
ggugaagacccagaggaa

SEQ ID NO: 7257 - RNA, 25 nt, Human
gugaggaagagcaggcaccagcagc

SEQ ID NO: 7258 - RNA, 20 nt, Human
gugauugccauuucuuccca

SEQ ID NO: 7259 - RNA, 23 nt, Human
gucugaacuggaguggaguagga

SEQ ID NO: 7260 - RNA, 23 nt, Human
ggcaccagcagcagaauggggaa

SEQ ID NO: 7261 - RNA, 22 nt, Human
ggcagggguuccagcuucccuu

SEQ ID NO: 7262 - RNA, 25 nt, Human
gcauugccagcucuuccaaucucca

SEQ ID NO: 7263 - RNA, 24 nt, Human
cggaacucuucaucuuaaacuaca

SEQ ID NO: 7264 - RNA, 22 nt, Human
ccugcugucagaccuucuucca

SEQ ID NO: 7265 - RNA, 21 nt, Human
ucagaccuucuuccacagcaa

SEQ ID NO: 7266 - RNA, 23 nt, Human
uacugaugaagaaacugaggcca

SEQ ID NO: 7267 - RNA, 25 nt, Human
cgcuuuggggagcgccucgcuucac

SEQ ID NO: 7268 - RNA, 21 nt, Human
cugugugaccauagaaaguga

SEQ ID NO: 7269 - RNA, 23 nt, Human
gcucuggcuggagaggaaaagcc

SEQ ID NO: 7270 - RNA, 18 nt, Human
gcuuuguccaugaugucc

SEQ ID NO: 7271 - RNA, 21 nt, Human
gagcuaaagugacuuuuccca

SEQ ID NO: 7272 - RNA, 23 nt, Human
ggagcaggcauuuccagcaguga

SEQ ID NO: 7273 - RNA, 28 nt, Human
ggagagugaugugagggagcugugugac

SEQ ID NO: 7274 - RNA, 22 nt, Human
gcuaugcucacauucauggccu

SEQ ID NO: 7275 - RNA, 21 nt, Human
uccagcagugaggagacagcc

SEQ ID NO: 7276 - RNA, 23 nt, Human
ugggacuucucagacgucaggag

SEQ ID NO: 7277 - RNA, 25 nt, Human
agcauccggcaugagggcugagaug

SEQ ID NO: 7278 - RNA, 24 nt, Human
uucucagacgucaggagagugaug

SEQ ID NO: 7279 - RNA, 20 nt, Human
ccaaguguccgggauucaga

SEQ ID NO: 7280 - RNA, 25 nt, Human
cacaggcugcaagcugcagggaauu

SEQ ID NO: 7281 - RNA, 26 nt, Human
gaagcaagcuauuggagcugaaggaa

SEQ ID NO: 7282 - RNA, 27 nt, Human
ccuggcaccugggugcucuggcuggag

SEQ ID NO: 7283 - RNA, 19 nt, Human
uuggugaggaggaggcaga

SEQ ID NO: 7284 - RNA, 22 nt, Human
agaaacugaggccacagagcua

SEQ ID NO: 7285 - RNA, 19 nt, Human
caaguguccgggauucaga

SEQ ID NO: 7286 - RNA, 24 nt, Human
agggugacagggacacaacauggc

SEQ ID NO: 7287 - RNA, 21 nt, Human
ucuaggguuuucuuucauuuu

SEQ ID NO: 7288 - RNA, 25 nt, Human
gggccaggccugggugaucugcugc

SEQ ID NO: 7289 - RNA, 21 nt, Human
uguauaugaaucaaaacaaac

SEQ ID NO: 7290 - RNA, 20 nt, Human
cgagcaggcauuucugugau

SEQ ID NO: 7291 - RNA, 21 nt, Human
cuuuuccguccagugucggca

SEQ ID NO: 7292 - RNA, 23 nt, Human
auccuagugcgggaccccgccuc

SEQ ID NO: 7293 - RNA, 20 nt, Human
ugccuaggauguucugggcu

SEQ ID NO: 7294 - RNA, 20 nt, Human
ugucccuucccagcgcugcu

SEQ ID NO: 7295 - RNA, 23 nt, Human
ggagcgccaucaugucuuaccag

SEQ ID NO: 7296 - RNA, 20 nt, Human
aauuuggggcaggaaauacu

SEQ ID NO: 7297 - RNA, 23 nt, Human
aauccgagccagcucugggggcu

SEQ ID NO: 7298 - RNA, 19 nt, Human
cagccguguuguagcuaau

SEQ ID NO: 7299 - RNA, 20 nt, Human
uguagcuaauuaggaagcuu

SEQ ID NO: 7300 - RNA, 26 nt, Human
ggggugagacaaggaagaggaugucu

SEQ ID NO: 7301 - RNA, 26 nt, Human
ucuuucugcuauauuaggccugugug

SEQ ID NO: 7302 - RNA, 31 nt, Human
ucuuucugcuauauuaggccuguguguaagc

SEQ ID NO: 7303 - RNA, 26 nt, Human
aggaagaggaugucugagcuggagaa

SEQ ID NO: 7304 - RNA, 27 nt, Human
auuugaaaacacugcuguucuuuaaau

SEQ ID NO: 7305 - RNA, 22 nt, Human
cacuaccgggggcucugagcca

SEQ ID NO: 7306 - RNA, 27 nt, Human
auucuuucugcuauauuaggccugugu

SEQ ID NO: 7307 - RNA, 20 nt, Human
aaggagaccaggaaggggug

SEQ ID NO: 7308 - RNA, 20 nt, Human
gcccugcaagggcguggugg

SEQ ID NO: 7309 - RNA, 22 nt, Human
guaagcugacuggccccaggga

SEQ ID NO: 7310 - RNA, 19 nt, Human
ggggugagacaaggaagag

SEQ ID NO: 7311 - RNA, 20 nt, Human
cuguucuuuaaaugcguucc

SEQ ID NO: 7312 - RNA, 27 nt, Human
uauccagcauuauuugaaaacacugcu

SEQ ID NO: 7313 - RNA, 19 nt, Human
gaagcucucacacgcacag

SEQ ID NO: 7314 - RNA, 23 nt, Human
ccugugcaccguaguggccaugg

SEQ ID NO: 7315 - RNA, 22 nt, Human
gcccauggacucuucagucugg

SEQ ID NO: 7316 - RNA, 21 nt, Human
auguguggcccugucugcuua

SEQ ID NO: 7317 - RNA, 21 nt, Human
aguaggaacuuggaaugcaag

SEQ ID NO: 7318 - RNA, 20 nt, Human
ugaagcucucacacgcacag

SEQ ID NO: 7319 - RNA, 20 nt, Human
cagucuggaggguccuggcc

SEQ ID NO: 7320 - RNA, 22 nt, Human
cauguguggcccugucugcuua

SEQ ID NO: 7321 - RNA, 21 nt, Human
cccauggacucuucagucugg

SEQ ID NO: 7322 - RNA, 23 nt, Human
cucuucagucuggaggguccugg

SEQ ID NO: 7323 - RNA, 21 nt, Human
ccuuguucccagugcugucaa

SEQ ID NO: 7324 - RNA, 24 nt, Human
cuaaccuuugagaucacucagcuc

SEQ ID NO: 7325 - RNA, 20 nt, Human
ccaucuccuuucagaaaaau

SEQ ID NO: 7326 - RNA, 22 nt, Human
cccugcuccucucuguccugcc

SEQ ID NO: 7327 - RNA, 22 nt, Human
ccucucuguccugccucaggcc

SEQ ID NO: 7328 - RNA, 17 nt, Human
ucuccacccguucugcc

SEQ ID NO: 7329 - RNA, 30 nt, Human
uccuuuaucuccagggacucucaggcuaac

SEQ ID NO: 7330 - RNA, 27 nt, Human
ucuccagggacucucaggcuaaccuuu

SEQ ID NO: 7331 - RNA, 26 nt, Human
auugccucucagggguagugaagcug

SEQ ID NO: 7332 - RNA, 27 nt, Human
aggaacccugcuccucucuguccugcc

SEQ ID NO: 7333 - RNA, 16 nt, Human
gcacccacaccccccg

SEQ ID NO: 7334 - RNA, 25 nt, Human
ugccucaggccuaagaagcacucuc

SEQ ID NO: 7335 - RNA, 30 nt, Human
ugcuccucucuguccugccucaggccuaag

SEQ ID NO: 7336 - RNA, 23 nt, Human
aucuccagggacucucaggcuaa

SEQ ID NO: 7337 - RNA, 21 nt, Human
uuacucguccccgccauucca

SEQ ID NO: 7338 - RNA, 21 nt, Human
ggaccuccauuccacucaucu

SEQ ID NO: 7339 - RNA, 22 nt, Human
ccucuccacccguucugccuca

SEQ ID NO: 7340 - RNA, 20 nt, Human
cuccacccguucugccucag

SEQ ID NO: 7341 - RNA, 21 nt, Human
cuccucucuguccugccucag

SEQ ID NO: 7342 - RNA, 22 nt, Human
ucagggguagugaagcugcaga

SEQ ID NO: 7343 - RNA, 22 nt, Human
uagaaccuucuaauccaugugc

SEQ ID NO: 7344 - RNA, 26 nt, Human
ggagagaacagggaugcuaucucgcu

SEQ ID NO: 7345 - RNA, 19 nt, Human
gccuccagccacuuauuuc

SEQ ID NO: 7346 - RNA, 21 nt, Human
uucuccacaaccuccuccucc

SEQ ID NO: 7347 - RNA, 20 nt, Human
aucaagucugugaaagucuc

SEQ ID NO: 7348 - RNA, 23 nt, Human
auuuuggacgugugaggaugugg

SEQ ID NO: 7349 - RNA, 29 nt, Human
agacucaaggccuccagccacuuauuucc

SEQ ID NO: 7350 - RNA, 23 nt, Human
acccuaucaucaguuaggauuag

SEQ ID NO: 7351 - RNA, 20 nt, Human
ucagugucauuuacuaacca

SEQ ID NO: 7352 - RNA, 32 nt, Human
ucagugucauuuacuaaccagcaggauggaga

SEQ ID NO: 7353 - RNA, 27 nt, Human
uagaaccuucuaauccaugugcugcug

SEQ ID NO: 7354 - RNA, 24 nt, Human
caguucugaugaggcacgccugcc

SEQ ID NO: 7355 - RNA, 24 nt, Human
ggcacgccugccuucuccccucca

SEQ ID NO: 7356 - RNA, 23 nt, Human
aagcacccagagaucaauuggga

SEQ ID NO: 7357 - RNA, 27 nt, Human
aggccuccagccacuuauuuccaugga

SEQ ID NO: 7358 - RNA, 25 nt, Human
auauucccaugguagacugugacac

SEQ ID NO: 7359 - RNA, 22 nt, Human
cccuaucaucaguuaggauuag

SEQ ID NO: 7360 - RNA, 24 nt, Human
caaccuccuccuccaguucugaug

SEQ ID NO: 7361 - RNA, 27 nt, Human
cgaaccugaagccuagaaauaucuuug

SEQ ID NO: 7362 - RNA, 20 nt, Human
cuguuguucagaaguuguua

SEQ ID NO: 7363 - RNA, 20 nt, Human
cuucccuuucacugaaguga

SEQ ID NO: 7364 - RNA, 21 nt, Human
uuuaauugagccuuuuauuaa

SEQ ID NO: 7365 - RNA, 24 nt, Human
uuaagaacugacacaaaggacaaa

SEQ ID NO: 7366 - RNA, 18 nt, Human
ugcccccacucagcauuu

SEQ ID NO: 7367 - RNA, 24 nt, Human
gcccccacucagcauuucggugcu

SEQ ID NO: 7368 - RNA, 22 nt, Human
ucagcauuucggugcuucccuu

SEQ ID NO: 7369 - RNA, 23 nt, Human
ucggaauucccugaagcaacacu

SEQ ID NO: 7370 - RNA, 27 nt, Human
ugcuguuguucagaaguuguuagugau

SEQ ID NO: 7371 - RNA, 22 nt, Human
accugaagccuagaaauaucuu

SEQ ID NO: 7372 - RNA, 20 nt, Human
aguaucuguaccugccccca

SEQ ID NO: 7373 - RNA, 20 nt, Human
augcuguaccuuucugacaa

SEQ ID NO: 7374 - RNA, 22 nt, Human
uuccuuaaguggcugugauuaa

SEQ ID NO: 7375 - RNA, 28 nt, Human
gccuuuuauuaacauauauuguuauuuu

SEQ ID NO: 7376 - RNA, 22 nt, Human
gccauuugaagaaggaggaauu

SEQ ID NO: 7377 - RNA, 21 nt, Human
gcuguuguucagaaguuguua

SEQ ID NO: 7378 - RNA, 22 nt, Human
uuuucucucacugaugcccuuu

SEQ ID NO: 7379 - RNA, 26 nt, Human
agaguguuuuuucugucauuucuacu

SEQ ID NO: 7380 - RNA, 25 nt, Human
acagcauaaagcacauugcugagcc

SEQ ID NO: 7381 - RNA, 26 nt, Human
uggaaagagaaccaugaaaacaaugc

SEQ ID NO: 7382 - RNA, 26 nt, Human
uacagcauaaagcacauugcugagcc

SEQ ID NO: 7383 - RNA, 17 nt, Human
aauaucaggaugccuua

SEQ ID NO: 7384 - RNA, 19 nt, Human
aggaaagaauaaggcagca

SEQ ID NO: 7385 - RNA, 19 nt, Human
cauugcugagccagaguca

SEQ ID NO: 7386 - RNA, 24 nt, Human
uuuuucugucauuucuacuuuuug

SEQ ID NO: 7387 - RNA, 22 nt, Human
ccggggcauggacagggccagg

SEQ ID NO: 7388 - RNA, 23 nt, Human
cgcagccgccgcuccauccccag

SEQ ID NO: 7389 - RNA, 19 nt, Human
ucugucccugucccugccc

SEQ ID NO: 7390 - RNA, 26 nt, Human
ugagccagaggcguagggcccaggag

SEQ ID NO: 7391 - RNA, 26 nt, Human
ucuuccuuccgcucugaggcaacccc

SEQ ID NO: 7392 - RNA, 28 nt, Human
uccuguuccacuccggccuuccuagcgg

SEQ ID NO: 7393 - RNA, 19 nt, Human
cagcacaauucugucccug

SEQ ID NO: 7394 - RNA, 22 nt, Human
gcaacccccucggagccugugu

SEQ ID NO: 7395 - RNA, 31 nt, Human
cugcgagcuccguccugccugcagcagcaca

SEQ ID NO: 7396 - RNA, 22 nt, Human
ccugugcugcugcaccaaccuc

SEQ ID NO: 7397 - RNA, 25 nt, Human
ugcgagcuccguccugccugcagca

SEQ ID NO: 7398 - RNA, 26 nt, Human
ccugcgagcuccguccugccugcagc

SEQ ID NO: 7399 - RNA, 21 nt, Human
cugcugcaccaaccucacugc

SEQ ID NO: 7400 - RNA, 25 nt, Human
gagacuaagggcuacaggccagcgu

SEQ ID NO: 7401 - RNA, 27 nt, Human
cugaguauguuaagcucuuuaugacug

SEQ ID NO: 7402 - RNA, 19 nt, Human
uuguagcauuucuugaugu

SEQ ID NO: 7403 - RNA, 24 nt, Human
aggucugcaagaaccugacucguc

SEQ ID NO: 7404 - RNA, 28 nt, Human
aucauacugaaguagagugcggcguuuc

SEQ ID NO: 7405 - RNA, 23 nt, Human
ugggaauugugugauguuuaaca

SEQ ID NO: 7406 - RNA, 27 nt, Human
uggaggaguccaggccauggaggcaga

SEQ ID NO: 7407 - RNA, 23 nt, Human
ucugcagcuguuuuaguuaaauu

SEQ ID NO: 7408 - RNA, 22 nt, Human
ugaugggaauugugugauguuu

SEQ ID NO: 7409 - RNA, 21 nt, Human
cuggggcagccaagaacgagc

SEQ ID NO: 7410 - RNA, 26 nt, Human
ccaguggcugcuccuuccuucaccuc

SEQ ID NO: 7411 - RNA, 22 nt, Human
caguucugcagcuguuuuaguu

SEQ ID NO: 7412 - RNA, 21 nt, Human
gagagcgagaccugggaggga

SEQ ID NO: 7413 - RNA, 22 nt, Human
gccaggauggccugggcucuga

SEQ ID NO: 7414 - RNA, 26 nt, Human
ggaggaguccaggccauggaggcaga

SEQ ID NO: 7415 - RNA, 22 nt, Human
ggaaggagccaggauggccugg

SEQ ID NO: 7416 - RNA, 24 nt, Human
gcugccucugggaagucugcagua

SEQ ID NO: 7417 - RNA, 18 nt, Human
gcugcugcuggucugacu

SEQ ID NO: 7418 - RNA, 25 nt, Human
aaggucugcaagaaccugacucguc

SEQ ID NO: 7419 - RNA, 22 nt, Human
aguccaggccauggaggcagaa

SEQ ID NO: 7420 - RNA, 22 nt, Human
acagagcagugcuagucgggcu

SEQ ID NO: 7421 - RNA, 24 nt, Human
acaggaagaucuuaaauuuuguga

SEQ ID NO: 7422 - RNA, 26 nt, Human
uaguugagcaaagggguccucacguu

SEQ ID NO: 7423 - RNA, 19 nt, Human
uggaggcagaauccuggcc

SEQ ID NO: 7424 - RNA, 19 nt, Human
ugcuagucgggcuuggggg

SEQ ID NO: 7425 - RNA, 27 nt, Human
gggagagagcgagaccugggagggagg

SEQ ID NO: 7426 - RNA, 27 nt, Human
cugggagggagggguccuccagcagaa

SEQ ID NO: 7427 - RNA, 21 nt, Human
cugagagcugggcagggggga

SEQ ID NO: 7428 - RNA, 19 nt, Human
ggcugcugcuggucugacu

SEQ ID NO: 7429 - RNA, 22 nt, Human
ggaggcuaaggugggaggauca

SEQ ID NO: 7430 - RNA, 26 nt, Human
ggaggaaggagucgccgaggagcagc

SEQ ID NO: 7431 - RNA, 26 nt, Human
gagacacccccgguccaagccucccc

SEQ ID NO: 7432 - RNA, 22 nt, Human
gccacugcggggaggaggggga

SEQ ID NO: 7433 - RNA, 26 nt, Human
gccuguaauccuagcacuuuugggag

SEQ ID NO: 7434 - RNA, 21 nt, Human
gcccuucucccugaggagccu

SEQ ID NO: 7435 - RNA, 24 nt, Human
cugccuccuccugccugucugcac

SEQ ID NO: 7436 - RNA, 23 nt, Human
ccucucugccuccuccugccugu

SEQ ID NO: 7437 - RNA, 18 nt, Human
cuccuccugccugucugc

SEQ ID NO: 7438 - RNA, 22 nt, Human
cuccuccugccugucugcacua

SEQ ID NO: 7439 - RNA, 24 nt, Human
cgcugggagccggaggcgcgggga

SEQ ID NO: 7440 - RNA, 21 nt, Human
cgccuguaauccuagcacuuu

SEQ ID NO: 7441 - RNA, 22 nt, Human
cgccuguaauccuagcacuuuu

SEQ ID NO: 7442 - RNA, 17 nt, Human
ggccucggcccggagcg

SEQ ID NO: 7443 - RNA, 26 nt, Human
ccauuuuaaagguugaggaaacaagc

SEQ ID NO: 7444 - RNA, 27 nt, Human
ccaggcauuugagaccagccuggguaa

SEQ ID NO: 7445 - RNA, 18 nt, Human
ccauagcaacacucugag

SEQ ID NO: 7446 - RNA, 22 nt, Human
uaacauagugagacccuaucuc

SEQ ID NO: 7447 - RNA, 20 nt, Human
gggaggaguuccugcccacc

SEQ ID NO: 7448 - RNA, 22 nt, Human
gguccaagccuccccuccacca

SEQ ID NO: 7449 - RNA, 23 nt, Human
ggugcucacgccuguaauccuag

SEQ ID NO: 7450 - RNA, 23 nt, Human
ugcggggaggagggggaggagga

SEQ ID NO: 7451 - RNA, 21 nt, Human
uccuccugccugucugcacua

SEQ ID NO: 7452 - RNA, 25 nt, Human
uccaggcauuugagaccagccuggg

SEQ ID NO: 7453 - RNA, 22 nt, Human
accagccuggguaacauaguga

SEQ ID NO: 7454 - RNA, 22 nt, Human
agaccagccuggguaacauagu

SEQ ID NO: 7455 - RNA, 22 nt, Human
acuauuccuuugcccggcauca

SEQ ID NO: 7456 - RNA, 22 nt, Human
acgccuguaauccuagcacuuu

SEQ ID NO: 7457 - RNA, 20 nt, Human
agugagacccuaucucuaca

SEQ ID NO: 7458 - RNA, 19 nt, Human
aggcuaaggugggaggauc

SEQ ID NO: 7459 - RNA, 22 nt, Human
aggaaccugcuuuaguggggga

SEQ ID NO: 7460 - RNA, 22 nt, Human
cacgccuguaauccuagcacuu

SEQ ID NO: 7461 - RNA, 27 nt, Human
auuccuuugcccggcaucaaggcacag

SEQ ID NO: 7462 - RNA, 21 nt, Human
uugggaggcagagaugggagg

SEQ ID NO: 7463 - RNA, 22 nt, Human
ugggagccggaggcgcggggac

SEQ ID NO: 7464 - RNA, 21 nt, Human
aauguacaccuguggucccag

SEQ ID NO: 7465 - RNA, 23 nt, Human
gcugggagccggaggcgcgggga

SEQ ID NO: 7466 - RNA, 22 nt, Human
gcucacgccuguaauccuagca

SEQ ID NO: 7467 - RNA, 23 nt, Human
gccuguaauccuagcacuuuugg

SEQ ID NO: 7468 - RNA, 27 nt, Human
gcaccuugggcacuguugaagugccuu

SEQ ID NO: 7469 - RNA, 26 nt, Human
caggcauuugagaccagccuggguaa

SEQ ID NO: 7470 - RNA, 25 nt, Human
caccacugcgcccuucucccugagg

SEQ ID NO: 7471 - RNA, 31 nt, Human
ccaggcauuugagaccagccuggguaacaua

SEQ ID NO: 7472 - RNA, 26 nt, Human
cccaccaggaaccugcuuuagugggg

SEQ ID NO: 7473 - RNA, 25 nt, Human
cccugaggagccucagcuuucccuc

SEQ ID NO: 7474 - RNA, 26 nt, Human
cugggagccggaggcgcggggaccuc

SEQ ID NO: 7475 - RNA, 22 nt, Human
gaccagccuggguaacauagug

SEQ ID NO: 7476 - RNA, 22 nt, Human
ccuguaauccuagcacuuuugg

SEQ ID NO: 7477 - RNA, 22 nt, Human
cuccugagcccccgcgcauccu

SEQ ID NO: 7478 - RNA, 23 nt, Human
cucucugccuccuccugccuguc

SEQ ID NO: 7479 - RNA, 24 nt, Human
ucugccuccuccugccugucugca

SEQ ID NO: 7480 - RNA, 20 nt, Human
uggaggcuaaggugggagga

SEQ ID NO: 7481 - RNA, 25 nt, Human
auccuagcacuuuugggaggcagag

SEQ ID NO: 7482 - RNA, 27 nt, Human
ugucauugucuguccccacccggucgu

SEQ ID NO: 7483 - RNA, 22 nt, Human
ucuccucucugggaaacguccc

SEQ ID NO: 7484 - RNA, 21 nt, Human
gcggcugucuugccucuuguc

SEQ ID NO: 7485 - RNA, 21 nt, Human
ggcacagugccugggacuggc

SEQ ID NO: 7486 - RNA, 20 nt, Human
cggcugucuugccucuuguc

SEQ ID NO: 7487 - RNA, 24 nt, Human
gcacugcgacugcccagucuggcc

SEQ ID NO: 7488 - RNA, 27 nt, Human
ggcacagugccugggacuggcagggug

SEQ ID NO: 7489 - RNA, 28 nt, Human
ggggcaggcucuggcacagugccuggga

SEQ ID NO: 7490 - RNA, 23 nt, Human
gguggaaggagggagggagccgc

SEQ ID NO: 7491 - RNA, 28 nt, Human
gguggaaggagggagggagccgcaggcg

SEQ ID NO: 7492 - RNA, 21 nt, Human
gcuccccaggggaguuguguc

SEQ ID NO: 7493 - RNA, 24 nt, Human
ggaccuuaggccuuccucucucca

SEQ ID NO: 7494 - RNA, 26 nt, Human
gagaauugggggcuuagggucggaac

SEQ ID NO: 7495 - RNA, 20 nt, Human
cuggaaucuggagaccaggg

SEQ ID NO: 7496 - RNA, 21 nt, Human
cuugagacacggagcccagcc

SEQ ID NO: 7497 - RNA, 26 nt, Human
cccucucuccccuggaaaggacacca

SEQ ID NO: 7498 - RNA, 21 nt, Human
cccucagcaaggacagcagag

SEQ ID NO: 7499 - RNA, 27 nt, Human
uccacccucucuccccuggaaaggaca

SEQ ID NO: 7500 - RNA, 25 nt, Human
ccuggccucugugccuucuuuugau

SEQ ID NO: 7501 - RNA, 21 nt, Human
ccuuaggccuuccucucucca

SEQ ID NO: 7502 - RNA, 23 nt, Human
gaccuuaggccuuccucucucca

SEQ ID NO: 7503 - RNA, 27 nt, Human
cuucccaaacgccuccccugccccaau

SEQ ID NO: 7504 - RNA, 20 nt, Human
cuuaggccuuccucucucca

SEQ ID NO: 7505 - RNA, 27 nt, Human
ccagcucccucuauuuauguuugcacu

SEQ ID NO: 7506 - RNA, 21 nt, Human
cacuggggccuacagcuuuga

SEQ ID NO: 7507 - RNA, 22 nt, Human
uuccuugagacacggagcccag

SEQ ID NO: 7508 - RNA, 28 nt, Human
aggaauguguggccugcacagugaagug

SEQ ID NO: 7509 - RNA, 21 nt, Human
agugcuggcaaccacuaagaa

SEQ ID NO: 7510 - RNA, 21 nt, Human
accuuaggccuuccucucucc

SEQ ID NO: 7511 - RNA, 22 nt, Human
acucacuggggccuacagcuuu

SEQ ID NO: 7512 - RNA, 23 nt, Human
ugcuggcaaccacuaagaauuca

SEQ ID NO: 7513 - RNA, 20 nt, Human
uccuggcuccaacacugcug

SEQ ID NO: 7514 - RNA, 27 nt, Human
ucacccaggaggauggcaaagagaguc

SEQ ID NO: 7515 - RNA, 27 nt, Human
ggggcaggggagucagcagaggccucg

SEQ ID NO: 7516 - RNA, 22 nt, Human
caggagagacagugaggcugca

SEQ ID NO: 7517 - RNA, 20 nt, Human
acaggagaccuggcacugga

SEQ ID NO: 7518 - RNA, 26 nt, Human
aguuugagacaggagaccuggcacug

SEQ ID NO: 7519 - RNA, 19 nt, Human
caggagaccuggcacugga

SEQ ID NO: 7520 - RNA, 26 nt, Human
cccgacgaucuuccuggcuccaacac

SEQ ID NO: 7521 - RNA, 27 nt, Human
ucccgacgaucuuccuggcuccaacac

SEQ ID NO: 7522 - RNA, 22 nt, Human
uggcuccaacacugcugcucca

SEQ ID NO: 7523 - RNA, 20 nt, Human
agugggcugcacccacccag

SEQ ID NO: 7524 - RNA, 20 nt, Human
gcgugagggugaggggcugg

SEQ ID NO: 7525 - RNA, 23 nt, Human
gagacaggagaccuggcacugga

SEQ ID NO: 7526 - RNA, 21 nt, Human
ggcuccaacacugcugcucca

SEQ ID NO: 7527 - RNA, 30 nt, Human
ggugaggggcuggcacugacugggcauagc

SEQ ID NO: 7528 - RNA, 21 nt, Human
gucacccaggaggauggcaaa

SEQ ID NO: 7529 - RNA, 27 nt, Human
gucacccaggaggauggcaaagagagu

SEQ ID NO: 7530 - RNA, 21 nt, Human
ggucacccaggaggauggcaa

SEQ ID NO: 7531 - RNA, 21 nt, Human
ucacccaggaggauggcaaag

SEQ ID NO: 7532 - RNA, 26 nt, Human
uccaaggauguuuaaaaucuaguugg

SEQ ID NO: 7533 - RNA, 26 nt, Human
gugaaaaacaacaaauucaguucuga

SEQ ID NO: 7534 - RNA, 24 nt, Human
gugacacacagguguucaaagacg

SEQ ID NO: 7535 - RNA, 26 nt, Human
ggcaagacugcccuuagaaauucuag

SEQ ID NO: 7536 - RNA, 16 nt, Human
gcguaugacacauuga

SEQ ID NO: 7537 - RNA, 23 nt, Human
gacaauguccaagacacagcaga

SEQ ID NO: 7538 - RNA, 23 nt, Human
gacgcuucuggggagugagggaa

SEQ ID NO: 7539 - RNA, 21 nt, Human
cugcccuuagaaauucuagcc

SEQ ID NO: 7540 - RNA, 25 nt, Human
cgcaagagugacacacagguguuca

SEQ ID NO: 7541 - RNA, 25 nt, Human
gccagcccuggcugcccaggcggag

SEQ ID NO: 7542 - RNA, 21 nt, Human
augcagaaagcacagaaagga

SEQ ID NO: 7543 - RNA, 21 nt, Human
auguaaacugugaagauaguu

SEQ ID NO: 7544 - RNA, 26 nt, Human
uugggugaagagaaaggaaguacaga

SEQ ID NO: 7545 - RNA, 25 nt, Human
ugggugaagagaaaggaaguacaga

SEQ ID NO: 7546 - RNA, 23 nt, Human
ucucaggcaucaaaagcauuuug

SEQ ID NO: 7547 - RNA, 18 nt, Human
cuggcucaaaacuaccua

SEQ ID NO: 7548 - RNA, 24 nt, Human
cuuugccaccucuccauuuuugcc

SEQ ID NO: 7549 - RNA, 21 nt, Human
auuuaaauaaggcucuaccuc

SEQ ID NO: 7550 - RNA, 26 nt, Human
auggaaagaaagaagcguaugacaca

SEQ ID NO: 7551 - RNA, 27 nt, Human
auggaaagaaagaagcguaugacacau

SEQ ID NO: 7552 - RNA, 24 nt, Human
auguccaagacacagcagaacaga

SEQ ID NO: 7553 - RNA, 22 nt, Human
acaauguccaagacacagcaga

SEQ ID NO: 7554 - RNA, 19 nt, Human
uccucaaggacauuacuag

SEQ ID NO: 7555 - RNA, 24 nt, Human
ucuuucucaggcaucaaaagcauu

SEQ ID NO: 7556 - RNA, 26 nt, Human
ucagugaagaugcagaagggaaaugg

SEQ ID NO: 7557 - RNA, 32 nt, Human
cagguugaauucugaguaaacagcagauaacu

SEQ ID NO: 7558 - RNA, 23 nt, Human
auuacaggucacaugaaaccaaa

SEQ ID NO: 7559 - RNA, 27 nt, Human
aguucucuucuuuccacccugucccua

SEQ ID NO: 7560 - RNA, 25 nt, Human
uuuccacccugucccuaucucuacc

SEQ ID NO: 7561 - RNA, 23 nt, Human
cuugcaggcugugguggagcuga

SEQ ID NO: 7562 - RNA, 21 nt, Human
cucugccagaagauaccauuu

SEQ ID NO: 7563 - RNA, 22 nt, Human
caugaaaccaaaacgggcccug

SEQ ID NO: 7564 - RNA, 21 nt, Human
uucaguuuuguuucuuugcgu

SEQ ID NO: 7565 - RNA, 24 nt, Human
auccagagaguccuaugaaaagac

SEQ ID NO: 7566 - RNA, 21 nt, Human
cggacaguuauucauucucuu

SEQ ID NO: 7567 - RNA, 20 nt, Human
cuaugaaaagacaaggccau

SEQ ID NO: 7568 - RNA, 20 nt, Human
cuccuuauggagaacuauuu

SEQ ID NO: 7569 - RNA, 26 nt, Human
gcagaagggaaauggggagccucagc

SEQ ID NO: 7570 - RNA, 24 nt, Human
ggcugugguggagcugacgcuggg

SEQ ID NO: 7571 - RNA, 25 nt, Human
ggagaacuauuuauuauacacucca

SEQ ID NO: 7572 - RNA, 22 nt, Human
gcuggcucuucugugcuuucca

SEQ ID NO: 7573 - RNA, 22 nt, Human
ggcugugugacggcugccugaa

SEQ ID NO: 7574 - RNA, 32 nt, Human
ggccuggcuggcucuucugugcuuuccacaaa

SEQ ID NO: 7575 - RNA, 26 nt, Human
gcagaagcucucccucccuacucccu

SEQ ID NO: 7576 - RNA, 22 nt, Human
gccaggaugcaggcauccacau

SEQ ID NO: 7577 - RNA, 24 nt, Human
gcagcugggaacaugugcaggcug

SEQ ID NO: 7578 - RNA, 29 nt, Human
gggagggagcucuuucucuggcccugcag

SEQ ID NO: 7579 - RNA, 22 nt, Human
gggcacugucugaacuccugac

SEQ ID NO: 7580 - RNA, 25 nt, Human
gggcagcaggccugguugcagcugg

SEQ ID NO: 7581 - RNA, 20 nt, Human
cugacacguccagggccagg

SEQ ID NO: 7582 - RNA, 26 nt, Human
cugccuggccacugagcacuggccga

SEQ ID NO: 7583 - RNA, 27 nt, Human
cugccuggccacugagcacuggccgag

SEQ ID NO: 7584 - RNA, 27 nt, Human
cggcuccaguccauagacguucccccc

SEQ ID NO: 7585 - RNA, 17 nt, Human
ccugcagccccucagcc

SEQ ID NO: 7586 - RNA, 20 nt, Human
cccaggccugucaagagacg

SEQ ID NO: 7587 - RNA, 22 nt, Human
cccagccaagggacacaucuca

SEQ ID NO: 7588 - RNA, 20 nt, Human
agccucaucuuccugucucu

SEQ ID NO: 7589 - RNA, 27 nt, Human
ucugaucuauuucaccaaccaccccau

SEQ ID NO: 7590 - RNA, 20 nt, Human
ccaagacauuaaaucugcca

SEQ ID NO: 7591 - RNA, 25 nt, Human
cccugccacucuccccaagagggcc

SEQ ID NO: 7592 - RNA, 23 nt, Human
cugcagaugaccucaugaacugg

SEQ ID NO: 7593 - RNA, 22 nt, Human
cugccuggccacugagcacugg

SEQ ID NO: 7594 - RNA, 23 nt, Human
cuugccuggccugggcuaggggc

SEQ ID NO: 7595 - RNA, 21 nt, Human
ccuggccaggacucaggcugu

SEQ ID NO: 7596 - RNA, 26 nt, Human
ccuggccaggacucaggcuguuccug

SEQ ID NO: 7597 - RNA, 22 nt, Human
cucucuagccacccccuugucc

SEQ ID NO: 7598 - RNA, 24 nt, Human
cggugagcuuccugcagccugugg

SEQ ID NO: 7599 - RNA, 20 nt, Human
cucacgcagcugggaacaug

SEQ ID NO: 7600 - RNA, 19 nt, Human
gcagcugggaacaugugca

SEQ ID NO: 7601 - RNA, 21 nt, Human
gaggugccucaacauggagcc

SEQ ID NO: 7602 - RNA, 21 nt, Human
gcgagcuggagagaggacugu

SEQ ID NO: 7603 - RNA, 25 nt, Human
gcuggcgugggggucucagaaugga

SEQ ID NO: 7604 - RNA, 24 nt, Human
ggccccagccaagggacacaucuc

SEQ ID NO: 7605 - RNA, 21 nt, Human
uucuccucugacccaucagcu

SEQ ID NO: 7606 - RNA, 19 nt, Human
augcaggcauccacaugcc

SEQ ID NO: 7607 - RNA, 23 nt, Human
cacuacugcugugcccucaggcu

SEQ ID NO: 7608 - RNA, 21 nt, Human
agucugcugcagaugaccuca

SEQ ID NO: 7609 - RNA, 26 nt, Human
agggcagcaggccugguugcagcugg

SEQ ID NO: 7610 - RNA, 24 nt, Human
aagcucucccucccuacucccugg

SEQ ID NO: 7611 - RNA, 26 nt, Human
accaugucgcuggcagcuggugcugg

SEQ ID NO: 7612 - RNA, 22 nt, Human
cccaaguuucuccucugaccca

SEQ ID NO: 7613 - RNA, 26 nt, Human
ggcgguggagacuucccugugcggug

SEQ ID NO: 7614 - RNA, 24 nt, Human
ggucaaggugacccgggaggagag

SEQ ID NO: 7615 - RNA, 21 nt, Human
gucugaacuccugacugucag

SEQ ID NO: 7616 - RNA, 25 nt, Human
gugccucaacauggagccuugccug

SEQ ID NO: 7617 - RNA, 19 nt, Human
ucaacauggagccuugccu

SEQ ID NO: 7618 - RNA, 22 nt, Human
uccucucagaacaucagccuca

SEQ ID NO: 7619 - RNA, 26 nt, Human
ucucuagccacccccuuguccccagu

SEQ ID NO: 7620 - RNA, 26 nt, Human
ugcagccuguggauguccugcagccc

SEQ ID NO: 7621 - RNA, 23 nt, Human
uggagagaggacuguccugaggg

SEQ ID NO: 7622 - RNA, 22 nt, Human
guggguggacgugguuggugau

SEQ ID NO: 7623 - RNA, 23 nt, Human
uuacucugcacuauagccauuug

SEQ ID NO: 7624 - RNA, 28 nt, Human
uuacucugcacuauagccauuugcccca

SEQ ID NO: 7625 - RNA, 22 nt, Human
uuacaaguuucaguaauagcug

SEQ ID NO: 7626 - RNA, 27 nt, Human
uguggguggacgugguuggugauuggc

SEQ ID NO: 7627 - RNA, 21 nt, Human
gcauuacucugcacuauagcc

SEQ ID NO: 7628 - RNA, 21 nt, Human
aaccuguucaaaauguuaaua

SEQ ID NO: 7629 - RNA, 23 nt, Human
uguggguggacgugguuggugau

SEQ ID NO: 7630 - RNA, 25 nt, Human
auggcauucgcagugcccagugaug

SEQ ID NO: 7631 - RNA, 26 nt, Human
guggguggacgugguuggugauuggc

SEQ ID NO: 7632 - RNA, 26 nt, Human
uccacauucuacuucagcuuuggaug

SEQ ID NO: 7633 - RNA, 21 nt, Human
agguuugcaaagacugagugu

SEQ ID NO: 7634 - RNA, 21 nt, Human
cacauucuacuucagcuuugg

SEQ ID NO: 7635 - RNA, 25 nt, Human
ugcuucuagaugccuucucucucca

SEQ ID NO: 7636 - RNA, 20 nt, Human
uucucucuccaucuaccuuc

SEQ ID NO: 7637 - RNA, 22 nt, Human
uucuagaugccuucucucucca

SEQ ID NO: 7638 - RNA, 27 nt, Human
uucucucuccaucuaccuuccagucag

SEQ ID NO: 7639 - RNA, 17 nt, Human
gaugccuucucucucca

SEQ ID NO: 7640 - RNA, 20 nt, Human
gaugccuucucucuccaucu

SEQ ID NO: 7641 - RNA, 22 nt, Human
gugcaauuuguuugugcuucua

SEQ ID NO: 7642 - RNA, 23 nt, Human
gucucccaaaccaccuucccuca

SEQ ID NO: 7643 - RNA, 24 nt, Human
cucucuccaucuaccuuccaguca

SEQ ID NO: 7644 - RNA, 18 nt, Human
cuucccuuguccuucccu

SEQ ID NO: 7645 - RNA, 23 nt, Human
ccuccaucuaugcacagcuuucc

SEQ ID NO: 7646 - RNA, 24 nt, Human
cccuccaucuaugcacagcuuucc

SEQ ID NO: 7647 - RNA, 25 nt, Human
ggucuauaugcugggugcugagaca

SEQ ID NO: 7648 - RNA, 19 nt, Human
gcugggugcugagacacug

SEQ ID NO: 7649 - RNA, 20 nt, Human
ucagaaucugggacccaggg

SEQ ID NO: 7650 - RNA, 20 nt, Human
ggccccaucucuguucuguu

SEQ ID NO: 7651 - RNA, 22 nt, Human
uucagccccacuggucuuuuca

SEQ ID NO: 7652 - RNA, 19 nt, Human
agcuaaccucuucuggacc

SEQ ID NO: 7653 - RNA, 22 nt, Human
ugccauagagcuaacugggguc

SEQ ID NO: 7654 - RNA, 21 nt, Human
ucucuguucuguucccuccau

SEQ ID NO: 7655 - RNA, 27 nt, Human
ucucuguucuguucccuccaucuaugc

SEQ ID NO: 7656 - RNA, 24 nt, Human
ccccagcuaaccucuucuggacca

SEQ ID NO: 7657 - RNA, 21 nt, Human
auuugaugagcaaaugagcua

SEQ ID NO: 7658 - RNA, 22 nt, Human
uuucaugcucucuccugccuuc

SEQ ID NO: 7659 - RNA, 20 nt, Human
uuugaugagcaaaugagcua

SEQ ID NO: 7660 - RNA, 22 nt, Human
uucaugcucucuccugccuucc

SEQ ID NO: 7661 - RNA, 27 nt, Human
ucucuaauccuguaucuuucugacugu

SEQ ID NO: 7662 - RNA, 22 nt, Human
uccuccagggagacuagguuau

SEQ ID NO: 7663 - RNA, 27 nt, Human
uccuccagggagacuagguuauucucu

SEQ ID NO: 7664 - RNA, 22 nt, Human
agggagacuagguuauucucug

SEQ ID NO: 7665 - RNA, 22 nt, Human
aauccuguaucuuucugacugu

SEQ ID NO: 7666 - RNA, 20 nt, Human
aaucaucugcugcugugguu

SEQ ID NO: 7667 - RNA, 22 nt, Human
aaucaugcgaaaggggagcugu

SEQ ID NO: 7668 - RNA, 23 nt, Human
aauacagccacuaauugccuuac

SEQ ID NO: 7669 - RNA, 21 nt, Human
aauauucauacaacaaagagg

SEQ ID NO: 7670 - RNA, 20 nt, Human
acaaaacuuugaggcagcgc

SEQ ID NO: 7671 - RNA, 22 nt, Human
acaucacauggcauguuuuguc

SEQ ID NO: 7672 - RNA, 17 nt, Human
accaaauauaugccuua

SEQ ID NO: 7673 - RNA, 21 nt, Human
aaccuaacuugaaucaugcga

SEQ ID NO: 7674 - RNA, 27 nt, Human
agagauucugugccugcuuuaucugug

SEQ ID NO: 7675 - RNA, 20 nt, Human
acuagcaauggcaaagcuuu

SEQ ID NO: 7676 - RNA, 27 nt, Human
acugacacauagaguaacuucuaguuc

SEQ ID NO: 7677 - RNA, 32 nt, Human
agcaggacgaugauagggcuggagggcuaugg

SEQ ID NO: 7678 - RNA, 26 nt, Human
agccccaucacauuugugauacugac

SEQ ID NO: 7679 - RNA, 28 nt, Human
agcauauugagaaccucuucagugaccu

SEQ ID NO: 7680 - RNA, 25 nt, Human
agcuaaauaacuugccauuucuuua

SEQ ID NO: 7681 - RNA, 22 nt, Human
caaaagaaaauauagucacagg

SEQ ID NO: 7682 - RNA, 26 nt, Human
cagcagccaacuuauuggcaugaugg

SEQ ID NO: 7683 - RNA, 20 nt, Human
ucucaugcuauuucuaccuc

SEQ ID NO: 7684 - RNA, 23 nt, Human
ucauuuugauuuucucucucaca

SEQ ID NO: 7685 - RNA, 22 nt, Human
ucaugcagagaucccugauccu

SEQ ID NO: 7686 - RNA, 20 nt, Human
ucacguaaguaguaaugauu

SEQ ID NO: 7687 - RNA, 21 nt, Human
uaucuagucacuugcuuucua

SEQ ID NO: 7688 - RNA, 25 nt, Human
uaugggacuguuuacaaaugaguga

SEQ ID NO: 7689 - RNA, 22 nt, Human
ucuuuuuguuuuucuuuuagac

SEQ ID NO: 7690 - RNA, 22 nt, Human
ugaaaagagaaaaauaagcuga

SEQ ID NO: 7691 - RNA, 24 nt, Human
guguaagagaaaaguaccaacagg

SEQ ID NO: 7692 - RNA, 21 nt, Human
gucuagaauggauuuuucccg

SEQ ID NO: 7693 - RNA, 22 nt, Human
uaauauucauacaacaaagagg

SEQ ID NO: 7694 - RNA, 22 nt, Human
ccauccuuugcauuucucugcg

SEQ ID NO: 7695 - RNA, 21 nt, Human
caguguugggaucacucacuu

SEQ ID NO: 7696 - RNA, 25 nt, Human
cagccuauuuccuuaauguacguga

SEQ ID NO: 7697 - RNA, 18 nt, Human
uucagcuuccugcugcua

SEQ ID NO: 7698 - RNA, 20 nt, Human
uucucucucacaaucaguaa

SEQ ID NO: 7699 - RNA, 23 nt, Human
uugaacaaaaauugagagcuuua

SEQ ID NO: 7700 - RNA, 22 nt, Human
uucggagaaaaacgaauaggaa

SEQ ID NO: 7701 - RNA, 21 nt, Human
ugugcacaccugaguucacag

SEQ ID NO: 7702 - RNA, 22 nt, Human
uggugaguaaaagcugcagaua

SEQ ID NO: 7703 - RNA, 23 nt, Human
cagagauucugugccugcuuuau

SEQ ID NO: 7704 - RNA, 23 nt, Human
cagccugaccuagcuccuggacu

SEQ ID NO: 7705 - RNA, 18 nt, Human
caggugcaaaaagauugu

SEQ ID NO: 7706 - RNA, 23 nt, Human
caggugcaaaaagauuguguguu

SEQ ID NO: 7707 - RNA, 26 nt, Human
gacgcuggaccuuuucuuuacccaag

SEQ ID NO: 7708 - RNA, 23 nt, Human
gaaucaggagaaagaugcuguuu

SEQ ID NO: 7709 - RNA, 22 nt, Human
gaacgcauuuuggguuguuuaa

SEQ ID NO: 7710 - RNA, 27 nt, Human
cugcgaguaguuccacacagguuugua

SEQ ID NO: 7711 - RNA, 26 nt, Human
ucucacagucaaaaggaacugggugg

SEQ ID NO: 7712 - RNA, 23 nt, Human
ucugcugcugugguuaucuccua

SEQ ID NO: 7713 - RNA, 29 nt, Human
ucugugccugcuuuaucugugcuuggcua

SEQ ID NO: 7714 - RNA, 21 nt, Human
ucuucucacagucaaaaggaa

SEQ ID NO: 7715 - RNA, 22 nt, Human
ugaacaaaaauugagagcuuua

SEQ ID NO: 7716 - RNA, 28 nt, Human
ugaacaaugucaacaaggcacugcgggu

SEQ ID NO: 7717 - RNA, 21 nt, Human
ugauagggcuggagggcuaug

SEQ ID NO: 7718 - RNA, 25 nt, Human
ugacucuaccuccagguuuaccaua

SEQ ID NO: 7719 - RNA, 25 nt, Human
uggaagagauuuugucuaaagggca

SEQ ID NO: 7720 - RNA, 21 nt, Human
uggcaaagcuuugugcggagg

SEQ ID NO: 7721 - RNA, 26 nt, Human
uggagugacaggaaaaacagcuggca

SEQ ID NO: 7722 - RNA, 22 nt, Human
ugucauuguuuucagguacuga

SEQ ID NO: 7723 - RNA, 23 nt, Human
uggucagagauucugugccugcu

SEQ ID NO: 7724 - RNA, 21 nt, Human
uuacaagccuuauaagaaaua

SEQ ID NO: 7725 - RNA, 21 nt, Human
uuugguuuugggguguuccug

SEQ ID NO: 7726 - RNA, 24 nt, Human
uuguuugcuauuuauuuuucuccu

SEQ ID NO: 7727 - RNA, 21 nt, Human
uucucaugcuauuucuaccuc

SEQ ID NO: 7728 - RNA, 25 nt, Human
uuggguuguuuaaaaauuuauaaca

SEQ ID NO: 7729 - RNA, 21 nt, Human
uuggagccucuccuacucaga

SEQ ID NO: 7730 - RNA, 27 nt, Human
aucaguuggaaauuuauaaccaaccaa

SEQ ID NO: 7731 - RNA, 24 nt, Human
aguuuuacugcauuuucacaacau

SEQ ID NO: 7732 - RNA, 22 nt, Human
auaacuugccauuucuuuauau

SEQ ID NO: 7733 - RNA, 22 nt, Human
agucucuucuauuucuuucuuu

SEQ ID NO: 7734 - RNA, 22 nt, Human
aggcgccuccuagaccuccucg

SEQ ID NO: 7735 - RNA, 23 nt, Human
ggaucacucacuuucccccuaca

SEQ ID NO: 7736 - RNA, 22 nt, Human
gcucugaacuaaaagcauccgu

SEQ ID NO: 7737 - RNA, 18 nt, Human
gcggcucugggaagcuca

SEQ ID NO: 7738 - RNA, 26 nt, Human
gagauucugugccugcuuuaucugug

SEQ ID NO: 7739 - RNA, 23 nt, Human
aaagauaagacuuccucuaccac

SEQ ID NO: 7740 - RNA, 22 nt, Human
aauaaaucuauauuuuugugaa

SEQ ID NO: 7741 - RNA, 22 nt, Human
uauuugaacuccucucagcuga

SEQ ID NO: 7742 - RNA, 26 nt, Human
ucaguuggaaauuuauaaccaaccaa

SEQ ID NO: 7743 - RNA, 22 nt, Human
uauaauauucauacaacaaaga

SEQ ID NO: 7744 - RNA, 26 nt, Human
uaacuugccauuucuuuauauggaac

SEQ ID NO: 7745 - RNA, 23 nt, Human
guuuuacugcauuuucacaacau

SEQ ID NO: 7746 - RNA, 21 nt, Human
gcuuggcuaugacucuaccuc

SEQ ID NO: 7747 - RNA, 22 nt, Human
gggaggcaauuaccuucggaga

SEQ ID NO: 7748 - RNA, 26 nt, Human
gcauuuucacaacauaucagacuuca

SEQ ID NO: 7749 - RNA, 23 nt, Human
gcuauuuauuuuucuccuucaca

SEQ ID NO: 7750 - RNA, 24 nt, Human
gagccucuccuacucagacuguua

SEQ ID NO: 7751 - RNA, 22 nt, Human
gaucacucacuuucccccuaca

SEQ ID NO: 7752 - RNA, 24 nt, Human
gguuuugggguguuccugauaauu

SEQ ID NO: 7753 - RNA, 18 nt, Human
cucauuugagaacuguca

SEQ ID NO: 7754 - RNA, 23 nt, Human
cugaacacccuccuuucacuccc

SEQ ID NO: 7755 - RNA, 28 nt, Human
gcacagaccucucccacccacaagaacu

SEQ ID NO: 7756 - RNA, 29 nt, Human
gauccuaaucccuuccucucccauucacc

SEQ ID NO: 7757 - RNA, 20 nt, Human
gccuggccuguggcugcccu

SEQ ID NO: 7758 - RNA, 25 nt, Human
ggaggagguugugucacugacucag

SEQ ID NO: 7759 - RNA, 22 nt, Human
auccuaaucccuuccucuccca

SEQ ID NO: 7760 - RNA, 23 nt, Human
ugggaugaagaggguagaguggg

SEQ ID NO: 7761 - RNA, 23 nt, Human
gaagggcagggguguccugaugc

SEQ ID NO: 7762 - RNA, 20 nt, Human
ccagccuggccuguggcugc

SEQ ID NO: 7763 - RNA, 20 nt, Human
ugccuccccggaagugccuu

SEQ ID NO: 7764 - RNA, 26 nt, Human
uagagugcugugagaugagagugggu

SEQ ID NO: 7765 - RNA, 28 nt, Human
agacuuuggagaccagagacgcgccugg

SEQ ID NO: 7766 - RNA, 26 nt, Human
accuuaguuugcugccaucagucuag

SEQ ID NO: 7767 - RNA, 22 nt, Human
acccuguguaacaggaccccaa

SEQ ID NO: 7768 - RNA, 25 nt, Human
gacuccagacugaauuuuaauucaa

SEQ ID NO: 7769 - RNA, 22 nt, Human
uaucaaguaaaacaaacaaaua

SEQ ID NO: 7770 - RNA, 19 nt, Human
uauuaaaaagaaguuucua

SEQ ID NO: 7771 - RNA, 27 nt, Human
auacuauauuaacuuuuauuacgguga

SEQ ID NO: 7772 - RNA, 26 nt, Human
ccaccgacccuuccuggccuaauccu

SEQ ID NO: 7773 - RNA, 25 nt, Human
ccaaacccacccauaccagcuagaa

SEQ ID NO: 7774 - RNA, 23 nt, Human
ccagccggcugcaaguuuuguaa

SEQ ID NO: 7775 - RNA, 21 nt, Human
caucuccuccccuuucugccu

SEQ ID NO: 7776 - RNA, 22 nt, Human
ggggcugucucccaaugaaaga

SEQ ID NO: 7777 - RNA, 21 nt, Human
gucaggcaguucccagaaaga

SEQ ID NO: 7778 - RNA, 27 nt, Human
ucaugccagcuauaaucuccccugccu

SEQ ID NO: 7779 - RNA, 24 nt, Human
uccucccaaaggcuuucuuuccaa

SEQ ID NO: 7780 - RNA, 18 nt, Human
ucuaacaggcuggcaaug

SEQ ID NO: 7781 - RNA, 20 nt, Human
ucccacucccucucuugccg

SEQ ID NO: 7782 - RNA, 21 nt, Human
uggauuaaauguuaaagcuuu

SEQ ID NO: 7783 - RNA, 18 nt, Human
ugacccccuccuccagca

SEQ ID NO: 7784 - RNA, 22 nt, Human
ugacucaccuugcucugccauc

SEQ ID NO: 7785 - RNA, 17 nt, Human
acaacuuggggugggaa

SEQ ID NO: 7786 - RNA, 22 nt, Human
aacucagaucaaaaaugggcag

SEQ ID NO: 7787 - RNA, 26 nt, Human
acgggugcaugaaaccacuggaacau

SEQ ID NO: 7788 - RNA, 25 nt, Human
acauuaagaaauaaauucccccuca

SEQ ID NO: 7789 - RNA, 19 nt, Human
acgggugcaugaaaccacu

SEQ ID NO: 7790 - RNA, 22 nt, Human
acuccuugaguuuuccugcugc

SEQ ID NO: 7791 - RNA, 22 nt, Human
agcuauaaucuccccugccuuc

SEQ ID NO: 7792 - RNA, 21 nt, Human
agcaauagcauccaaggggcc

SEQ ID NO: 7793 - RNA, 23 nt, Human
aggguccacgcccauguaccuga

SEQ ID NO: 7794 - RNA, 21 nt, Human
agucccucagccacugaaguc

SEQ ID NO: 7795 - RNA, 21 nt, Human
aucaugccaccgacgggccac

SEQ ID NO: 7796 - RNA, 22 nt, Human
ugggacccccuguggcccucgc

SEQ ID NO: 7797 - RNA, 18 nt, Human
uucuaaacuccuuuccug

SEQ ID NO: 7798 - RNA, 27 nt, Human
uucuacccuguuuguugugucuugcua

SEQ ID NO: 7799 - RNA, 20 nt, Human
uugucccucaggcuuguugc

SEQ ID NO: 7800 - RNA, 21 nt, Human
aggcggaugcaggaaaucaug

SEQ ID NO: 7801 - RNA, 26 nt, Human
agugguuuccucggcccuccuggguu

SEQ ID NO: 7802 - RNA, 22 nt, Human
uugcuauacagaaaaaccacau

SEQ ID NO: 7803 - RNA, 21 nt, Human
uuuacagugggggcaccaaga

SEQ ID NO: 7804 - RNA, 29 nt, Human
agcuccuacuggacccucuugcccagccg

SEQ ID NO: 7805 - RNA, 20 nt, Human
ugcugcuucacccuugggga

SEQ ID NO: 7806 - RNA, 24 nt, Human
ugccacugcuuucauugaagaccc

SEQ ID NO: 7807 - RNA, 23 nt, Human
uccuccagcaauagcauccaagg

SEQ ID NO: 7808 - RNA, 19 nt, Human
uccugcucuccguguagcc

SEQ ID NO: 7809 - RNA, 24 nt, Human
gaaagagacaagaaauccuagugg

SEQ ID NO: 7810 - RNA, 20 nt, Human
cuccuaguagcuuuccuccc

SEQ ID NO: 7811 - RNA, 27 nt, Human
ccagcuccuaguagcuuuccucccaaa

SEQ ID NO: 7812 - RNA, 26 nt, Human
ccaauccuuuauagcuuuggagacgc

SEQ ID NO: 7813 - RNA, 28 nt, Human
ccaccagccaugagugggugacgcugag

SEQ ID NO: 7814 - RNA, 23 nt, Human
cccauuuccagcuccuaguagcu

SEQ ID NO: 7815 - RNA, 21 nt, Human
ccgguguccuguuccugccac

SEQ ID NO: 7816 - RNA, 21 nt, Human
ccaagaccccaaaggcccagg

SEQ ID NO: 7817 - RNA, 23 nt, Human
gccuggucaaccaucacuuccuu

SEQ ID NO: 7818 - RNA, 21 nt, Human
gccucucuugacgucugccug

SEQ ID NO: 7819 - RNA, 23 nt, Human
acaaaacucuguucccacucccu

SEQ ID NO: 7820 - RNA, 28 nt, Human
aaagacagagagggcugaagccuuguca

SEQ ID NO: 7821 - RNA, 20 nt, Human
ucaugccaccgacgggccac

SEQ ID NO: 7822 - RNA, 19 nt, Human
uaaagaggaagugcacugg

SEQ ID NO: 7823 - RNA, 25 nt, Human
gaugccucagaucugauccgcaucu

SEQ ID NO: 7824 - RNA, 21 nt, Human
gcaccaagaccccaaaggccc

SEQ ID NO: 7825 - RNA, 22 nt, Human
gcuauaaucuccccugccuucc

SEQ ID NO: 7826 - RNA, 22 nt, Human
ggaaagggaauguucugcuggu

SEQ ID NO: 7827 - RNA, 25 nt, Human
guccccaaggauggaaagggaaugu

SEQ ID NO: 7828 - RNA, 25 nt, Human
gugguuuccucggcccuccuggguu

SEQ ID NO: 7829 - RNA, 26 nt, Human
guucaguuugggugucugcuaaagag

SEQ ID NO: 7830 - RNA, 27 nt, Human
cugaagccuggauccuccuggugaaau

SEQ ID NO: 7831 - RNA, 21 nt, Human
cuccuugaguuuuccugcugc

SEQ ID NO: 7832 - RNA, 23 nt, Human
cugcucacucuuccacagauaua

SEQ ID NO: 7833 - RNA, 23 nt, Human
cgggcuucucgccccucaguggu

SEQ ID NO: 7834 - RNA, 25 nt, Human
cgccucucuugacgucugccugguc

SEQ ID NO: 7835 - RNA, 27 nt, Human
ccucggcccuccuggguuuacuccuug

SEQ ID NO: 7836 - RNA, 27 nt, Human
ccccucggaagcuaguuaccauggagg

SEQ ID NO: 7837 - RNA, 20 nt, Human
ccuccccuuuguucuucuau

SEQ ID NO: 7838 - RNA, 21 nt, Human
cguucaccuccaagcauuuca

SEQ ID NO: 7839 - RNA, 25 nt, Human
cugccgccugccugccugccacuga

SEQ ID NO: 7840 - RNA, 20 nt, Human
gguuugccugaggcuguaac

SEQ ID NO: 7841 - RNA, 21 nt, Human
ggucggaucucacaggcugag

SEQ ID NO: 7842 - RNA, 27 nt, Human
ggcuucuccuccucugucuuuuggaga

SEQ ID NO: 7843 - RNA, 21 nt, Human
ggaggugggcaaagggaagua

SEQ ID NO: 7844 - RNA, 19 nt, Human
aacugagagaaagauucug

SEQ ID NO: 7845 - RNA, 26 nt, Human
gcagcuucaacuuuucucuuuagugu

SEQ ID NO: 7846 - RNA, 22 nt, Human
cggacugucaguucucugggaa

SEQ ID NO: 7847 - RNA, 25 nt, Human
ccuuuuccacacgcauuaauagucc

SEQ ID NO: 7848 - RNA, 26 nt, Human
ucucuugccauuuguagcuuugccca

SEQ ID NO: 7849 - RNA, 24 nt, Human
ucugccugccgccugccugccugc

SEQ ID NO: 7850 - RNA, 20 nt, Human
uuaaggccuuuuccacacgc

SEQ ID NO: 7851 - RNA, 20 nt, Human
uuaacggugcuaaaaaugaa

SEQ ID NO: 7852 - RNA, 22 nt, Human
uugcagcuucaacuuuucucuu

SEQ ID NO: 7853 - RNA, 27 nt, Human
uucuccuccucugucuuuuggagaacc

SEQ ID NO: 7854 - RNA, 22 nt, Human
uucaucaccauuuccuccuuua

SEQ ID NO: 7855 - RNA, 21 nt, Human
aguguucuguuugaaacuaau

SEQ ID NO: 7856 - RNA, 23 nt, Human
augacauucuuagcuguaacuua

SEQ ID NO: 7857 - RNA, 26 nt, Human
uuuguuguucugccuggagacaaggu

SEQ ID NO: 7858 - RNA, 17 nt, Human
uuaccuuucagugcagu

SEQ ID NO: 7859 - RNA, 23 nt, Human
uuaccuuucagugcaguuucuuu

SEQ ID NO: 7860 - RNA, 26 nt, Human
uucaaacuuuugggagcacggacugu

SEQ ID NO: 7861 - RNA, 21 nt, Human
auuaaggccuuuuccacacgc

SEQ ID NO: 7862 - RNA, 27 nt, Human
aggguucccagcaccaugagggccugg

SEQ ID NO: 7863 - RNA, 26 nt, Human
agagaaacuucaaaguuaaugggaug

SEQ ID NO: 7864 - RNA, 21 nt, Human
acccaagacaugacauucuua

SEQ ID NO: 7865 - RNA, 22 nt, Human
uggaugguuuguuguucugccu

SEQ ID NO: 7866 - RNA, 24 nt, Human
ugccugccacugaggguucccagc

SEQ ID NO: 7867 - RNA, 27 nt, Human
uccugcagggcuucuccuccucugucu

SEQ ID NO: 7868 - RNA, 27 nt, Human
ucacauuaggcuguugguucaaacuuu

SEQ ID NO: 7869 - RNA, 23 nt, Human
gguuuguuguucugccuggagac

SEQ ID NO: 7870 - RNA, 18 nt, Human
gggucuuggcugccugug

SEQ ID NO: 7871 - RNA, 19 nt, Human
gucccauuuuucucuugcc

SEQ ID NO: 7872 - RNA, 25 nt, Human
guucaucaccauuuccuccuuuacc

SEQ ID NO: 7873 - RNA, 23 nt, Human
cauggguggacacggaucugcug

SEQ ID NO: 7874 - RNA, 26 nt, Human
cccaagacaugacauucuuagcugua

SEQ ID NO: 7875 - RNA, 19 nt, Human
gguggcuuucaaagggguc

SEQ ID NO: 7876 - RNA, 19 nt, Human
ugcacucuggcuggggaag

SEQ ID NO: 7877 - RNA, 26 nt, Human
acucagucuaaacaauaaauauuuca

SEQ ID NO: 7878 - RNA, 21 nt, Human
agcugcacucuggcuggggaa

SEQ ID NO: 7879 - RNA, 25 nt, Human
caaugagagcugcacucuggcuggg

SEQ ID NO: 7880 - RNA, 26 nt, Human
aggaggaacggaagaaaccuauugug

SEQ ID NO: 7881 - RNA, 26 nt, Human
gccugacagaacucaaagacacgucu

SEQ ID NO: 7882 - RNA, 19 nt, Human
gcugcacucuggcugggga

SEQ ID NO: 7883 - RNA, 26 nt, Human
gcugcacucuggcuggggaaggcaug

SEQ ID NO: 7884 - RNA, 18 nt, Human
ggaacggaagaaaccuau

SEQ ID NO: 7885 - RNA, 20 nt, Human
gcugcacucuggcuggggaa

SEQ ID NO: 7886 - RNA, 27 nt, Human
ucauaauuuacaaaggaggaacggaag

SEQ ID NO: 7887 - RNA, 19 nt, Human
guuccauuucucucauuca

SEQ ID NO: 7888 - RNA, 26 nt, Human
guggaaauaaagagaacugagaugga

SEQ ID NO: 7889 - RNA, 21 nt, Human
cuucccuugaacuuugaaccu

SEQ ID NO: 7890 - RNA, 25 nt, Human
cuucuuuggaaaccaucacuauuga

SEQ ID NO: 7891 - RNA, 21 nt, Human
gcaaaguugcaguuuguucuu

SEQ ID NO: 7892 - RNA, 21 nt, Human
uucccuugaacuuugaaccug

SEQ ID NO: 7893 - RNA, 20 nt, Human
uuugucaauaaacugccuuu

SEQ ID NO: 7894 - RNA, 22 nt, Human
ugagagaugggaaaaaccugaa

SEQ ID NO: 7895 - RNA, 25 nt, Human
cgcuggguugcuccuucuucgggag

SEQ ID NO: 7896 - RNA, 20 nt, Human
ccuguacuguguucuucaca

SEQ ID NO: 7897 - RNA, 26 nt, Human
cuccuucuucgggagcgagcuguucu

SEQ ID NO: 7898 - RNA, 24 nt, Human
cuggacagcuacggcgccgaaaga

SEQ ID NO: 7899 - RNA, 25 nt, Human
caggaugucgacagcuguggcuucc

SEQ ID NO: 7900 - RNA, 25 nt, Human
ccaguuccauuucucucauucacaa

SEQ ID NO: 7901 - RNA, 14 nt, Human
caagaguguggaaa

SEQ ID NO: 7902 - RNA, 31 nt, Human
accuguacuguguucuucacagacccuuugu

SEQ ID NO: 7903 - RNA, 24 nt, Human
acugaguuucuucuuuggaaacca

SEQ ID NO: 7904 - RNA, 23 nt, Human
uggacagcuacggcgccgaaaga

SEQ ID NO: 7905 - RNA, 21 nt, Human
uauguauucuucacuacugag

SEQ ID NO: 7906 - RNA, 23 nt, Human
ucaacugaucaaacuaaugcaaa

SEQ ID NO: 7907 - RNA, 27 nt, Human
ucgacagcuguggcuuccuuguuuuug

SEQ ID NO: 7908 - RNA, 20 nt, Human
ccaguuccauuucucucauu

SEQ ID NO: 7909 - RNA, 24 nt, Human
ggcucacugcagccucgaacuccu

SEQ ID NO: 7910 - RNA, 27 nt, Human
ucucuacccagcccaucuugccuccau

SEQ ID NO: 7911 - RNA, 19 nt, Human
ucccaagcuggagugcagu

SEQ ID NO: 7912 - RNA, 25 nt, Human
ucccaagcuggagugcaguggugcg

SEQ ID NO: 7913 - RNA, 22 nt, Human
uauuucccaagcuggagugcag

SEQ ID NO: 7914 - RNA, 22 nt, Human
ucacugcagccucgaacuccug

SEQ ID NO: 7915 - RNA, 22 nt, Human
ugccuccauggugccucuggag

SEQ ID NO: 7916 - RNA, 18 nt, Human
acuccaggaaggggcugg

SEQ ID NO: 7917 - RNA, 22 nt, Human
acugcagccucgaacuccuggg

SEQ ID NO: 7918 - RNA, 21 nt, Human
aacuccugggcucaagcaauc

SEQ ID NO: 7919 - RNA, 23 nt, Human
auuucccaagcuggagugcagug

SEQ ID NO: 7920 - RNA, 21 nt, Human
aggcaccauucaggaaccugg

SEQ ID NO: 7921 - RNA, 21 nt, Human
uucccaagcuggagugcagug

SEQ ID NO: 7922 - RNA, 22 nt, Human
uucccaagcuggagugcagugg

SEQ ID NO: 7923 - RNA, 27 nt, Human
ccauucaggaaccuggaccaaagcuga

SEQ ID NO: 7924 - RNA, 19 nt, Human
cccaagcuggagugcagug

SEQ ID NO: 7925 - RNA, 23 nt, Human
ccacagccagaaccccgagcccu

SEQ ID NO: 7926 - RNA, 27 nt, Human
ccuccauggugccucuggaggccucug

SEQ ID NO: 7927 - RNA, 17 nt, Human
ccaagcuggagugcagu

SEQ ID NO: 7928 - RNA, 26 nt, Human
cagagcugggugaguggggagacacc

SEQ ID NO: 7929 - RNA, 19 nt, Human
cacuccaggaaggggcugg

SEQ ID NO: 7930 - RNA, 22 nt, Human
caagcuggagugcaguggugcg

SEQ ID NO: 7931 - RNA, 20 nt, Human
cacaaggugggcagggaggc

SEQ ID NO: 7932 - RNA, 22 nt, Human
cuuuguuuuuagagacaggguc

SEQ ID NO: 7933 - RNA, 22 nt, Human
gaacuccugggcucaagcaauc

SEQ ID NO: 7934 - RNA, 22 nt, Human
cucagccccagcccagcccagc

SEQ ID NO: 7935 - RNA, 22 nt, Human
cgaacuccugggcucaagcaau

SEQ ID NO: 7936 - RNA, 20 nt, Human
ucccaagcuggagugcagug

SEQ ID NO: 7937 - RNA, 21 nt, Human
ucccaagcuggagugcagugg

SEQ ID NO: 7938 - RNA, 22 nt, Human
ucccaagcuggagugcaguggu

SEQ ID NO: 7939 - RNA, 22 nt, Human
uguuuuuagagacaggguccug

SEQ ID NO: 7940 - RNA, 25 nt, Human
uggggagaucggggccagaggcaga

SEQ ID NO: 7941 - RNA, 21 nt, Human
uuucccaagcuggagugcagu

SEQ ID NO: 7942 - RNA, 22 nt, Human
uuucccaagcuggagugcagug

SEQ ID NO: 7943 - RNA, 20 nt, Human
uucccaagcuggagugcagu

SEQ ID NO: 7944 - RNA, 20 nt, Human
agcuggagugcaguggugcg

SEQ ID NO: 7945 - RNA, 21 nt, Human
auuucccaagcuggagugcag

SEQ ID NO: 7946 - RNA, 22 nt, Human
auuucccaagcuggagugcagu

SEQ ID NO: 7947 - RNA, 27 nt, Human
gccucgaacuccugggcucaagcaauc

SEQ ID NO: 7948 - RNA, 18 nt, Human
gcccucuguucaguaaca

SEQ ID NO: 7949 - RNA, 27 nt, Human
gccucacuccaggaaggggcuggacug

SEQ ID NO: 7950 - RNA, 26 nt, Human
gcagccgccacauccccgcuggcugg

SEQ ID NO: 7951 - RNA, 21 nt, Human
gcccaaccucagcaaccugua

SEQ ID NO: 7952 - RNA, 27 nt, Human
ggagacaccucagagccccgcaaaacc

SEQ ID NO: 7953 - RNA, 22 nt, Human
gcucacugcagccucgaacucc

SEQ ID NO: 7954 - RNA, 25 nt, Human
gcuauuucccaagcuggagugcagu

SEQ ID NO: 7955 - RNA, 23 nt, Human
aagcuggagugcaguggugcgau

SEQ ID NO: 7956 - RNA, 21 nt, Human
cuuaccucccaccuuuggucc

SEQ ID NO: 7957 - RNA, 27 nt, Human
cuuaccucccaccuuugguccuaaguc

SEQ ID NO: 7958 - RNA, 27 nt, Human
cugcuauuucccaagcuggagugcagu

SEQ ID NO: 7959 - RNA, 22 nt, Human
cugcagccucgaacuccugggc

SEQ ID NO: 7960 - RNA, 24 nt, Human
cuaaugcucacgcucccaacacaa

SEQ ID NO: 7961 - RNA, 23 nt, Human
cgccacauccccgcuggcugggg

SEQ ID NO: 7962 - RNA, 21 nt, Human
guggauggggagaucggggcc

SEQ ID NO: 7963 - RNA, 23 nt, Human
gucccugcccccuccccuucaca

SEQ ID NO: 7964 - RNA, 25 nt, Human
gcucucuacccagcccaucuugccu

SEQ ID NO: 7965 - RNA, 23 nt, Human
gcucagccccagcccagcccagc

SEQ ID NO: 7966 - RNA, 20 nt, Human
ggagacaccucagagccccg

SEQ ID NO: 7967 - RNA, 23 nt, Human
ggcgacgguggcgccccuccuca

SEQ ID NO: 7968 - RNA, 26 nt, Human
gggaaggggagagggaaacgugcccu

SEQ ID NO: 7969 - RNA, 25 nt, Human
gggaggcaccauucaggaaccugga

SEQ ID NO: 7970 - RNA, 22 nt, Human
ggcucacugcagccucgaacuc

SEQ ID NO: 7971 - RNA, 22 nt, Human
gcgaucauggcucacugcagcc

SEQ ID NO: 7972 - RNA, 19 nt, Human
ucauggcucacugcagccu

SEQ ID NO: 7973 - RNA, 23 nt, Human
gacuugacagaacacugucuuga

SEQ ID NO: 7974 - RNA, 23 nt, Human
gggaauggcacagcccaaagaag

SEQ ID NO: 7975 - RNA, 23 nt, Human
gcuggugguaucugaguugacuu

SEQ ID NO: 7976 - RNA, 22 nt, Human
gcugggauguuucugucacauc

SEQ ID NO: 7977 - RNA, 22 nt, Human
cuugggucccagggaaguuuug

SEQ ID NO: 7978 - RNA, 27 nt, Human
cuugacagaacacugucuugaagacaa

SEQ ID NO: 7979 - RNA, 27 nt, Human
gauuacaucaaggcuucaaaaauacuc

SEQ ID NO: 7980 - RNA, 21 nt, Human
auugcguggaauugugcugag

SEQ ID NO: 7981 - RNA, 21 nt, Human
uguggguucaaacacauuuca

SEQ ID NO: 7982 - RNA, 22 nt, Human
cgagggagaagacuauauugua

SEQ ID NO: 7983 - RNA, 21 nt, Human
cacagcccaaagaaggaaaag

SEQ ID NO: 7984 - RNA, 27 nt, Human
uguuuuuaacucaauauuuuccaugaa

SEQ ID NO: 7985 - RNA, 21 nt, Human
uuugcaaggaagccacagcug

SEQ ID NO: 7986 - RNA, 23 nt, Human
acagaagaaggcagcagguggca

SEQ ID NO: 7987 - RNA, 23 nt, Human
acauguguaauacauaucuggga

SEQ ID NO: 7988 - RNA, 27 nt, Human
ucuacuuccugaagaccugaacaccgc

SEQ ID NO: 7989 - RNA, 23 nt, Human
cagguggcagaauggggugcaug

SEQ ID NO: 7990 - RNA, 20 nt, Human
guggguucaaacacauuuca

SEQ ID NO: 7991 - RNA, 26 nt, Human
uggaagggaaggugcaucgccaucua

SEQ ID NO: 7992 - RNA, 22 nt, Human
aauuccucaguaaccuccaucu

SEQ ID NO: 7993 - RNA, 23 nt, Human
auuuaucauaucccuuuucuccu

SEQ ID NO: 7994 - RNA, 27 nt, Human
cucuggcccgauuuaucauaucccuuu

SEQ ID NO: 7995 - RNA, 24 nt, Human
cuccaucuaaaaucuccaaggaag

SEQ ID NO: 7996 - RNA, 27 nt, Human
cuccaucuaaaaucuccaaggaagcaa

SEQ ID NO: 7997 - RNA, 27 nt, Human
uacaugccugggguaagccacccggcu

SEQ ID NO: 7998 - RNA, 27 nt, Human
cuucugcuuuaaugacuuuacaaagcu

SEQ ID NO: 7999 - RNA, 27 nt, Human
cuggcaauauuacaauccuugaccuca

SEQ ID NO: 8000 - RNA, 23 nt, Human
gcagucaucuucagcguuuucca

SEQ ID NO: 8001 - RNA, 31 nt, Human
cgagcucuacugacucccaaaagagcgccca

SEQ ID NO: 8002 - RNA, 21 nt, Human
auucuugucuguucugccuca

SEQ ID NO: 8003 - RNA, 20 nt, Human
ccccauggggcucucuugug

SEQ ID NO: 8004 - RNA, 24 nt, Human
ugguuaugccuccucgauugcucc

SEQ ID NO: 8005 - RNA, 21 nt, Human
auuguuuaagguuuccucaaa

SEQ ID NO: 8006 - RNA, 21 nt, Human
uucuugucuguucugccucac

SEQ ID NO: 8007 - RNA, 24 nt, Human
gcuggcuuucccugucuauugccu

SEQ ID NO: 8008 - RNA, 23 nt, Human
aacuucugcuuuaaugacuuuac

SEQ ID NO: 8009 - RNA, 24 nt, Human
auuuuucugaacacaauaaacuau

SEQ ID NO: 8010 - RNA, 24 nt, Human
uccuugaccucagugaaagcaguc

SEQ ID NO: 8011 - RNA, 23 nt, Human
ucuacuuccugucugcaugccca

SEQ ID NO: 8012 - RNA, 24 nt, Human
ucacccugggaaucacaguggucu

SEQ ID NO: 8013 - RNA, 23 nt, Human
uacuaccucuucuuucuguaggg

SEQ ID NO: 8014 - RNA, 24 nt, Human
ucuuuaaugggccagcauucucau

SEQ ID NO: 8015 - RNA, 26 nt, Human
uacaucuucugcugguguuuuguuca

SEQ ID NO: 8016 - RNA, 26 nt, Human
gguccccaucagccuggagcagcccu

SEQ ID NO: 8017 - RNA, 24 nt, Human
cauguguaaugcuggauguguaca

SEQ ID NO: 8018 - RNA, 25 nt, Human
ccaguuuuaagaggagccacuuauc

SEQ ID NO: 8019 - RNA, 22 nt, Human
cacccaggcaugaagcacguug

SEQ ID NO: 8020 - RNA, 27 nt, Human
augcauacuuauauuaucuuaagcaug

SEQ ID NO: 8021 - RNA, 26 nt, Human
aucacaguggucuaccugcauucaua

SEQ ID NO: 8022 - RNA, 22 nt, Human
agcagcccuccagaccugggug

SEQ ID NO: 8023 - RNA, 22 nt, Human
agcccuccagaccuggguggaa

SEQ ID NO: 8024 - RNA, 23 nt, Human
acacauuuacaagaaaaauguuu

SEQ ID NO: 8025 - RNA, 26 nt, Human
aacuguacauuaguacauacucagua

SEQ ID NO: 8026 - RNA, 25 nt, Human
agaaggcaaagaauaaacauuugau

SEQ ID NO: 8027 - RNA, 21 nt, Human
uguucuguuuucagcugacuu

SEQ ID NO: 8028 - RNA, 22 nt, Human
aaccagcuuuggagaaagccca

SEQ ID NO: 8029 - RNA, 20 nt, Human
gcuugacagcccaacagcca

SEQ ID NO: 8030 - RNA, 26 nt, Human
uucauuuagccugaaagcugcaguua

SEQ ID NO: 8031 - RNA, 22 nt, Human
agccuggagcagcccuccagac

SEQ ID NO: 8032 - RNA, 22 nt, Human
augcauacuuauauuaucuuaa

SEQ ID NO: 8033 - RNA, 27 nt, Human
ucuacuuccugucugcaugcccaaggc

SEQ ID NO: 8034 - RNA, 21 nt, Human
ucuggcacccaggcaugaagc

SEQ ID NO: 8035 - RNA, 24 nt, Human
auugcaaacaaaaucaucuuuaau

SEQ ID NO: 8036 - RNA, 23 nt, Human
cacccaggcaugaagcacguugg

SEQ ID NO: 8037 - RNA, 22 nt, Human
cuauacccauggugccucuggg

SEQ ID NO: 8038 - RNA, 24 nt, Human
gaaagcugcaguuacuauagguug

SEQ ID NO: 8039 - RNA, 27 nt, Human
cuuuccucugcugcucaauaguuuuau

SEQ ID NO: 8040 - RNA, 22 nt, Human
gcagcccuccagaccugggugg

SEQ ID NO: 8041 - RNA, 21 nt, Human
gguguuuuguucaaucuggaa

SEQ ID NO: 8042 - RNA, 25 nt, Human
cuucugcugguguuuuguucaaucu

SEQ ID NO: 8043 - RNA, 21 nt, Human
cuuuccucugcugcucaauag

SEQ ID NO: 8044 - RNA, 25 nt, Human
cuaguaugguguucuguuuucagcu

SEQ ID NO: 8045 - RNA, 26 nt, Human
ccuggagcagcccuccagaccugggu

SEQ ID NO: 8046 - RNA, 19 nt, Human
uaugcauacauauauacac

SEQ ID NO: 8047 - RNA, 19 nt, Human
guuguccaagcugugccuc

SEQ ID NO: 8048 - RNA, 17 nt, Human
gaagggaaaauauccau

SEQ ID NO: 8049 - RNA, 26 nt, Human
agcaucugagcuaacuuauauuuauu

SEQ ID NO: 8050 - RNA, 27 nt, Human
uuuugggccgagcuggaggcggcgggg

SEQ ID NO: 8051 - RNA, 21 nt, Human
uucauucacuuuaauagaagg

SEQ ID NO: 8052 - RNA, 22 nt, Human
aagcaagagaccagagucccgg

SEQ ID NO: 8053 - RNA, 22 nt, Human
acacaggaggaugacacagaaa

SEQ ID NO: 8054 - RNA, 27 nt, Human
acaaucagcuaauuuauguauagauuu

SEQ ID NO: 8055 - RNA, 22 nt, Human
acucuccguccugcccagagca

SEQ ID NO: 8056 - RNA, 25 nt, Human
auauuaagcaaaauguuuaaagaca

SEQ ID NO: 8057 - RNA, 21 nt, Human
auggugagccgugauugugcc

SEQ ID NO: 8058 - RNA, 23 nt, Human
auugugccacugcauaccagccu

SEQ ID NO: 8059 - RNA, 22 nt, Human
cacugcauaccagccuagguga

SEQ ID NO: 8060 - RNA, 23 nt, Human
ucuggaaucccuuucucauuagc

SEQ ID NO: 8061 - RNA, 24 nt, Human
ugaccagccugggaaacauaacaa

SEQ ID NO: 8062 - RNA, 21 nt, Human
uggaugggaacgcaagagaua

SEQ ID NO: 8063 - RNA, 20 nt, Human
ugcccugcaguuaguucuga

SEQ ID NO: 8064 - RNA, 22 nt, Human
uaugugcgcucuguaaagugau

SEQ ID NO: 8065 - RNA, 21 nt, Human
augugcgcucuguaaagugau

SEQ ID NO: 8066 - RNA, 22 nt, Human
aggaugaggcaggaggaucucu

SEQ ID NO: 8067 - RNA, 23 nt, Human
ucuaagcaaguuuaaucuuugga

SEQ ID NO: 8068 - RNA, 27 nt, Human
gaccagccugggaaacauaacaagacc

SEQ ID NO: 8069 - RNA, 22 nt, Human
caggaggucaaggcuaugguga

SEQ ID NO: 8070 - RNA, 23 nt, Human
ccaccucucuaaaagacacagga

SEQ ID NO: 8071 - RNA, 22 nt, Human
ccacugcauaccagccuaggug

SEQ ID NO: 8072 - RNA, 22 nt, Human
ccaggaggucaaggcuauggug

SEQ ID NO: 8073 - RNA, 23 nt, Human
ggaugaaaauuuggaggaaaagu

SEQ ID NO: 8074 - RNA, 22 nt, Human
gagcccaggaggucaaggcuau

SEQ ID NO: 8075 - RNA, 21 nt, Human
gccacugcauaccagccuagg

SEQ ID NO: 8076 - RNA, 21 nt, Human
gccugggaaacauaacaagac

SEQ ID NO: 8077 - RNA, 24 nt, Human
cuaaaugcucauugaaacaaucag

SEQ ID NO: 8078 - RNA, 23 nt, Human
gcagguggcuucuuaacagcccu

SEQ ID NO: 8079 - RNA, 22 nt, Human
gagaagcagacagaugcaaaga

SEQ ID NO: 8080 - RNA, 27 nt, Human
gaucagucccuauuaugcaaaauguga

SEQ ID NO: 8081 - RNA, 24 nt, Human
uauuaagcaaaauguuuaaagaca

SEQ ID NO: 8082 - RNA, 23 nt, Human
uaaaugcucauugaaacaaucag

SEQ ID NO: 8083 - RNA, 23 nt, Human
uaacugcauaaguaaugacuuuc

SEQ ID NO: 8084 - RNA, 27 nt, Human
gccacugccucuuccucccucauucca

SEQ ID NO: 8085 - RNA, 21 nt, Human
gccucuuccucccucauucca

SEQ ID NO: 8086 - RNA, 20 nt, Human
gugccucugccugucucccc

SEQ ID NO: 8087 - RNA, 27 nt, Human
cuccacuccagauuuuuuacagcugcc

SEQ ID NO: 8088 - RNA, 22 nt, Human
cucaggucccugcagggccaag

SEQ ID NO: 8089 - RNA, 24 nt, Human
ccuacuuccugugacuucagcucu

SEQ ID NO: 8090 - RNA, 20 nt, Human
gaccaccugcccaaccugcu

SEQ ID NO: 8091 - RNA, 29 nt, Human
gcccaaccugcucuccucuugccacugcc

SEQ ID NO: 8092 - RNA, 19 nt, Human
gccauugagggguggaccc

SEQ ID NO: 8093 - RNA, 20 nt, Human
gcagagcaggaaacaugacu

SEQ ID NO: 8094 - RNA, 21 nt, Human
gcuguauauguugggugcaaa

SEQ ID NO: 8095 - RNA, 23 nt, Human
gcucuccucuugccacugccucu

SEQ ID NO: 8096 - RNA, 21 nt, Human
gccugucucccccaccgggcu

SEQ ID NO: 8097 - RNA, 27 nt, Human
ccaggcacugcugcccagccuccaagc

SEQ ID NO: 8098 - RNA, 27 nt, Human
ccuacuuccugugacuucagcucuguu

SEQ ID NO: 8099 - RNA, 21 nt, Human
cacccuguuuuacaaaaaaga

SEQ ID NO: 8100 - RNA, 25 nt, Human
cuuccucccucauuccaccuuccca

SEQ ID NO: 8101 - RNA, 23 nt, Human
cugccccagggcucccggcuaug

SEQ ID NO: 8102 - RNA, 21 nt, Human
cucagcucccaaggcucugag

SEQ ID NO: 8103 - RNA, 18 nt, Human
cuccccauggcuuuagcu

SEQ ID NO: 8104 - RNA, 23 nt, Human
ccugcucuccucuugccacugcc

SEQ ID NO: 8105 - RNA, 26 nt, Human
ccugccuguucccauucuugcauggc

SEQ ID NO: 8106 - RNA, 19 nt, Human
ugugccucugccugucucc

SEQ ID NO: 8107 - RNA, 23 nt, Human
ugggcagcagcucaguugaguua

SEQ ID NO: 8108 - RNA, 23 nt, Human
ugccuccagaauggucuuucuaa

SEQ ID NO: 8109 - RNA, 20 nt, Human
aggcugaggacuuaaaauau

SEQ ID NO: 8110 - RNA, 22 nt, Human
aggcugaggacuuaaaauauuc

SEQ ID NO: 8111 - RNA, 22 nt, Human
agggggauuauaaaacuaauca

SEQ ID NO: 8112 - RNA, 27 nt, Human
ucugccuccucuucaacugaccagccu

SEQ ID NO: 8113 - RNA, 20 nt, Human
ggccugccuguucccauucu

SEQ ID NO: 8114 - RNA, 21 nt, Human
caucuccacuccagauuuuuu

SEQ ID NO: 8115 - RNA, 27 nt, Human
uaacugcauaaguaaugacuuucagug

SEQ ID NO: 8116 - RNA, 22 nt, Human
guucuuucuuccucugcugaag

SEQ ID NO: 8117 - RNA, 18 nt, Human
gugccucugccugucucc

SEQ ID NO: 8118 - RNA, 28 nt, Human
caaggcucugagcaaauguggcuccugg

SEQ ID NO: 8119 - RNA, 22 nt, Human
acuccucuguccaggcacugcu

SEQ ID NO: 8120 - RNA, 31 nt, Human
acucguauaugucucaggucccugcagggcc

SEQ ID NO: 8121 - RNA, 23 nt, Human
acuccagauuuuuuacagcugcc

SEQ ID NO: 8122 - RNA, 25 nt, Human
acugcccaggccugccuguucccau

SEQ ID NO: 8123 - RNA, 24 nt, Human
accugcucuccucuugccacugcc

SEQ ID NO: 8124 - RNA, 20 nt, Human
acugcccaggccugccuguu

SEQ ID NO: 8125 - RNA, 25 nt, Human
acugccucuuccucccucauuccac

SEQ ID NO: 8126 - RNA, 21 nt, Human
caagucacagugcuuccuuaa

SEQ ID NO: 8127 - RNA, 21 nt, Human
auguacacugguuugagcuua

SEQ ID NO: 8128 - RNA, 22 nt, Human
agaggaaguguggggaggaagg

SEQ ID NO: 8129 - RNA, 32 nt, Human
aggaaggaaguggguauagaagggugcugaga

SEQ ID NO: 8130 - RNA, 25 nt, Human
uuaggacuucuuucaaauugagaga

SEQ ID NO: 8131 - RNA, 21 nt, Human
uuugggccacgccgggcuggg

SEQ ID NO: 8132 - RNA, 22 nt, Human
uguuuuuaaucuguggcucuug

SEQ ID NO: 8133 - RNA, 27 nt, Human
ccugcagccgcgcguaggcagagacgg

SEQ ID NO: 8134 - RNA, 28 nt, Human
cugcuagccugcucacgcaugcagcccg

SEQ ID NO: 8135 - RNA, 20 nt, Human
cuucuuucaaauugagagaa

SEQ ID NO: 8136 - RNA, 21 nt, Human
cucagcuuuuaaauggguaga

SEQ ID NO: 8137 - RNA, 21 nt, Human
ccccacugggugggcagaggu

SEQ ID NO: 8138 - RNA, 24 nt, Human
gggguaguggccgcuuaguguuga

SEQ ID NO: 8139 - RNA, 21 nt, Human
gccgacuuccccuccucuucc

SEQ ID NO: 8140 - RNA, 28 nt, Human
gccgggcugggcggcucacagcgagggg

SEQ ID NO: 8141 - RNA, 24 nt, Human
gcugcuagccugcucacgcaugca

SEQ ID NO: 8142 - RNA, 24 nt, Human
ggaaguguggggaggaaggaagug

SEQ ID NO: 8143 - RNA, 25 nt, Human
ggagcccggcccugcgccuccgcac

SEQ ID NO: 8144 - RNA, 21 nt, Human
uacaucuuugauacuuguuca

SEQ ID NO: 8145 - RNA, 21 nt, Human
ggaggcacacagcugcagaga

SEQ ID NO: 8146 - RNA, 22 nt, Human
ccuguccuucucucaccuccua

SEQ ID NO: 8147 - RNA, 22 nt, Human
ugugugaagaucacguuccuuc

SEQ ID NO: 8148 - RNA, 24 nt, Human
cacagcugcagagacagagaggac

SEQ ID NO: 8149 - RNA, 21 nt, Human
gugggcggcagagaggacugu

SEQ ID NO: 8150 - RNA, 24 nt, Human
ggggcagcacagagagggggccac

SEQ ID NO: 8151 - RNA, 29 nt, Human
ggggcagcacagagagggggccaccuccc

SEQ ID NO: 8152 - RNA, 18 nt, Human
ggugauuucagaaagcua

SEQ ID NO: 8153 - RNA, 20 nt, Human
guggcauuuguuuucacuuu

SEQ ID NO: 8154 - RNA, 27 nt, Human
ucucugcuuuccuccggagaaauaaca

SEQ ID NO: 8155 - RNA, 21 nt, Human
ucuguaaauguuccuuuccuu

SEQ ID NO: 8156 - RNA, 21 nt, Human
ugcuucuuugaaacuuguaug

SEQ ID NO: 8157 - RNA, 25 nt, Human
ucacaugcuuuucaagaaugucgca

SEQ ID NO: 8158 - RNA, 22 nt, Human
ucuauguauaugucuuaccuca

SEQ ID NO: 8159 - RNA, 20 nt, Human
ucccuuaaauaacacuuaga

SEQ ID NO: 8160 - RNA, 21 nt, Human
caagaaaauuuaagcugcaaa

SEQ ID NO: 8161 - RNA, 25 nt, Human
agaugcauccuuucauaagaaguga

SEQ ID NO: 8162 - RNA, 20 nt, Human
agacuaaaucaaccacucca

SEQ ID NO: 8163 - RNA, 23 nt, Human
accagucagcacagcaugccugg

SEQ ID NO: 8164 - RNA, 22 nt, Human
agaagcagauaaugguguuuuu

SEQ ID NO: 8165 - RNA, 21 nt, Human
acccguuucacaugcuuuuca

SEQ ID NO: 8166 - RNA, 21 nt, Human
uuacauguguuuuucucuccc

SEQ ID NO: 8167 - RNA, 19 nt, Human
uuaagcugcaaaaauguau

SEQ ID NO: 8168 - RNA, 26 nt, Human
uuacauguguuuuucucucccuccuu

SEQ ID NO: 8169 - RNA, 23 nt, Human
ugaauucugguuacauguguuuu

SEQ ID NO: 8170 - RNA, 22 nt, Human
uuucccuuaaauaacacuuaga

SEQ ID NO: 8171 - RNA, 23 nt, Human
uuguuguuuucccaaagagaacu

SEQ ID NO: 8172 - RNA, 26 nt, Human
uugucuauuugcuguugauuguacca

SEQ ID NO: 8173 - RNA, 22 nt, Human
uuuuuuaaaaaauggacucuug

SEQ ID NO: 8174 - RNA, 22 nt, Human
augcacaaacuuggcuucuuua

SEQ ID NO: 8175 - RNA, 22 nt, Human
auucucuauuuuuuguaaugug

SEQ ID NO: 8176 - RNA, 26 nt, Human
gaauucaagaaaauuuaagcugcaaa

SEQ ID NO: 8177 - RNA, 28 nt, Human
gaaaucuuuuuuguucaaagauuaaugc

SEQ ID NO: 8178 - RNA, 21 nt, Human
cacugcauuucauaucacacu

SEQ ID NO: 8179 - RNA, 21 nt, Human
ccucuacugagucccuuagcc

SEQ ID NO: 8180 - RNA, 24 nt, Human
aagcaguuucuuucaaagaagcca

SEQ ID NO: 8181 - RNA, 23 nt, Human
ccuuuccuuuguagucucuggca

SEQ ID NO: 8182 - RNA, 23 nt, Human
cuuaccucaucuccuaaaaggca

SEQ ID NO: 8183 - RNA, 23 nt, Human
cuguuaaaaguuguguuuugaaa

SEQ ID NO: 8184 - RNA, 23 nt, Human
cuuagguugaguaacccacucug

SEQ ID NO: 8185 - RNA, 27 nt, Human
gagaucuauauauguauaaauauguau

SEQ ID NO: 8186 - RNA, 21 nt, Human
gcagagcagagaggcugaaua

SEQ ID NO: 8187 - RNA, 21 nt, Human
gguaaauucucuauuuuuugu

SEQ ID NO: 8188 - RNA, 20 nt, Human
guauagcaguuucugcuuca

SEQ ID NO: 8189 - RNA, 21 nt, Human
guucaaagauuaaugccaacu

SEQ ID NO: 8190 - RNA, 21 nt, Human
ccgucugggcuggagcgcagu

SEQ ID NO: 8191 - RNA, 26 nt, Human
cgucugggcuggagcgcaguccccag

SEQ ID NO: 8192 - RNA, 23 nt, Human
ugccgucugggcuggagcgcagu

SEQ ID NO: 8193 - RNA, 27 nt, Human
uucucuuccugguaauccucuggccca

SEQ ID NO: 8194 - RNA, 22 nt, Human
cuaccacccacccucucagucu

SEQ ID NO: 8195 - RNA, 25 nt, Human
cugcuggugggaaaugggagccagg

SEQ ID NO: 8196 - RNA, 22 nt, Human
cccacuccccucaccaccuaau

SEQ ID NO: 8197 - RNA, 20 nt, Human
gcuggugggaaaugggagcc

SEQ ID NO: 8198 - RNA, 22 nt, Human
ggaccuccuucuuccccacuuc

SEQ ID NO: 8199 - RNA, 19 nt, Human
gcccagggcuucagucuuc

SEQ ID NO: 8200 - RNA, 24 nt, Human
ugggacuacaagaagaggagcugc

SEQ ID NO: 8201 - RNA, 24 nt, Human
uggccucucauuuccuuacacucu

SEQ ID NO: 8202 - RNA, 25 nt, Human
gugaaccccccagugcccccguggg

SEQ ID NO: 8203 - RNA, 19 nt, Human
ggugggaaaugggagccag

SEQ ID NO: 8204 - RNA, 26 nt, Human
cagcccagggcuucagucuuccuuua

SEQ ID NO: 8205 - RNA, 23 nt, Human
cgagauaggucaucagcccaggg

SEQ ID NO: 8206 - RNA, 23 nt, Human
cuguguaccuaguacacaggcau

SEQ ID NO: 8207 - RNA, 25 nt, Human
ccccguccugccuccuuucuuucuc

SEQ ID NO: 8208 - RNA, 23 nt, Human
ccccaccucccucacuucacugc

SEQ ID NO: 8209 - RNA, 18 nt, Human
cccagggcuucagucuuc

SEQ ID NO: 8210 - RNA, 26 nt, Human
gggcuucagucuuccuuuauuuauaa

SEQ ID NO: 8211 - RNA, 20 nt, Human
ucauuuccuuacacucugac

SEQ ID NO: 8212 - RNA, 21 nt, Human
guaagcucaggauauggcuua

SEQ ID NO: 8213 - RNA, 24 nt, Human
ucuagaaucauacuuaacauuuca

SEQ ID NO: 8214 - RNA, 26 nt, Human
ucaggauauggcuuaggaaugacuua

SEQ ID NO: 8215 - RNA, 26 nt, Human
accaucaaaggaauauaagaaaagua

SEQ ID NO: 8216 - RNA, 20 nt, Human
aagcucaggauauggcuuag

SEQ ID NO: 8217 - RNA, 23 nt, Human
aacugaugaguaaacugaggccc

SEQ ID NO: 8218 - RNA, 21 nt, Human
uggugucauaaacuuucucca

SEQ ID NO: 8219 - RNA, 24 nt, Human
uuaaugccaccacacguguuccgc

SEQ ID NO: 8220 - RNA, 21 nt, Human
gcucccuuuuuggguaaacca

SEQ ID NO: 8221 - RNA, 25 nt, Human
aauccaaggaaacaugcagcucuuc

SEQ ID NO: 8222 - RNA, 21 nt, Human
caaaaucaacaugacuggugg

SEQ ID NO: 8223 - RNA, 22 nt, Human
caucauauuuuguugugcacua

SEQ ID NO: 8224 - RNA, 27 nt, Human
ccuguagcugcugcgccacccaccauc

SEQ ID NO: 8225 - RNA, 21 nt, Human
cgagaggggaaagccugagca

SEQ ID NO: 8226 - RNA, 21 nt, Human
uucucucuuuuaaaguauuua

SEQ ID NO: 8227 - RNA, 22 nt, Human
uuguaaaauauuauguuugauu

SEQ ID NO: 8228 - RNA, 23 nt, Human
auuaagcagaaacagcauauuag

SEQ ID NO: 8229 - RNA, 20 nt, Human
uccugugguuuuauuacaaa

SEQ ID NO: 8230 - RNA, 24 nt, Human
ucuccugccgccgcugcugcugcc

SEQ ID NO: 8231 - RNA, 23 nt, Human
ugcugcaucuccccucagauucc

SEQ ID NO: 8232 - RNA, 21 nt, Human
ugggagcgugagcaggacggu

SEQ ID NO: 8233 - RNA, 26 nt, Human
uuaacaaaagcaauuguauuacuucc

SEQ ID NO: 8234 - RNA, 22 nt, Human
ugucgcuuaugucuauaacucc

SEQ ID NO: 8235 - RNA, 24 nt, Human
ugucaccuguagauuuccacacgc

SEQ ID NO: 8236 - RNA, 23 nt, Human
uuccaauuuuguugcaucauguu

SEQ ID NO: 8237 - RNA, 20 nt, Human
ccuuuugguaucuacuucua

SEQ ID NO: 8238 - RNA, 23 nt, Human
caucgacgacuucccggggcgac

SEQ ID NO: 8239 - RNA, 23 nt, Human
cagauguuuuucuucauuaacca

SEQ ID NO: 8240 - RNA, 22 nt, Human
cagaagcccgcacgcaccucgc

SEQ ID NO: 8241 - RNA, 29 nt, Human
ccgcucgcucuccccaucgagggacaaac

SEQ ID NO: 8242 - RNA, 23 nt, Human
aaggcauuucaaagucucacuuu

SEQ ID NO: 8243 - RNA, 23 nt, Human
gcuaagcuguaaccgauaugcac

SEQ ID NO: 8244 - RNA, 22 nt, Human
ggcccagaaacagcagcuuaaa

SEQ ID NO: 8245 - RNA, 20 nt, Human
gccgcucgcucucccccucg

SEQ ID NO: 8246 - RNA, 22 nt, Human
gagggacaaacuuuucccaaac

SEQ ID NO: 8247 - RNA, 17 nt, Human
acugccucugccugucg

SEQ ID NO: 8248 - RNA, 25 nt, Human
acgacuucccggggcgacaggagca

SEQ ID NO: 8249 - RNA, 22 nt, Human
acgauauacuuugauuuuguag

SEQ ID NO: 8250 - RNA, 25 nt, Human
accagcuucagaugcucgaggugag

SEQ ID NO: 8251 - RNA, 21 nt, Human
acugccucugccugucgcaug

SEQ ID NO: 8252 - RNA, 27 nt, Human
acugccucugccugucgcaugagaaca

SEQ ID NO: 8253 - RNA, 22 nt, Human
agcaauuguauuacuuccucug

SEQ ID NO: 8254 - RNA, 23 nt, Human
agcagacaccagcuucagaugcu

SEQ ID NO: 8255 - RNA, 26 nt, Human
agggacaaacuuuucccaaacccgau

SEQ ID NO: 8256 - RNA, 23 nt, Human
aggguguugcuaagcuguaaccg

SEQ ID NO: 8257 - RNA, 27 nt, Human
auuaacaaaagcaauuguauuacuucc

SEQ ID NO: 8258 - RNA, 22 nt, Human
aucgacgacuucccggggcgac

SEQ ID NO: 8259 - RNA, 27 nt, Human
ucauggaagaagagagaccucuacuuc

SEQ ID NO: 8260 - RNA, 23 nt, Human
ucuccacccguguccagcaugac

SEQ ID NO: 8261 - RNA, 27 nt, Human
ucuccacccguguccagcaugacggug

SEQ ID NO: 8262 - RNA, 23 nt, Human
ucugaacucuucuugauuuuaau

SEQ ID NO: 8263 - RNA, 22 nt, Human
ggugcugcgaggggaaggaaaa

SEQ ID NO: 8264 - RNA, 20 nt, Human
ggggaaggaaaagggaggca

SEQ ID NO: 8265 - RNA, 23 nt, Human
uaccucuucgccuuucugugguu

SEQ ID NO: 8266 - RNA, 21 nt, Human
ccaauuuuguugcaucauguu

SEQ ID NO: 8267 - RNA, 22 nt, Human
ggcugguccuccuucugcuuuu

SEQ ID NO: 8268 - RNA, 20 nt, Human
gggacaaacuuuucccaaac

SEQ ID NO: 8269 - RNA, 20 nt, Human
gggagcgugagcaggacggu

SEQ ID NO: 8270 - RNA, 23 nt, Human
ccaucuucuuuauacaaugacca

SEQ ID NO: 8271 - RNA, 23 nt, Human
gucaccuguagauuuccacacgc

SEQ ID NO: 8272 - RNA, 23 nt, Human
gcgggagguggguggcugcgggg

SEQ ID NO: 8273 - RNA, 32 nt, Human
gggacaaacuuuucccaaacccgauccgagcc

SEQ ID NO: 8274 - RNA, 20 nt, Human
cccggggcgacaggagcagc

SEQ ID NO: 8275 - RNA, 22 nt, Human
cuuccaccacaaccccacgcgc

SEQ ID NO: 8276 - RNA, 26 nt, Human
cgggagguggguggcugcggggcaau

SEQ ID NO: 8277 - RNA, 27 nt, Human
cgggagguggguggcugcggggcaauu

SEQ ID NO: 8278 - RNA, 21 nt, Human
cuagaaaaguggcccagaaac

SEQ ID NO: 8279 - RNA, 29 nt, Human
ccgcucgcucucccccucgagggacaaac

SEQ ID NO: 8280 - RNA, 22 nt, Human
cuugacuacaaaacagagcugu

SEQ ID NO: 8281 - RNA, 21 nt, Human
cucucaggagccuucuccgca

SEQ ID NO: 8282 - RNA, 21 nt, Human
aaaacagagcugucuucagca

SEQ ID NO: 8283 - RNA, 20 nt, Human
uuauuagcauuucuuaguau

SEQ ID NO: 8284 - RNA, 17 nt, Human
cuugacaaaaaugacug

SEQ ID NO: 8285 - RNA, 22 nt, Human
ccagugagcuuaucaugcuguc

SEQ ID NO: 8286 - RNA, 16 nt, Human
uucugaaaugaccuca

SEQ ID NO: 8287 - RNA, 21 nt, Human
uuguagaaggguuauauuuua

SEQ ID NO: 8288 - RNA, 22 nt, Human
auauuagcauuuaguccaaugu

SEQ ID NO: 8289 - RNA, 22 nt, Human
gagagagaauucuuucaaguga

SEQ ID NO: 8290 - RNA, 21 nt, Human
gcuuuuccuuuguuuuuauga

SEQ ID NO: 8291 - RNA, 22 nt, Human
aaaccuuugagacuauugagau

SEQ ID NO: 8292 - RNA, 22 nt, Human
uguuuuuaaaaaucauaaacug

SEQ ID NO: 8293 - RNA, 20 nt, Human
uuuaagaguauguugcuuuu

SEQ ID NO: 8294 - RNA, 23 nt, Human
guaaaucacacaacagguuucua

SEQ ID NO: 8295 - RNA, 22 nt, Human
ugcuuuuccuuuguuuuuauga

SEQ ID NO: 8296 - RNA, 23 nt, Human
ucccauguuaaaucccauucaua

SEQ ID NO: 8297 - RNA, 23 nt, Human
uccagugagcuuaucaugcuguc

SEQ ID NO: 8298 - RNA, 24 nt, Human
ucaugcugucuuuacaugggguuu

SEQ ID NO: 8299 - RNA, 27 nt, Human
ucaugcugucuuuacaugggguuuuca

SEQ ID NO: 8300 - RNA, 21 nt, Human
uauuaaaaugaauauuuuugu

SEQ ID NO: 8301 - RNA, 22 nt, Human
cacacaacagguuucuacucuc

SEQ ID NO: 8302 - RNA, 19 nt, Human
agcuuaucaugcugucuuu

SEQ ID NO: 8303 - RNA, 22 nt, Human
acaacagguuucuacucucuuu

SEQ ID NO: 8304 - RNA, 21 nt, Human
acacaacagguuucuacucuc

SEQ ID NO: 8305 - RNA, 20 nt, Human
uaggcaggaaaaucagucua

SEQ ID NO: 8306 - RNA, 27 nt, Human
ugaaagaaguuuuuaugagaauaacac

SEQ ID NO: 8307 - RNA, 21 nt, Human
uuguuucagcauguaauuuua

SEQ ID NO: 8308 - RNA, 22 nt, Human
aaauuuauaucauuaacaaugu

SEQ ID NO: 8309 - RNA, 25 nt, Human
aaauuuauaucauuaacaaugugug

SEQ ID NO: 8310 - RNA, 16 nt, Human
aggauucugccgccaa

SEQ ID NO: 8311 - RNA, 19 nt, Human
ccucccucuccacucugag

SEQ ID NO: 8312 - RNA, 22 nt, Human
ccuucauuuugaaagaaguuuu

SEQ ID NO: 8313 - RNA, 21 nt, Human
ccucuuccuaaaauuaggcag

SEQ ID NO: 8314 - RNA, 24 nt, Human
guucuguguaauuguuuaguuuaa

SEQ ID NO: 8315 - RNA, 27 nt, Human
uacuacugagucaaguuuucuaguucu

SEQ ID NO: 8316 - RNA, 20 nt, Human
gaauauaacauuuuauguca

SEQ ID NO: 8317 - RNA, 22 nt, Human
uucauucuauagaagaaaugca

SEQ ID NO: 8318 - RNA, 20 nt, Human
uggcuucauggaaacucccu

SEQ ID NO: 8319 - RNA, 20 nt, Human
ucacuaccaugagaauugca

SEQ ID NO: 8320 - RNA, 24 nt, Human
ucgucucaggccaguugcagccuu

SEQ ID NO: 8321 - RNA, 18 nt, Human
ccaugagaauugcaguga

SEQ ID NO: 8322 - RNA, 23 nt, Human
aaucuuuuaucuugaauguaaua

SEQ ID NO: 8323 - RNA, 21 nt, Human
acauaaccuuuuuuacugccu

SEQ ID NO: 8324 - RNA, 17 nt, Human
aaagaaaaaaugcuuua

SEQ ID NO: 8325 - RNA, 25 nt, Human
agacucgucucaggccaguugcagc

SEQ ID NO: 8326 - RNA, 24 nt, Human
agaauauaacauuuuaugucacua

SEQ ID NO: 8327 - RNA, 22 nt, Human
agauguuucaaaaaaucugacc

SEQ ID NO: 8328 - RNA, 22 nt, Human
aggcugaggcaagagaauuguu

SEQ ID NO: 8329 - RNA, 27 nt, Human
caaccaaaaaauucuacaacacacacu

SEQ ID NO: 8330 - RNA, 22 nt, Human
cacuacacuccagccuggcgac

SEQ ID NO: 8331 - RNA, 27 nt, Human
cacuacacuccagccuggcgacagagc

SEQ ID NO: 8332 - RNA, 22 nt, Human
cacgagaucaagagaucaagac

SEQ ID NO: 8333 - RNA, 22 nt, Human
caccuguaaucccaacauuuug

SEQ ID NO: 8334 - RNA, 21 nt, Human
aucuuucaggacucuaccuca

SEQ ID NO: 8335 - RNA, 24 nt, Human
acuaaaagaucgcaguuugccugg

SEQ ID NO: 8336 - RNA, 22 nt, Human
accuguaaucccaacauuuugg

SEQ ID NO: 8337 - RNA, 21 nt, Human
accuguaaucccaacauuuug

SEQ ID NO: 8338 - RNA, 23 nt, Human
aaagugacucacuuaucccaaga

SEQ ID NO: 8339 - RNA, 27 nt, Human
ccacuacacuccagccuggcgacagag

SEQ ID NO: 8340 - RNA, 22 nt, Human
gggaggcagagguugcagugug

SEQ ID NO: 8341 - RNA, 20 nt, Human
uccagccuggcgacagagcg

SEQ ID NO: 8342 - RNA, 22 nt, Human
ucaugccacuacacuccagccu

SEQ ID NO: 8343 - RNA, 22 nt, Human
ucaagagaucaagaccauagug

SEQ ID NO: 8344 - RNA, 22 nt, Human
ugaccaacauagugaaacccca

SEQ ID NO: 8345 - RNA, 27 nt, Human
ugccacuacacuccagccuggcgacag

SEQ ID NO: 8346 - RNA, 23 nt, Human
ugccuguagucccagcuacuuga

SEQ ID NO: 8347 - RNA, 27 nt, Human
uggcucacaccuguaaucccaacauuu

SEQ ID NO: 8348 - RNA, 15 nt, Human
uugccuggugcagug

SEQ ID NO: 8349 - RNA, 27 nt, Human
ugccuguagucccagcuacuugagagg

SEQ ID NO: 8350 - RNA, 17 nt, Human
uguggugagaucaugcc

SEQ ID NO: 8351 - RNA, 22 nt, Human
uguuugaacccgggaggcagag

SEQ ID NO: 8352 - RNA, 27 nt, Human
ugacuuacagcagucagacucugacag

SEQ ID NO: 8353 - RNA, 23 nt, Human
aguuugccuggugcaguggcuca

SEQ ID NO: 8354 - RNA, 22 nt, Human
auuguuugaacccgggaggcag

SEQ ID NO: 8355 - RNA, 21 nt, Human
ccuguaaucccaacauuuugg

SEQ ID NO: 8356 - RNA, 27 nt, Human
cgggaggcagagguugcagugugguga

SEQ ID NO: 8357 - RNA, 22 nt, Human
gaccauagugaccaacauagug

SEQ ID NO: 8358 - RNA, 22 nt, Human
cugaggcaagagaauuguuuga

SEQ ID NO: 8359 - RNA, 21 nt, Human
cuggguguguuggcacaugcc

SEQ ID NO: 8360 - RNA, 22 nt, Human
cuguagucccagcuacuugaga

SEQ ID NO: 8361 - RNA, 22 nt, Human
ccgggaggcagagguugcagug

SEQ ID NO: 8362 - RNA, 28 nt, Human
ccgggaggcagagguugcagugugguga

SEQ ID NO: 8363 - RNA, 21 nt, Human
cacuacacuccagccuggcga

SEQ ID NO: 8364 - RNA, 22 nt, Human
caacauagugaaaccccaucuc

SEQ ID NO: 8365 - RNA, 22 nt, Human
cacaccuguaaucccaacauuu

SEQ ID NO: 8366 - RNA, 17 nt, Human
caaugguuaacaucuuc

SEQ ID NO: 8367 - RNA, 22 nt, Human
ccaacauagugaaaccccaucu

SEQ ID NO: 8368 - RNA, 22 nt, Human
gcucacaccuguaaucccaaca

SEQ ID NO: 8369 - RNA, 22 nt, Human
gcuggguguguuggcacaugcc

SEQ ID NO: 8370 - RNA, 22 nt, Human
gagaucaugccacuacacucca

SEQ ID NO: 8371 - RNA, 27 nt, Human
gagaauuguuugaacccgggaggcaga

SEQ ID NO: 8372 - RNA, 26 nt, Human
gaggcugaggcaagagaauuguuuga

SEQ ID NO: 8373 - RNA, 26 nt, Human
gaccaaaacaaacaaacagaaaacag

SEQ ID NO: 8374 - RNA, 22 nt, Human
gaacccgggaggcagagguugc

SEQ ID NO: 8375 - RNA, 24 nt, Human
gaagacugucagcuuccaaacauu

SEQ ID NO: 8376 - RNA, 21 nt, Human
cgggaggcagagguugcagug

SEQ ID NO: 8377 - RNA, 22 nt, Human
cgggaggcagagguugcagugu

SEQ ID NO: 8378 - RNA, 22 nt, Human
gggccuuuuuaguuggcuacug

SEQ ID NO: 8379 - RNA, 21 nt, Human
ggcucacaccuguaaucccaa

SEQ ID NO: 8380 - RNA, 18 nt, Human
gccuggugcaguggcuca

SEQ ID NO: 8381 - RNA, 22 nt, Human
gaucuuucaggacucuaccuca

SEQ ID NO: 8382 - RNA, 21 nt, Human
gcacagccaggcuggagucag

SEQ ID NO: 8383 - RNA, 22 nt, Human
gcacagccaggcuggagucagu

SEQ ID NO: 8384 - RNA, 24 nt, Human
gccuugccugugagcuaugucacu

SEQ ID NO: 8385 - RNA, 26 nt, Human
cuguucugccuugccugugagcuaug

SEQ ID NO: 8386 - RNA, 22 nt, Human
caggcuggagucagugucugcc

SEQ ID NO: 8387 - RNA, 21 nt, Human
cacagccaggcuggagucagu

SEQ ID NO: 8388 - RNA, 21 nt, Human
cagccaggcuggagucagugu

SEQ ID NO: 8389 - RNA, 21 nt, Human
cuuuggguuucuugcugcugc

SEQ ID NO: 8390 - RNA, 24 nt, Human
aggcuggagucagugucugccccu

SEQ ID NO: 8391 - RNA, 21 nt, Human
aggcuuccacugcauccuggc

SEQ ID NO: 8392 - RNA, 20 nt, Human
agucagugucugccccugag

SEQ ID NO: 8393 - RNA, 24 nt, Human
agccaggcuggagucagugucugc

SEQ ID NO: 8394 - RNA, 19 nt, Human
ugccccugugcuuggagag

SEQ ID NO: 8395 - RNA, 23 nt, Human
ugccugugagcuaugucacuccc

SEQ ID NO: 8396 - RNA, 21 nt, Human
ccacugcauccuggccagggg

SEQ ID NO: 8397 - RNA, 20 nt, Human
cagccaggcuggagucagug

SEQ ID NO: 8398 - RNA, 27 nt, Human
caggcuggagucagugucugccccuga

SEQ ID NO: 8399 - RNA, 23 nt, Human
aaaagauguaggggcuuggaggu

SEQ ID NO: 8400 - RNA, 20 nt, Human
acagccaggcuggagucagu

SEQ ID NO: 8401 - RNA, 21 nt, Human
acagccaggcuggagucagug

SEQ ID NO: 8402 - RNA, 26 nt, Human
cagacaccugcccuaauccucagccu

SEQ ID NO: 8403 - RNA, 22 nt, Human
cacagccaggcuggagucagug

SEQ ID NO: 8404 - RNA, 27 nt, Human
agggcuccagacccaaccuggucacaa

SEQ ID NO: 8405 - RNA, 19 nt, Human
agccaggcuggagucagug

SEQ ID NO: 8406 - RNA, 26 nt, Human
gucuuggccauggcuuuccugcaaga

SEQ ID NO: 8407 - RNA, 23 nt, Human
ggucuccgucucuccaccggggg

SEQ ID NO: 8408 - RNA, 26 nt, Human
cugagugugggagugcagagaaagaa

SEQ ID NO: 8409 - RNA, 23 nt, Human
cuuuuguaugugugcucucuuua

SEQ ID NO: 8410 - RNA, 24 nt, Human
uaggaauaguugaaggagauucga

SEQ ID NO: 8411 - RNA, 22 nt, Human
cgggacgcagagguuacaguga

SEQ ID NO: 8412 - RNA, 24 nt, Human
aagugugagccaaaggauccuucc

SEQ ID NO: 8413 - RNA, 27 nt, Human
guaccuugccuagccucucccucuccc

SEQ ID NO: 8414 - RNA, 23 nt, Human
cacuuucccugagucucaagagc

SEQ ID NO: 8415 - RNA, 22 nt, Human
ccaaagugcugggauuacaggu

SEQ ID NO: 8416 - RNA, 20 nt, Human
guugcaugccuauguacucu

SEQ ID NO: 8417 - RNA, 20 nt, Human
gcuauuuuuaugacuauccu

SEQ ID NO: 8418 - RNA, 26 nt, Human
ccaccgacccuuccuggccuaauccu

SEQ ID NO: 8419 - RNA, 21 nt, Human
uggaugacuccagauucuauc

SEQ ID NO: 8420 - RNA, 22 nt, Human
auuuuucuagcgaacguauuuc

SEQ ID NO: 8421 - RNA, 22 nt, Human
ccuugauacgacuaagcgguua

SEQ ID NO: 8422 - RNA, 23 nt, Human
agagccauauaaguuugaaggaa

SEQ ID NO: 8423 - RNA, 21 nt, Human
ccugaguagcuggugcgcacg

SEQ ID NO: 8424 - RNA, 20 nt, Human
gugugaaaaacaguaaaguu

SEQ ID NO: 8425 - RNA, 19 nt, Human
ggggugagucugggucugg

SEQ ID NO: 8426 - RNA, 23 nt, Human
uuucacuguacauuacuuugcag

SEQ ID NO: 8427 - RNA, 20 nt, Human
ugacuucugggaacuugguu

SEQ ID NO: 8428 - RNA, 23 nt, Human
gggccuggaagugcccgcugaga

SEQ ID NO: 8429 - RNA, 20 nt, Human
gaggagcagagggccuagga

SEQ ID NO: 8430 - RNA, 23 nt, Human
uacagcaagaagccagaacuguu

SEQ ID NO: 8431 - RNA, 21 nt, Human
gcccaggcugaagcucagggc

SEQ ID NO: 8432 - RNA, 26 nt, Human
acagaugguaucccuuccuggaucau

SEQ ID NO: 8433 - RNA, 23 nt, Human
cccaggaggcugaggcugcaaug

SEQ ID NO: 8434 - RNA, 23 nt, Human
ggguccuggaguaaagucaggag

SEQ ID NO: 8435 - RNA, 21 nt, Human
ucuucauucugggauauugug

SEQ ID NO: 8436 - RNA, 28 nt, Human
gccaugauucacagcacugcacugcagc

SEQ ID NO: 8437 - RNA, 26 nt, Human
ggggugauggagaagaaacaggcugu

SEQ ID NO: 8438 - RNA, 25 nt, Human
gcguuggcugugauccuggaaugag

SEQ ID NO: 8439 - RNA, 20 nt, Human
acucauaguuuacuuuuguu

SEQ ID NO: 8440 - RNA, 19 nt, Human
cucuacuggaauuccugcc

SEQ ID NO: 8441 - RNA, 24 nt, Human
cuucacugucuucucucuguuuca

SEQ ID NO: 8442 - RNA, 22 nt, Human
uaguuuuccuuugcuacuugaa

SEQ ID NO: 8443 - RNA, 23 nt, Human
gcauugcugugaauuagcucacu

SEQ ID NO: 8444 - RNA, 23 nt, Human
caucaaauguacaacuuauucua

SEQ ID NO: 8445 - RNA, 22 nt, Human
agccucccagaguacugggauu

SEQ ID NO: 8446 - RNA, 20 nt, Human
uccugggauugacugagaug

SEQ ID NO: 8447 - RNA, 24 nt, Human
gcacagccagugcauuccugccug

SEQ ID NO: 8448 - RNA, 22 nt, Human
gugaucuuggcucacugcagcc

SEQ ID NO: 8449 - RNA, 29 nt, Human
auguaauugacaggauggcugcugcagaa

SEQ ID NO: 8450 - RNA, 23 nt, Human
gcagagauuaucagugacuuuua

SEQ ID NO: 8451 - RNA, 23 nt, Human
ggcuguugggguuucuggagaau

SEQ ID NO: 8452 - RNA, 20 nt, Human
gucagaggcaggaguggggg

SEQ ID NO: 8453 - RNA, 22 nt, Human
uccugagugaggaguugcagcc

SEQ ID NO: 8454 - RNA, 22 nt, Human
agcucuguaaccaguccugucc

SEQ ID NO: 8455 - RNA, 21 nt, Human
aguuucucuucucacaaaaga

SEQ ID NO: 8456 - RNA, 20 nt, Human
uuuugauauagugcauugcu

SEQ ID NO: 8457 - RNA, 28 nt, Human
ucagagaggcagagguggcacaggacag

SEQ ID NO: 8458 - RNA, 19 nt, Human
ugaucuauccuuuacuuga

SEQ ID NO: 8459 - RNA, 25 nt, Human
ccugcagcaggaauauaugugugcc

SEQ ID NO: 8460 - RNA, 28 nt, Human
auggaaaaacaaauuugcacaauggccu

SEQ ID NO: 8461 - RNA, 22 nt, Human
agggguggggaugggguugggc

SEQ ID NO: 8462 - RNA, 18 nt, Human
ucccuagaccccgcaggg

SEQ ID NO: 8463 - RNA, 20 nt, Human
cgcgagggcuggcugugaug

SEQ ID NO: 8464 - RNA, 25 nt, Human
auucccguagcucuucacagcugaa

SEQ ID NO: 8465 - RNA, 23 nt, Human
ggaccugauuucuuugaccggcu

SEQ ID NO: 8466 - RNA, 22 nt, Human
uugggaaggcagggaaauuuga

SEQ ID NO: 8467 - RNA, 24 nt, Human
cguaaagcuguugccugggagcuu

SEQ ID NO: 8468 - RNA, 23 nt, Human
aggcuggagugcaaugggcacaa

SEQ ID NO: 8469 - RNA, 27 nt, Human
cagaaauugcauaauuuucuaauuuca

SEQ ID NO: 8470 - RNA, 22 nt, Human
gguucaagugauucucuugccu

SEQ ID NO: 8471 - RNA, 21 nt, Human
ugccaguagaaaauucauaac

SEQ ID NO: 8472 - RNA, 22 nt, Human
agagaauaugaccuaaauccau

SEQ ID NO: 8473 - RNA, 20 nt, Human
ggaaugagacaggaccuaga

SEQ ID NO: 8474 - RNA, 24 nt, Human
ggaagcgcagcagcgggagcuagg

SEQ ID NO: 8475 - RNA, 22 nt, Human
uucuagaagugaggaugcguaa

SEQ ID NO: 8476 - RNA, 26 nt, Human
gacucaccacaccucuacggcugggg

SEQ ID NO: 8477 - RNA, 21 nt, Human
ccuaccccgaacuccaaaaau

SEQ ID NO: 8478 - RNA, 23 nt, Human
uugucugucuguccggucuuguu

SEQ ID NO: 8479 - RNA, 32 nt, Human
cucuaccguguuucucuuccaucccuaaacca

SEQ ID NO: 8480 - RNA, 20 nt, Human
ucugcauuuucuauuucuau

SEQ ID NO: 8481 - RNA, 21 nt, Human
guugcccaggcagaucucaga

SEQ ID NO: 8482 - RNA, 19 nt, Human
ucauaaucuggaggcaagg

SEQ ID NO: 8483 - RNA, 19 nt, Human
aggaaucggaauccugucg

SEQ ID NO: 8484 - RNA, 21 nt, Human
cacaucccggggcaaagaccu

SEQ ID NO: 8485 - RNA, 22 nt, Human
agccucucaaguagcugggacu

SEQ ID NO: 8486 - RNA, 20 nt, Human
ucacugcagccccucugccc

SEQ ID NO: 8487 - RNA, 20 nt, Human
gggacccaggaaaccaaagu

SEQ ID NO: 8488 - RNA, 25 nt, Human
ucacagaaaauaaggcacccaucug

SEQ ID NO: 8489 - RNA, 22 nt, Human
aacugaaguuucacaugagcua

SEQ ID NO: 8490 - RNA, 21 nt, Human
ccugggucuguucccugcccc

SEQ ID NO: 8491 - RNA, 24 nt, Human
ccaagcccaauacagccauuaaag

SEQ ID NO: 8492 - RNA, 21 nt, Human
gugucuggccaaaucuucccg

SEQ ID NO: 8493 - RNA, 19 nt, Human
gcauuucacaugccuugca

SEQ ID NO: 8494 - RNA, 20 nt, Human
uauaacuaauaacaugugaa

SEQ ID NO: 8495 - RNA, 20 nt, Human
aauuuccacaccaaugucau

SEQ ID NO: 8496 - RNA, 24 nt, Human
accauuuuauauuugccaccuaca

SEQ ID NO: 8497 - RNA, 30 nt, Human
ggcucacccagagcagcugggucuccaggc

SEQ ID NO: 8498 - RNA, 22 nt, Human
ucucagccuuagcucucccaac

SEQ ID NO: 8499 - RNA, 21 nt, Human
guccucugcuugcuggaacau

SEQ ID NO: 8500 - RNA, 22 nt, Human
uuuuuggggagggggcaccaug

SEQ ID NO: 8501 - RNA, 21 nt, Human
uacagauauuauucaugacag

SEQ ID NO: 8502 - RNA, 22 nt, Human
ggcucacugcaguuuugaccuc

SEQ ID NO: 8503 - RNA, 22 nt, Human
ccagaagcccauggagcaggga

SEQ ID NO: 8504 - RNA, 21 nt, Human
ggccagccuggcgaaacccca

SEQ ID NO: 8505 - RNA, 21 nt, Human
uuauuuuuagggugauuuuuu

SEQ ID NO: 8506 - RNA, 23 nt, Human
ccauugcucuccuagaggggguc

SEQ ID NO: 8507 - RNA, 21 nt, Human
ccuacuuccuccuagcaacca

SEQ ID NO: 8508 - RNA, 22 nt, Human
cgcuucccugguucaagcgauu

SEQ ID NO: 8509 - RNA, 24 nt, Human
gaguuucuggcgccccugccugug

SEQ ID NO: 8510 - RNA, 23 nt, Human
caaacauccuaucuuucuucuuc

SEQ ID NO: 8511 - RNA, 23 nt, Human
ccuggucaccaucagaguacugg

SEQ ID NO: 8512 - RNA, 22 nt, Human
acacuagccugggugcaucugc

SEQ ID NO: 8513 - RNA, 23 nt, Human
cccucuaaaaaagaacuuuagca

SEQ ID NO: 8514 - RNA, 27 nt, Human
gccaccgcgcccagccucaucucuuug

SEQ ID NO: 8515 - RNA, 24 nt, Human
aaauagugcccucagcuacugcag

SEQ ID NO: 8516 - RNA, 21 nt, Human
ggugcagaugagguugcuaga

SEQ ID NO: 8517 - RNA, 20 nt, Human
ugauuucucccuguauugag

SEQ ID NO: 8518 - RNA, 21 nt, Human
gagacugucucgaucucucca

SEQ ID NO: 8519 - RNA, 20 nt, Human
uguuacuuguuacugcagca

SEQ ID NO: 8520 - RNA, 20 nt, Human
ucccagggagggggaagaga

SEQ ID NO: 8521 - RNA, 22 nt, Human
uggcauagcacccguggugcau

SEQ ID NO: 8522 - RNA, 23 nt, Human
gggaggacaguggaugacaggga

SEQ ID NO: 8523 - RNA, 27 nt, Human
ccugccccacacggacucccgggccac

SEQ ID NO: 8524 - RNA, 19 nt, Human
uacuuucuacuuuguguuu

SEQ ID NO: 8525 - RNA, 25 nt, Human
uucaauuaauauuaucacacuauua

SEQ ID NO: 8526 - RNA, 23 nt, Human
auuucaaauuugugcagugucuu

SEQ ID NO: 8527 - RNA, 27 nt, Human
ggugcauuuuuuaauagggcuugggga

SEQ ID NO: 8528 - RNA, 23 nt, Human
gauagacuucaggauggccaguc

SEQ ID NO: 8529 - RNA, 21 nt, Human
ggcggggugggacuuccuucc

SEQ ID NO: 8530 - RNA, 23 nt, Human
gagagguggggacagcaagaagc

SEQ ID NO: 8531 - RNA, 19 nt, Human
ucucggggacacaggccag

SEQ ID NO: 8532 - RNA, 27 nt, Human
guugucugcuccucugcaaaggccagc

SEQ ID NO: 8533 - RNA, 20 nt, Human
ucuuucuucuuuguaaacca

SEQ ID NO: 8534 - RNA, 22 nt, Human
guccucugcugucuccccacua

SEQ ID NO: 8535 - RNA, 24 nt, Human
gugggagggggcagggggcuuggc

SEQ ID NO: 8536 - RNA, 24 nt, Human
gagaagccuggugguuuuccucuc

SEQ ID NO: 8537 - RNA, 21 nt, Human
uaugcaauacuuucccccuuu

SEQ ID NO: 8538 - RNA, 24 nt, Human
uucagcccaccagccaccucaucc

SEQ ID NO: 8539 - RNA, 22 nt, Human
ucaugcuguuucucuguuugcu

SEQ ID NO: 8540 - RNA, 22 nt, Human
caacacagcaggacuccaucuc

SEQ ID NO: 8541 - RNA, 21 nt, Human
cugccucccauccuucccuca

SEQ ID NO: 8542 - RNA, 18 nt, Human
uuucuaauuuauaacucc

SEQ ID NO: 8543 - RNA, 21 nt, Human
agacgcuauguccagcaaagg

SEQ ID NO: 8544 - RNA, 20 nt, Human
acagaaaaucacccugugca

SEQ ID NO: 8545 - RNA, 25 nt, Human
cggcgggagugcagcggccacugua

SEQ ID NO: 8546 - RNA, 23 nt, Human
aucgcgacacugcacuccagccu

SEQ ID NO: 8547 - RNA, 22 nt, Human
caucuguaaccccagcacuuug

SEQ ID NO: 8548 - RNA, 27 nt, Human
gcuccacccuuugggccuguagcucuu

SEQ ID NO: 8549 - RNA, 23 nt, Human
gaugcacugcaugugugaacaca

SEQ ID NO: 8550 - RNA, 29 nt, Human
agaaacuuucccugucaaaggcuccgggg

SEQ ID NO: 8551 - RNA, 20 nt, Human
auaacugguuaucaugacaa

SEQ ID NO: 8552 - RNA, 24 nt, Human
caccaccagggcuccaggagccuc

SEQ ID NO: 8553 - RNA, 22 nt, Human
gccaccugccuuccccugguca

SEQ ID NO: 8554 - RNA, 27 nt, Human
aguguucucaucucaaagcaaacuauc

SEQ ID NO: 8555 - RNA, 21 nt, Human
ccccgcccccaccugccccca

SEQ ID NO: 8556 - RNA, 21 nt, Human
ggcucacugcagccucuaccu

SEQ ID NO: 8557 - RNA, 20 nt, Human
acugggcccaacauauccau

SEQ ID NO: 8558 - RNA, 19 nt, Human
cuccuccagggacugcugu

SEQ ID NO: 8559 - RNA, 22 nt, Human
caggcagcacugacaauaguua

SEQ ID NO: 8560 - RNA, 24 nt, Human
acgggagggauggagggaggcagg

SEQ ID NO: 8561 - RNA, 27 nt, Human
ccccucgggagcaccccaccucugugu

SEQ ID NO: 8562 - RNA, 27 nt, Human
ccuguucuuuucuccccugugcugccg

SEQ ID NO: 8563 - RNA, 26 nt, Human
aggauuaguccaccugucccuccugg

SEQ ID NO: 8564 - RNA, 26 nt, Human
aaccugacagaguucaacacugccca

SEQ ID NO: 8565 - RNA, 18 nt, Human
cuuuucagaagaaaagca

SEQ ID NO: 8566 - RNA, 27 nt, Human
aaauguuccauuauucagcuggcugau

SEQ ID NO: 8567 - RNA, 21 nt, Human
gcagagcauccucucugcccu

SEQ ID NO: 8568 - RNA, 23 nt, Human
cacccaggcuuugaagagcaugg

SEQ ID NO: 8569 - RNA, 22 nt, Human
accacucucucaguccccaggu

SEQ ID NO: 8570 - RNA, 18 nt, Human
cuucccuugcccauguga

SEQ ID NO: 8571 - RNA, 20 nt, Human
uccuuuaggcagguuacagu

SEQ ID NO: 8572 - RNA, 26 nt, Human
ucugccugggccucggucccuccugc

SEQ ID NO: 8573 - RNA, 24 nt, Human
aacucagagaagauccagauucug

SEQ ID NO: 8574 - RNA, 22 nt, Human
aaaccgcgggagccgagcccag

SEQ ID NO: 8575 - RNA, 29 nt, Human
gcccguugucucccuggcccucaaggcuc

SEQ ID NO: 8576 - RNA, 22 nt, Human
guauguucagaaaagcauuuua

SEQ ID NO: 8577 - RNA, 27 nt, Human
ggggccggaaggaaugucagggccagg

SEQ ID NO: 8578 - RNA, 14 nt, Human
cacuccucgcucag

SEQ ID NO: 8579 - RNA, 27 nt, Human
aguauuuuguauaauuggauucuaaua

SEQ ID NO: 8580 - RNA, 22 nt, Human
acccaggcuggagugcagugcu

SEQ ID NO: 8581 - RNA, 24 nt, Human
uguccuucaggagaggacaccagg

SEQ ID NO: 8582 - RNA, 24 nt, Human
auuucuccugucaccuuccgggga

SEQ ID NO: 8583 - RNA, 25 nt, Human
aauucugauuuauuccuacauuuuc

SEQ ID NO: 8584 - RNA, 26 nt, Human
aggcagcagagcauucagacuccaaa

SEQ ID NO: 8585 - RNA, 27 nt, Human
aggaaacaaaaugggaucuuucugaca

SEQ ID NO: 8586 - RNA, 23 nt, Human
ccagacccugccccaccucacuu

SEQ ID NO: 8587 - RNA, 23 nt, Human
ugcguuauuuucaagcuuugcua

SEQ ID NO: 8588 - RNA, 25 nt, Human
gaaagagauggcuaacaaucuguga

SEQ ID NO: 8589 - RNA, 29 nt, Human
cgcgggcgggcggacagaucggagccgag

SEQ ID NO: 8590 - RNA, 22 nt, Human
uucauucucacucugcuuugca

SEQ ID NO: 8591 - RNA, 24 nt, Human
ggcaggcagggcauggguuuuagu

SEQ ID NO: 8592 - RNA, 21 nt, Human
ucuucucucaauuccagucau

SEQ ID NO: 8593 - RNA, 23 nt, Human
uuaccagcauauauaguauuuaa

SEQ ID NO: 8594 - RNA, 17 nt, Human
uuuuuaaaaauguuuug

SEQ ID NO: 8595 - RNA, 23 nt, Human
ggagguggcgaaacgaggaggag

SEQ ID NO: 8596 - RNA, 26 nt, Human
ggaggaggcggcgugcagggaggaga

SEQ ID NO: 8597 - RNA, 21 nt, Human
ugggugauucacgugugccca

SEQ ID NO: 8598 - RNA, 24 nt, Human
uucugccaggggcaaaagauacua

SEQ ID NO: 8599 - RNA, 21 nt, Human
agucucgaacucaugaccuca

SEQ ID NO: 8600 - RNA, 29 nt, Human
gugaacugcuaauacagaaacuuaaugua

SEQ ID NO: 8601 - RNA, 24 nt, Human
aaauuuccuuguucccuaggcuga

SEQ ID NO: 8602 - RNA, 18 nt, Human
cccgaaagaggugaaaga

SEQ ID NO: 8603 - RNA, 27 nt, Human
gcagagcugggauugaaggaccccuau

SEQ ID NO: 8604 - RNA, 22 nt, Human
gggaggcgggggccggcgggag

SEQ ID NO: 8605 - RNA, 20 nt, Human
uuuggaaccugcugucaaca

SEQ ID NO: 8606 - RNA, 27 nt, Human
uuaguaaaauauuuauuguuccuuuau

SEQ ID NO: 8607 - RNA, 22 nt, Human
uggcucugucucccaggcugga

SEQ ID NO: 8608 - RNA, 26 nt, Human
gugaugccuccgaaggggcucugagu

SEQ ID NO: 8609 - RNA, 22 nt, Human
cuauucauguggcaggccccug

SEQ ID NO: 8610 - RNA, 30 nt, Human
aucuuccaggucccagaggguggaaggagc

SEQ ID NO: 8611 - RNA, 23 nt, Human
guagaggcccuucuuugcacuug

SEQ ID NO: 8612 - RNA, 20 nt, Human
ggacuccuuguucugcucug

SEQ ID NO: 8613 - RNA, 19 nt, Human
cggagguugcagggccaag

SEQ ID NO: 8614 - RNA, 20 nt, Human
acugaguuugaacacagauc

SEQ ID NO: 8615 - RNA, 21 nt, Human
uccccaggcucuagugcagga

SEQ ID NO: 8616 - RNA, 27 nt, Human
cucuaauuuuccugucuugaaacugua

SEQ ID NO: 8617 - RNA, 27 nt, Human
cucacccaggcugagggugccuuugug

SEQ ID NO: 8618 - RNA, 20 nt, Human
aagacuuaggagaaaauggu

SEQ ID NO: 8619 - RNA, 23 nt, Human
acaacaacagcugagaucacuua

SEQ ID NO: 8620 - RNA, 28 nt, Human
ugugcuccguagcuucuagucuggaacu

SEQ ID NO: 8621 - RNA, 24 nt, Human
gguagaaaagucccaagaucuuca

SEQ ID NO: 8622 - RNA, 20 nt, Human
uuuaaggcuguuuugaugag

SEQ ID NO: 8623 - RNA, 22 nt, Human
cugagucugcaucauccuccug

SEQ ID NO: 8624 - RNA, 21 nt, Human
ucuguacccucuccuucuguu

SEQ ID NO: 8625 - RNA, 22 nt, Human
ucaucccacuuccucagcccca

SEQ ID NO: 8626 - RNA, 22 nt, Human
uuaccuuugucucuucauaccg

SEQ ID NO: 8627 - RNA, 27 nt, Human
aagacccagagaaguccagacuggacu

SEQ ID NO: 8628 - RNA, 20 nt, Human
ucuuuugagaggagaugugu

SEQ ID NO: 8629 - RNA, 23 nt, Human
gagucccagggaccgcuggcugc

SEQ ID NO: 8630 - RNA, 23 nt, Human
uauucauucuguuugcuuaauuc

SEQ ID NO: 8631 - RNA, 22 nt, Human
uugugccauugcacugcagccu

SEQ ID NO: 8632 - RNA, 22 nt, Human
accagccuggacaauauaguga

SEQ ID NO: 8633 - RNA, 22 nt, Human
cugccacugcacuuagcacuuu

SEQ ID NO: 8634 - RNA, 22 nt, Human
uagucuuguuuacuucuucuua

SEQ ID NO: 8635 - RNA, 21 nt, Human
aaccaguucuacuaaugcuuc

SEQ ID NO: 8636 - RNA, 25 nt, Human
ggcagggugggggagggagguuccu

SEQ ID NO: 8637 - RNA, 20 nt, Human
cuaagaaugaggagaaagca

SEQ ID NO: 8638 - RNA, 21 nt, Human
gauguuggguggcuuuuguuc

SEQ ID NO: 8639 - RNA, 23 nt, Human
acccggcugcugugcacugggac

SEQ ID NO: 8640 - RNA, 22 nt, Human
aagugcuuuacuuaaguguuga

SEQ ID NO: 8641 - RNA, 22 nt, Human
ggagugagacccaggagccgga

SEQ ID NO: 8642 - RNA, 30 nt, Human
ccccaucucgggggcuugcugcacugcuug

SEQ ID NO: 8643 - RNA, 24 nt, Human
augaaaguacagacagcuucauug

SEQ ID NO: 8644 - RNA, 22 nt, Human
ggcaaaguuugcuuugcuuggg

SEQ ID NO: 8645 - RNA, 26 nt, Human
cagacagcuccagacacucaggcauu

SEQ ID NO: 8646 - RNA, 21 nt, Human
cagggcuuggguaacagcugc

SEQ ID NO: 8647 - RNA, 21 nt, Human
cuuacuugagccuuuaaugga

SEQ ID NO: 8648 - RNA, 29 nt, Human
ugugccgggaggcagccacagggaagcuc

SEQ ID NO: 8649 - RNA, 22 nt, Human
ccucccauggcccugcuguggc

SEQ ID NO: 8650 - RNA, 27 nt, Human
ugccccucucugggccucagaggccuu

SEQ ID NO: 8651 - RNA, 32 nt, Human
gagagggauauggagagcaggugguggaauca

SEQ ID NO: 8652 - RNA, 27 nt, Human
gcugggggaggcaccccacagacucag

SEQ ID NO: 8653 - RNA, 27 nt, Human
cucuaauuuccccucuguccuccaucc

SEQ ID NO: 8654 - RNA, 21 nt, Human
cuugauuuucuuuuccuuuau

SEQ ID NO: 8655 - RNA, 21 nt, Human
caguuuucagcacuagucuua

SEQ ID NO: 8656 - RNA, 22 nt, Human
gcucacugaaaccucugccuuc

SEQ ID NO: 8657 - RNA, 22 nt, Human
gcuuuuuuagaggaagaccaaa

SEQ ID NO: 8658 - RNA, 19 nt, Human
ccuuucucucucuuaagcc

SEQ ID NO: 8659 - RNA, 27 nt, Human
aaccuauacuaaaaauuaguuccauaa

SEQ ID NO: 8660 - RNA, 21 nt, Human
cugccccagggccaauccaag

SEQ ID NO: 8661 - RNA, 26 nt, Human
ugugacagcugcugcccacgcaugug

SEQ ID NO: 8662 - RNA, 25 nt, Human
uggcggucaccauggcaaugcggga

SEQ ID NO: 8663 - RNA, 24 nt, Human
aaaacaaaagaaucacguuuuccc

SEQ ID NO: 8664 - RNA, 21 nt, Human
cuucaccucucugugccucag

SEQ ID NO: 8665 - RNA, 22 nt, Human
aggcugaggcaggaggaucacu

SEQ ID NO: 8666 - RNA, 24 nt, Human
uacaacacaaagagaaaaagaaau

SEQ ID NO: 8667 - RNA, 25 nt, Human
auggaguuuauauuuguuauuucua

SEQ ID NO: 8668 - RNA, 21 nt, Human
cagugguuagcauugccgcua

SEQ ID NO: 8669 - RNA, 22 nt, Human
ggacguggccggcgcucuccag

SEQ ID NO: 8670 - RNA, 22 nt, Human
uccagugagggcagcagguguc

SEQ ID NO: 8671 - RNA, 20 nt, Human
aacaaccaaagaaaauuggu

SEQ ID NO: 8672 - RNA, 22 nt, Human
cuggcagcgcugcacuugccau

SEQ ID NO: 8673 - RNA, 24 nt, Human
uugccaagaccuuucaaagccauu

SEQ ID NO: 8674 - RNA, 21 nt, Human
gcagcugcugccucucuccug

SEQ ID NO: 8675 - RNA, 17 nt, Human
auacuucucccucgagg

SEQ ID NO: 8676 - RNA, 22 nt, Human
gagcuuugacucaggagccugu

SEQ ID NO: 8677 - RNA, 19 nt, Human
ggacaaucgccagagggug

SEQ ID NO: 8678 - RNA, 26 nt, Human
agacuccauguaguuacuuccuuuaa

SEQ ID NO: 8679 - RNA, 26 nt, Human
agcccuagggagccccugugcugccc

SEQ ID NO: 8680 - RNA, 21 nt, Human
cucuagaucgccuagucucaa

SEQ ID NO: 8681 - RNA, 27 nt, Human
ccuguucugggaaucaauguaacagcc

SEQ ID NO: 8682 - RNA, 23 nt, Human
ggugugucuguugaucuguguuu

SEQ ID NO: 8683 - RNA, 20 nt, Human
aguaucuguaccugccccca

SEQ ID NO: 8684 - RNA, 27 nt, Human
uagguguagcagagaucucgcuccugu

SEQ ID NO: 8685 - RNA, 27 nt, Human
uucauucuaguauucuuaauuauuuau

SEQ ID NO: 8686 - RNA, 24 nt, Human
aggacuccccaggccaggccacca

SEQ ID NO: 8687 - RNA, 23 nt, Human
cuuauuagaugguuccacucagg

SEQ ID NO: 8688 - RNA, 20 nt, Human
aacagaugacuucuuugcag

SEQ ID NO: 8689 - RNA, 26 nt, Human
uugugaguugcauauuaagauuacug

SEQ ID NO: 8690 - RNA, 21 nt, Human
aguuauucacaccagcaucau

SEQ ID NO: 8691 - RNA, 21 nt, Human
cucucaucuagcacugaguca

SEQ ID NO: 8692 - RNA, 19 nt, Human
uguggaccuuagaauacag

SEQ ID NO: 8693 - RNA, 20 nt, Human
cccagacaacagcccaggca

SEQ ID NO: 8694 - RNA, 26 nt, Human
aguauguguccaaugcugccuuccca

SEQ ID NO: 8695 - RNA, 26 nt, Human
ucccacccucaccauuugcaaguggc

SEQ ID NO: 8696 - RNA, 21 nt, Human
gccuggcccuaccuccugguc

SEQ ID NO: 8697 - RNA, 21 nt, Human
cgcuugaaccugggaggcaga

SEQ ID NO: 8698 - RNA, 20 nt, Human
cccaguuugauaccugcacu

SEQ ID NO: 8699 - RNA, 20 nt, Human
cucuccacuccuccucacua

SEQ ID NO: 8700 - RNA, 24 nt, Human
cccucacgcucuccaucauaggcu

SEQ ID NO: 8701 - RNA, 26 nt, Human
accccugguuaaguuucugaagacuu

SEQ ID NO: 8702 - RNA, 28 nt, Human
ucccaggcugcuccagacauggggguug

SEQ ID NO: 8703 - RNA, 20 nt, Human
gcucugguggcgggcagcag

SEQ ID NO: 8704 - RNA, 21 nt, Human
aaacccagggcaacaagcccg

SEQ ID NO: 8705 - RNA, 22 nt, Human
gcagggacugccuucuccuucc

SEQ ID NO: 8706 - RNA, 23 nt, Human
aaccucuggagcuagaagcuccu

SEQ ID NO: 8707 - RNA, 22 nt, Human
auuuaagcauuguuugcuuauu

SEQ ID NO: 8708 - RNA, 23 nt, Human
acaguacaaaaaacacuggcacu

SEQ ID NO: 8709 - RNA, 24 nt, Human
ucugcccucagagagcucuuugca

SEQ ID NO: 8710 - RNA, 19 nt, Human
ggaaagggagccugcucuc

SEQ ID NO: 8711 - RNA, 22 nt, Human
aaagagcugggauuacaggugu

SEQ ID NO: 8712 - RNA, 24 nt, Human
gacacgugucuucuaguucugccu

SEQ ID NO: 8713 - RNA, 20 nt, Human
uccaggccucagagucccgc

SEQ ID NO: 8714 - RNA, 20 nt, Human
uuucugcugcaagguccccu

SEQ ID NO: 8715 - RNA, 21 nt, Human
ccucuacuugucccuuuggcc

SEQ ID NO: 8716 - RNA, 24 nt, Human
uugguaaaauaaucaguguuucca

SEQ ID NO: 8717 - RNA, 20 nt, Human
uagauauuguuuucuguaaa

SEQ ID NO: 8718 - RNA, 19 nt, Human
gauccccuggaaacccacc

SEQ ID NO: 8719 - RNA, 21 nt, Human
gaccuaaaauacugacuuuag

SEQ ID NO: 8720 - RNA, 25 nt, Human
ccucuacuguaaaugugccuuagcc

SEQ ID NO: 8721 - RNA, 25 nt, Human
aaacagagacaagaaaggcagacac

SEQ ID NO: 8722 - RNA, 25 nt, Human
gggauuacaggcgugagcccccacg

SEQ ID NO: 8723 - RNA, 22 nt, Human
cacaaucccguggacagagcuu

SEQ ID NO: 8724 - RNA, 21 nt, Human
cagggcccagagcuuuggcca

SEQ ID NO: 8725 - RNA, 24 nt, Human
caccugaggucaggaguuccagac

SEQ ID NO: 8726 - RNA, 24 nt, Human
uggcagccacacucacccagccuc

SEQ ID NO: 8727 - RNA, 21 nt, Human
uuuccguauuucuucuuuuca

SEQ ID NO: 8728 - RNA, 26 nt, Human
ugguaugggcagcccaagguugcaug

SEQ ID NO: 8729 - RNA, 30 nt, Human
uccacggagugagcuggggcugaaguuguc

SEQ ID NO: 8730 - RNA, 27 nt, Human
guugaggcauggagcagagugauggga

SEQ ID NO: 8731 - RNA, 27 nt, Human
ggaggcagcagcccagacgcggcacag

SEQ ID NO: 8732 - RNA, 27 nt, Human
agcucacugcagcuuugaucugaccgc

SEQ ID NO: 8733 - RNA, 25 nt, Human
agggaggcugaagagauuucaaaga

SEQ ID NO: 8734 - RNA, 23 nt, Human
cugcugcccaaucuccaucuguc

SEQ ID NO: 8735 - RNA, 20 nt, Human
gcagcaccuggaucuugccu

SEQ ID NO: 8736 - RNA, 30 nt, Human
cccuuuguugcaggaaugugcgucgggcua

SEQ ID NO: 8737 - RNA, 24 nt, Human
ugucacccaaguuggagugcagug

SEQ ID NO: 8738 - RNA, 21 nt, Human
cauguucucucacccgcuuca

SEQ ID NO: 8739 - RNA, 26 nt, Human
caguuuguuaaaaagcuuuagaggag

SEQ ID NO: 8740 - RNA, 21 nt, Human
gggcucucuccacccuucuca

SEQ ID NO: 8741 - RNA, 23 nt, Human
acagggguuucuuccauguugcc

SEQ ID NO: 8742 - RNA, 25 nt, Human
cacugcugggcugcgagcugggccc

SEQ ID NO: 8743 - RNA, 22 nt, Human
ggccugcccccgggagccaaag

SEQ ID NO: 8744 - RNA, 23 nt, Human
cauaccuguaaucccagcuacuc

SEQ ID NO: 8745 - RNA, 27 nt, Human
cagacccacagaagguguucaaacaca

SEQ ID NO: 8746 - RNA, 23 nt, Human
ggcaggagaauggcaugaaccug

SEQ ID NO: 8747 - RNA, 25 nt, Human
agggguuggcugggaggaggaagac

SEQ ID NO: 8748 - RNA, 22 nt, Human
gugugggagggagggaggagga

SEQ ID NO: 8749 - RNA, 22 nt, Human
gucaccaggcuggagugcagug

SEQ ID NO: 8750 - RNA, 29 nt, Human
ucugcugcugcuuuaaaagcucuguccuu

SEQ ID NO: 8751 - RNA, 21 nt, Human
ggcucacgccuguaaucccag

SEQ ID NO: 8752 - RNA, 21 nt, Human
ucauacuuagaaacaaaaaga

SEQ ID NO: 8753 - RNA, 24 nt, Human
uugcauggauguagggcuuggggu

SEQ ID NO: 8754 - RNA, 26 nt, Human
ucuguugccauuaaauguaugagacu

SEQ ID NO: 8755 - RNA, 24 nt, Human
uuccuuuggcggaccuuggaaucc

SEQ ID NO: 8756 - RNA, 18 nt, Human
ccugcagccucccguguc

SEQ ID NO: 8757 - RNA, 19 nt, Human
agauccuugggaacacugu

SEQ ID NO: 8758 - RNA, 22 nt, Human
uauucgggugugagucuuuuca

SEQ ID NO: 8759 - RNA, 22 nt, Human
ccucuugccaccugcugcugcu

SEQ ID NO: 8760 - RNA, 21 nt, Human
gucuucucccugccauguccc

SEQ ID NO: 8761 - RNA, 26 nt, Human
cccgccccaggcccugcucuuccugc

SEQ ID NO: 8762 - RNA, 19 nt, Human
gaagaauuuacuuuggaaa

SEQ ID NO: 8763 - RNA, 19 nt, Human
ugaaauucauguuuucuca

SEQ ID NO: 8764 - RNA, 23 nt, Human
uugcguccuuucucuucuccgcc

SEQ ID NO: 8765 - RNA, 25 nt, Human
uuucuaccguccuugucauaacuuu

SEQ ID NO: 8766 - RNA, 23 nt, Human
aucugcugggccaccagccacuu

SEQ ID NO: 8767 - RNA, 22 nt, Human
cuuugcagaagcucuaggcccu

SEQ ID NO: 8768 - RNA, 19 nt, Human
gcuacauuccuaacucaua

SEQ ID NO: 8769 - RNA, 20 nt, Human
uuacuuucacauacagcccu

SEQ ID NO: 8770 - RNA, 22 nt, Human
ccucaaagcagcgccugccucc

SEQ ID NO: 8771 - RNA, 20 nt, Human
cuccauacagcuucugugcu

SEQ ID NO: 8772 - RNA, 21 nt, Human
ccaauuaucuuaacauuggaa

SEQ ID NO: 8773 - RNA, 22 nt, Human
uugccaggcuggagugcagugg

SEQ ID NO: 8774 - RNA, 21 nt, Human
gcugucaaaaugacauugaug

SEQ ID NO: 8775 - RNA, 22 nt, Human
cgagcaggggagagcgagacca

SEQ ID NO: 8776 - RNA, 26 nt, Human
ccaagagcagaggcagcgaguugugg

SEQ ID NO: 8777 - RNA, 20 nt, Human
gguauuuugguaugugcaaa

SEQ ID NO: 8778 - RNA, 27 nt, Human
guugcccaggcuggucgcgaacuccug

SEQ ID NO: 8779 - RNA, 26 nt, Human
cgagcccagcuggaguaggagcgcgg

SEQ ID NO: 8780 - RNA, 21 nt, Human
ugagccaagauugcaccacug

SEQ ID NO: 8781 - RNA, 27 nt, Human
aggauauugauuuaaaauuguucuacu

SEQ ID NO: 8782 - RNA, 22 nt, Human
ccagaguacugggauuacaggc

SEQ ID NO: 8783 - RNA, 20 nt, Human
cgagugcuggggaugggccu

SEQ ID NO: 8784 - RNA, 20 nt, Human
caguguccauggacucagaa

SEQ ID NO: 8785 - RNA, 26 nt, Human
aggucuugagggaauagugaaacaca

SEQ ID NO: 8786 - RNA, 23 nt, Human
guugcccaggcaagagugcagug

SEQ ID NO: 8787 - RNA, 22 nt, Human
gcucacugcaagcucuaccucu

SEQ ID NO: 8788 - RNA, 26 nt, Human
uccuccuccuccucaccaagggccca

SEQ ID NO: 8789 - RNA, 27 nt, Human
uguagcucugguuguauacuuuugcuu

SEQ ID NO: 8790 - RNA, 22 nt, Human
cacaaauguuccacaaggcggg

SEQ ID NO: 8791 - RNA, 26 nt, Human
ccuguuuaguuuuuaaagauggaacu

SEQ ID NO: 8792 - RNA, 22 nt, Human
ccaggagauggaaguugcagug

SEQ ID NO: 8793 - RNA, 27 nt, Human
aucccacaagacaugcaucuccacaag

SEQ ID NO: 8794 - RNA, 23 nt, Human
ucgaauauuuaauaaaacugaua

SEQ ID NO: 8795 - RNA, 27 nt, Human
ugccaagcauuccauugacugccugua

SEQ ID NO: 8796 - RNA, 26 nt, Human
ugcagcuagagaauuauaguucacua

SEQ ID NO: 8797 - RNA, 24 nt, Human
accaguugguuuuucauuuuuugu

SEQ ID NO: 8798 - RNA, 25 nt, Human
ugcauugucuugucacaccucccuc

SEQ ID NO: 8799 - RNA, 20 nt, Human
uuuccaucccaguucuggga

SEQ ID NO: 8800 - RNA, 22 nt, Human
ggcgcugugcucgcuccuggau

SEQ ID NO: 8801 - RNA, 23 nt, Human
aauucaaagcugcagugagcugu

SEQ ID NO: 8802 - RNA, 30 nt, Human
ucuuuuccauuucuuuccuccuagaaucug

SEQ ID NO: 8803 - RNA, 26 nt, Human
gaagccaagcugcuguuuggcuacug

SEQ ID NO: 8804 - RNA, 27 nt, Human
acacagcuccauuaugcaauccauucc

SEQ ID NO: 8805 - RNA, 23 nt, Human
uuuucauuuuacauccucucuau

SEQ ID NO: 8806 - RNA, 20 nt, Human
uguuacugacaguugccuug

SEQ ID NO: 8807 - RNA, 26 nt, Human
guguuuucacacaaacugcuagaauu

SEQ ID NO: 8808 - RNA, 27 nt, Human
acugaacauguauguauguugcuuaga

SEQ ID NO: 8809 - RNA, 21 nt, Human
ucacccaggcuggaaugcagu

SEQ ID NO: 8810 - RNA, 30 nt, Human
guggcccagcuggcuggaguccaggcagcc

SEQ ID NO: 8811 - RNA, 27 nt, Human
agccccauccaggugccgcggccagcu

SEQ ID NO: 8812 - RNA, 22 nt, Human
cucugcaauagacagcuacugu

SEQ ID NO: 8813 - RNA, 23 nt, Human
auugguggccacaccaccuccuu

SEQ ID NO: 8814 - RNA, 21 nt, Human
cagcugacacuggaccccaac

SEQ ID NO: 8815 - RNA, 23 nt, Human
ccuccugccggcuccuugguucu

SEQ ID NO: 8816 - RNA, 20 nt, Human
aguguuucaaauuaugggaa

SEQ ID NO: 8817 - RNA, 20 nt, Human
aucucaggcuggagugcagu

SEQ ID NO: 8818 - RNA, 24 nt, Human
ggaaggaggugcuggagcaguuga

SEQ ID NO: 8819 - RNA, 21 nt, Human
aggauggcgccaccaccagcu

SEQ ID NO: 8820 - RNA, 20 nt, Human
aacucauauguucccaauua

SEQ ID NO: 8821 - RNA, 21 nt, Human
aaagcugaaggaagaggauca

SEQ ID NO: 8822 - RNA, 23 nt, Human
cuauccaccugggggugucgcag

SEQ ID NO: 8823 - RNA, 23 nt, Human
cccaccugauccugcacuguccu

SEQ ID NO: 8824 - RNA, 29 nt, Human
agagaccagccucccucccugugccagac

SEQ ID NO: 8825 - RNA, 22 nt, Human
ggcugggggaagaagcucucuc

SEQ ID NO: 8826 - RNA, 22 nt, Human
ggugagccagcccuggggaccc

SEQ ID NO: 8827 - RNA, 27 nt, Human
gcugcugggccgcuccccuuggaggcc

SEQ ID NO: 8828 - RNA, 29 nt, Human
gucgcugcccuucacaccuuuuggugcua

SEQ ID NO: 8829 - RNA, 22 nt, Human
ggggugagaacccaagcguugg

SEQ ID NO: 8830 - RNA, 21 nt, Human
auugcccaggcuggagugcaa

SEQ ID NO: 8831 - RNA, 25 nt, Human
agggcauuuagaggaagaaggcuga

SEQ ID NO: 8832 - RNA, 24 nt, Human
aacaucauauauuuguaauaguga

SEQ ID NO: 8833 - RNA, 27 nt, Human
ugcauggucagacucggugucagguac

SEQ ID NO: 8834 - RNA, 23 nt, Human
gcugggggaaggguggucugagc

SEQ ID NO: 8835 - RNA, 22 nt, Human
gcaugagccacggcgccuggcc

SEQ ID NO: 8836 - RNA, 23 nt, Human
cuggagaggcuagaaccuggaga

SEQ ID NO: 8837 - RNA, 21 nt, Human
auuucuccaggagccuggcac

SEQ ID NO: 8838 - RNA, 24 nt, Human
ccuccaucugugcuuauuacuuga

SEQ ID NO: 8839 - RNA, 22 nt, Human
aaccgggcuggagugcaguggu

SEQ ID NO: 8840 - RNA, 22 nt, Human
gggcagcagaaggcugagagga

SEQ ID NO: 8841 - RNA, 21 nt, Human
agcugacccccugcugccauc

SEQ ID NO: 8842 - RNA, 26 nt, Human
cucaggcuggggucugcagugcagca

SEQ ID NO: 8843 - RNA, 27 nt, Human
uuagaagcagaaaaggucuuggugccu

SEQ ID NO: 8844 - RNA, 21 nt, Human
ucagcugguaauuccuccuca

SEQ ID NO: 8845 - RNA, 23 nt, Human
ggaucagaacaacagccugccac

SEQ ID NO: 8846 - RNA, 21 nt, Human
ugccuguaauuccagcacuuu

SEQ ID NO: 8847 - RNA, 21 nt, Human
ugucuguaaucccagcacuuu

SEQ ID NO: 8848 - RNA, 19 nt, Human
ccagcacuuugggaagcug

SEQ ID NO: 8849 - RNA, 21 nt, Human
aauacuuggcuuggaaauuua

SEQ ID NO: 8850 - RNA, 26 nt, Human
uugcacaggcuggcugcguguucuug

SEQ ID NO: 8851 - RNA, 25 nt, Human
ccccacugcuaaggcugcuggcuuc

SEQ ID NO: 8852 - RNA, 23 nt, Human
augccuaaauucucauucuguua

SEQ ID NO: 8853 - RNA, 25 nt, Human
gcugacccugcagagggaaggggug

SEQ ID NO: 8854 - RNA, 20 nt, Human
aagauucuuacuuaaacuug

SEQ ID NO: 8855 - RNA, 23 nt, Human
cucuuuuguaacaugcuucccuu

SEQ ID NO: 8856 - RNA, 23 nt, Human
gccuuuggagcuagagcacccuu

SEQ ID NO: 8857 - RNA, 21 nt, Human
ggaaaagggaagagcuuucac

SEQ ID NO: 8858 - RNA, 21 nt, Human
cacuccucuccggccgggcgc

SEQ ID NO: 8859 - RNA, 23 nt, Human
aaaugccuaacaguacagagcca

SEQ ID NO: 8860 - RNA, 27 nt, Human
auuguauucccagccugugucccaugg

SEQ ID NO: 8861 - RNA, 26 nt, Human
gcacagccuggcuguggccuaaccug

SEQ ID NO: 8862 - RNA, 21 nt, Human
ggugagggcagagugugguga

SEQ ID NO: 8863 - RNA, 23 nt, Human
agguggaggccuuuagcauuuca

SEQ ID NO: 8864 - RNA, 17 nt, Human
uucauuucaaaaggaca

SEQ ID NO: 8865 - RNA, 18 nt, Human
ugggaaaguauuuuggaa

SEQ ID NO: 8866 - RNA, 22 nt, Human
gugaggccaucucugagcagug

SEQ ID NO: 8867 - RNA, 22 nt, Human
ccugcacucccgaccuuagcuu

SEQ ID NO: 8868 - RNA, 19 nt, Human
caggcugaagagagggaca

SEQ ID NO: 8869 - RNA, 20 nt, Human
gaaaccuuaaacauuuuugg

SEQ ID NO: 8870 - RNA, 27 nt, Human
ugucucucuuuguacugucacucucau

SEQ ID NO: 8871 - RNA, 21 nt, Human
gccucucuccccuuggcgucu

SEQ ID NO: 8872 - RNA, 21 nt, Human
gguggugugucucaggacaaa

SEQ ID NO: 8873 - RNA, 24 nt, Human
uccaacaacucuguagagcucucu

SEQ ID NO: 8874 - RNA, 27 nt, Human
ucauugcacuccagccuggucaacaag

SEQ ID NO: 8875 - RNA, 22 nt, Human
uuccagcaauucuucugccuca

SEQ ID NO: 8876 - RNA, 18 nt, Human
uuggagccaggauggguc

SEQ ID NO: 8877 - RNA, 25 nt, Human
uucucagaagugaaaaagacuucaa

SEQ ID NO: 8878 - RNA, 22 nt, Human
cugccucccggguucaagcaau

SEQ ID NO: 8879 - RNA, 20 nt, Human
gccugggccugacauggccc

SEQ ID NO: 8880 - RNA, 20 nt, Human
gaccugcaaccaucugacuu

SEQ ID NO: 8881 - RNA, 20 nt, Human
acuggucucgaacuccuggg

SEQ ID NO: 8882 - RNA, 20 nt, Human
uuuuaaugccuaugcauuua

SEQ ID NO: 8883 - RNA, 25 nt, Human
uccucaaggaaucucuuaaguuuug

SEQ ID NO: 8884 - RNA, 19 nt, Human
agacaugcaucaagaaaua

SEQ ID NO: 8885 - RNA, 21 nt, Human
gguggagggaagcugaggaua

SEQ ID NO: 8886 - RNA, 21 nt, Human
cguucauccacucugccugcu

SEQ ID NO: 8887 - RNA, 19 nt, Human
ccacacacauacacacaua

SEQ ID NO: 8888 - RNA, 18 nt, Human
uaacugccugcugcucag

SEQ ID NO: 8889 - RNA, 22 nt, Human
uggcugaggcaggagaaucgcu

SEQ ID NO: 8890 - RNA, 24 nt, Human
acccaucuccaaccaugagcaaug

SEQ ID NO: 8891 - RNA, 22 nt, Human
cuaaccucagauaagugcagug

SEQ ID NO: 8892 - RNA, 22 nt, Human
ccaaauugcugggauuacaggc

SEQ ID NO: 8893 - RNA, 20 nt, Human
aaaugauucucuaaacuuuc

SEQ ID NO: 8894 - RNA, 20 nt, Human
agucagguuccagcuaguua

SEQ ID NO: 8895 - RNA, 23 nt, Human
acacauucucucagagcucaagg

SEQ ID NO: 8896 - RNA, 22 nt, Human
ggcuggcuagcuaguuucuaca

SEQ ID NO: 8897 - RNA, 19 nt, Human
aucacauuaaagcuuuuca

SEQ ID NO: 8898 - RNA, 26 nt, Human
gagggagagaggggaggcaaagcuga

SEQ ID NO: 8899 - RNA, 30 nt, Human
ggggccaaaaggaaaaagcuccaugugccu

SEQ ID NO: 8900 - RNA, 25 nt, Human
gcacaucuucucuucaguuuagaga

SEQ ID NO: 8901 - RNA, 22 nt, Human
aacacaaauauuucuucaaggg

SEQ ID NO: 8902 - RNA, 20 nt, Human
aagaggcuggggauauuuca

SEQ ID NO: 8903 - RNA, 26 nt, Human
cucuggccccucguugccuuuucacu

SEQ ID NO: 8904 - RNA, 23 nt, Human
ucauccaggcuggacaguucagu

SEQ ID NO: 8905 - RNA, 29 nt, Human
aaucccaauguuugacaaacacagccaag

SEQ ID NO: 8906 - RNA, 26 nt, Human
ggccccgcccccuuccuggccugcau

SEQ ID NO: 8907 - RNA, 20 nt, Human
uuggaagcuucagcaaccag

SEQ ID NO: 8908 - RNA, 22 nt, Human
caaccaccuccagccugggaga

SEQ ID NO: 8909 - RNA, 21 nt, Human
ugacugggcucaugccuccaa

SEQ ID NO: 8910 - RNA, 22 nt, Human
aguauuuuuagaauggcagcua

SEQ ID NO: 8911 - RNA, 24 nt, Human
uuaacagcaacauaaggaucucca

SEQ ID NO: 8912 - RNA, 20 nt, Human
aguggccucgaacuccuggc

SEQ ID NO: 8913 - RNA, 26 nt, Human
aggaaggagacucaccucugccucaa

SEQ ID NO: 8914 - RNA, 26 nt, Human
ccugcucuucccggucauggaggcgc

SEQ ID NO: 8915 - RNA, 26 nt, Human
cuggaaggaagagguugcagugagcc

SEQ ID NO: 8916 - RNA, 26 nt, Human
acacccuucacgguugcuacccaggc

SEQ ID NO: 8917 - RNA, 27 nt, Human
gaguagcugggacuacaggcacgugug

SEQ ID NO: 8918 - RNA, 24 nt, Human
aguucacguuucauguaauccuca

SEQ ID NO: 8919 - RNA, 21 nt, Human
ugguggaauuaauuucugcca

SEQ ID NO: 8920 - RNA, 20 nt, Human
uuggggucuccugaagaugc

SEQ ID NO: 8921 - RNA, 22 nt, Human
uaaggggugggaagaacaggaa

SEQ ID NO: 8922 - RNA, 31 nt, Human
cugccucccaagguccucucaguucucuccc

SEQ ID NO: 8923 - RNA, 17 nt, Human
acucugguguguuaaca

SEQ ID NO: 8924 - RNA, 22 nt, Human
gacuuguuucuccaugggcucu

SEQ ID NO: 8925 - RNA, 26 nt, Human
cacccaggcggaucugcaagcaccuc

SEQ ID NO: 8926 - RNA, 24 nt, Human
ggaaaucucacugggucucucuca

SEQ ID NO: 8927 - RNA, 19 nt, Human
ugccuuccuucucuuccca

SEQ ID NO: 8928 - RNA, 22 nt, Human
caaaccuauuuguaaccaaaga

SEQ ID NO: 8929 - RNA, 23 nt, Human
cuccaagaaacaucauucaccca

SEQ ID NO: 8930 - RNA, 22 nt, Human
ggccucgggacuucccaccacc

SEQ ID NO: 8931 - RNA, 20 nt, Human
auucaauaaaguguaauauu

SEQ ID NO: 8932 - RNA, 19 nt, Human
uguuccccucacuccacuu

SEQ ID NO: 8933 - RNA, 23 nt, Human
cccaggaggcggagguaguggug

SEQ ID NO: 8934 - RNA, 24 nt, Human
ugggcgacagagucuccaucuggg

SEQ ID NO: 8935 - RNA, 23 nt, Human
ccuggacacacacuuccagacac

SEQ ID NO: 8936 - RNA, 28 nt, Human
ugcucucucaacaucacauacagcuuca

SEQ ID NO: 8937 - RNA, 21 nt, Human
acauucagacccacagaaagg

SEQ ID NO: 8938 - RNA, 24 nt, Human
gcauccggccugugcugggcaugg

SEQ ID NO: 8939 - RNA, 25 nt, Human
aggauagcagagaagccugucugua

SEQ ID NO: 8940 - RNA, 22 nt, Human
ucacuuaccuucuucucuuuca

SEQ ID NO: 8941 - RNA, 25 nt, Human
auucagugccucugaaagacuacca

SEQ ID NO: 8942 - RNA, 22 nt, Human
cucgcucgguccggcugccuca

SEQ ID NO: 8943 - RNA, 26 nt, Human
cucauccauccacagagcagugcagu

SEQ ID NO: 8944 - RNA, 24 nt, Human
cuccacuccucucaacugccucag

SEQ ID NO: 8945 - RNA, 21 nt, Human
cugagccgacugugaauucgg

SEQ ID NO: 8946 - RNA, 21 nt, Human
aagugugauuugaauauaugc

SEQ ID NO: 8947 - RNA, 22 nt, Human
guugucuuguccccucuugacc

SEQ ID NO: 8948 - RNA, 22 nt, Human
cccggccccaaaccacaggggc

SEQ ID NO: 8949 - RNA, 22 nt, Human
cugggcacgagauuugcucuga

SEQ ID NO: 8950 - RNA, 26 nt, Human
uggaaagacuggcaaagucuuuugga

SEQ ID NO: 8951 - RNA, 22 nt, Human
aaccauuucagggcuucuugaa

SEQ ID NO: 8952 - RNA, 26 nt, Human
ggcugcugugccccuugggugugggu

SEQ ID NO: 8953 - RNA, 23 nt, Human
ggaaggcagggguggggccgugg

SEQ ID NO: 8954 - RNA, 19 nt, Human
gauccagcaggcaugggga

SEQ ID NO: 8955 - RNA, 25 nt, Human
uucaguggggaccaagcagucauuu

SEQ ID NO: 8956 - RNA, 22 nt, Human
ugagguggggaccaaaggaaac

SEQ ID NO: 8957 - RNA, 26 nt, Human
guuugcgaucccagcucuccuguugg

SEQ ID NO: 8958 - RNA, 24 nt, Human
gggcgccuguaaucccagcuacuc

SEQ ID NO: 8959 - RNA, 22 nt, Human
guggugcauuuuuguaaguuag

SEQ ID NO: 8960 - RNA, 24 nt, Human
ggcugguggccgucuccacucccu

SEQ ID NO: 8961 - RNA, 21 nt, Human
guucccggucccgaguacagu

SEQ ID NO: 8962 - RNA, 27 nt, Human
gugagccacaugcaggcugaugaaugc

SEQ ID NO: 8963 - RNA, 23 nt, Human
ggcaaaaacaaaggagcugaugg

SEQ ID NO: 8964 - RNA, 22 nt, Human
cugcaaccuccacuucccaggu

SEQ ID NO: 8965 - RNA, 21 nt, Human
cucuucucugcugaguuugcc

SEQ ID NO: 8966 - RNA, 20 nt, Human
agguugccucucacaaugaa

SEQ ID NO: 8967 - RNA, 26 nt, Human
ugucugccuauaggagggggagcugu

SEQ ID NO: 8968 - RNA, 22 nt, Human
gcaacuugaauaauacugugaa

SEQ ID NO: 8969 - RNA, 26 nt, Human
cgaugccacccggugccgacugaggc

SEQ ID NO: 8970 - RNA, 21 nt, Human
ugcagccugaauuuugaagga

SEQ ID NO: 8971 - RNA, 24 nt, Human
cucuucucuccccuuuuccuucag

SEQ ID NO: 8972 - RNA, 24 nt, Human
cacacuugcaguguagcccaguuu

SEQ ID NO: 8973 - RNA, 23 nt, Human
uagaucauguucacugcaaugcu

SEQ ID NO: 8974 - RNA, 25 nt, Human
uuccugaacccuccugagcgcccgu

SEQ ID NO: 8975 - RNA, 21 nt, Human
cccucuuacucauuuguaguc

SEQ ID NO: 8976 - RNA, 26 nt, Human
uuccuccaauccccaguuuguauuua

SEQ ID NO: 8977 - RNA, 26 nt, Human
cuugcuuucaagaugaugaccacaca

SEQ ID NO: 8978 - RNA, 26 nt, Human
uugccucucuccugugggccucuguc

SEQ ID NO: 8979 - RNA, 16 nt, Human
guuaucucccacgccu

SEQ ID NO: 8980 - RNA, 16 nt, Human
ccuccacuauaagucu

SEQ ID NO: 8981 - RNA, 21 nt, Human
gccaagcugcaucagccgcac

SEQ ID NO: 8982 - RNA, 22 nt, Human
cagggaggggccuggggaaagc

SEQ ID NO: 8983 - RNA, 24 nt, Human
uugggaggcugaggcaggagaauc

SEQ ID NO: 8984 - RNA, 23 nt, Human
acccugauggcugcuccaugagg

SEQ ID NO: 8985 - RNA, 22 nt, Human
cucaagcgauucuccugccuca

SEQ ID NO: 8986 - RNA, 25 nt, Human
cauggccguugucgucgccgccgcg

SEQ ID NO: 8987 - RNA, 27 nt, Human
ccuguguuucuagggaaaugaaagaaa

SEQ ID NO: 8988 - RNA, 21 nt, Human
cuucugagcccccgacccgag

SEQ ID NO: 8989 - RNA, 23 nt, Human
uaggcuaaggugaguuuggugca

SEQ ID NO: 8990 - RNA, 26 nt, Human
cacccaggucgggcggugggggcgag

SEQ ID NO: 8991 - RNA, 19 nt, Human
auauagacaaaacagcccu

SEQ ID NO: 8992 - RNA, 17 nt, Human
accaacucaaugccuuu

SEQ ID NO: 8993 - RNA, 31 nt, Human
accagugcauccuucaucacagcaugugcaa

SEQ ID NO: 8994 - RNA, 23 nt, Human
cagagcagcagaaaaggcaguuc

SEQ ID NO: 8995 - RNA, 28 nt, Human
ucaguuaaggagcugugcaauaaccuuc

SEQ ID NO: 8996 - RNA, 22 nt, Human
cuaagcuggagugugguggcac

SEQ ID NO: 8997 - RNA, 27 nt, Human
ccccugcccugcagcuccaccaugagg

SEQ ID NO: 8998 - RNA, 22 nt, Human
gccaaagcucgccaacauggcg

SEQ ID NO: 8999 - RNA, 20 nt, Human
ggcuggucuccuggugucag

SEQ ID NO: 9000 - RNA, 22 nt, Human
acuauacuugaacaaaaggguc

SEQ ID NO: 9001 - RNA, 18 nt, Human
ugacucuucaggccaggu

SEQ ID NO: 9002 - RNA, 22 nt, Human
gacuacaggcaugagccaccau

SEQ ID NO: 9003 - RNA, 18 nt, Human
ggcccgggaucccgagca

SEQ ID NO: 9004 - RNA, 23 nt, Human
ugacugccugcagaaagaccagc

SEQ ID NO: 9005 - RNA, 23 nt, Human
gugggaaagggagauuuucuucu

SEQ ID NO: 9006 - RNA, 21 nt, Human
cccugugcucucccguggagg

SEQ ID NO: 9007 - RNA, 27 nt, Human
agggcauucaaaugggcugcugcuuag

SEQ ID NO: 9008 - RNA, 23 nt, Human
cauuguuucauguuaaugcagcu

SEQ ID NO: 9009 - RNA, 27 nt, Human
uccacacagaaggagcucaguauuuag

SEQ ID NO: 9010 - RNA, 21 nt, Human
agcauuuugcuaucuuuuuua

SEQ ID NO: 9011 - RNA, 26 nt, Human
caugcugugaacugcuguggggugug

SEQ ID NO: 9012 - RNA, 21 nt, Human
acccucagagaguucacacug

SEQ ID NO: 9013 - RNA, 20 nt, Human
uucccgucaucacagcagua

SEQ ID NO: 9014 - RNA, 22 nt, Human
uaucacacucuguuaaaaacac

SEQ ID NO: 9015 - RNA, 23 nt, Human
ugccgcccaggcuggacugcagu

SEQ ID NO: 9016 - RNA, 19 nt, Human
accuacuccauacugaggg

SEQ ID NO: 9017 - RNA, 27 nt, Human
acagagggauuuauuuuuaugaugcug

SEQ ID NO: 9018 - RNA, 27 nt, Human
aauagcagcgggcugggcacauccucu

SEQ ID NO: 9019 - RNA, 23 nt, Human
gagacaggagaccuggcacugga

SEQ ID NO: 9020 - RNA, 22 nt, Human
uuuugaucuuaaugcuucugaa

SEQ ID NO: 9021 - RNA, 21 nt, Human
gggagcugcagguggggaugg

SEQ ID NO: 9022 - RNA, 22 nt, Human
agcuggaggaauaucuacagca

SEQ ID NO: 9023 - RNA, 22 nt, Human
cuguauucaaaaacaaaugaca

SEQ ID NO: 9024 - RNA, 22 nt, Human
aacacagagagacagacuugag

SEQ ID NO: 9025 - RNA, 26 nt, Human
gacauccuccuucaggaacacgggga

SEQ ID NO: 9026 - RNA, 25 nt, Human
caugccugcgccugcugccugcuga

SEQ ID NO: 9027 - RNA, 20 nt, Human
aaacuauaaccacuagcucg

SEQ ID NO: 9028 - RNA, 22 nt, Human
aacgaugaaagaaagcacaucc

SEQ ID NO: 9029 - RNA, 26 nt, Human
uucauacccuguuaccauuuuggggu

SEQ ID NO: 9030 - RNA, 25 nt, Human
uucaguuggcucaucagccagcauu

SEQ ID NO: 9031 - RNA, 28 nt, Human
ucacuuagagacuggaguccugcuuaua

SEQ ID NO: 9032 - RNA, 27 nt, Human
ugccuguagucucagcuacucaggagg

SEQ ID NO: 9033 - RNA, 22 nt, Human
acuuccugaauuuuguguauua

SEQ ID NO: 9034 - RNA, 22 nt, Human
gggaaauuuucaugcacgcuua

SEQ ID NO: 9035 - RNA, 20 nt, Human
gcacuuggaaagguuucaag

SEQ ID NO: 9036 - RNA, 18 nt, Human
ucuguccuuucuauuggg

SEQ ID NO: 9037 - RNA, 21 nt, Human
cagaauuauuggucuucuggg

SEQ ID NO: 9038 - RNA, 27 nt, Human
auucuguuugccuuuuguuuucauugg

SEQ ID NO: 9039 - RNA, 22 nt, Human
cggaccacccagaguuuccucu

SEQ ID NO: 9040 - RNA, 24 nt, Human
gaaauauuuugcuaaucuuauaga

SEQ ID NO: 9041 - RNA, 24 nt, Human
gagccuguuuuuaacuuccuugcu

SEQ ID NO: 9042 - RNA, 23 nt, Human
gccauucagagacuggagugaga

SEQ ID NO: 9043 - RNA, 25 nt, Human
uucaacacauuuagugccucuuuca

SEQ ID NO: 9044 - RNA, 26 nt, Human
gugggcauagccagagcuguucgaac

SEQ ID NO: 9045 - RNA, 26 nt, Human
caacuugcuacuuaucauuuuuguau

SEQ ID NO: 9046 - RNA, 22 nt, Human
cugggagguggagcuugcagug

SEQ ID NO: 9047 - RNA, 19 nt, Human
cauggcuacacugcaacuu

SEQ ID NO: 9048 - RNA, 23 nt, Human
ggagagaagagugaucuggcuuc

SEQ ID NO: 9049 - RNA, 27 nt, Human
guuacccaggcuggucuucaacucuug

SEQ ID NO: 9050 - RNA, 20 nt, Human
gcugguuccaccaagcacag

SEQ ID NO: 9051 - RNA, 22 nt, Human
cagacugaagugcaguggcaca

SEQ ID NO: 9052 - RNA, 20 nt, Human
gcccaagaggacugagacug

SEQ ID NO: 9053 - RNA, 22 nt, Human
augagaucuuaagcaucuggug

SEQ ID NO: 9054 - RNA, 21 nt, Human
uugugagcccucuagggcagg

SEQ ID NO: 9055 - RNA, 28 nt, Human
uucgguggugaugugaaaggagagaauu

SEQ ID NO: 9056 - RNA, 20 nt, Human
ggccaaugacaccuaccuca

SEQ ID NO: 9057 - RNA, 19 nt, Human
cucccccgcccugcccugc

SEQ ID NO: 9058 - RNA, 24 nt, Human
cuggcagcagaagugggugcagga

SEQ ID NO: 9059 - RNA, 21 nt, Human
guuaccaccuccugccucaga

SEQ ID NO: 9060 - RNA, 27 nt, Human
cuuuuucuuggacuacuuuaauuugga

SEQ ID NO: 9061 - RNA, 19 nt, Human
guucgagagaaagcagggg

SEQ ID NO: 9062 - RNA, 26 nt, Human
cccucauucugcauuaauaauagcua

SEQ ID NO: 9063 - RNA, 26 nt, Human
ccaugacucagagaacuuacucaucg

SEQ ID NO: 9064 - RNA, 22 nt, Human
ugcauucucuauagccucugca

SEQ ID NO: 9065 - RNA, 32 nt, Human
acaccacagcugcgcacacagcugcuugcuca

SEQ ID NO: 9066 - RNA, 22 nt, Human
uaaaaacccacaggugcugcug

SEQ ID NO: 9067 - RNA, 23 nt, Human
auuaugccauugcacuccagccu

SEQ ID NO: 9068 - RNA, 24 nt, Human
cugccucacuauuacuguauucuc

SEQ ID NO: 9069 - RNA, 24 nt, Human
uccggcagcuggagauguccgagc

SEQ ID NO: 9070 - RNA, 27 nt, Human
cgggaggugggugacugaccagggcug

SEQ ID NO: 9071 - RNA, 27 nt, Human
cucagcuuucacacuggugaagucugu

SEQ ID NO: 9072 - RNA, 22 nt, Human
uugcccaggcuggagugcaacg

SEQ ID NO: 9073 - RNA, 27 nt, Human
ggagaacacugguuauguugauagaau

SEQ ID NO: 9074 - RNA, 22 nt, Human
aguuucugguacccauccucug

SEQ ID NO: 9075 - RNA, 22 nt, Human
guucacugcaaccuccgcaucc

SEQ ID NO: 9076 - RNA, 22 nt, Human
augugggagcaaaaucagcuga

SEQ ID NO: 9077 - RNA, 26 nt, Human
ugaaucugcuuuuccucugccuucgg

SEQ ID NO: 9078 - RNA, 26 nt, Human
augccaggcgcugauguaagcacuuu

SEQ ID NO: 9079 - RNA, 23 nt, Human
agugcaucuauucccacucucau

SEQ ID NO: 9080 - RNA, 20 nt, Human
aaaacaaugauaaagaugug

SEQ ID NO: 9081 - RNA, 23 nt, Human
gaguguguuggggcaaaggggcu

SEQ ID NO: 9082 - RNA, 27 nt, Human
uuuccaaaacuguggcagcuaacuuuu

SEQ ID NO: 9083 - RNA, 22 nt, Human
uuuacauugaaaaacucuuuca

SEQ ID NO: 9084 - RNA, 27 nt, Human
uguggagggagaagcgagugugguccg

SEQ ID NO: 9085 - RNA, 23 nt, Human
uaagccacauggcugggauuuaa

SEQ ID NO: 9086 - RNA, 25 nt, Human
cccuucagaccccagcugucugcgc

SEQ ID NO: 9087 - RNA, 20 nt, Human
cuucugagcccaccucccag

SEQ ID NO: 9088 - RNA, 20 nt, Human
ggaguguaccucacagccuu

SEQ ID NO: 9089 - RNA, 26 nt, Human
uuucugcugguuguagguccuuggcu

SEQ ID NO: 9090 - RNA, 24 nt, Human
gagggaauuauuagcaucaucccc

SEQ ID NO: 9091 - RNA, 24 nt, Human
caccauuaguggcagcaucaugua

SEQ ID NO: 9092 - RNA, 23 nt, Human
ggcaagaaugcagcaggagccag

SEQ ID NO: 9093 - RNA, 19 nt, Human
acaaucauuugagcuuuga

SEQ ID NO: 9094 - RNA, 25 nt, Human
aggguccaaaaaugcugaucuaagg

SEQ ID NO: 9095 - RNA, 21 nt, Human
cagugaagugccuuuuuccua

SEQ ID NO: 9096 - RNA, 21 nt, Human
accggcaaccuguaacugccc

SEQ ID NO: 9097 - RNA, 26 nt, Human
ccuccuggccccacccugccccuucu

SEQ ID NO: 9098 - RNA, 20 nt, Human
agggaagagggcucacaaga

SEQ ID NO: 9099 - RNA, 23 nt, Human
gugugagugccagaagcugccuc

SEQ ID NO: 9100 - RNA, 20 nt, Human
ucuuuuuucuuuuuugagac

SEQ ID NO: 9101 - RNA, 23 nt, Human
gguagcccaggagauggagcagc

SEQ ID NO: 9102 - RNA, 24 nt, Human
gaaccccagaccgaaggggaaaag

SEQ ID NO: 9103 - RNA, 26 nt, Human
cauccaggcugggaggggaagagugc

SEQ ID NO: 9104 - RNA, 27 nt, Human
guggugauuuagcaggaagcugugaga

SEQ ID NO: 9105 - RNA, 21 nt, Human
ccugcucugccacuuucaacc

SEQ ID NO: 9106 - RNA, 20 nt, Human
acuccugaguuccacugcuc

SEQ ID NO: 9107 - RNA, 22 nt, Human
cagccucuuuaacaucuucuuu

SEQ ID NO: 9108 - RNA, 26 nt, Human
aaugguuacagagaugaaucccaaug

SEQ ID NO: 9109 - RNA, 26 nt, Human
aacacagccccggaaugcuuccaguu

SEQ ID NO: 9110 - RNA, 25 nt, Human
cagacuucuuucugcaaauuauuca

SEQ ID NO: 9111 - RNA, 20 nt, Human
cuguggggaugccucuuguu

SEQ ID NO: 9112 - RNA, 22 nt, Human
guguccgcgguccugcugcugu

SEQ ID NO: 9113 - RNA, 30 nt, Human
ccuuucuguccugguucccugaagcaucga

SEQ ID NO: 9114 - RNA, 28 nt, Human
ucaguguacgaggcagacggcggcagug

SEQ ID NO: 9115 - RNA, 21 nt, Human
guuuuucucacaguuucuuua

SEQ ID NO: 9116 - RNA, 18 nt, Human
ucaauaaggcagugcagu

SEQ ID NO: 9117 - RNA, 27 nt, Human
accagccugguccacugggaacucaaa

SEQ ID NO: 9118 - RNA, 19 nt, Human
uguucuagucauuguacua

SEQ ID NO: 9119 - RNA, 18 nt, Human
gauacuccugccacacag

SEQ ID NO: 9120 - RNA, 21 nt, Human
augccauuggagugcacggug

SEQ ID NO: 9121 - RNA, 27 nt, Human
uuuuguugucuuuuuauaaaaggggag

SEQ ID NO: 9122 - RNA, 27 nt, Human
cauuccucccuucuccucagcugcagu

SEQ ID NO: 9123 - RNA, 27 nt, Human
uauccaugcugucaacuccugccucca

SEQ ID NO: 9124 - RNA, 24 nt, Human
ucuuaucauugcuuuuccaucuag

SEQ ID NO: 9125 - RNA, 23 nt, Human
uauucacugcacuuuuuuauugu

SEQ ID NO: 9126 - RNA, 25 nt, Human
gcugaggucaggaggccgacguggc

SEQ ID NO: 9127 - RNA, 22 nt, Human
ggcuacuucuuguauuuuuugu

SEQ ID NO: 9128 - RNA, 32 nt, Human
guacagugggggucuacaacaagaaguguaua

SEQ ID NO: 9129 - RNA, 29 nt, Human
ugccuccugcuuaguucacuuuguaucac

SEQ ID NO: 9130 - RNA, 21 nt, Human
gggagcggagguugcagugag

SEQ ID NO: 9131 - RNA, 26 nt, Human
acccagcauguacaaaaguaccauag

SEQ ID NO: 9132 - RNA, 20 nt, Human
cauugucuugagcaccagaa

SEQ ID NO: 9133 - RNA, 25 nt, Human
gguaucuuuuuauucauugcccuca

SEQ ID NO: 9134 - RNA, 18 nt, Human
aacguacugugacuuuaa

SEQ ID NO: 9135 - RNA, 27 nt, Human
gucuuccugagucagugccugaaucuu

SEQ ID NO: 9136 - RNA, 18 nt, Human
uuuguagaaugaaccacu

SEQ ID NO: 9137 - RNA, 27 nt, Human
ugcuauuccaagagaaggauaugcuga

SEQ ID NO: 9138 - RNA, 24 nt, Human
agaacauauuuucuguucaaugca

SEQ ID NO: 9139 - RNA, 22 nt, Human
gacgaccuccagcucucaguua

SEQ ID NO: 9140 - RNA, 21 nt, Human
ucuguucuuccuauuucuggc

SEQ ID NO: 9141 - RNA, 28 nt, Human
cagacuagcuuucagccuucugucagca

SEQ ID NO: 9142 - RNA, 19 nt, Human
gagcagugagggggagacu

SEQ ID NO: 9143 - RNA, 22 nt, Human
cuccuugcuccuccuccugcaa

SEQ ID NO: 9144 - RNA, 20 nt, Human
gcccccucucccccugagcc

SEQ ID NO: 9145 - RNA, 23 nt, Human
ccacguccacaaggagcuuuuca

SEQ ID NO: 9146 - RNA, 23 nt, Human
ugggagaaggucuccaagggagg

SEQ ID NO: 9147 - RNA, 21 nt, Human
gggccuggggagauggaggaa

SEQ ID NO: 9148 - RNA, 18 nt, Human
agauuaagauaagaaaua

SEQ ID NO: 9149 - RNA, 21 nt, Human
aauaucaaacuacauucuucc

SEQ ID NO: 9150 - RNA, 26 nt, Human
ggggaugaaguaaggagagggacugg

SEQ ID NO: 9151 - RNA, 20 nt, Human
cugaagccacuggggugggg

SEQ ID NO: 9152 - RNA, 23 nt, Human
cgcccacagagacacacugugug

SEQ ID NO: 9153 - RNA, 24 nt, Human
cgcagccgccucauggggguccag

SEQ ID NO: 9154 - RNA, 25 nt, Human
agcucacaggagcuuaaacagcugg

SEQ ID NO: 9155 - RNA, 23 nt, Human
gggccuggagugcggcggcggcg

SEQ ID NO: 9156 - RNA, 24 nt, Human
ucacaggccuggccagccuaggag

SEQ ID NO: 9157 - RNA, 22 nt, Human
ucuauguauaugucuuaccuca

SEQ ID NO: 9158 - RNA, 20 nt, Human
cacaugcucugccauccaca

SEQ ID NO: 9159 - RNA, 26 nt, Human
gacaagaagcaacaacucuguugauc

SEQ ID NO: 9160 - RNA, 23 nt, Human
ccuccauaucaauccauucucau

SEQ ID NO: 9161 - RNA, 21 nt, Human
uggaagcuauuagcaccaaug

SEQ ID NO: 9162 - RNA, 21 nt, Human
aaccagggagaucauggucac

SEQ ID NO: 9163 - RNA, 23 nt, Human
aacguauuuuauacaaugcucug

SEQ ID NO: 9164 - RNA, 22 nt, Human
acaugggaaggugccacuggua

SEQ ID NO: 9165 - RNA, 22 nt, Human
ucacaugggugcaaucuuuagc

SEQ ID NO: 9166 - RNA, 28 nt, Human
ugguuuuuaccacuguacuccaaccccg

SEQ ID NO: 9167 - RNA, 20 nt, Human
gaaguccuuugcuguggagg

SEQ ID NO: 9168 - RNA, 21 nt, Human
ccaagguggggggauuacccg

SEQ ID NO: 9169 - RNA, 22 nt, Human
ugcuguugccgcugcugcugcu

SEQ ID NO: 9170 - RNA, 27 nt, Human
ccagcacuucgcuugcagaagccaucc

SEQ ID NO: 9171 - RNA, 21 nt, Human
guuguuaggaagagaugagga

SEQ ID NO: 9172 - RNA, 26 nt, Human
ccuucuacuuucuuucucacccaccc

SEQ ID NO: 9173 - RNA, 20 nt, Human
ggaaggcaaaguccucugug

SEQ ID NO: 9174 - RNA, 24 nt, Human
gccccgaaacuggagugugaagga

SEQ ID NO: 9175 - RNA, 21 nt, Human
ccuccuugcccugccagcugu

SEQ ID NO: 9176 - RNA, 19 nt, Human
uauuuacaccagcuuuuca

SEQ ID NO: 9177 - RNA, 23 nt, Human
ggacaaauaaaaguagugauuau

SEQ ID NO: 9178 - RNA, 21 nt, Human
cuguuucucugggcuccugag

SEQ ID NO: 9179 - RNA, 22 nt, Human
ugcuuaaaagauuucaccagaa

SEQ ID NO: 9180 - RNA, 19 nt, Human
gggggcccuuccaggagga

SEQ ID NO: 9181 - RNA, 26 nt, Human
aggaagaggagggcaaggugucuggc

SEQ ID NO: 9182 - RNA, 20 nt, Human
gcaucugccaggacacugcc

SEQ ID NO: 9183 - RNA, 27 nt, Human
cuuuguuguuuuaucacuguaagccug

SEQ ID NO: 9184 - RNA, 23 nt, Human
gucagcacagcuuuucuuguguc

SEQ ID NO: 9185 - RNA, 19 nt, Human
uaacuggaggauucagcac

SEQ ID NO: 9186 - RNA, 24 nt, Human
uagacuucaaaauguuaagugaaa

SEQ ID NO: 9187 - RNA, 27 nt, Human
ggagauggagucccuuuucauucuccu

SEQ ID NO: 9188 - RNA, 20 nt, Human
guacaguuguauauacagua

SEQ ID NO: 9189 - RNA, 22 nt, Human
ggagcagcagaaggagcagcgg

SEQ ID NO: 9190 - RNA, 18 nt, Human
gaguuagacagcccaggg

SEQ ID NO: 9191 - RNA, 22 nt, Human
gaucaaccuggccaacauacug

SEQ ID NO: 9192 - RNA, 27 nt, Human
cugcagccuggaacuccugggaucaag

SEQ ID NO: 9193 - RNA, 27 nt, Human
uguuuuuaauuaaacuuuucucuuccu

SEQ ID NO: 9194 - RNA, 20 nt, Human
cuuuugccaccauuggccau

SEQ ID NO: 9195 - RNA, 20 nt, Human
ucuaagcgcugcucucugcu

SEQ ID NO: 9196 - RNA, 22 nt, Human
uuuucuucugcacccacuucua

SEQ ID NO: 9197 - RNA, 20 nt, Human
uauucaaacauuauucucaa

SEQ ID NO: 9198 - RNA, 23 nt, Human
uccaggccacauggggcugggca

SEQ ID NO: 9199 - RNA, 28 nt, Human
uggaagaucuaccugcaacacaacauuu

SEQ ID NO: 9200 - RNA, 21 nt, Human
aauggcaagaaggccacagag

SEQ ID NO: 9201 - RNA, 22 nt, Human
aauauuaaaauuuuacacuuuu

SEQ ID NO: 9202 - RNA, 24 nt, Human
aucugugaaugggaaaagccauuu

SEQ ID NO: 9203 - RNA, 20 nt, Human
uggggaggggugggcagagu

SEQ ID NO: 9204 - RNA, 20 nt, Human
uaugauuaaacuguguguaa

SEQ ID NO: 9205 - RNA, 20 nt, Human
acaguguguggagacuuaca

SEQ ID NO: 9206 - RNA, 20 nt, Human
cugccuccuggauaucuugg

SEQ ID NO: 9207 - RNA, 22 nt, Human
cccugcacugcauucgcacaaa

SEQ ID NO: 9208 - RNA, 26 nt, Human
caucucccuacacuggcagccaguca

SEQ ID NO: 9209 - RNA, 26 nt, Human
aguggagaagaggaagaccuggagca

SEQ ID NO: 9210 - RNA, 22 nt, Human
gcuggucucuauacuggagaag

SEQ ID NO: 9211 - RNA, 23 nt, Human
cacaaggcuggggcuggagaaug

SEQ ID NO: 9212 - RNA, 24 nt, Human
auugcugucuggugcuccucucuc

SEQ ID NO: 9213 - RNA, 22 nt, Human
cuccucccucagacccagcggu

SEQ ID NO: 9214 - RNA, 22 nt, Human
gacuagccuggccagcauggug

SEQ ID NO: 9215 - RNA, 27 nt, Human
gagacggaggaaggucugaggagcagc

SEQ ID NO: 9216 - RNA, 20 nt, Human
gauggcugcuucuaaaacaa

SEQ ID NO: 9217 - RNA, 21 nt, Human
cacugcacuccagccugguga

SEQ ID NO: 9218 - RNA, 20 nt, Human
cucccucccuuccuugggca

SEQ ID NO: 9219 - RNA, 19 nt, Human
uuuccuuuuaagccucgcc

SEQ ID NO: 9220 - RNA, 25 nt, Human
ggccaggguagacuuggagcugucc

SEQ ID NO: 9221 - RNA, 27 nt, Human
cagaguguucuguuauucucaaucuuu

SEQ ID NO: 9222 - RNA, 24 nt, Human
ucgggagccguggagcucucggau

SEQ ID NO: 9223 - RNA, 26 nt, Human
cacccaggccaggaguggagccaggu

SEQ ID NO: 9224 - RNA, 26 nt, Human
gucagcuggaaagucugcaauaaaca

SEQ ID NO: 9225 - RNA, 27 nt, Human
aaaugcaccaauucugaaggcacuuua

SEQ ID NO: 9226 - RNA, 21 nt, Human
acagaggagaacacacaggca

SEQ ID NO: 9227 - RNA, 22 nt, Human
gacuacaggcgccuaccaccau

SEQ ID NO: 9228 - RNA, 21 nt, Human
cugaauccuagucucucaccu

SEQ ID NO: 9229 - RNA, 23 nt, Human
uucaagacauugaaacuacuuug

SEQ ID NO: 9230 - RNA, 22 nt, Human
cugagauugugucauugcacuc

SEQ ID NO: 9231 - RNA, 28 nt, Human
ccgggaggcggagguugcgacccaaagc

SEQ ID NO: 9232 - RNA, 26 nt, Human
cccugcagggcuggucagggugucug

SEQ ID NO: 9233 - RNA, 26 nt, Human
ucuccuggcccccucaguucucccag

SEQ ID NO: 9234 - RNA, 27 nt, Human
ccugcagcugagcuuccacaagacacu

SEQ ID NO: 9235 - RNA, 22 nt, Human
gggccucucuugggucuguguc

SEQ ID NO: 9236 - RNA, 20 nt, Human
gcuuuucuuguuugaaggaa

SEQ ID NO: 9237 - RNA, 20 nt, Human
ccaucucggggagagcgaag

SEQ ID NO: 9238 - RNA, 26 nt, Human
uccugugugcagggacugauuccuca

SEQ ID NO: 9239 - RNA, 22 nt, Human
uucugaaaacagcacuucagcu

SEQ ID NO: 9240 - RNA, 27 nt, Human
uagcaaacaauuuuuguucaaugccca

SEQ ID NO: 9241 - RNA, 20 nt, Human
gaacagggugaaccacugau

SEQ ID NO: 9242 - RNA, 22 nt, Human
caguucugaggugaagcugggc

SEQ ID NO: 9243 - RNA, 25 nt, Human
ccugguuccuguuuagcuguucuga

SEQ ID NO: 9244 - RNA, 21 nt, Human
ggcuaccucugggaagccgcu

SEQ ID NO: 9245 - RNA, 22 nt, Human
cagcauggagaccucaugacaa

SEQ ID NO: 9246 - RNA, 20 nt, Human
ggcuggagugcaguggugca

SEQ ID NO: 9247 - RNA, 26 nt, Human
gcugggccagugcaucuaacagcccu

SEQ ID NO: 9248 - RNA, 22 nt, Human
cuguaaaauuagaggauugcac

SEQ ID NO: 9249 - RNA, 21 nt, Human
cuucccucucaccaucccacu

SEQ ID NO: 9250 - RNA, 20 nt, Human
ugcacaucuuaaaacugggc

SEQ ID NO: 9251 - RNA, 21 nt, Human
caugcccagagcaccgggcac

SEQ ID NO: 9252 - RNA, 20 nt, Human
ggaauuuugcuuuuugucuu

SEQ ID NO: 9253 - RNA, 26 nt, Human
auaccugcacugucucugaggacuua

SEQ ID NO: 9254 - RNA, 22 nt, Human
caccacugcacuccagccgggg

SEQ ID NO: 9255 - RNA, 21 nt, Human
ccaguaggagaucagaaaaau

SEQ ID NO: 9256 - RNA, 27 nt, Human
gggggcaggcgccauugggcagaggga

SEQ ID NO: 9257 - RNA, 26 nt, Human
ucucccacuugauugaccucaccagu

SEQ ID NO: 9258 - RNA, 25 nt, Human
uaggauucacugcucucuccuacag

SEQ ID NO: 9259 - RNA, 24 nt, Human
ugccuggucagugcccagagacaa

SEQ ID NO: 9260 - RNA, 23 nt, Human
uguugccugggcuggagaacagu

SEQ ID NO: 9261 - RNA, 25 nt, Human
gcugucuuccuuucuccccuuugga

SEQ ID NO: 9262 - RNA, 21 nt, Human
cuccucuccugccagccuccc

SEQ ID NO: 9263 - RNA, 21 nt, Human
ggaguuaaucuugucucuucu

SEQ ID NO: 9264 - RNA, 24 nt, Human
ggaaagaugcaugccaguggaugc

SEQ ID NO: 9265 - RNA, 30 nt, Human
gagggaagaaggacagggacucguguggca

SEQ ID NO: 9266 - RNA, 22 nt, Human
gaccgaggugugggagugugga

SEQ ID NO: 9267 - RNA, 22 nt, Human
ugcugagacaggauggccuggc

SEQ ID NO: 9268 - RNA, 22 nt, Human
uguauaaaugucuuuaaugcaa

SEQ ID NO: 9269 - RNA, 22 nt, Human
gagaucaggcgccaucuguaaa

SEQ ID NO: 9270 - RNA, 24 nt, Human
aguuguuccuaucucucccccgcc

SEQ ID NO: 9271 - RNA, 27 nt, Human
gaggaagaguugagucugucugggacu

SEQ ID NO: 9272 - RNA, 27 nt, Human
gaggaagagagcugcuuaaacucacac

SEQ ID NO: 9273 - RNA, 19 nt, Human
aggaggucgaggcugcagu

SEQ ID NO: 9274 - RNA, 20 nt, Human
auucuucuuuauggcugagu

SEQ ID NO: 9275 - RNA, 25 nt, Human
gccucugugucuccuuccucggggg

SEQ ID NO: 9276 - RNA, 21 nt, Human
acccugggcuggagaguuggu

SEQ ID NO: 9277 - RNA, 27 nt, Human
cauugcacuccagccugggcaacagug

SEQ ID NO: 9278 - RNA, 25 nt, Human
uuuggagcuuuuaagccaguuucag

SEQ ID NO: 9279 - RNA, 22 nt, Human
cucaagcgauccuccuuccuca

SEQ ID NO: 9280 - RNA, 27 nt, Human
ggacucaaacuccugaccuugugauuu

SEQ ID NO: 9281 - RNA, 24 nt, Human
ccuucccuggcccugcugccgacc

SEQ ID NO: 9282 - RNA, 20 nt, Human
uaacaacagccaggagcuuc

SEQ ID NO: 9283 - RNA, 21 nt, Human
ugcacacagcugcucagcacc

SEQ ID NO: 9284 - RNA, 24 nt, Human
cucaaguucuggucaacuaguagc

SEQ ID NO: 9285 - RNA, 20 nt, Human
uguucucugugaaccacagu

SEQ ID NO: 9286 - RNA, 22 nt, Human
gcuaucaaucaucuuaucauca

SEQ ID NO: 9287 - RNA, 19 nt, Human
gcggugagcuauguuuaca

SEQ ID NO: 9288 - RNA, 21 nt, Human
aacccuaugaauuuacugaau

SEQ ID NO: 9289 - RNA, 20 nt, Human
gcuggucagucuuugcucag

SEQ ID NO: 9290 - RNA, 25 nt, Human
gcuccgcccuagcccgcagcucuuc

SEQ ID NO: 9291 - RNA, 24 nt, Human
ccccuccuccuucucucuuggcga

SEQ ID NO: 9292 - RNA, 23 nt, Human
guuuaauuauuggugauuacaca

SEQ ID NO: 9293 - RNA, 21 nt, Human
gggggcccuuguaaugccacu

SEQ ID NO: 9294 - RNA, 24 nt, Human
ugcaaccucuugaccuucagcucc

SEQ ID NO: 9295 - RNA, 17 nt, Human
cccugcagacugccauu

SEQ ID NO: 9296 - RNA, 21 nt, Human
aucacaccaccugacaggccu

SEQ ID NO: 9297 - RNA, 19 nt, Human
ugugugccagcugugugag

SEQ ID NO: 9298 - RNA, 15 nt, Human
accauaaagcacuau

SEQ ID NO: 9299 - RNA, 22 nt, Human
ugacugccauuggucccucagc

SEQ ID NO: 9300 - RNA, 20 nt, Human
cuacuuugcuuuucucucca

SEQ ID NO: 9301 - RNA, 26 nt, Human
aggaagggaaagggaagugauaucau

SEQ ID NO: 9302 - RNA, 22 nt, Human
augcgagcugcgccucucggca

SEQ ID NO: 9303 - RNA, 27 nt, Human
cacaagucccagcgcggauguuucugc

SEQ ID NO: 9304 - RNA, 18 nt, Human
uguaacacuggcacugaa

SEQ ID NO: 9305 - RNA, 21 nt, Human
agcaaaaucaaguucuuuuug

SEQ ID NO: 9306 - RNA, 23 nt, Human
uguggugaguagagguguguguc

SEQ ID NO: 9307 - RNA, 26 nt, Human
ucgcccaggcuggagugcagcagcac

SEQ ID NO: 9308 - RNA, 20 nt, Human
uagcuccucugugacucaga

SEQ ID NO: 9309 - RNA, 21 nt, Human
ucuccguuagcuccuguggcc

SEQ ID NO: 9310 - RNA, 16 nt, Human
acuucuuucuucugcc

SEQ ID NO: 9311 - RNA, 23 nt, Human
cacuggauccuuggccuccaggg

SEQ ID NO: 9312 - RNA, 22 nt, Human
cugggcccugccuuccauacac

SEQ ID NO: 9313 - RNA, 27 nt, Human
uuccauucauuguuuacgcuggaauuu

SEQ ID NO: 9314 - RNA, 23 nt, Human
cuuagcaaaaugagaagauguga

SEQ ID NO: 9315 - RNA, 21 nt, Human
ccuaaaugguguucccuuuga

SEQ ID NO: 9316 - RNA, 22 nt, Human
gauucauugaucaaauauuuca

SEQ ID NO: 9317 - RNA, 24 nt, Human
ucacaugccccuccuaacuccaca

SEQ ID NO: 9318 - RNA, 21 nt, Human
ggcaccugccaacacgcccgg

SEQ ID NO: 9319 - RNA, 25 nt, Human
guucaaaacucugcagcauuaaaca

SEQ ID NO: 9320 - RNA, 25 nt, Human
ggaaugcguuuuaguucuucaccuu

SEQ ID NO: 9321 - RNA, 24 nt, Human
ggauuuuucugucauuuagcacca

SEQ ID NO: 9322 - RNA, 23 nt, Human
cuucuaucugcaccugcucucaa

SEQ ID NO: 9323 - RNA, 23 nt, Human
guucucuguucuagagugacagg

SEQ ID NO: 9324 - RNA, 22 nt, Human
auccuaaaugaacuauuucagu

SEQ ID NO: 9325 - RNA, 22 nt, Human
uuggagcucauucugucucuuu

SEQ ID NO: 9326 - RNA, 21 nt, Human
uuucagagcccuccugcucac

SEQ ID NO: 9327 - RNA, 25 nt, Human
gcaauggcuuucccuccugcuggcu

SEQ ID NO: 9328 - RNA, 21 nt, Human
gccacuguacuccagccuggg

SEQ ID NO: 9329 - RNA, 21 nt, Human
ggaaggggguggaaacugccu

SEQ ID NO: 9330 - RNA, 19 nt, Human
ccagcagaagacaaaaaga

SEQ ID NO: 9331 - RNA, 23 nt, Human
gauguauagcaacauuaaauuug

SEQ ID NO: 9332 - RNA, 22 nt, Human
uuggaggcggagguugcauuga

SEQ ID NO: 9333 - RNA, 22 nt, Human
uugcccaggcuagcaugcaaug

SEQ ID NO: 9334 - RNA, 21 nt, Human
agccccgggcauguuccgaga

SEQ ID NO: 9335 - RNA, 21 nt, Human
cucccuuuuauaaacauugcu

SEQ ID NO: 9336 - RNA, 25 nt, Human
gccacaccagcccccuuucaccucc

SEQ ID NO: 9337 - RNA, 23 nt, Human
uuuuguuccuaggugucugcugc

SEQ ID NO: 9338 - RNA, 23 nt, Human
ccccauuuacaucauuucaccuu

SEQ ID NO: 9339 - RNA, 27 nt, Human
ugguuugucagccuuucuccuguuuau

SEQ ID NO: 9340 - RNA, 27 nt, Human
gcgcuccucucugcacaccuacuaguc

SEQ ID NO: 9341 - RNA, 21 nt, Human
gacccugagacuacuaaagcu

SEQ ID NO: 9342 - RNA, 22 nt, Human
aggcugaggcaggcggaucaca

SEQ ID NO: 9343 - RNA, 20 nt, Human
cgcccaggcuggagugcagc

SEQ ID NO: 9344 - RNA, 22 nt, Human
cugcuuuuuagccagggccagu

SEQ ID NO: 9345 - RNA, 22 nt, Human
acuguccuuggggaggcaggcg

SEQ ID NO: 9346 - RNA, 22 nt, Human
accacgcccuuccuggggcagc

SEQ ID NO: 9347 - RNA, 20 nt, Human
cgcucaggcuggagugccau

SEQ ID NO: 9348 - RNA, 20 nt, Human
cgcucaggcuggagugcagu

SEQ ID NO: 9349 - RNA, 20 nt, Human
ccucuacgcugccucaggcc

SEQ ID NO: 9350 - RNA, 23 nt, Human
cccggcgggcagccccaggcugg

SEQ ID NO: 9351 - RNA, 21 nt, Human
ucgcccuucagguuucguuga

SEQ ID NO: 9352 - RNA, 27 nt, Human
aaccaucaccagaauuaauuuuauuau

SEQ ID NO: 9353 - RNA, 23 nt, Human
gaugaaccaauuuucugcagccu

SEQ ID NO: 9354 - RNA, 26 nt, Human
uugggagccugaggcaggagaacugc

SEQ ID NO: 9355 - RNA, 20 nt, Human
acauccauuucaaacagcua

SEQ ID NO: 9356 - RNA, 28 nt, Human
agagucugagacaggacccaggcacccu

SEQ ID NO: 9357 - RNA, 26 nt, Human
ggagggagggagugguuugcaggugg

SEQ ID NO: 9358 - RNA, 20 nt, Human
aacaaaacaaguagcucuag

SEQ ID NO: 9359 - RNA, 22 nt, Human
uguuagcuguggccacugugga

SEQ ID NO: 9360 - RNA, 24 nt, Human
uuucaugcagaguugaaguuuaca

SEQ ID NO: 9361 - RNA, 23 nt, Human
aacuguacacuuguuuggugcua

SEQ ID NO: 9362 - RNA, 26 nt, Human
uucauguguucauuuauuuccaccac

SEQ ID NO: 9363 - RNA, 22 nt, Human
cuuccuuguaucugucuuccca

SEQ ID NO: 9364 - RNA, 28 nt, Human
ugaggugucacccccuuccagcugagga

SEQ ID NO: 9365 - RNA, 22 nt, Human
ccugccugaauuuauggcauua

SEQ ID NO: 9366 - RNA, 20 nt, Human
ucaugccaccgacgggccac

SEQ ID NO: 9367 - RNA, 21 nt, Human
cugcagcugggaagaggagcc

SEQ ID NO: 9368 - RNA, 22 nt, Human
aggaaagagggaaacugcagcu

SEQ ID NO: 9369 - RNA, 20 nt, Human
ugucccuucccagcgcugcu

SEQ ID NO: 9370 - RNA, 22 nt, Human
ccgcggguuucagcuguugguc

SEQ ID NO: 9371 - RNA, 24 nt, Human
augacugccaagacugcuguggcc

SEQ ID NO: 9372 - RNA, 21 nt, Human
cuaauucaauaugacugauga

SEQ ID NO: 9373 - RNA, 22 nt, Human
cacaaucgcugccuccuggguu

SEQ ID NO: 9374 - RNA, 20 nt, Human
guaaagcaucugcacuugac

SEQ ID NO: 9375 - RNA, 21 nt, Human
agcuuggucaaccucuauacu

SEQ ID NO: 9376 - RNA, 27 nt, Human
ggguggcuggcaggagucccagcugcu

SEQ ID NO: 9377 - RNA, 22 nt, Human
cucccagcuccugcaccaggaa

SEQ ID NO: 9378 - RNA, 25 nt, Human
ucuccaccuuugcgaacagaggguc

SEQ ID NO: 9379 - RNA, 24 nt, Human
gggagggagagaacauucagcagc

SEQ ID NO: 9380 - RNA, 23 nt, Human
cucccuuugcugaccaccagccc

SEQ ID NO: 9381 - RNA, 22 nt, Human
aucuccucucauacaucaagcc

SEQ ID NO: 9382 - RNA, 20 nt, Human
cugcuuaauuauagcacuuu

SEQ ID NO: 9383 - RNA, 22 nt, Human
uccaucaucccucaaaguguca

SEQ ID NO: 9384 - RNA, 21 nt, Human
cacuuuauaaccagaugguuc

SEQ ID NO: 9385 - RNA, 22 nt, Human
uaucaccuaggcuggagugcag

SEQ ID NO: 9386 - RNA, 23 nt, Human
uguccuggucuaucucuccagcc

SEQ ID NO: 9387 - RNA, 21 nt, Human
cuucucugcccacagucuuuc

SEQ ID NO: 9388 - RNA, 25 nt, Human
ugugcccaggcuagggggcuauaga

SEQ ID NO: 9389 - RNA, 24 nt, Human
ccugcugccuccccaacccugccc

SEQ ID NO: 9390 - RNA, 27 nt, Human
agcuuucagguuuuauuaaaaccuaga

SEQ ID NO: 9391 - RNA, 26 nt, Human
uccagaaggcggggagagcagcagcg

SEQ ID NO: 9392 - RNA, 26 nt, Human
ugaagaaugccgcguugggugggugc

SEQ ID NO: 9393 - RNA, 22 nt, Human
ggaccugucuggguggccucag

SEQ ID NO: 9394 - RNA, 26 nt, Human
gaacaacaacugggaagaaacuugaa

SEQ ID NO: 9395 - RNA, 24 nt, Human
ccucaacuccgugcuuaaccaaag

SEQ ID NO: 9396 - RNA, 26 nt, Human
caaaacugagcacucuucugugcacu

SEQ ID NO: 9397 - RNA, 22 nt, Human
ccuccugggacugugacugcuu

SEQ ID NO: 9398 - RNA, 28 nt, Human
accagauuuuuacacauguaucuaugca

SEQ ID NO: 9399 - RNA, 20 nt, Human
cccucuccucuccccgcgcc

SEQ ID NO: 9400 - RNA, 19 nt, Human
uuauuucuuacaggcacaa

SEQ ID NO: 9401 - RNA, 30 nt, Human
ugccucuuccacucuggagugaaguuaaug

SEQ ID NO: 9402 - RNA, 24 nt, Human
acacugucaauggacugcaccuug

SEQ ID NO: 9403 - RNA, 25 nt, Human
augugauugugccgucauucuguuu

SEQ ID NO: 9404 - RNA, 19 nt, Human
cuuccugccuccugcccca

SEQ ID NO: 9405 - RNA, 22 nt, Human
uaugccuguaaucccagcacuu

SEQ ID NO: 9406 - RNA, 20 nt, Human
ccaccggagccucccccuca

SEQ ID NO: 9407 - RNA, 28 nt, Human
guuauugcuguuugagcugucucagugg

SEQ ID NO: 9408 - RNA, 20 nt, Human
cuuggagcuggaucauugga

SEQ ID NO: 9409 - RNA, 24 nt, Human
ucucucuucucuuuguuucaacug

SEQ ID NO: 9410 - RNA, 22 nt, Human
caugccugcaaucccagcacuu

SEQ ID NO: 9411 - RNA, 24 nt, Human
ccccagucuucgccuuccucuuuu

SEQ ID NO: 9412 - RNA, 22 nt, Human
uggccaacauuguaaaacccca

SEQ ID NO: 9413 - RNA, 21 nt, Human
uagagaugauuucuggaacau

SEQ ID NO: 9414 - RNA, 20 nt, Human
ucuuccuuugauuuuauugg

SEQ ID NO: 9415 - RNA, 21 nt, Human
acugcccguggcaugagggag

SEQ ID NO: 9416 - RNA, 27 nt, Human
aacugauuuuaaaggguuuagauuuua

SEQ ID NO: 9417 - RNA, 24 nt, Human
ccccacaggaacaaaacacugccu

SEQ ID NO: 9418 - RNA, 25 nt, Human
gaagggaggguggcgagggggaagc

SEQ ID NO: 9419 - RNA, 19 nt, Human
cuaagcaaagugccuuagg

SEQ ID NO: 9420 - RNA, 26 nt, Human
cuucuuuccuuucugucaaccucuca

SEQ ID NO: 9421 - RNA, 29 nt, Human
gucaguccuaggcuggaugggaggguggc

SEQ ID NO: 9422 - RNA, 19 nt, Human
uccucaaggacauuacuag

SEQ ID NO: 9423 - RNA, 23 nt, Human
ccccagcugcuccuccucaagcc

SEQ ID NO: 9424 - RNA, 25 nt, Human
agcuuccguguuccuugccuuguga

SEQ ID NO: 9425 - RNA, 26 nt, Human
acacaugcaguagcacuuugguaaga

SEQ ID NO: 9426 - RNA, 20 nt, Human
cagaaaugcuauuuuguaug

SEQ ID NO: 9427 - RNA, 26 nt, Human
caguauuuauuuccaggaaaagccug

SEQ ID NO: 9428 - RNA, 26 nt, Human
gcaccauucagcaucuggauccugau

SEQ ID NO: 9429 - RNA, 26 nt, Human
caguagucccugcacagugacuucug

SEQ ID NO: 9430 - RNA, 18 nt, Human
gguaacaaugaacaguga

SEQ ID NO: 9431 - RNA, 22 nt, Human
ggaccuccuucuuccccacuuc

SEQ ID NO: 9432 - RNA, 20 nt, Human
cauuccugcagagggucggu

SEQ ID NO: 9433 - RNA, 26 nt, Human
gcacuucccagagcaucuugcaucca

SEQ ID NO: 9434 - RNA, 22 nt, Human
ucgcccaggcuggagggcagug

SEQ ID NO: 9435 - RNA, 22 nt, Human
ucgcccaugcuggagugcagug

SEQ ID NO: 9436 - RNA, 19 nt, Human
acagucccuaaugacaccc

SEQ ID NO: 9437 - RNA, 19 nt, Human
acuucucuuccucccucau

SEQ ID NO: 9438 - RNA, 22 nt, Human
ugcagcucccaccuccuccucc

SEQ ID NO: 9439 - RNA, 18 nt, Human
uuauucuuaccuauguca

SEQ ID NO: 9440 - RNA, 21 nt, Human
uguccugcuuccucacugugg

SEQ ID NO: 9441 - RNA, 32 nt, Human
ggcuuuggcuuuaagucccagacuggucuccc

SEQ ID NO: 9442 - RNA, 25 nt, Human
gagccucccaccuuuccccugcugc

SEQ ID NO: 9443 - RNA, 20 nt, Human
uggguuccacagacggaagg

SEQ ID NO: 9444 - RNA, 23 nt, Human
uagggaaaaguuauuuuguuuac

SEQ ID NO: 9445 - RNA, 22 nt, Human
gcacuacccuguucuguaguua

SEQ ID NO: 9446 - RNA, 29 nt, Human
gccuccucagcacucccuccugggaggcc

SEQ ID NO: 9447 - RNA, 20 nt, Human
ggaggcggagguagugguga

SEQ ID NO: 9448 - RNA, 27 nt, Human
uggccagacuggucuugaacucuuggc

SEQ ID NO: 9449 - RNA, 28 nt, Human
uuuuugguggagaaaggcugcaaaaaga

SEQ ID NO: 9450 - RNA, 21 nt, Human
uuccuggaacuguauuuugaa

SEQ ID NO: 9451 - RNA, 27 nt, Human
gcuaccaucugaggaagaaagcauuuu

SEQ ID NO: 9452 - RNA, 20 nt, Human
uugcccagguagugaucagu

SEQ ID NO: 9453 - RNA, 30 nt, Human
uacaggcaugcgccaccacgcccaacuaau

SEQ ID NO: 9454 - RNA, 26 nt, Human
ccccaacuuuucagagcgagucuuuu

SEQ ID NO: 9455 - RNA, 21 nt, Human
gaggugcuggggcuggggcag

SEQ ID NO: 9456 - RNA, 23 nt, Human
aucgcgccccugcacuccagccu

SEQ ID NO: 9457 - RNA, 24 nt, Human
cagaaccuucccgucugauuguuc

SEQ ID NO: 9458 - RNA, 21 nt, Human
cgcucaguggggcagaggcag

SEQ ID NO: 9459 - RNA, 22 nt, Human
uauaguuuuuaccuuuuaugua

SEQ ID NO: 9460 - RNA, 24 nt, Human
aaucuauguuuaaucaacugaggc

SEQ ID NO: 9461 - RNA, 22 nt, Human
cugggagcucagugaggauucu

SEQ ID NO: 9462 - RNA, 23 nt, Human
ucugcacucuccacccuggcugg

SEQ ID NO: 9463 - RNA, 18 nt, Human
gcuuucuccuuugagaga

SEQ ID NO: 9464 - RNA, 27 nt, Human
uagaguguugcaguguauauuguaaca

SEQ ID NO: 9465 - RNA, 23 nt, Human
ucuuagcaaaaaaugaacaguga

SEQ ID NO: 9466 - RNA, 22 nt, Human
ggcucacugcaaccuccgccuc

SEQ ID NO: 9467 - RNA, 23 nt, Human
aaaagcuuggguuaacucaguau

SEQ ID NO: 9468 - RNA, 26 nt, Human
ggugggggcaggauaacauggcuucu

SEQ ID NO: 9469 - RNA, 26 nt, Human
cugugcaaagggcugccuugcuguuc

SEQ ID NO: 9470 - RNA, 27 nt, Human
cccugcacugugccccgcgggcuuugu

SEQ ID NO: 9471 - RNA, 21 nt, Human
agcuccagcaaaagcgcagga

SEQ ID NO: 9472 - RNA, 26 nt, Human
gagauuucagcauuuccuaccuugug

SEQ ID NO: 9473 - RNA, 22 nt, Human
uucaccaaaccaaauguggaaa

SEQ ID NO: 9474 - RNA, 21 nt, Human
ggaauuugcuccuguucuguc

SEQ ID NO: 9475 - RNA, 25 nt, Human
cuacucucugggccacugcugcaga

SEQ ID NO: 9476 - RNA, 21 nt, Human
ucuaugaaagaauauaggaag

SEQ ID NO: 9477 - RNA, 23 nt, Human
gaggaaaggcuggaagcugcaga

SEQ ID NO: 9478 - RNA, 24 nt, Human
agccucucugggcacuugcagccg

SEQ ID NO: 9479 - RNA, 26 nt, Human
aggcagcaagggcugauucuaggaua

SEQ ID NO: 9480 - RNA, 19 nt, Human
agcugggcgugguggugca

SEQ ID NO: 9481 - RNA, 23 nt, Human
agagaaaacguguugccauccca

SEQ ID NO: 9482 - RNA, 22 nt, Human
cugccuugccccugagcacuuc

SEQ ID NO: 9483 - RNA, 21 nt, Human
ggagagcauagcaccugcagc

SEQ ID NO: 9484 - RNA, 21 nt, Human
ucuuugugagcuucaguuucc

SEQ ID NO: 9485 - RNA, 20 nt, Human
cagggagggcacaggccugc

SEQ ID NO: 9486 - RNA, 23 nt, Human
aaaucaucuguaacaauuauguu

SEQ ID NO: 9487 - RNA, 19 nt, Human
uuucuuauucuuuacuuga

SEQ ID NO: 9488 - RNA, 28 nt, Human
gcccuuggaguguugguggagaucagag

SEQ ID NO: 9489 - RNA, 28 nt, Human
uucugcagaaucagcaugauuuuuccaa

SEQ ID NO: 9490 - RNA, 23 nt, Human
ccuccccaccccaccugccaccg

SEQ ID NO: 9491 - RNA, 22 nt, Human
uuucuccaauuuggcugggauu

SEQ ID NO: 9492 - RNA, 21 nt, Human
ugucuccuccccaccucccaa

SEQ ID NO: 9493 - RNA, 21 nt, Human
uuggccgaggaacaacugaac

SEQ ID NO: 9494 - RNA, 19 nt, Human
gccaggcacacacagcccc

SEQ ID NO: 9495 - RNA, 24 nt, Human
ccgcaagccccagccccgaggacc

SEQ ID NO: 9496 - RNA, 21 nt, Human
uuauagaacaaauauuugaua

SEQ ID NO: 9497 - RNA, 22 nt, Human
agaccagccuggucaacauggu

SEQ ID NO: 9498 - RNA, 19 nt, Human
cccagucuggagugcagug

SEQ ID NO: 9499 - RNA, 23 nt, Human
uucugaccuuuuccuugauucaa

SEQ ID NO: 9500 - RNA, 22 nt, Human
ucugucugcucuuagcugucuc

SEQ ID NO: 9501 - RNA, 19 nt, Human
augcaggcccucagcccgg

SEQ ID NO: 9502 - RNA, 19 nt, Human
aaaagccaauggcugcagu

SEQ ID NO: 9503 - RNA, 24 nt, Human
cagcguggccuuguucugucacca

SEQ ID NO: 9504 - RNA, 19 nt, Human
uucaacaaaaggggccuga

SEQ ID NO: 9505 - RNA, 21 nt, Human
caguugugauuguaugacugu

SEQ ID NO: 9506 - RNA, 23 nt, Human
ugggcaugccuuucuguaaccaa

SEQ ID NO: 9507 - RNA, 23 nt, Human
ccccucgggagcaccccaccucu

SEQ ID NO: 9508 - RNA, 24 nt, Human
uuuugcagauuuacauuuugcuug

SEQ ID NO: 9509 - RNA, 27 nt, Human
aucaugucuguuuccagaacagugccu

SEQ ID NO: 9510 - RNA, 20 nt, Human
cccaauucccaggucucaca

SEQ ID NO: 9511 - RNA, 20 nt, Human
ggaggcggagguuacaguga

SEQ ID NO: 9512 - RNA, 25 nt, Human
accagcagaggaaacuuauaaccuc

SEQ ID NO: 9513 - RNA, 22 nt, Human
ggggugggagaagaggggcugg

SEQ ID NO: 9514 - RNA, 18 nt, Human
gacccucucccaagagga

SEQ ID NO: 9515 - RNA, 28 nt, Human
uggagaaugagaaaaauuuacauggcaa

SEQ ID NO: 9516 - RNA, 28 nt, Human
cacacguacacaugcacauguacgcacc

SEQ ID NO: 9517 - RNA, 20 nt, Human
cagggggcggggguggcaug

SEQ ID NO: 9518 - RNA, 24 nt, Human
ggucccaucugcagggccccgcac

SEQ ID NO: 9519 - RNA, 22 nt, Human
ccucagcccagcccagcccagc

SEQ ID NO: 9520 - RNA, 21 nt, Human
cccaccccacauuggucaucu

SEQ ID NO: 9521 - RNA, 23 nt, Human
gaggugcuggggaugacaggaag

SEQ ID NO: 9522 - RNA, 24 nt, Human
gcagcagguguggccaauggaggg

SEQ ID NO: 9523 - RNA, 25 nt, Human
acccaaagggacuuggugucaggag

SEQ ID NO: 9524 - RNA, 23 nt, Human
ugacccaggauacagaguguugc

SEQ ID NO: 9525 - RNA, 22 nt, Human
cugggcuucuguccuccucugu

SEQ ID NO: 9526 - RNA, 22 nt, Human
aaacccagcugcagaucaugcu

SEQ ID NO: 9527 - RNA, 24 nt, Human
cugccugguuuuucccacaugggc

SEQ ID NO: 9528 - RNA, 27 nt, Human
uguggguggaagagggaguagcugauu

SEQ ID NO: 9529 - RNA, 22 nt, Human
ucaccucaggccaggugcagug

SEQ ID NO: 9530 - RNA, 24 nt, Human
uugaggugggcauggagugagcag

SEQ ID NO: 9531 - RNA, 18 nt, Human
aaaauagagaaaugagug

SEQ ID NO: 9532 - RNA, 22 nt, Human
cccaaaccacgccucuugacca

SEQ ID NO: 9533 - RNA, 23 nt, Human
ccagcacauucaugcagaaaagu

SEQ ID NO: 9534 - RNA, 22 nt, Human
aagcuuuggguuggagcuguuc

SEQ ID NO: 9535 - RNA, 26 nt, Human
cccagccugggaaggagagcuugcuu

SEQ ID NO: 9536 - RNA, 26 nt, Human
gagcaucuccccuaacaccaccuacc

SEQ ID NO: 9537 - RNA, 23 nt, Human
gccuguugaacucuucugagcaa

SEQ ID NO: 9538 - RNA, 27 nt, Human
ucuggggcuucuccacuccugccccag

SEQ ID NO: 9539 - RNA, 22 nt, Human
caagaaaccuguuucaacuuga

SEQ ID NO: 9540 - RNA, 20 nt, Human
ugcuuuguuuaugguuuugu

SEQ ID NO: 9541 - RNA, 22 nt, Human
aggcccuucccggcugcgagga

SEQ ID NO: 9542 - RNA, 22 nt, Human
acccaggcuagagugcaauggc

SEQ ID NO: 9543 - RNA, 24 nt, Human
uuucaugccgggcgcaguggcuca

SEQ ID NO: 9544 - RNA, 22 nt, Human
gggugagccgagcugugguggc

SEQ ID NO: 9545 - RNA, 23 nt, Human
ccagcuugccaauggcggacuca

SEQ ID NO: 9546 - RNA, 22 nt, Human
acccaggcuggagugcaguggc

SEQ ID NO: 9547 - RNA, 22 nt, Human
gcccaggcuggagugcgguggc

SEQ ID NO: 9548 - RNA, 23 nt, Human
auuccuggcucacugagcaucaa

SEQ ID NO: 9549 - RNA, 21 nt, Human
cagguuaggaauagugguggg

SEQ ID NO: 9550 - RNA, 21 nt, Human
gcaguguagauuuuauagugu

SEQ ID NO: 9551 - RNA, 24 nt, Human
caggcagcucaucucauguccuga

SEQ ID NO: 9552 - RNA, 20 nt, Human
cgcacaucuucuguauucca

SEQ ID NO: 9553 - RNA, 21 nt, Human
gccuaaauaaggcauuugauc

SEQ ID NO: 9554 - RNA, 28 nt, Human
gggaguuucuuagccugaaggacaagaa

SEQ ID NO: 9555 - RNA, 20 nt, Human
accagccccuccagccuggg

SEQ ID NO: 9556 - RNA, 26 nt, Human
gugggugggcuguuuaggggaucugg

SEQ ID NO: 9557 - RNA, 21 nt, Human
aucuuguucuuugcuggacca

SEQ ID NO: 9558 - RNA, 24 nt, Human
uuucaugccucuccucuguggcua

SEQ ID NO: 9559 - RNA, 23 nt, Human
ugugggcagugagcggaugugac

SEQ ID NO: 9560 - RNA, 25 nt, Human
ggcuacugucugggcugagcaguag

SEQ ID NO: 9561 - RNA, 20 nt, Human
gcgguugauuccagugaggg

SEQ ID NO: 9562 - RNA, 26 nt, Human
caguagaaaugcaucuaugaggucag

SEQ ID NO: 9563 - RNA, 20 nt, Human
accacccucuaucagcagug

SEQ ID NO: 9564 - RNA, 22 nt, Human
caggggcuguucugcagcaccg

SEQ ID NO: 9565 - RNA, 26 nt, Human
gccgggcccauagguguagcugagca

SEQ ID NO: 9566 - RNA, 22 nt, Human
gaacuccugagcucaagcaguc

SEQ ID NO: 9567 - RNA, 25 nt, Human
cuuacgucuguccauccaucugucc

SEQ ID NO: 9568 - RNA, 21 nt, Human
guccuguuuguucauuuggau

SEQ ID NO: 9569 - RNA, 21 nt, Human
ggaguccgacaaagcuacuug

SEQ ID NO: 9570 - RNA, 21 nt, Human
caugacugcggaacugcccag

SEQ ID NO: 9571 - RNA, 20 nt, Human
agaagagacaggagaucaga

SEQ ID NO: 9572 - RNA, 19 nt, Human
acaguuacagggagagaac

SEQ ID NO: 9573 - RNA, 19 nt, Human
aacgucacaucuuuaaccc

SEQ ID NO: 9574 - RNA, 23 nt, Human
ucaacugaucaaacuaaugcaaa

SEQ ID NO: 9575 - RNA, 21 nt, Human
ccugaaaaacaaacacaaguu

SEQ ID NO: 9576 - RNA, 22 nt, Human
ccuguaaucccagcuacucggg

SEQ ID NO: 9577 - RNA, 22 nt, Human
ccuguaauccuagcuacuuggg

SEQ ID NO: 9578 - RNA, 22 nt, Human
gaccagccuggccaauauggug

SEQ ID NO: 9579 - RNA, 26 nt, Human
agggcggccagagaacccagcaaucc

SEQ ID NO: 9580 - RNA, 19 nt, Human
gcaugguauucaaguacaa

SEQ ID NO: 9581 - RNA, 19 nt, Human
gaggcagacaucugaacag

SEQ ID NO: 9582 - RNA, 20 nt, Human
cauuuccaguuccuccauga

SEQ ID NO: 9583 - RNA, 20 nt, Human
gggccagcccaccauggggg

SEQ ID NO: 9584 - RNA, 18 nt, Human
cuucguccuguuccccga

SEQ ID NO: 9585 - RNA, 18 nt, Human
gaauccucagggcacuga

SEQ ID NO: 9586 - RNA, 16 nt, Human
acuauaaaaauccuua

SEQ ID NO: 9587 - RNA, 21 nt, Human
caacagcaacaaaaggcucca

SEQ ID NO: 9588 - RNA, 24 nt, Human
ucuccccuucucuuccccgaggcu

SEQ ID NO: 9589 - RNA, 19 nt, Human
acccaggcuugagugcagu

SEQ ID NO: 9590 - RNA, 25 nt, Human
gggcauuucacagugcccaagagug

SEQ ID NO: 9591 - RNA, 23 nt, Human
agagcaggcaccagcagcagaau

SEQ ID NO: 9592 - RNA, 22 nt, Human
caagacugagcaacucccugaa

SEQ ID NO: 9593 - RNA, 21 nt, Human
cuguccuccucgugggugggg

SEQ ID NO: 9594 - RNA, 21 nt, Human
uuguagcccaggcuggagugc

SEQ ID NO: 9595 - RNA, 18 nt, Human
acagggagagucagccuc

SEQ ID NO: 9596 - RNA, 18 nt, Human
cuuccucuucuucauugc

SEQ ID NO: 9597 - RNA, 21 nt, Human
acugaucucugugguuugguu

SEQ ID NO: 9598 - RNA, 28 nt, Human
uggcucugucagccucucugggcacuug

SEQ ID NO: 9599 - RNA, 22 nt, Human
agcaaccucuaccuccuggguu

SEQ ID NO: 9600 - RNA, 23 nt, Human
gcuagaggcaucuucuacgggau

SEQ ID NO: 9601 - RNA, 20 nt, Human
gugcaugugacugugcuggg

SEQ ID NO: 9602 - RNA, 21 nt, Human
ccucagcugccccccaaccuc

SEQ ID NO: 9603 - RNA, 21 nt, Human
uaacucauauguucccaauua

SEQ ID NO: 9604 - RNA, 18 nt, Human
ccuccugaaaggcugcuu

SEQ ID NO: 9605 - RNA, 27 nt, Human
agguuuguuuggaacagaaaucaaaga

SEQ ID NO: 9606 - RNA, 21 nt, Human
cacccaggcuggaaugcagug

SEQ ID NO: 9607 - RNA, 21 nt, Human
ccuuuugucucugggaccaga

SEQ ID NO: 9608 - RNA, 27 nt, Human
gaggagugcagaggggaccuugggagc

SEQ ID NO: 9609 - RNA, 21 nt, Human
agaaguccuacuugacaauca

SEQ ID NO: 9610 - RNA, 25 nt, Human
cagcucuucccaaggaccagguccc

SEQ ID NO: 9611 - RNA, 23 nt, Human
ccaaacacauuuacccuuuggcc

SEQ ID NO: 9612 - RNA, 22 nt, Human
ccccuuucacguagacacaccu

SEQ ID NO: 9613 - RNA, 24 nt, Human
cucugaaucucaaacaaguugaua

SEQ ID NO: 9614 - RNA, 22 nt, Human
cugcaaccuccaccucccgggu

SEQ ID NO: 9615 - RNA, 22 nt, Human
cugcaaccuccgccucccgagu

SEQ ID NO: 9616 - RNA, 22 nt, Human
acuguaaccuccgccucccagg

SEQ ID NO: 9617 - RNA, 23 nt, Human
ccugggcugugcugaggcagugc

SEQ ID NO: 9618 - RNA, 25 nt, Human
aaccugacggacauggacgcccuga

SEQ ID NO: 9619 - RNA, 22 nt, Human
ugucgcccuggcuggagugcaa

SEQ ID NO: 9620 - RNA, 25 nt, Human
uucauucucuauuuuugcuaaauuu

SEQ ID NO: 9621 - RNA, 20 nt, Human
cuccaacauaccagauugua

SEQ ID NO: 9622 - RNA, 22 nt, Human
agacugaggcaggagaauggcg

SEQ ID NO: 9623 - RNA, 19 nt, Human
uuauuuuuuaaaugcagug

SEQ ID NO: 9624 - RNA, 19 nt, Human
uacaagaaguaguguggug

SEQ ID NO: 9625 - RNA, 21 nt, Human
agcuuucugcagugacggaaa

SEQ ID NO: 9626 - RNA, 21 nt, Human
cccaaacacaaaacauucaug

SEQ ID NO: 9627 - RNA, 22 nt, Human
aggcugaggcaggagaauagcg

SEQ ID NO: 9628 - RNA, 22 nt, Human
agaccagccuggucaacauggc

SEQ ID NO: 9629 - RNA, 21 nt, Human
cugggcuuuuguguguuuugg

SEQ ID NO: 9630 - RNA, 24 nt, Human
guccaugcuggugucuggguuaua

SEQ ID NO: 9631 - RNA, 21 nt, Human
cuacggggcggugccugcugu

SEQ ID NO: 9632 - RNA, 27 nt, Human
ugcuguuccaccuccccucagacuauc

SEQ ID NO: 9633 - RNA, 21 nt, Human
cuugcaucuucacaaaggaua

SEQ ID NO: 9634 - RNA, 21 nt, Human
accaugucaagaaauuauuaa

SEQ ID NO: 9635 - RNA, 24 nt, Human
cgccgucgcuuggcuucuucugga

SEQ ID NO: 9636 - RNA, 24 nt, Human
gcucucuccuggugccugcaccug

SEQ ID NO: 9637 - RNA, 22 nt, Human
uaaugccaccaacucuggcuua

SEQ ID NO: 9638 - RNA, 21 nt, Human
auucauuuucuggguguuuuc

SEQ ID NO: 9639 - RNA, 20 nt, Human
uaguagaguauaggagaagu

SEQ ID NO: 9640 - RNA, 26 nt, Human
ugagaggucuccuggguuggggccca

SEQ ID NO: 9641 - RNA, 22 nt, Human
accaggaugaauuuccuucuca

SEQ ID NO: 9642 - RNA, 21 nt, Human
gggcaaucugucacacucuca

SEQ ID NO: 9643 - RNA, 22 nt, Human
aguguuuguaaucccagcacuu

SEQ ID NO: 9644 - RNA, 22 nt, Human
uguaagacacacagccuuucug

SEQ ID NO: 9645 - RNA, 22 nt, Human
aacaaccaaaaaucuauugugg

SEQ ID NO: 9646 - RNA, 27 nt, Human
acguccuccauaaguggagcacagggu

SEQ ID NO: 9647 - RNA, 22 nt, Human
gcugccagacacccccugcugc

SEQ ID NO: 9648 - RNA, 24 nt, Human
uguggguggaaauauuccucugag

SEQ ID NO: 9649 - RNA, 28 nt, Human
ccucucgccagccgcauccaugcuucug

SEQ ID NO: 9650 - RNA, 20 nt, Human
uccuccuccuccuccugggu

SEQ ID NO: 9651 - RNA, 21 nt, Human
caucuccacuccagauuuuuu

SEQ ID NO: 9652 - RNA, 22 nt, Human
ucacuuuguacucaaagccaca

SEQ ID NO: 9653 - RNA, 25 nt, Human
ccaaugcccggccaggcuaagccgc

SEQ ID NO: 9654 - RNA, 26 nt, Human
ccacuggccccacgucacacaguuac

SEQ ID NO: 9655 - RNA, 25 nt, Human
guguuuucucuccuuuucugggccu

SEQ ID NO: 9656 - RNA, 21 nt, Human
gacacaccagggucucagccu

SEQ ID NO: 9657 - RNA, 21 nt, Human
ugaauaucuugaauccuguua

SEQ ID NO: 9658 - RNA, 21 nt, Human
cauuggguuucuucuuuguca

SEQ ID NO: 9659 - RNA, 20 nt, Human
gggguccacgggcacuggga

SEQ ID NO: 9660 - RNA, 19 nt, Human
gaaauugaaaacuugaagg

SEQ ID NO: 9661 - RNA, 27 nt, Human
gcuucuauuauugccuucuucagcaca

SEQ ID NO: 9662 - RNA, 26 nt, Human
ccugccugcccgccagccugaccugu

SEQ ID NO: 9663 - RNA, 21 nt, Human
gguuacgucagccuacugugg

SEQ ID NO: 9664 - RNA, 19 nt, Human
ugcggccgccuccggccag

SEQ ID NO: 9665 - RNA, 26 nt, Human
gcaucuucagcacuuaccgauccaga

SEQ ID NO: 9666 - RNA, 19 nt, Human
ggagaggaaagagcaggca

SEQ ID NO: 9667 - RNA, 22 nt, Human
gccucccagguucaagugauuc

SEQ ID NO: 9668 - RNA, 22 nt, Human
auguccacaggccagggccugu

SEQ ID NO: 9669 - RNA, 23 nt, Human
acuuuuuugggaaauacuggaaa

SEQ ID NO: 9670 - RNA, 20 nt, Human
ugguguucccaguguggcuc

SEQ ID NO: 9671 - RNA, 23 nt, Human
cucaggguuuugggguccugggc

SEQ ID NO: 9672 - RNA, 26 nt, Human
cagggcugugucccagaugggccacg

SEQ ID NO: 9673 - RNA, 25 nt, Human
cagcucuuucuuccgggaagguuau

SEQ ID NO: 9674 - RNA, 23 nt, Human
agcauucaccugcccugucucca

SEQ ID NO: 9675 - RNA, 30 nt, Human
ggggcaggaggaaugcaggagcaggaguug

SEQ ID NO: 9676 - RNA, 30 nt, Human
gauguucucggucacccuccugguucugcc

SEQ ID NO: 9677 - RNA, 23 nt, Human
gcggcugccccaccauggcuacc

SEQ ID NO: 9678 - RNA, 26 nt, Human
acaugcuggaggagccccggccgcgg

SEQ ID NO: 9679 - RNA, 24 nt, Human
ucauauucacggguucuggagauu

SEQ ID NO: 9680 - RNA, 21 nt, Human
ucuccaucuucagcuucuuca

SEQ ID NO: 9681 - RNA, 22 nt, Human
gcuggggacuggggaaggggag

SEQ ID NO: 9682 - RNA, 23 nt, Human
uaaaaagcaaaauaaacuugguu

SEQ ID NO: 9683 - RNA, 19 nt, Human
uuugaaguuaagcugcaaa

SEQ ID NO: 9684 - RNA, 22 nt, Human
gcuuucucagauuccaaggacu

SEQ ID NO: 9685 - RNA, 22 nt, Human
aggaaucaugccguuugcaaaa

SEQ ID NO: 9686 - RNA, 26 nt, Human
agcuggcccauaaucagcaguggggc

SEQ ID NO: 9687 - RNA, 23 nt, Human
caucucuacaaaagaugcaagaa

SEQ ID NO: 9688 - RNA, 26 nt, Human
ccacaggauacaucaucgccccucug

SEQ ID NO: 9689 - RNA, 24 nt, Human
ggagaauugggcacccacaggaau

SEQ ID NO: 9690 - RNA, 24 nt, Human
accuuuugcccuaggaggaagcaa

SEQ ID NO: 9691 - RNA, 22 nt, Human
ggcucaaugcaaccucugcccc

SEQ ID NO: 9692 - RNA, 26 nt, Human
gcuggcugugccugcuucuguguacc

SEQ ID NO: 9693 - RNA, 28 nt, Human
cagaaauagccacagcuuccaguggugg

SEQ ID NO: 9694 - RNA, 24 nt, Human
cucaaagcuuauuugaguagaaug

SEQ ID NO: 9695 - RNA, 20 nt, Human
ccccacugcugugcaaugcc

SEQ ID NO: 9696 - RNA, 27 nt, Human
gagccccggagcgagagcgagugccug

SEQ ID NO: 9697 - RNA, 24 nt, Human
uuucucacccucuguccuuccccc

SEQ ID NO: 9698 - RNA, 30 nt, Human
ccaccauuuuguccaagccugggcaugggu

SEQ ID NO: 9699 - RNA, 14 nt, Human
cugucuugaagauu

SEQ ID NO: 9700 - RNA, 26 nt, Human
ucuuccucugcuuggugaauugugcc

SEQ ID NO: 9701 - RNA, 21 nt, Human
uuagccugggggcccccaccu

SEQ ID NO: 9702 - RNA, 21 nt, Human
auucccuggggaaaacuugca

SEQ ID NO: 9703 - RNA, 23 nt, Human
cagcccaguuucaaacuccugac

SEQ ID NO: 9704 - RNA, 23 nt, Human
augcagauacuuauugcauuucu

SEQ ID NO: 9705 - RNA, 27 nt, Human
agcagcagcagcagguaccagcacggc

SEQ ID NO: 9706 - RNA, 23 nt, Human
gaaauugaguugaacaggccagg

SEQ ID NO: 9707 - RNA, 24 nt, Human
cucaaguuuuagaaaggcaaccaa

SEQ ID NO: 9708 - RNA, 25 nt, Human
uuuuauguucaaaacacacaguaca

SEQ ID NO: 9709 - RNA, 22 nt, Human
cagaagcucaaggcugcaguga

SEQ ID NO: 9710 - RNA, 20 nt, Human
uaacauucuccacagccuca

SEQ ID NO: 9711 - RNA, 18 nt, Human
gccccgcuggugcacuga

SEQ ID NO: 9712 - RNA, 27 nt, Human
cgcagcccagccucgaaaugcagaacg

SEQ ID NO: 9713 - RNA, 20 nt, Human
accugcucuccaccuggacu

SEQ ID NO: 9714 - RNA, 21 nt, Human
aguccuucccaccuccaguca

SEQ ID NO: 9715 - RNA, 23 nt, Human
ugcgcucggcccucaagugcccg

SEQ ID NO: 9716 - RNA, 26 nt, Human
aaaugauacagaucuguuuacaaggu

SEQ ID NO: 9717 - RNA, 22 nt, Human
caauuccggacgcaguaccaug

SEQ ID NO: 9718 - RNA, 21 nt, Human
agcuucucuggggaacugcuc

SEQ ID NO: 9719 - RNA, 19 nt, Human
acaucuuguuuuacugaau

SEQ ID NO: 9720 - RNA, 22 nt, Human
cagauacacaagugagggcuuu

SEQ ID NO: 9721 - RNA, 27 nt, Human
gcuuccugccugucauuugaauaaaca

SEQ ID NO: 9722 - RNA, 23 nt, Human
accgcagcagccucccucccucu

SEQ ID NO: 9723 - RNA, 23 nt, Human
aucaugaguaagcucccuucugu

SEQ ID NO: 9724 - RNA, 25 nt, Human
accugcugucuaaaccucugcuugg

SEQ ID NO: 9725 - RNA, 21 nt, Human
gccucguggagcucgccccuc

SEQ ID NO: 9726 - RNA, 22 nt, Human
gaacuccugaccucaagugauc

SEQ ID NO: 9727 - RNA, 26 nt, Human
ggcucacuggucacggauuugugucu

SEQ ID NO: 9728 - RNA, 22 nt, Human
agcccaggccagagugcagugg

SEQ ID NO: 9729 - RNA, 23 nt, Human
cccugccuuaaguccaguucuuu

SEQ ID NO: 9730 - RNA, 21 nt, Human
caguuugaaaaagcauauuca

SEQ ID NO: 9731 - RNA, 25 nt, Human
gcugcagggccucagccucaggaug

SEQ ID NO: 9732 - RNA, 23 nt, Human
guccacugcaaccuccacauccu

SEQ ID NO: 9733 - RNA, 22 nt, Human
gaagcugggcugucucucucca

SEQ ID NO: 9734 - RNA, 23 nt, Human
uugcaacaggcugggcuucagug

SEQ ID NO: 9735 - RNA, 23 nt, Human
uccucaaguguagauuucucuua

SEQ ID NO: 9736 - RNA, 24 nt, Human
uugaggcagagucuucuuugugcc

SEQ ID NO: 9737 - RNA, 20 nt, Human
gaauugaaagcucucaggau

SEQ ID NO: 9738 - RNA, 21 nt, Human
cagggcuggaauggaagcuuu

SEQ ID NO: 9739 - RNA, 24 nt, Human
ggaugggaaaaacugcagucauca

SEQ ID NO: 9740 - RNA, 26 nt, Human
uacauccaucaagagagacagagcgc

SEQ ID NO: 9741 - RNA, 22 nt, Human
cauccuagcgaggcaccagcac

SEQ ID NO: 9742 - RNA, 23 nt, Human
gaagcucuuguuucugacauuuc

SEQ ID NO: 9743 - RNA, 21 nt, Human
auacaauaaaauaaaaugcac

SEQ ID NO: 9744 - RNA, 25 nt, Human
gagagggagaugugugggcgagagc

SEQ ID NO: 9745 - RNA, 21 nt, Human
ucgggagacggaguggaacac

SEQ ID NO: 9746 - RNA, 24 nt, Human
uguaaacaauuucuuaggacacca

SEQ ID NO: 9747 - RNA, 22 nt, Human
ucacccaggcugcaguucacug

SEQ ID NO: 9748 - RNA, 24 nt, Human
cgagggaguugggacaggaggauu

SEQ ID NO: 9749 - RNA, 26 nt, Human
cuccacccacguucucccguccuggg

SEQ ID NO: 9750 - RNA, 20 nt, Human
guguauuucuuaugcaaaca

SEQ ID NO: 9751 - RNA, 22 nt, Human
aaacuccugggcuccaacgauc

SEQ ID NO: 9752 - RNA, 25 nt, Human
uccagcacccaccucccuacucucc

SEQ ID NO: 9753 - RNA, 21 nt, Human
cguguuguuccccacucuggg

SEQ ID NO: 9754 - RNA, 27 nt, Human
ccagaguagcugggacuacaaacgugu

SEQ ID NO: 9755 - RNA, 24 nt, Human
gaaguugaaaaaaggcagagcagg

SEQ ID NO: 9756 - RNA, 28 nt, Human
ccucuauuggcucugcucaaauguugca

SEQ ID NO: 9757 - RNA, 26 nt, Human
ccuaucucccuggcagcaacuaaguu

SEQ ID NO: 9758 - RNA, 26 nt, Human
gacugccuggccagccuggggcacug

SEQ ID NO: 9759 - RNA, 18 nt, Human
caagaaagaucagaggaa

SEQ ID NO: 9760 - RNA, 25 nt, Human
uggagagaagagaaggcagcagcag

SEQ ID NO: 9761 - RNA, 22 nt, Human
cuguaaucccagcuacucggga

SEQ ID NO: 9762 - RNA, 27 nt, Human
cauuuccugggcuguuaaacaaagcga

SEQ ID NO: 9763 - RNA, 21 nt, Human
ugggguguguggcagagccag

SEQ ID NO: 9764 - RNA, 23 nt, Human
ucacugcaccuccaccuuccggg

SEQ ID NO: 9765 - RNA, 22 nt, Human
ccaagaucacaccauugcacuc

SEQ ID NO: 9766 - RNA, 22 nt, Human
gcuccccacgauaagcaccagu

SEQ ID NO: 9767 - RNA, 22 nt, Human
gggaaaggugugccauaagcug

SEQ ID NO: 9768 - RNA, 22 nt, Human
cugagaucaugccauugcacuc

SEQ ID NO: 9769 - RNA, 22 nt, Human
cugagaucacgccauuguacuc

SEQ ID NO: 9770 - RNA, 25 nt, Human
cccugcaggaacgcgccgaggucuc

SEQ ID NO: 9771 - RNA, 26 nt, Human
uuuaaaccauuauuuucacccuguug

SEQ ID NO: 9772 - RNA, 22 nt, Human
gggcccaggaggucaaggcuuc

SEQ ID NO: 9773 - RNA, 26 nt, Human
ccagcuguuucacccuucagcaacau

SEQ ID NO: 9774 - RNA, 26 nt, Human
ccaaguaccaguauaagcaucugcca

SEQ ID NO: 9775 - RNA, 22 nt, Human
gccggggcuggcggugccugag

SEQ ID NO: 9776 - RNA, 22 nt, Human
gggaggcggagguuccagugag

SEQ ID NO: 9777 - RNA, 19 nt, Human
ccuuucuccuccggcagcc

SEQ ID NO: 9778 - RNA, 20 nt, Human
gcuugcaucuuccauccuac

SEQ ID NO: 9779 - RNA, 21 nt, Human
ggcucgugcauguaauccuag

SEQ ID NO: 9780 - RNA, 20 nt, Human
uacaacugcuauaugacucu

SEQ ID NO: 9781 - RNA, 27 nt, Human
gcucucucaacaucacauacagcuuca

SEQ ID NO: 9782 - RNA, 22 nt, Human
uccgcccaggcugcagugcagu

SEQ ID NO: 9783 - RNA, 21 nt, Human
augucacaggcccagcucuuc

SEQ ID NO: 9784 - RNA, 22 nt, Human
ucccaaggcugccagacaugga

SEQ ID NO: 9785 - RNA, 22 nt, Human
acgaggcaggggcucugcuucc

SEQ ID NO: 9786 - RNA, 23 nt, Human
aggcuggaguacaguggugugau

SEQ ID NO: 9787 - RNA, 21 nt, Human
ugucuagguuugugcuucuag

SEQ ID NO: 9788 - RNA, 22 nt, Human
ugagacuacaagcacccaccac

SEQ ID NO: 9789 - RNA, 22 nt, Human
uccaacuagcugggacuacagg

SEQ ID NO: 9790 - RNA, 24 nt, Human
acaugucucucccugcucuuccag

SEQ ID NO: 9791 - RNA, 22 nt, Human
cgcgcucccgggagcccagggc

SEQ ID NO: 9792 - RNA, 22 nt, Human
ucagcagaaccauugggaccug

SEQ ID NO: 9793 - RNA, 28 nt, Human
gggaagaggcagagggaggcagccagcg

SEQ ID NO: 9794 - RNA, 22 nt, Human
aauguaccaucaaauguuaaca

SEQ ID NO: 9795 - RNA, 27 nt, Human
uucaguuagacaaggaccaggauugca

SEQ ID NO: 9796 - RNA, 23 nt, Human
ggcccugcugucaaccucuccuc

SEQ ID NO: 9797 - RNA, 23 nt, Human
accagcacaucacuaugcaucug

SEQ ID NO: 9798 - RNA, 22 nt, Human
ugucacccaggcuguggugcag

SEQ ID NO: 9799 - RNA, 27 nt, Human
ccuuaagcugcaggauucucaccagcu

SEQ ID NO: 9800 - RNA, 27 nt, Human
gggccaggaccagaaccuugcccacgg

SEQ ID NO: 9801 - RNA, 27 nt, Human
ucagcugugggaccuuuuuccuccucu

SEQ ID NO: 9802 - RNA, 20 nt, Human
cacaucucacucaucaccaa

SEQ ID NO: 9803 - RNA, 22 nt, Human
uuccuucuugcuucucauagcc

SEQ ID NO: 9804 - RNA, 27 nt, Human
gaugcaaucacuuuuggacaugcuuuu

SEQ ID NO: 9805 - RNA, 22 nt, Human
cgccuccucucagucuacucaa

SEQ ID NO: 9806 - RNA, 21 nt, Human
gagugagacccaggagccgga

SEQ ID NO: 9807 - RNA, 21 nt, Human
uaggccauuuguuacaguuuc

SEQ ID NO: 9808 - RNA, 21 nt, Human
auaucuauucaaauauacagg

SEQ ID NO: 9809 - RNA, 22 nt, Human
ggucucaaacuccugggcucag

SEQ ID NO: 9810 - RNA, 22 nt, Human
gacuguuuccccucucagcauc

SEQ ID NO: 9811 - RNA, 23 nt, Human
ucaguagcgccacaucugguuua

SEQ ID NO: 9812 - RNA, 23 nt, Human
ucuuagcaaucaauauuuuucug

SEQ ID NO: 9813 - RNA, 23 nt, Human
ccaggagucagagguuucaguga

SEQ ID NO: 9814 - RNA, 20 nt, Human
uuugagaccagccugggcaa

SEQ ID NO: 9815 - RNA, 24 nt, Human
gugaggcgcucagccagggccaag

SEQ ID NO: 9816 - RNA, 21 nt, Human
ggucggaucucacaggcugag

SEQ ID NO: 9817 - RNA, 22 nt, Human
aauccccacaggcacauuaacu

SEQ ID NO: 9818 - RNA, 22 nt, Human
aacuguugaauaguuacugaau

SEQ ID NO: 9819 - RNA, 24 nt, Human
uucgagcucaucaugagaugccaa

SEQ ID NO: 9820 - RNA, 21 nt, Human
ugaauugcauuuuacuuuaau

SEQ ID NO: 9821 - RNA, 19 nt, Human
aagaggcagagccugugcc

SEQ ID NO: 9822 - RNA, 26 nt, Human
aagcguugccuggaugcgguggugca

SEQ ID NO: 9823 - RNA, 21 nt, Human
agaauccuaauuagcuacuuu

SEQ ID NO: 9824 - RNA, 27 nt, Human
uccacauacccugaccuggcccccuca

SEQ ID NO: 9825 - RNA, 27 nt, Human
ccugaguagcugggaauacagcaugcg

SEQ ID NO: 9826 - RNA, 19 nt, Human
uccccuugcccacugggac

SEQ ID NO: 9827 - RNA, 24 nt, Human
ccuccucccacuucuuucucugca

SEQ ID NO: 9828 - RNA, 25 nt, Human
aggacaacacugccuuucaaacuuu

SEQ ID NO: 9829 - RNA, 22 nt, Human
augacaccuuccugauacuuug

SEQ ID NO: 9830 - RNA, 21 nt, Human
ggaggucgaggcugcagugag

SEQ ID NO: 9831 - RNA, 29 nt, Human
uuuguucucaccucuaccugucauuccag

SEQ ID NO: 9832 - RNA, 21 nt, Human
uguugcuggacugucauagaa

SEQ ID NO: 9833 - RNA, 22 nt, Human
ucaucacuuuaaacaucauguu

SEQ ID NO: 9834 - RNA, 23 nt, Human
uucauuucaucuugcuuugcuuu

SEQ ID NO: 9835 - RNA, 19 nt, Human
cuggauggaggcuggaggc

SEQ ID NO: 9836 - RNA, 22 nt, Human
cuuggccucccaaagugcuggg

SEQ ID NO: 9837 - RNA, 28 nt, Human
ucucucaccuguucucaccccucugcag

SEQ ID NO: 9838 - RNA, 24 nt, Human
guggaggccuccugggguggccug

SEQ ID NO: 9839 - RNA, 24 nt, Human
ccugcaaccuccgccuccuggguu

SEQ ID NO: 9840 - RNA, 26 nt, Human
acucacaaccccugcuccaguccugg

SEQ ID NO: 9841 - RNA, 25 nt, Human
ggccugaagcaauccgcccaccuca

SEQ ID NO: 9842 - RNA, 23 nt, Human
auuguucugcugaagaguuguca

SEQ ID NO: 9843 - RNA, 27 nt, Human
ucuucuuucuugaaaucccaaaccuuc

SEQ ID NO: 9844 - RNA, 21 nt, Human
guuuaaaagagaaaguggcca

SEQ ID NO: 9845 - RNA, 22 nt, Human
cacagggagcagggaguuuucu

SEQ ID NO: 9846 - RNA, 23 nt, Human
acuuccucugugaacugugugug

SEQ ID NO: 9847 - RNA, 27 nt, Human
uucaguuacuuaccugcauguguugua

SEQ ID NO: 9848 - RNA, 22 nt, Human
ugccucccagguucaagcgauu

SEQ ID NO: 9849 - RNA, 28 nt, Human
uucuguacuuugcccucaugaguuccaa

SEQ ID NO: 9850 - RNA, 22 nt, Human
aaaggguuucaccaaggaugga

SEQ ID NO: 9851 - RNA, 20 nt, Human
cuaaagugugagccacugag

SEQ ID NO: 9852 - RNA, 18 nt, Human
ucacagaaaaucacccug

SEQ ID NO: 9853 - RNA, 27 nt, Human
agaaaaaugcuggaggcugggcguggc

SEQ ID NO: 9854 - RNA, 21 nt, Human
ugaaaccucccaauggcauuu

SEQ ID NO: 9855 - RNA, 26 nt, Human
cccuuuugaacauuccuuuucucaug

SEQ ID NO: 9856 - RNA, 23 nt, Human
gcacccuagcugcugacagcccu

SEQ ID NO: 9857 - RNA, 21 nt, Human
augaugccuaggcccaaagga

SEQ ID NO: 9858 - RNA, 26 nt, Human
aaggauuggccgggcgcgguggcuca

SEQ ID NO: 9859 - RNA, 21 nt, Human
ccuacuucucuuucuuguaau

SEQ ID NO: 9860 - RNA, 23 nt, Human
cugagucugcacgcuggcuucug

SEQ ID NO: 9861 - RNA, 26 nt, Human
cccugccccucuccccacauguaucc

SEQ ID NO: 9862 - RNA, 23 nt, Human
gggaacccuggggcauggagagg

SEQ ID NO: 9863 - RNA, 27 nt, Human
agcuagcaaagacuugugugaugccuc

SEQ ID NO: 9864 - RNA, 22 nt, Human
uggcacacaccuguaguccgag

SEQ ID NO: 9865 - RNA, 18 nt, Human
gcugccugugaaugcacu

SEQ ID NO: 9866 - RNA, 28 nt, Human
uaauuaguugucuaaauauuuuucagug

SEQ ID NO: 9867 - RNA, 26 nt, Human
aggcaacgggcggcagguugcagugg

SEQ ID NO: 9868 - RNA, 22 nt, Human
uauccagcaaaaugucuccuga

SEQ ID NO: 9869 - RNA, 21 nt, Human
ugagccaaggaacuuuccuuc

SEQ ID NO: 9870 - RNA, 22 nt, Human
aucuuucuuccuguccucucac

SEQ ID NO: 9871 - RNA, 26 nt, Human
gucagcaggcugcagggagugcacac

SEQ ID NO: 9872 - RNA, 24 nt, Human
gagugagggaacuuucugucuuca

SEQ ID NO: 9873 - RNA, 23 nt, Human
ccugcugcaagucccaacuuuga

SEQ ID NO: 9874 - RNA, 21 nt, Human
uuggacacaguguuuuaucac

SEQ ID NO: 9875 - RNA, 26 nt, Human
acucaagcuuguuagagggcuuuuua

SEQ ID NO: 9876 - RNA, 22 nt, Human
ugucauugcacuccagccuggg

SEQ ID NO: 9877 - RNA, 28 nt, Human
ggggaguggagucaccacucgggacaua

SEQ ID NO: 9878 - RNA, 27 nt, Human
ggcccgaccuggggcugagugcagagg

SEQ ID NO: 9879 - RNA, 28 nt, Human
uaggaaugggggacagggggaggggagg

SEQ ID NO: 9880 - RNA, 20 nt, Human
uauuguaauugcucucuuua

SEQ ID NO: 9881 - RNA, 22 nt, Human
ccuggcuggagaauguggagaa

SEQ ID NO: 9882 - RNA, 21 nt, Human
ugucacuucucucaagccuga

SEQ ID NO: 9883 - RNA, 25 nt, Human
ucauccagaggagcuggaaccaugg

SEQ ID NO: 9884 - RNA, 22 nt, Human
cacugcauuucagccuggggga

SEQ ID NO: 9885 - RNA, 24 nt, Human
agggguggagauggguguggcagu

SEQ ID NO: 9886 - RNA, 26 nt, Human
cugggaccuccacacuccugguucuc

SEQ ID NO: 9887 - RNA, 27 nt, Human
ucauagaacaugauguuaaaugagacc

SEQ ID NO: 9888 - RNA, 22 nt, Human
gggagagaugugagcaucccgg

SEQ ID NO: 9889 - RNA, 32 nt, Human
agaggggcugccaguccucucugggccgcagc

SEQ ID NO: 9890 - RNA, 27 nt, Human
cuugcaacuuugagaacaaaacagucc

SEQ ID NO: 9891 - RNA, 22 nt, Human
ccgaauagcugggacuacaggu

SEQ ID NO: 9892 - RNA, 22 nt, Human
uacugcccucugccucagcagu

SEQ ID NO: 9893 - RNA, 19 nt, Human
acccagguuggagugcagu

SEQ ID NO: 9894 - RNA, 19 nt, Human
acccaggcuggaguguagu

SEQ ID NO: 9895 - RNA, 22 nt, Human
agcucacuuggccugcuugccc

SEQ ID NO: 9896 - RNA, 25 nt, Human
cugccucuguggcucugccugugga

SEQ ID NO: 9897 - RNA, 30 nt, Human
ccgggaucagcaacccuuccugcugcugcu

SEQ ID NO: 9898 - RNA, 26 nt, Human
gucaguccuuuggaaaccagcagguc

SEQ ID NO: 9899 - RNA, 27 nt, Human
caggcuggagugcaguggcaccaucuc

SEQ ID NO: 9900 - RNA, 27 nt, Human
ugggacccugcacagcccacggacgcc

SEQ ID NO: 9901 - RNA, 21 nt, Human
ugaugacacuggcacauugag

SEQ ID NO: 9902 - RNA, 21 nt, Human
uacucuugaagucaagcaaua

SEQ ID NO: 9903 - RNA, 22 nt, Human
caggagguggagguuacaguga

SEQ ID NO: 9904 - RNA, 21 nt, Human
ucauccaggucagugcucaga

SEQ ID NO: 9905 - RNA, 23 nt, Human
uucuguugauguuaacugagcua

SEQ ID NO: 9906 - RNA, 22 nt, Human
agccucccaaaauucugggauu

SEQ ID NO: 9907 - RNA, 22 nt, Human
ggaggcuggaagcagagaggag

SEQ ID NO: 9908 - RNA, 27 nt, Human
gauaagaaagugcuccugagaaggcuc

SEQ ID NO: 9909 - RNA, 22 nt, Human
acaaaaauagcuacaaauccac

SEQ ID NO: 9910 - RNA, 25 nt, Human
gcaagcaaaaacaauaacacugcuu

SEQ ID NO: 9911 - RNA, 23 nt, Human
ugaaaacagauauuacagcuuau

SEQ ID NO: 9912 - RNA, 24 nt, Human
ucucuggugcagccccuguccuca

SEQ ID NO: 9913 - RNA, 19 nt, Human
aacagcuuucaagugccuu

SEQ ID NO: 9914 - RNA, 20 nt, Human
agcugugguuuacaacuuuu

SEQ ID NO: 9915 - RNA, 21 nt, Human
acccuugcucugaccggaaga

SEQ ID NO: 9916 - RNA, 20 nt, Human
cccugcucccacuccagaag

SEQ ID NO: 9917 - RNA, 19 nt, Human
ucuuuggauuucagucuug

SEQ ID NO: 9918 - RNA, 28 nt, Human
gaggaaagagaaucgggccacugccaga

SEQ ID NO: 9919 - RNA, 24 nt, Human
ggaagucuugugucuggagaauag

SEQ ID NO: 9920 - RNA, 19 nt, Human
uuggcauuuguuuaaccuc

SEQ ID NO: 9921 - RNA, 22 nt, Human
uucggaggaagggaauggggga

SEQ ID NO: 9922 - RNA, 20 nt, Human
agggcucuuccuacagccuu

SEQ ID NO: 9923 - RNA, 22 nt, Human
gacauuuuaagaaccagagcca

SEQ ID NO: 9924 - RNA, 23 nt, Human
gggggccagaggauucagggccg

SEQ ID NO: 9925 - RNA, 22 nt, Human
uugggcuucugcguaguuuagg

SEQ ID NO: 9926 - RNA, 22 nt, Human
ucagccccucuuuccucccucu

SEQ ID NO: 9927 - RNA, 24 nt, Human
aacuggacaagauuuccuacuuuc

SEQ ID NO: 9928 - RNA, 25 nt, Human
gaccuuggaggagauugccugcugc

SEQ ID NO: 9929 - RNA, 25 nt, Human
ucacgccuguaaucccagaacuuug

SEQ ID NO: 9930 - RNA, 29 nt, Human
cccuucugguggacaaggcugugccaacc

SEQ ID NO: 9931 - RNA, 22 nt, Human
accuuagauuagcucuggacca

SEQ ID NO: 9932 - RNA, 21 nt, Human
ucuguagcccacggcacccca

SEQ ID NO: 9933 - RNA, 20 nt, Human
gccuguaucccagcacuuug

SEQ ID NO: 9934 - RNA, 20 nt, Human
uguuccucuguuaucaugcc

SEQ ID NO: 9935 - RNA, 20 nt, Human
ccuccucugagggccgugcc

SEQ ID NO: 9936 - RNA, 19 nt, Human
caaaggcuucagggaugga

SEQ ID NO: 9937 - RNA, 27 nt, Human
ggaccugcgcuccaggguggucucggu

SEQ ID NO: 9938 - RNA, 25 nt, Human
cugcccgccugccuguccuccagca

SEQ ID NO: 9939 - RNA, 22 nt, Human
agcggcgcgcccugcagaggga

SEQ ID NO: 9940 - RNA, 27 nt, Human
acuuccauuuucaaauuuuaagcaauc

SEQ ID NO: 9941 - RNA, 22 nt, Human
cucuauauuaguuuauuguuag

SEQ ID NO: 9942 - RNA, 23 nt, Human
gacucuggguggcuccacugucu

SEQ ID NO: 9943 - RNA, 19 nt, Human
ugcaggagcucaaccaagg

SEQ ID NO: 9944 - RNA, 20 nt, Human
agggcccagugcacucacuu

SEQ ID NO: 9945 - RNA, 25 nt, Human
ggacaaagucuccagcccacguucu

SEQ ID NO: 9946 - RNA, 23 nt, Human
cauugguggugaugaugggugag

SEQ ID NO: 9947 - RNA, 20 nt, Human
cgcccaggcuggagugcaau

SEQ ID NO: 9948 - RNA, 22 nt, Human
agaagggcaaucagucuggccu

SEQ ID NO: 9949 - RNA, 20 nt, Human
cuuggcuguccaaucacacu

SEQ ID NO: 9950 - RNA, 20 nt, Human
acggcuguggccgcugccuc

SEQ ID NO: 9951 - RNA, 19 nt, Human
ucggccgccuccugcccgg

SEQ ID NO: 9952 - RNA, 23 nt, Human
uuugcagguugucuuccauucca

SEQ ID NO: 9953 - RNA, 26 nt, Human
agcuuuguccccugcuucagaugugg

SEQ ID NO: 9954 - RNA, 22 nt, Human
cacuaccacauccaaacauaag

SEQ ID NO: 9955 - RNA, 22 nt, Human
caugccuauaaucccagugcuu

SEQ ID NO: 9956 - RNA, 21 nt, Human
ugugcuugucccuggcagugg

SEQ ID NO: 9957 - RNA, 21 nt, Human
caagaguugaccauuaucucu

SEQ ID NO: 9958 - RNA, 24 nt, Human
gccagugcaaggccacugccugcc

SEQ ID NO: 9959 - RNA, 21 nt, Human
auccacuuucuucuaaaauaa

SEQ ID NO: 9960 - RNA, 30 nt, Human
gugaccugggaggcaggaggcgggucuguc

SEQ ID NO: 9961 - RNA, 22 nt, Human
cagucucaaacuccuggccuca

SEQ ID NO: 9962 - RNA, 21 nt, Human
auuaccaaccccuuagcaaua

SEQ ID NO: 9963 - RNA, 16 nt, Human
uugcuucuuagcuaua

SEQ ID NO: 9964 - RNA, 21 nt, Human
acuguccuucugccauggccc

SEQ ID NO: 9965 - RNA, 22 nt, Human
acccucucccccagccgcacgg

SEQ ID NO: 9966 - RNA, 27 nt, Human
aaauguucacuuuaaagcaauugcaua

SEQ ID NO: 9967 - RNA, 18 nt, Human
agacccauaauccugcau

SEQ ID NO: 9968 - RNA, 23 nt, Human
aauagcaaaggaaaucacuguga

SEQ ID NO: 9969 - RNA, 21 nt, Human
uucaguucugugucugguggg

SEQ ID NO: 9970 - RNA, 23 nt, Human
agcaagaagcgagaauucugaga

SEQ ID NO: 9971 - RNA, 22 nt, Human
ugacauuuaauuuucaaaucac

SEQ ID NO: 9972 - RNA, 21 nt, Human
ggagggaggcccugccugugu

SEQ ID NO: 9973 - RNA, 27 nt, Human
agggaaagugggacagcuuguagggga

SEQ ID NO: 9974 - RNA, 21 nt, Human
agaauaagacauaaaauagcu

SEQ ID NO: 9975 - RNA, 22 nt, Human
aggcugaggcaggaaaaucacu

SEQ ID NO: 9976 - RNA, 24 nt, Human
uucauuucugucacauuucauuuc

SEQ ID NO: 9977 - RNA, 26 nt, Human
ucuucuuuuccuuucucuuuucuaga

SEQ ID NO: 9978 - RNA, 24 nt, Human
caccugaggucaggaguucgaaac

SEQ ID NO: 9979 - RNA, 22 nt, Human
uguccuuugggaugauacuugg

SEQ ID NO: 9980 - RNA, 21 nt, Human
augccugacccacacacuuuu

SEQ ID NO: 9981 - RNA, 24 nt, Human
uuugcuuuccuguucccuagcuag

SEQ ID NO: 9982 - RNA, 19 nt, Human
auuaaauaaugugcugcua

SEQ ID NO: 9983 - RNA, 24 nt, Human
ugcauuucacuuccagcugcuggu

SEQ ID NO: 9984 - RNA, 22 nt, Human
gggaggcggagauugcggugag

SEQ ID NO: 9985 - RNA, 22 nt, Human
uuuauaaaaucacagauuggua

SEQ ID NO: 9986 - RNA, 23 nt, Human
cuuagcuuucagauuauggauga

SEQ ID NO: 9987 - RNA, 18 nt, Human
cuauuuccuuuccaguca

SEQ ID NO: 9988 - RNA, 27 nt, Human
ccauacaggcuggauaaaacuguuuuu

SEQ ID NO: 9989 - RNA, 25 nt, Human
ggggagccagggcuaugggagcagc

SEQ ID NO: 9990 - RNA, 19 nt, Human
ccagcagcugccagaggcc

SEQ ID NO: 9991 - RNA, 25 nt, Human
cuggaaccauacuaucaaauggcga

SEQ ID NO: 9992 - RNA, 22 nt, Human
aaaauacgaaaaaauuagcugg

SEQ ID NO: 9993 - RNA, 20 nt, Human
uguucacugcuccuugcugc

SEQ ID NO: 9994 - RNA, 25 nt, Human
ucacuugcuggagugccaaguagau

SEQ ID NO: 9995 - RNA, 23 nt, Human
cugggucucccccuaccucuucc

SEQ ID NO: 9996 - RNA, 22 nt, Human
ccaaaguucugggauuacaagu

SEQ ID NO: 9997 - RNA, 24 nt, Human
cuccucacugggggcaggguggag

SEQ ID NO: 9998 - RNA, 20 nt, Human
cgcaggugcaggcacagggc

SEQ ID NO: 9999 - RNA, 26 nt, Human
aucacaguggucuaccugcauucaua

SEQ ID NO: 10000 - RNA, 20 nt, Human
acacuguugagugcuuacuc

SEQ ID NO: 10001 - RNA, 23 nt, Human
cagguggagacccugagaaggac

SEQ ID NO: 10002 - RNA, 22 nt, Human
uauacagucuuccuguggaagu

SEQ ID NO: 10003 - RNA, 18 nt, Human
aauucuccaacagcugac

SEQ ID NO: 10004 - RNA, 21 nt, Human
ucuguggguucgucugcccag

SEQ ID NO: 10005 - RNA, 21 nt, Human
augucugacuucaaggaacuc

SEQ ID NO: 10006 - RNA, 19 nt, Human
agggaggaaggcagcauug

SEQ ID NO: 10007 - RNA, 21 nt, Human
cagaaaacaaaugaaaacccu

SEQ ID NO: 10008 - RNA, 22 nt, Human
accuguguccuccucaccccac

SEQ ID NO: 10009 - RNA, 28 nt, Human
ggcagauuaaaagcacaagcguguuucu

SEQ ID NO: 10010 - RNA, 26 nt, Human
ccuucuuaggccuccuggugcaacuu

SEQ ID NO: 10011 - RNA, 21 nt, Human
uucuuucuucuuuuaagaaca

SEQ ID NO: 10012 - RNA, 22 nt, Human
acuaagcuuaacuacaugucac

SEQ ID NO: 10013 - RNA, 25 nt, Human
aggcugcaggcacuggcagugggaa

SEQ ID NO: 10014 - RNA, 21 nt, Human
gauggccaggaauggacucau

SEQ ID NO: 10015 - RNA, 27 nt, Human
gugcacccaggcugcagggugaggcca

SEQ ID NO: 10016 - RNA, 27 nt, Human
cagccuggagugcagugagcugagauu

SEQ ID NO: 10017 - RNA, 25 nt, Human
accaggagauaaaaauggagccuga

SEQ ID NO: 10018 - RNA, 24 nt, Human
ggccucggggggcgcagaccugca

SEQ ID NO: 10019 - RNA, 24 nt, Human
uuuccuauaagcucuguguuagcu

SEQ ID NO: 10020 - RNA, 22 nt, Human
acuauccauccaucauaaccac

SEQ ID NO: 10021 - RNA, 21 nt, Human
gaccagccacugccaccuccg

SEQ ID NO: 10022 - RNA, 20 nt, Human
uucagugagcccagaucgcg

SEQ ID NO: 10023 - RNA, 27 nt, Human
ccagaaaucuaacucccugaaaccucu

SEQ ID NO: 10024 - RNA, 20 nt, Human
aaaacaaacaggaguuucca

SEQ ID NO: 10025 - RNA, 21 nt, Human
gucuuaaaagauacugcauuc

SEQ ID NO: 10026 - RNA, 21 nt, Human
cugcccuugucacuaaucacc

SEQ ID NO: 10027 - RNA, 27 nt, Human
caguguacagggcuggagucuugggga

SEQ ID NO: 10028 - RNA, 22 nt, Human
agacugccuguggcagcagaac

SEQ ID NO: 10029 - RNA, 21 nt, Human
guuuugccauguugcccaggc

SEQ ID NO: 10030 - RNA, 20 nt, Human
aaccaugagccagagcccgg

SEQ ID NO: 10031 - RNA, 24 nt, Human
uggcacaauaaaggcuucacuuuc

SEQ ID NO: 10032 - RNA, 25 nt, Human
uccccaggcucuagugcaggaggag

SEQ ID NO: 10033 - RNA, 22 nt, Human
cgcauagcuacauucugggcaa

SEQ ID NO: 10034 - RNA, 23 nt, Human
gagggaggggauaaagaggaagc

SEQ ID NO: 10035 - RNA, 22 nt, Human
cucuugagcccuccuggaaugg

SEQ ID NO: 10036 - RNA, 24 nt, Human
cuacagcugugcugugaagagagu

SEQ ID NO: 10037 - RNA, 23 nt, Human
augcccagcugcacagcuuaccc

SEQ ID NO: 10038 - RNA, 19 nt, Human
aaucaugugugggaacauu

SEQ ID NO: 10039 - RNA, 22 nt, Human
ccgauaagcugagauuacagga

SEQ ID NO: 10040 - RNA, 18 nt, Human
ucccacugggucaccuca

SEQ ID NO: 10041 - RNA, 21 nt, Human
auguuauaucugaugcugcua

SEQ ID NO: 10042 - RNA, 18 nt, Human
gccaaaagaaaugccuca

SEQ ID NO: 10043 - RNA, 23 nt, Human
uaugauaaccaagaaugucucca

SEQ ID NO: 10044 - RNA, 22 nt, Human
augcauacuuauauuaucuuaa

SEQ ID NO: 10045 - RNA, 24 nt, Human
cccacguacucuaucuuccauucc

SEQ ID NO: 10046 - RNA, 18 nt, Human
cuaccugcugagcgcccc

SEQ ID NO: 10047 - RNA, 26 nt, Human
ucacguguaacauucuuuuaaaaucu

SEQ ID NO: 10048 - RNA, 26 nt, Human
ucaaagugccugggcucagccugguu

SEQ ID NO: 10049 - RNA, 22 nt, Human
ugaucaaaaagaaggcuuagaa

SEQ ID NO: 10050 - RNA, 25 nt, Human
ggccagaagccuggagcuuugguuu

SEQ ID NO: 10051 - RNA, 26 nt, Human
caccuugcagcucuccccuucucugu

SEQ ID NO: 10052 - RNA, 24 nt, Human
gcugccucucccucccuguuugaa

SEQ ID NO: 10053 - RNA, 27 nt, Human
ggggaagagacaaaguggguguguggc

SEQ ID NO: 10054 - RNA, 24 nt, Human
ugugcuggugggguacacugcaga

SEQ ID NO: 10055 - RNA, 21 nt, Human
gccaaaacaaggacaaaucuu

SEQ ID NO: 10056 - RNA, 21 nt, Human
gaugcuuugcugcaggcacag

SEQ ID NO: 10057 - RNA, 26 nt, Human
gacuauuggcauaugauuccaaggac

SEQ ID NO: 10058 - RNA, 25 nt, Human
ucucaggcuggagugcaguggcaca

SEQ ID NO: 10059 - RNA, 22 nt, Human
uauuaaaaagcuauauuuuccu

SEQ ID NO: 10060 - RNA, 22 nt, Human
ccccccacucccugccacuguc

SEQ ID NO: 10061 - RNA, 20 nt, Human
cucaggcccagaacuggcug

SEQ ID NO: 10062 - RNA, 21 nt, Human
gucucacugcagucuuauuuc

SEQ ID NO: 10063 - RNA, 23 nt, Human
uguguauguaucuuuguaugcau

SEQ ID NO: 10064 - RNA, 23 nt, Human
aguggucacucuugagucacauc

SEQ ID NO: 10065 - RNA, 24 nt, Human
ucaguaaugucuucaguggaacac

SEQ ID NO: 10066 - RNA, 23 nt, Human
ugccgcccaggcuggagugcagu

SEQ ID NO: 10067 - RNA, 20 nt, Human
ccugugccucccaccucuuc

SEQ ID NO: 10068 - RNA, 23 nt, Human
ccguucccaccaccaucugcaug

SEQ ID NO: 10069 - RNA, 22 nt, Human
ccugccuggccggccagccagc

SEQ ID NO: 10070 - RNA, 21 nt, Human
gaccacuagagcuuguccuca

SEQ ID NO: 10071 - RNA, 27 nt, Human
ucacugcacuccaaccugggcaacaga

SEQ ID NO: 10072 - RNA, 17 nt, Human
agggugaaaaacugaca

SEQ ID NO: 10073 - RNA, 27 nt, Human
gaagcagucuuaaagggucuuuugcag

SEQ ID NO: 10074 - RNA, 22 nt, Human
ugccaggcuggauuguacgggc

SEQ ID NO: 10075 - RNA, 21 nt, Human
cuuauuuaguauucugccuca

SEQ ID NO: 10076 - RNA, 23 nt, Human
uucuugggcaucuccugccuccc

SEQ ID NO: 10077 - RNA, 22 nt, Human
gacuacaggcacaagucaccau

SEQ ID NO: 10078 - RNA, 26 nt, Human
gaugauaccauuuccugaccccguuu

SEQ ID NO: 10079 - RNA, 24 nt, Human
caugcuuguaauagguaggcaauu

SEQ ID NO: 10080 - RNA, 22 nt, Human
cagaccugguucccacugaggc

SEQ ID NO: 10081 - RNA, 23 nt, Human
guucccuccuauacuccuucacu

SEQ ID NO: 10082 - RNA, 22 nt, Human
uaggacacaggaauuccugggu

SEQ ID NO: 10083 - RNA, 24 nt, Human
gacugguucuucaggaacugugaa

SEQ ID NO: 10084 - RNA, 27 nt, Human
cagaagccucuccuccccgccgcccuc

SEQ ID NO: 10085 - RNA, 22 nt, Human
ugccuguaaucccagaacuuug

SEQ ID NO: 10086 - RNA, 26 nt, Human
aaaugcuggggauuuaaagaauugca

SEQ ID NO: 10087 - RNA, 21 nt, Human
caugguccugucuguccuucu

SEQ ID NO: 10088 - RNA, 22 nt, Human
uagcacgugccagucacuguuc

SEQ ID NO: 10089 - RNA, 20 nt, Human
cagagaccagcacucagccu

SEQ ID NO: 10090 - RNA, 21 nt, Human
ugagaggccuucuguaaccag

SEQ ID NO: 10091 - RNA, 22 nt, Human
acuaccaucugcucaacuucca

SEQ ID NO: 10092 - RNA, 20 nt, Human
caggccaugagcugcaguga

SEQ ID NO: 10093 - RNA, 26 nt, Human
agccuggaauggacuggccuggggaa

SEQ ID NO: 10094 - RNA, 20 nt, Human
ugcauuuauaaauguguggu

SEQ ID NO: 10095 - RNA, 22 nt, Human
ccuuguuggguggccaggcugg

SEQ ID NO: 10096 - RNA, 21 nt, Human
ggggccaugggccuuguggga

SEQ ID NO: 10097 - RNA, 27 nt, Human
ugaguaugaaugaggcauauucuccuc

SEQ ID NO: 10098 - RNA, 26 nt, Human
gggaggggauaagguggcagaaggaa

SEQ ID NO: 10099 - RNA, 21 nt, Human
uccagaacacauucaugauga

SEQ ID NO: 10100 - RNA, 23 nt, Human
gcccagggcaucccaugggggug

SEQ ID NO: 10101 - RNA, 22 nt, Human
ugucccacccuccccuccugac

SEQ ID NO: 10102 - RNA, 26 nt, Human
acucccugcuguuuucccugccugga

SEQ ID NO: 10103 - RNA, 23 nt, Human
ccugcagcugugccaguugggcc

SEQ ID NO: 10104 - RNA, 22 nt, Human
ggagugcgggaaagccuucagu

SEQ ID NO: 10105 - RNA, 24 nt, Human
uugaagacuuuagauuccucucug

SEQ ID NO: 10106 - RNA, 20 nt, Human
ucacagacauacaauagcau

SEQ ID NO: 10107 - RNA, 21 nt, Human
agccccugguccccagcucuu

SEQ ID NO: 10108 - RNA, 28 nt, Human
cuugcaggccuguucccuaaggggcccc

SEQ ID NO: 10109 - RNA, 17 nt, Human
cccgacugcagugcaag

SEQ ID NO: 10110 - RNA, 18 nt, Human
gaguccagagggagccau

SEQ ID NO: 10111 - RNA, 21 nt, Human
uggcuuucaaccaccugcuca

SEQ ID NO: 10112 - RNA, 18 nt, Human
auuggaaggcugguugcu

SEQ ID NO: 10113 - RNA, 24 nt, Human
cucauuucccugacuuaaaccuca

SEQ ID NO: 10114 - RNA, 27 nt, Human
ucagccacugucacaggcauauucccu

SEQ ID NO: 10115 - RNA, 20 nt, Human
uuuauguauucccuaaucca

SEQ ID NO: 10116 - RNA, 21 nt, Human
guucuuguuagaaucauggga

SEQ ID NO: 10117 - RNA, 26 nt, Human
caaaaguagucguccgccccucacgc

SEQ ID NO: 10118 - RNA, 22 nt, Human
cugccacuggggaaaacuccac

SEQ ID NO: 10119 - RNA, 25 nt, Human
uaaaagggagguggauguguuuccu

SEQ ID NO: 10120 - RNA, 21 nt, Human
cagacauggaccuucucucca

SEQ ID NO: 10121 - RNA, 22 nt, Human
auggcuugcgcucaggaggcag

SEQ ID NO: 10122 - RNA, 22 nt, Human
cugaggcaagagaauugcuuga

SEQ ID NO: 10123 - RNA, 26 nt, Human
auagauauccucucccccuccuccag

SEQ ID NO: 10124 - RNA, 23 nt, Human
ccugcacgcccuguucccuccac

SEQ ID NO: 10125 - RNA, 18 nt, Human
uaggaugucaaauaguca

SEQ ID NO: 10126 - RNA, 27 nt, Human
accagugacuaauuuugccacagggua

SEQ ID NO: 10127 - RNA, 22 nt, Human
gaauauacuaaauuaacuuuuu

SEQ ID NO: 10128 - RNA, 23 nt, Human
cgcuccugacuccugaccuccag

SEQ ID NO: 10129 - RNA, 22 nt, Human
ucugccucaggcccugcccugc

SEQ ID NO: 10130 - RNA, 27 nt, Human
cugucugucugcucacauaagcauucc

SEQ ID NO: 10131 - RNA, 23 nt, Human
ggacuccugugaaacugcugcca

SEQ ID NO: 10132 - RNA, 22 nt, Human
uuucauugauugacucuaccuc

SEQ ID NO: 10133 - RNA, 25 nt, Human
ccccaacaaugugauuggauuccuu

SEQ ID NO: 10134 - RNA, 22 nt, Human
uucagacccagggaaaggguga

SEQ ID NO: 10135 - RNA, 27 nt, Human
gcccgcccuggacuggcagcugccguc

SEQ ID NO: 10136 - RNA, 25 nt, Human
cccaccccacccuggggcccugccu

SEQ ID NO: 10137 - RNA, 23 nt, Human
ggauuuccuuugaauauugagaa

SEQ ID NO: 10138 - RNA, 26 nt, Human
ugacccuuccagacauagaaaacaca

SEQ ID NO: 10139 - RNA, 21 nt, Human
auuaaggccuuuuccacacgc

SEQ ID NO: 10140 - RNA, 22 nt, Human
cugccaggcugcagccugcugc

SEQ ID NO: 10141 - RNA, 26 nt, Human
ccucucucacacaucacauucccaug

SEQ ID NO: 10142 - RNA, 24 nt, Human
ccaaaaccuuuccccagacacauu

SEQ ID NO: 10143 - RNA, 31 nt, Human
ccaggagacccuugugguugacuaggcuggg

SEQ ID NO: 10144 - RNA, 21 nt, Human
ccaauguuaauguaaacagaa

SEQ ID NO: 10145 - RNA, 24 nt, Human
gcuggaaggcagcaggcauuugcu

SEQ ID NO: 10146 - RNA, 20 nt, Human
cccucugacccucaggcuuu

SEQ ID NO: 10147 - RNA, 27 nt, Human
ggugccaagaggcacaccagguagagc

SEQ ID NO: 10148 - RNA, 22 nt, Human
auauuagcauuuaguccaaugu

SEQ ID NO: 10149 - RNA, 27 nt, Human
acugcccuaccagccugcacaugggua

SEQ ID NO: 10150 - RNA, 23 nt, Human
uauuuuauugaaaauuuauuuca

SEQ ID NO: 10151 - RNA, 18 nt, Human
ugugugagccaggauccc

SEQ ID NO: 10152 - RNA, 21 nt, Human
gccgcccaaacuggagugcag

SEQ ID NO: 10153 - RNA, 22 nt, Human
ugcaaccucugccucccggauu

SEQ ID NO: 10154 - RNA, 22 nt, Human
ucucuccucccccgcccuucag

SEQ ID NO: 10155 - RNA, 20 nt, Human
cuucuguccuggauguuuca

SEQ ID NO: 10156 - RNA, 26 nt, Human
caacagccuuaauucagucaagacuc

SEQ ID NO: 10157 - RNA, 22 nt, Human
cagacuccugaggcucucccuu

SEQ ID NO: 10158 - RNA, 21 nt, Human
agacagugucugaaacaggau

SEQ ID NO: 10159 - RNA, 26 nt, Human
gcugccgcaucugccuggagccuggg

SEQ ID NO: 10160 - RNA, 20 nt, Human
cccaaaccacaggggcucag

SEQ ID NO: 10161 - RNA, 20 nt, Human
aauuuguuucuucugucuuu

SEQ ID NO: 10162 - RNA, 24 nt, Human
cagaagaaaaaugugaaagacugg

SEQ ID NO: 10163 - RNA, 26 nt, Human
cccugccucuccaccugcacccugcu

SEQ ID NO: 10164 - RNA, 25 nt, Human
accguguccagcacagaaggaaucu

SEQ ID NO: 10165 - RNA, 23 nt, Human
ugagggacgaggucaaggagaua

SEQ ID NO: 10166 - RNA, 17 nt, Human
ccugcagccccucagcc

SEQ ID NO: 10167 - RNA, 22 nt, Human
ccaugagacacggcuugcagug

SEQ ID NO: 10168 - RNA, 22 nt, Human
uuccccaggcaggaguuggggu

SEQ ID NO: 10169 - RNA, 23 nt, Human
agccugcucauguaccucugauu

SEQ ID NO: 10170 - RNA, 22 nt, Human
cucuuggagcaaguuucugccu

SEQ ID NO: 10171 - RNA, 24 nt, Human
cugucacccacgcuggagugcugu

SEQ ID NO: 10172 - RNA, 20 nt, Human
gccggcccgcuccuucccag

SEQ ID NO: 10173 - RNA, 24 nt, Human
uuuaaaaaacaaauuguugcuauu

SEQ ID NO: 10174 - RNA, 23 nt, Human
ccgucugucccaagagggucugc

SEQ ID NO: 10175 - RNA, 23 nt, Human
ccagagggagugacagaggcagc

SEQ ID NO: 10176 - RNA, 20 nt, Human
ucuauuuccccucuucugcu

SEQ ID NO: 10177 - RNA, 23 nt, Human
aacacagcugcuuucuucuuaca

SEQ ID NO: 10178 - RNA, 22 nt, Human
ugcucccaaagccagagcccag

SEQ ID NO: 10179 - RNA, 26 nt, Human
ccacucuagauucuguaucuagauca

SEQ ID NO: 10180 - RNA, 26 nt, Human
cugggagcugcaucugaggcuuaguc

SEQ ID NO: 10181 - RNA, 21 nt, Human
ucaaucaaguugcugcagccu

SEQ ID NO: 10182 - RNA, 21 nt, Human
gaguagccucagaaggguuua

SEQ ID NO: 10183 - RNA, 22 nt, Human
aaaaugcugggagucucugcau

SEQ ID NO: 10184 - RNA, 21 nt, Human
uuucacccuuaaaauauuuca

SEQ ID NO: 10185 - RNA, 27 nt, Human
ggcaauagagcagguaucuucaccccc

SEQ ID NO: 10186 - RNA, 19 nt, Human
gagugggcuccaagcacaa

SEQ ID NO: 10187 - RNA, 21 nt, Human
cuuauuucuucaaauccuucc

SEQ ID NO: 10188 - RNA, 19 nt, Human
uccaccccaucggcuucca

SEQ ID NO: 10189 - RNA, 27 nt, Human
uucagcaucucaccagccccucccucu

SEQ ID NO: 10190 - RNA, 21 nt, Human
ucuuccauuugaugauaccgc

SEQ ID NO: 10191 - RNA, 21 nt, Human
gucucuuggacuggagguaca

SEQ ID NO: 10192 - RNA, 22 nt, Human
gugcuaagaauaaacuccauuu

SEQ ID NO: 10193 - RNA, 21 nt, Human
ccggcugcugcggaccuccuc

SEQ ID NO: 10194 - RNA, 22 nt, Human
ggacccauauaccacguugcug

SEQ ID NO: 10195 - RNA, 21 nt, Human
auugggaaaggcauuuacagg

SEQ ID NO: 10196 - RNA, 19 nt, Human
agaugucccuuucuuggcc

SEQ ID NO: 10197 - RNA, 22 nt, Human
agccucucuuucuucacuuacc

SEQ ID NO: 10198 - RNA, 22 nt, Human
uugugcucaggacucacucugc

SEQ ID NO: 10199 - RNA, 19 nt, Human
ccuuucucgcuucugagcu

SEQ ID NO: 10200 - RNA, 26 nt, Human
cucugcucccuucuucaguaagcaag

SEQ ID NO: 10201 - RNA, 13 nt, Human
gaaacuugcucaa

SEQ ID NO: 10202 - RNA, 22 nt, Human
ccugcuucucugaucugugugu

SEQ ID NO: 10203 - RNA, 20 nt, Human
ggccccggagaaggcagcga

SEQ ID NO: 10204 - RNA, 21 nt, Human
cuggacugcaggcugcaguga

SEQ ID NO: 10205 - RNA, 26 nt, Human
uugcccagucugccuguuguggggcu

SEQ ID NO: 10206 - RNA, 19 nt, Human
ggacuccuaaccugcucca

SEQ ID NO: 10207 - RNA, 20 nt, Human
uugugcccaggcuagggggc

SEQ ID NO: 10208 - RNA, 25 nt, Human
cauuuuauuaaaaagcuacugacuu

SEQ ID NO: 10209 - RNA, 16 nt, Human
uuccuugcccaccuca

SEQ ID NO: 10210 - RNA, 25 nt, Human
guucuguuugcuccagacuggggcu

SEQ ID NO: 10211 - RNA, 26 nt, Human
aacucaucuccuuccugaggagccgg

SEQ ID NO: 10212 - RNA, 22 nt, Human
aggcuggagugcaguggugcaa

SEQ ID NO: 10213 - RNA, 20 nt, Human
acuccucccccuccuccaug

SEQ ID NO: 10214 - RNA, 22 nt, Human
uuauggaguugcuucuccauuu

SEQ ID NO: 10215 - RNA, 21 nt, Human
agggugucaucauuucacaga

SEQ ID NO: 10216 - RNA, 20 nt, Human
ucccaaauuguguuuauaau

SEQ ID NO: 10217 - RNA, 20 nt, Human
gguucugcaugaccuagcca

SEQ ID NO: 10218 - RNA, 20 nt, Human
ccaggucccauuucucugca

SEQ ID NO: 10219 - RNA, 21 nt, Human
caucaugcuuuuccucucaca

SEQ ID NO: 10220 - RNA, 23 nt, Human
cuccaucuggugacagugggaug

SEQ ID NO: 10221 - RNA, 27 nt, Human
agcaaaucuccuuggauuuccuccaga

SEQ ID NO: 10222 - RNA, 23 nt, Human
gggagagucacaagccacuggca

SEQ ID NO: 10223 - RNA, 25 nt, Human
acuugaggaaggaagaugauagaac

SEQ ID NO: 10224 - RNA, 26 nt, Human
ucacccaguuuagugggugguagggu

SEQ ID NO: 10225 - RNA, 21 nt, Human
uucuggcccaaauguuccauu

SEQ ID NO: 10226 - RNA, 22 nt, Human
caggcuggcgugcaguggugcg

SEQ ID NO: 10227 - RNA, 22 nt, Human
acccuucuccccuuccugguag

SEQ ID NO: 10228 - RNA, 23 nt, Human
ccuccaauuuugcagauuuuugc

SEQ ID NO: 10229 - RNA, 25 nt, Human
agcucucguucuccuuccccauuuc

SEQ ID NO: 10230 - RNA, 22 nt, Human
ccugcuaccagucugugccuua

SEQ ID NO: 10231 - RNA, 27 nt, Human
auuauugcuguuguuauuuuacaaggg

SEQ ID NO: 10232 - RNA, 22 nt, Human
aaacuccuuggauguugggaua

SEQ ID NO: 10233 - RNA, 30 nt, Human
cuuagcacucaggccugugaaucuaggaga

SEQ ID NO: 10234 - RNA, 19 nt, Human
gagaucaagaccauccugg

SEQ ID NO: 10235 - RNA, 22 nt, Human
aagcaaaacaauaaacuagcag

SEQ ID NO: 10236 - RNA, 22 nt, Human
aaaauccugaauaaaccaguau

SEQ ID NO: 10237 - RNA, 24 nt, Human
ugugcccgugugcgugagacagag

SEQ ID NO: 10238 - RNA, 22 nt, Human
cagggagugcacauauccaggc

SEQ ID NO: 10239 - RNA, 19 nt, Human
acugauuuuaaucaugcug

SEQ ID NO: 10240 - RNA, 22 nt, Human
guggggagacagauggagaagc

SEQ ID NO: 10241 - RNA, 29 nt, Human
cugcaaccguuuccgccuccugcuagagc

SEQ ID NO: 10242 - RNA, 27 nt, Human
gggagccucuuaagagccucuaauguu

SEQ ID NO: 10243 - RNA, 26 nt, Human
cugaggcuggaagcugggaaacccaa

SEQ ID NO: 10244 - RNA, 23 nt, Human
agugaguuaugacaugcccauuc

SEQ ID NO: 10245 - RNA, 23 nt, Human
uguugccaaggcuggagugcagg

SEQ ID NO: 10246 - RNA, 25 nt, Human
cccucgacccgcgccugugccaccc

SEQ ID NO: 10247 - RNA, 26 nt, Human
aacuccauauauguuagucuuccuuu

SEQ ID NO: 10248 - RNA, 24 nt, Human
cuggucuuuaaaaaacucuguggc

SEQ ID NO: 10249 - RNA, 20 nt, Human
caggaugaauuuucugcagc

SEQ ID NO: 10250 - RNA, 27 nt, Human
ugucacccaggcugccaggcuggagug

SEQ ID NO: 10251 - RNA, 20 nt, Human
uaaaguuggcuauaauuucu

SEQ ID NO: 10252 - RNA, 24 nt, Human
gcauuuccuugucccgucuggacc

SEQ ID NO: 10253 - RNA, 23 nt, Human
gggucggguguccgggagccagg

SEQ ID NO: 10254 - RNA, 17 nt, Human
ucuaauucaagauuaca

SEQ ID NO: 10255 - RNA, 25 nt, Human
uggucucaaaucccguguuuccuua

SEQ ID NO: 10256 - RNA, 23 nt, Human
cagucagggaaaguggaguucug

SEQ ID NO: 10257 - RNA, 27 nt, Human
uucaguuauuuacaaauguuuguccuu

SEQ ID NO: 10258 - RNA, 29 nt, Human
agcucuugccagcuucucugacacuuggg

SEQ ID NO: 10259 - RNA, 21 nt, Human
ggggggugcugagucaucuca

SEQ ID NO: 10260 - RNA, 26 nt, Human
acaaaccucuauauguugcugaaaca

SEQ ID NO: 10261 - RNA, 24 nt, Human
uucuuuucauugacaacaccuaca

SEQ ID NO: 10262 - RNA, 24 nt, Human
cgggacagaguuuucccagaccug

SEQ ID NO: 10263 - RNA, 25 nt, Human
agccugcgccagggaggaggcaggc

SEQ ID NO: 10264 - RNA, 27 nt, Human
acugcaucugacuauggcaaggaucuc

SEQ ID NO: 10265 - RNA, 25 nt, Human
aggaaauuuccuuucucuuuuagga

SEQ ID NO: 10266 - RNA, 21 nt, Human
gaggagaacuugggagccagg

SEQ ID NO: 10267 - RNA, 22 nt, Human
aaaacaaaaaccuacuagucuu

SEQ ID NO: 10268 - RNA, 20 nt, Human
uaaugaaccauguuguugcu

SEQ ID NO: 10269 - RNA, 23 nt, Human
uucuuggacuacuuuaauuugga

SEQ ID NO: 10270 - RNA, 27 nt, Human
ggcuggcggccugguggcagugcugga

SEQ ID NO: 10271 - RNA, 21 nt, Human
ggggacucugcccucccuccu

SEQ ID NO: 10272 - RNA, 22 nt, Human
ugccuccuauagaaauucaagg

SEQ ID NO: 10273 - RNA, 25 nt, Human
ggacgagcgggcggcaggagccggc

SEQ ID NO: 10274 - RNA, 25 nt, Human
ccgugaagauccaggcaucuugccg

SEQ ID NO: 10275 - RNA, 22 nt, Human
acaaaagaauauguugugagca

SEQ ID NO: 10276 - RNA, 29 nt, Human
ggcugggcgugcuagagguugcagcauga

SEQ ID NO: 10277 - RNA, 23 nt, Human
gaaugcugagaagaucugaaggg

SEQ ID NO: 10278 - RNA, 22 nt, Human
aagaugugauuuggaccauggc

SEQ ID NO: 10279 - RNA, 21 nt, Human
caaauagugaguucuguaaau

SEQ ID NO: 10280 - RNA, 21 nt, Human
agggaaacugcagcugggaag

SEQ ID NO: 10281 - RNA, 22 nt, Human
gccuguaaucccagcaauuugg

SEQ ID NO: 10282 - RNA, 22 nt, Human
auuugaguagcuucuccaugcu

SEQ ID NO: 10283 - RNA, 22 nt, Human
gcaaucagagcgcucccccuca

SEQ ID NO: 10284 - RNA, 22 nt, Human
cucaaccuuccaacuuccugug

SEQ ID NO: 10285 - RNA, 29 nt, Human
gccaaggguggaguggaaaaagauauggu

SEQ ID NO: 10286 - RNA, 25 nt, Human
ggugcugguggagcagcugaugucg

SEQ ID NO: 10287 - RNA, 22 nt, Human
ucuuccucuuuggccuaaucuc

SEQ ID NO: 10288 - RNA, 23 nt, Human
gagagaggccaagacaauuugua

SEQ ID NO: 10289 - RNA, 20 nt, Human
gcagagaagaugcaagagca

SEQ ID NO: 10290 - RNA, 21 nt, Human
gcuagcuaaaggguggggaga

SEQ ID NO: 10291 - RNA, 22 nt, Human
aggaagaggaagaccuccagca

SEQ ID NO: 10292 - RNA, 20 nt, Human
ugaggugaggggaugguuag

SEQ ID NO: 10293 - RNA, 26 nt, Human
aacuggagaguuucuauuaaagguca

SEQ ID NO: 10294 - RNA, 23 nt, Human
gacuccauuucaucauuguuucu

SEQ ID NO: 10295 - RNA, 22 nt, Human
gggcucucuccugggcucagca

SEQ ID NO: 10296 - RNA, 22 nt, Human
aucacagcagaaucaggaucuc

SEQ ID NO: 10297 - RNA, 21 nt, Human
ccugaagaagacuuaguuccu

SEQ ID NO: 10298 - RNA, 22 nt, Human
ugggacaucugaaucuccaucu

SEQ ID NO: 10299 - RNA, 24 nt, Human
agcuugcugcuccugccucauccc

SEQ ID NO: 10300 - RNA, 17 nt, Human
cuucccuugccucgugu

SEQ ID NO: 10301 - RNA, 23 nt, Human
ccuacccuaaugccaguuccagc

SEQ ID NO: 10302 - RNA, 22 nt, Human
gugaucucgguucacugcaacc

SEQ ID NO: 10303 - RNA, 19 nt, Human
agcuggcugaccuuugcca

SEQ ID NO: 10304 - RNA, 27 nt, Human
gagagugaggagggaguguuauuuccu

SEQ ID NO: 10305 - RNA, 20 nt, Human
gccgaggcugcagugcagcg

SEQ ID NO: 10306 - RNA, 24 nt, Human
caccauggcucucugcagccuuga

SEQ ID NO: 10307 - RNA, 26 nt, Human
uccauucaacaaguauuugcuaaaca

SEQ ID NO: 10308 - RNA, 20 nt, Human
gcagcgccucucuagcuacu

SEQ ID NO: 10309 - RNA, 22 nt, Human
aaauucugcugugacuaaucca

SEQ ID NO: 10310 - RNA, 27 nt, Human
ucuccacuggacccuugauucauucug

SEQ ID NO: 10311 - RNA, 21 nt, Human
ugagacacggcuugcaguggg

SEQ ID NO: 10312 - RNA, 27 nt, Human
uguuuuuaaaaccuucugaaccaugac

SEQ ID NO: 10313 - RNA, 19 nt, Human
gccauugagggguggaccc

SEQ ID NO: 10314 - RNA, 26 nt, Human
auauucuucuuuguaguccuucuucc

SEQ ID NO: 10315 - RNA, 21 nt, Human
guuccauuuccuuauucucaa

SEQ ID NO: 10316 - RNA, 19 nt, Human
uguuuuauuguaucuguuu

SEQ ID NO: 10317 - RNA, 23 nt, Human
ugaccuccuuggcucaaggcauc

SEQ ID NO: 10318 - RNA, 23 nt, Human
ggauggggaugaaguaaggagag

SEQ ID NO: 10319 - RNA, 31 nt, Human
gccuaucaauuuucuuccagaagauauuuau

SEQ ID NO: 10320 - RNA, 27 nt, Human
ugaccaacguggugaaacccugucucu

SEQ ID NO: 10321 - RNA, 27 nt, Human
ggcuggcuaacuggaagcauguaggag

SEQ ID NO: 10322 - RNA, 26 nt, Human
ccugcuuucccugccucuacuugacu

SEQ ID NO: 10323 - RNA, 25 nt, Human
gcggaggagucgugucgugccugag

SEQ ID NO: 10324 - RNA, 29 nt, Human
gccuccuuucucuugcagaagaaguaagu

SEQ ID NO: 10325 - RNA, 22 nt, Human
accagcccggccaacaugguga

SEQ ID NO: 10326 - RNA, 21 nt, Human
ccuggccaggacucaggcugu

SEQ ID NO: 10327 - RNA, 19 nt, Human
gugaggguggcacccaggc

SEQ ID NO: 10328 - RNA, 27 nt, Human
aguaaagcuuuucuuuuuuaauuucca

SEQ ID NO: 10329 - RNA, 22 nt, Human
ugucacccaggcuggggcgcaa

SEQ ID NO: 10330 - RNA, 27 nt, Human
gaguagcugggauuagaggcgccagcc

SEQ ID NO: 10331 - RNA, 20 nt, Human
aucagcaguggcccaggaag

SEQ ID NO: 10332 - RNA, 27 nt, Human
ucccacauccuauggaauucagguucu

SEQ ID NO: 10333 - RNA, 22 nt, Human
auccagagguagccauagggug

SEQ ID NO: 10334 - RNA, 21 nt, Human
uguggcaaccuguucuuccua

SEQ ID NO: 10335 - RNA, 22 nt, Human
uaaacaauguaugaaagaugua

SEQ ID NO: 10336 - RNA, 26 nt, Human
gcugggacuacaauugugagccacca

SEQ ID NO: 10337 - RNA, 22 nt, Human
gcgcgagccacggcgcccagcc

SEQ ID NO: 10338 - RNA, 26 nt, Human
auagcauuugauacagugucugugau

SEQ ID NO: 10339 - RNA, 28 nt, Human
uuugcugcaaagucuccuucggaacccg

SEQ ID NO: 10340 - RNA, 21 nt, Human
cucacuuaauccuuuguuuuc

SEQ ID NO: 10341 - RNA, 26 nt, Human
uggaaagaguugcugacuuuguaucu

SEQ ID NO: 10342 - RNA, 23 nt, Human
gucugugggcuucagcacuuuaa

SEQ ID NO: 10343 - RNA, 22 nt, Human
aauaucugcuccuuuucgaguu

SEQ ID NO: 10344 - RNA, 24 nt, Human
gcugagcagucaacagcauuucuu

SEQ ID NO: 10345 - RNA, 26 nt, Human
ucuuuuuauauauguucugugucuaa

SEQ ID NO: 10346 - RNA, 25 nt, Human
cugggugacuagcaaaacuccaucu

SEQ ID NO: 10347 - RNA, 21 nt, Human
uccucacggaucccucucucu

SEQ ID NO: 10348 - RNA, 23 nt, Human
ggaguauuuggaagcaacguguu

SEQ ID NO: 10349 - RNA, 22 nt, Human
cucugccggcuccccuaggcaa

SEQ ID NO: 10350 - RNA, 19 nt, Human
agaaaacaaaguucuauuu

SEQ ID NO: 10351 - RNA, 23 nt, Human
gugacaucauaaauacuugcuga

SEQ ID NO: 10352 - RNA, 20 nt, Human
cugggcuuggccugcuguga

SEQ ID NO: 10353 - RNA, 18 nt, Human
ccaggcuggaguacaaua

SEQ ID NO: 10354 - RNA, 24 nt, Human
cuggcugagaaauuguuuugcaaa

SEQ ID NO: 10355 - RNA, 22 nt, Human
augugggugugauggcuggauc

SEQ ID NO: 10356 - RNA, 20 nt, Human
gugucugaccacucugacag

SEQ ID NO: 10357 - RNA, 26 nt, Human
cagagcugagugcgcugggauccggg

SEQ ID NO: 10358 - RNA, 25 nt, Human
cccuguccacugugagcucuggugu

SEQ ID NO: 10359 - RNA, 19 nt, Human
cagccauccuccccuugag

SEQ ID NO: 10360 - RNA, 27 nt, Human
agugcauugggaugguuuuccaggcaa

SEQ ID NO: 10361 - RNA, 22 nt, Human
auaccuguaaugccagcacuuu

SEQ ID NO: 10362 - RNA, 21 nt, Human
ucgccaggcuggaguguagug

SEQ ID NO: 10363 - RNA, 20 nt, Human
ugagaaagaauggaagaugg

SEQ ID NO: 10364 - RNA, 19 nt, Human
agguaaacuucaaagugau

SEQ ID NO: 10365 - RNA, 22 nt, Human
gggauuacaagugugagccacc

SEQ ID NO: 10366 - RNA, 24 nt, Human
gugccugcccaugccagcacuucc

SEQ ID NO: 10367 - RNA, 25 nt, Human
gggagcuggggaucuggauuccugg

SEQ ID NO: 10368 - RNA, 24 nt, Human
ggccagggaaguccccgaguuucc

SEQ ID NO: 10369 - RNA, 26 nt, Human
aagacuugcuuaccacaacugagagu

SEQ ID NO: 10370 - RNA, 24 nt, Human
uuuccuuuguauguuugugucucu

SEQ ID NO: 10371 - RNA, 20 nt, Human
uuccagccucaggucccagc

SEQ ID NO: 10372 - RNA, 20 nt, Human
ugcagccaggcugggcagag

SEQ ID NO: 10373 - RNA, 22 nt, Human
guuuguaaucccagcacuuugg

SEQ ID NO: 10374 - RNA, 22 nt, Human
uuaucaacugcaaugggagaag

SEQ ID NO: 10375 - RNA, 25 nt, Human
gacuggguggacaagaaugaaccca

SEQ ID NO: 10376 - RNA, 21 nt, Human
gcuagccucaaacuccugggc

SEQ ID NO: 10377 - RNA, 22 nt, Human
uguucuagagaggacagcagac

SEQ ID NO: 10378 - RNA, 21 nt, Human
ccauuugagucuggccacuag

SEQ ID NO: 10379 - RNA, 23 nt, Human
ccagagagguggagucgguagcg

SEQ ID NO: 10380 - RNA, 21 nt, Human
cagcccugggcugaggcacag

SEQ ID NO: 10381 - RNA, 22 nt, Human
gcugaacugagcguaugugcca

SEQ ID NO: 10382 - RNA, 22 nt, Human
uugaccgcaacucacacauucc

SEQ ID NO: 10383 - RNA, 19 nt, Human
accccggccaccaagggca

SEQ ID NO: 10384 - RNA, 22 nt, Human
augcagggggcuccugggggug

SEQ ID NO: 10385 - RNA, 22 nt, Human
acauguguccuggaaagauauu

SEQ ID NO: 10386 - RNA, 25 nt, Human
aaacccaggcaaaacaccucuuccu

SEQ ID NO: 10387 - RNA, 24 nt, Human
gcaucuaucuggugauuucuagcu

SEQ ID NO: 10388 - RNA, 19 nt, Human
aucaugcaaaaaugccuuu

SEQ ID NO: 10389 - RNA, 22 nt, Human
cugaguagcuaggauuacaggu

SEQ ID NO: 10390 - RNA, 26 nt, Human
ggacugaauucaaauauucuuucaac

SEQ ID NO: 10391 - RNA, 27 nt, Human
gcccaggccucuucaucuggggacuuu

SEQ ID NO: 10392 - RNA, 21 nt, Human
uaggacgggaagaggaagcac

SEQ ID NO: 10393 - RNA, 22 nt, Human
caggcuggagugcaguggugcc

SEQ ID NO: 10394 - RNA, 22 nt, Human
ucauuucucaugaagaugcuua

SEQ ID NO: 10395 - RNA, 21 nt, Human
acuggucucgaacuccugggc

SEQ ID NO: 10396 - RNA, 24 nt, Human
cagaagugcagcuuccaaaagucc

SEQ ID NO: 10397 - RNA, 26 nt, Human
uuuugacagaauauguuucaaacuuu

SEQ ID NO: 10398 - RNA, 27 nt, Human
ucagcuccccuuucucgcccagcgccc

SEQ ID NO: 10399 - RNA, 21 nt, Human
uccacugcauuucagccuggg

SEQ ID NO: 10400 - RNA, 20 nt, Human
ccauggcuacacugcaacuu

SEQ ID NO: 10401 - RNA, 26 nt, Human
ggagagaagagagaaauagccugcgc

SEQ ID NO: 10402 - RNA, 20 nt, Human
ucccugccucauuccccaca

SEQ ID NO: 10403 - RNA, 25 nt, Human
uagccccuggagacauugugcaaug

SEQ ID NO: 10404 - RNA, 21 nt, Human
aaguauucuccauccucccag

SEQ ID NO: 10405 - RNA, 20 nt, Human
ggagccgccucccggcucgg

SEQ ID NO: 10406 - RNA, 23 nt, Human
cuguggcaucagucccugaguca

SEQ ID NO: 10407 - RNA, 25 nt, Human
agccuuuuucccagcuuccuugcac

SEQ ID NO: 10408 - RNA, 21 nt, Human
gggagguugugguugcaguga

SEQ ID NO: 10409 - RNA, 26 nt, Human
uaggagacccaaggcaucuugaaucc

SEQ ID NO: 10410 - RNA, 22 nt, Human
gcagacaccucauggcacuuca

SEQ ID NO: 10411 - RNA, 24 nt, Human
uuauauaauuugaaagcaaaaaga

SEQ ID NO: 10412 - RNA, 24 nt, Human
ccugggagucccggaggccaggcu

SEQ ID NO: 10413 - RNA, 28 nt, Human
ccagcagguuaccuggaggcggaucauc

SEQ ID NO: 10414 - RNA, 23 nt, Human
uuuuguuguuguuuauagacacu

SEQ ID NO: 10415 - RNA, 23 nt, Human
aacccacaagcugccucugacag

SEQ ID NO: 10416 - RNA, 20 nt, Human
uccagcucuccccaugcccc

SEQ ID NO: 10417 - RNA, 25 nt, Human
gcauuccuucuuucacaggcaucag

SEQ ID NO: 10418 - RNA, 20 nt, Human
uguccagcaaaaugaaaaga

SEQ ID NO: 10419 - RNA, 20 nt, Human
cugcagcuauucaccaauau

SEQ ID NO: 10420 - RNA, 20 nt, Human
uaagaaucugaggcgcgagg

SEQ ID NO: 10421 - RNA, 23 nt, Human
ggagguggcacugggggcugguc

SEQ ID NO: 10422 - RNA, 26 nt, Human
cugauugcugacccagucucaggccu

SEQ ID NO: 10423 - RNA, 25 nt, Human
gcaaaggcuaagcgaaggagagcug

SEQ ID NO: 10424 - RNA, 23 nt, Human
aagcugagcuccuuagccuuugu

SEQ ID NO: 10425 - RNA, 21 nt, Human
cccaccggagccucccccuca

SEQ ID NO: 10426 - RNA, 22 nt, Human
ugcaaccuccacauccuggguu

SEQ ID NO: 10427 - RNA, 23 nt, Human
cuccucugguucacguuuacaga

SEQ ID NO: 10428 - RNA, 22 nt, Human
acugcgagcuguggcgguagag

SEQ ID NO: 10429 - RNA, 23 nt, Human
gucauccaggcuggagugcagug

SEQ ID NO: 10430 - RNA, 21 nt, Human
gagcuaggggcaggaggcaug

SEQ ID NO: 10431 - RNA, 23 nt, Human
uuugguuuggauuacuauugcaa

SEQ ID NO: 10432 - RNA, 25 nt, Human
gagacaguuagauuuacuuccucuu

SEQ ID NO: 10433 - RNA, 18 nt, Human
acaaucuaaauaagcugc

SEQ ID NO: 10434 - RNA, 27 nt, Human
ggaagugaggccauggagggaggcaga

SEQ ID NO: 10435 - RNA, 22 nt, Human
gaacucaggaggcagagguugc

SEQ ID NO: 10436 - RNA, 23 nt, Human
guuagcuuucagaaagcuaauga

SEQ ID NO: 10437 - RNA, 22 nt, Human
ggaggccacauauuuuguucac

SEQ ID NO: 10438 - RNA, 19 nt, Human
gaucuagaugaccucuuga

SEQ ID NO: 10439 - RNA, 21 nt, Human
cuuugcuuaauuccucaggcu

SEQ ID NO: 10440 - RNA, 27 nt, Human
ggucuuggacuccugacgucgugaucc

SEQ ID NO: 10441 - RNA, 22 nt, Human
ccugccuguuuuugaccucugc

SEQ ID NO: 10442 - RNA, 23 nt, Human
ucuuaacaucaagagaacuguca

SEQ ID NO: 10443 - RNA, 27 nt, Human
cugucuuuaaagccugccucuuccagg

SEQ ID NO: 10444 - RNA, 24 nt, Human
caggucgcugcugcagccaaccca

SEQ ID NO: 10445 - RNA, 22 nt, Human
guugguggggucaggguccaag

SEQ ID NO: 10446 - RNA, 26 nt, Human
cgcccaggcucggugcuggagaguca

SEQ ID NO: 10447 - RNA, 22 nt, Human
cugccaccccacucgcagccac

SEQ ID NO: 10448 - RNA, 21 nt, Human
aauaaacuagauuacauucag

SEQ ID NO: 10449 - RNA, 22 nt, Human
uggagagaaacuacuaaccuga

SEQ ID NO: 10450 - RNA, 24 nt, Human
cguuguuccuucuguacuaaagua

SEQ ID NO: 10451 - RNA, 27 nt, Human
ucacagcugugugacgauuucuaaaug

SEQ ID NO: 10452 - RNA, 27 nt, Human
gccggcuucgcugcggguuugcacugc

SEQ ID NO: 10453 - RNA, 21 nt, Human
gccccucucccccacuuuccc

SEQ ID NO: 10454 - RNA, 26 nt, Human
cagccucccugaagccuuugcauuuu

SEQ ID NO: 10455 - RNA, 24 nt, Human
uuugccuccgcagauagugucugc

SEQ ID NO: 10456 - RNA, 27 nt, Human
gggggcagaggcccaucuggccugaac

SEQ ID NO: 10457 - RNA, 24 nt, Human
cccuccagaacugacguuggcagg

SEQ ID NO: 10458 - RNA, 27 nt, Human
gugggguuuaccccucacagguuuaag

SEQ ID NO: 10459 - RNA, 22 nt, Human
caccugugaucccagcacuuug

SEQ ID NO: 10460 - RNA, 22 nt, Human
gcucuccgccgcgcucuaccuc

SEQ ID NO: 10461 - RNA, 26 nt, Human
gggcuggaggguggggugccaaaggc

SEQ ID NO: 10462 - RNA, 19 nt, Human
aaauuacaacacugccuuu

SEQ ID NO: 10463 - RNA, 23 nt, Human
guagcuaauuuuucuuuaccuau

SEQ ID NO: 10464 - RNA, 25 nt, Human
ccuaacuugaacauuagagggaaag

SEQ ID NO: 10465 - RNA, 23 nt, Human
aaggagcugcaugcuucacugga

SEQ ID NO: 10466 - RNA, 23 nt, Human
aaucuuuuaucuugaauguaaua

SEQ ID NO: 10467 - RNA, 20 nt, Human
cucugguggcugggauucag

SEQ ID NO: 10468 - RNA, 24 nt, Human
uuuacuuagaauuaguggcacuug

SEQ ID NO: 10469 - RNA, 21 nt, Human
cccagcucuagacaacccugc

SEQ ID NO: 10470 - RNA, 26 nt, Human
uagagaugcagaacugggcccgugga

SEQ ID NO: 10471 - RNA, 27 nt, Human
gggagcccaggcgggcagauugcuuga

SEQ ID NO: 10472 - RNA, 19 nt, Human
ucucgcucccccuucgguc

SEQ ID NO: 10473 - RNA, 21 nt, Human
guaugacagaaaauggccuua

SEQ ID NO: 10474 - RNA, 17 nt, Human
ucuggauuuuacccacu

SEQ ID NO: 10475 - RNA, 29 nt, Human
cugcacauaaacucuuuuaucuccugaaa

SEQ ID NO: 10476 - RNA, 20 nt, Human
ugcugggagagcgggacggu

SEQ ID NO: 10477 - RNA, 21 nt, Human
gaggcugaggugggaagauca

SEQ ID NO: 10478 - RNA, 20 nt, Human
ucuuuucuccuccucccuag

SEQ ID NO: 10479 - RNA, 24 nt, Human
ggggaggcgcggggcccugcucug

SEQ ID NO: 10480 - RNA, 22 nt, Human
cacugcaauucagccuggguga

SEQ ID NO: 10481 - RNA, 23 nt, Human
caaacuguagcugucacagggca

SEQ ID NO: 10482 - RNA, 23 nt, Human
auggcaccacugcacuccagccu

SEQ ID NO: 10483 - RNA, 20 nt, Human
ccaauaaugaagaugacgca

SEQ ID NO: 10484 - RNA, 22 nt, Human
uauuguacaaaauguucacauu

SEQ ID NO: 10485 - RNA, 22 nt, Human
gguggcaugaucucgguucauu

SEQ ID NO: 10486 - RNA, 24 nt, Human
aucuuuuucugucuaucaaaacua

SEQ ID NO: 10487 - RNA, 23 nt, Human
augacaccacugcacuccaaccu

SEQ ID NO: 10488 - RNA, 21 nt, Human
uggcccuucucccaugcaggg

SEQ ID NO: 10489 - RNA, 22 nt, Human
cagcucuuacuaggagagggag

SEQ ID NO: 10490 - RNA, 19 nt, Human
gcacccaccaccacaccca

SEQ ID NO: 10491 - RNA, 23 nt, Human
cuccggccacuccugggagacag

SEQ ID NO: 10492 - RNA, 20 nt, Human
gauuacauaagggacacuga

SEQ ID NO: 10493 - RNA, 21 nt, Human
aucagcuuucaaaugagauga

SEQ ID NO: 10494 - RNA, 24 nt, Human
cucaaaucacccucucccguagcc

SEQ ID NO: 10495 - RNA, 27 nt, Human
cagcuggagagacuuuggggacuuuuu

SEQ ID NO: 10496 - RNA, 24 nt, Human
ccugguuuccuggcagccugcugc

SEQ ID NO: 10497 - RNA, 22 nt, Human
gggggaaagaaacaccugagca

SEQ ID NO: 10498 - RNA, 22 nt, Human
uggugcacuccuguaaucccag

SEQ ID NO: 10499 - RNA, 21 nt, Human
uucauucccuuagucuucuau

SEQ ID NO: 10500 - RNA, 21 nt, Human
cuccagcccuccccugcccag

SEQ ID NO: 10501 - RNA, 21 nt, Human
gaacuccugagucaagugauc

SEQ ID NO: 10502 - RNA, 22 nt, Human
agcuaauuuuuguauuuucggu

SEQ ID NO: 10503 - RNA, 22 nt, Human
agcuaauuuucauauuuuuagu

SEQ ID NO: 10504 - RNA, 25 nt, Human
cuccuuccaggcccuccucgcucac

SEQ ID NO: 10505 - RNA, 22 nt, Human
ugcugccuccccuccaucagcc

SEQ ID NO: 10506 - RNA, 24 nt, Human
aguucaggcugugugguucgcaag

SEQ ID NO: 10507 - RNA, 22 nt, Human
accacuucccugcuuuucuccc

SEQ ID NO: 10508 - RNA, 25 nt, Human
acaauuaaaagcacauuguuggacc

SEQ ID NO: 10509 - RNA, 20 nt, Human
ggagagggugugagggcaga

SEQ ID NO: 10510 - RNA, 26 nt, Human
cucacccuccggcuuccugucggggc

SEQ ID NO: 10511 - RNA, 27 nt, Human
agcuagagcacccaagcuucugccuuc

SEQ ID NO: 10512 - RNA, 19 nt, Human
gacaccagccuuucuccca

SEQ ID NO: 10513 - RNA, 20 nt, Human
caacaucugcucuucggguu

SEQ ID NO: 10514 - RNA, 23 nt, Human
uccucaccuugaaaucgggcuuc

SEQ ID NO: 10515 - RNA, 27 nt, Human
ccacugcaguccgcagucuggccuggg

SEQ ID NO: 10516 - RNA, 26 nt, Human
gcugcgugguugaugaucuuugcaga

SEQ ID NO: 10517 - RNA, 21 nt, Human
gccccagguaaacgucuaaac

SEQ ID NO: 10518 - RNA, 24 nt, Human
aggcacaagguagcugugggccaa

SEQ ID NO: 10519 - RNA, 23 nt, Human
uggggugggagggcagggguggg

SEQ ID NO: 10520 - RNA, 20 nt, Human
gaccacugaauucacuccag

SEQ ID NO: 10521 - RNA, 19 nt, Human
cugccaccgcggucagcuc

SEQ ID NO: 10522 - RNA, 24 nt, Human
auagucagcuuguaaauuuugugg

SEQ ID NO: 10523 - RNA, 21 nt, Human
guugcuucuagccuacugaga

SEQ ID NO: 10524 - RNA, 22 nt, Human
gcucguagcuuggcagugcagu

SEQ ID NO: 10525 - RNA, 20 nt, Human
agagggaccuccagcuucca

SEQ ID NO: 10526 - RNA, 22 nt, Human
uacuggucuguccuuuuuuccu

SEQ ID NO: 10527 - RNA, 23 nt, Human
gggagggagagggagugaagagc

SEQ ID NO: 10528 - RNA, 19 nt, Human
ucugucuguccuuuuccuc

SEQ ID NO: 10529 - RNA, 24 nt, Human
ugagggaacagacaggagaaaugc

SEQ ID NO: 10530 - RNA, 26 nt, Human
ggcaagacugcccuuagaaauucuag

SEQ ID NO: 10531 - RNA, 26 nt, Human
uguguaguguauuugagggaucaguc

SEQ ID NO: 10532 - RNA, 22 nt, Human
aaaaagaggauuuggauuaugc

SEQ ID NO: 10533 - RNA, 22 nt, Human
ugcuagaaaaaccuauccacug

SEQ ID NO: 10534 - RNA, 22 nt, Human
cccaucaugaaggaagcugccu

SEQ ID NO: 10535 - RNA, 22 nt, Human
gguagauggcuuccuggaauca

SEQ ID NO: 10536 - RNA, 20 nt, Human
gaguggguuuaacaauuuua

SEQ ID NO: 10537 - RNA, 23 nt, Human
uuugcugcuguuuugcuauucuu

SEQ ID NO: 10538 - RNA, 25 nt, Human
ggcucagaagggcagaguugaagaa

SEQ ID NO: 10539 - RNA, 26 nt, Human
ccuugcugggaagccucacccuucug

SEQ ID NO: 10540 - RNA, 24 nt, Human
ccuacuucucccuugcucccaaag

SEQ ID NO: 10541 - RNA, 24 nt, Human
agagcaugaucagcagaaagcucu

SEQ ID NO: 10542 - RNA, 20 nt, Human
ccuagcuccuguggucucca

SEQ ID NO: 10543 - RNA, 27 nt, Human
uuugcugucuugucuccugggacgaga

SEQ ID NO: 10544 - RNA, 22 nt, Human
agacagggagacuggagcccag

SEQ ID NO: 10545 - RNA, 23 nt, Human
gcccccuucccuguccuaagccu

SEQ ID NO: 10546 - RNA, 22 nt, Human
uucagccccacuggucuuuuca

SEQ ID NO: 10547 - RNA, 23 nt, Human
uggcccaggcuggagugcagugg

SEQ ID NO: 10548 - RNA, 22 nt, Human
ucuccucugggaggucuuggcc

SEQ ID NO: 10549 - RNA, 21 nt, Human
ugccuguaaccccagcacuuu

SEQ ID NO: 10550 - RNA, 27 nt, Human
ggacuccugucuaggugccccugauga

SEQ ID NO: 10551 - RNA, 19 nt, Human
ggugggaaaugggagccag

SEQ ID NO: 10552 - RNA, 22 nt, Human
gaggcguaggaaugaggcugga

SEQ ID NO: 10553 - RNA, 21 nt, Human
ucaacucaucugcccaaccaa

SEQ ID NO: 10554 - RNA, 24 nt, Human
gggggcggucggcccuguggaugc

SEQ ID NO: 10555 - RNA, 26 nt, Human
gcagccgccacauccccgcuggcugg

SEQ ID NO: 10556 - RNA, 22 nt, Human
acuauuuaaagccuccucaucc

SEQ ID NO: 10557 - RNA, 21 nt, Human
agagcucugacccacagccuc

SEQ ID NO: 10558 - RNA, 24 nt, Human
ccccuacaggugccagugccucca

SEQ ID NO: 10559 - RNA, 23 nt, Human
gcagugauggggaaagcuuuuuc

SEQ ID NO: 10560 - RNA, 23 nt, Human
cccuuacgcccuuccuccucucc

SEQ ID NO: 10561 - RNA, 23 nt, Human
ccuucaauucuugcuuuuuugcc

SEQ ID NO: 10562 - RNA, 22 nt, Human
augagcguuuaaaauacaucgc

SEQ ID NO: 10563 - RNA, 26 nt, Human
gcuguggcugccuaagaaaucauggc

SEQ ID NO: 10564 - RNA, 23 nt, Human
uggaauggaaggggcuugggaga

SEQ ID NO: 10565 - RNA, 23 nt, Human
cccauuagguauggagagcuggg

SEQ ID NO: 10566 - RNA, 26 nt, Human
uccugacagggugaccuuggguauuu

SEQ ID NO: 10567 - RNA, 22 nt, Human
ugaccaacguggagaaacccca

SEQ ID NO: 10568 - RNA, 22 nt, Human
ccuuacucauauauugccuuca

SEQ ID NO: 10569 - RNA, 28 nt, Human
cucucauccauuccucuuacuggggccu

SEQ ID NO: 10570 - RNA, 18 nt, Human
gcccuguuagugcacuga

SEQ ID NO: 10571 - RNA, 23 nt, Human
aaaggagucaggagccacuguga

SEQ ID NO: 10572 - RNA, 27 nt, Human
ugacucagagagggaagagauucagcc

SEQ ID NO: 10573 - RNA, 25 nt, Human
aaguuucagacuuaucuuuuccuug

SEQ ID NO: 10574 - RNA, 19 nt, Human
auuuuaaauaauguauuua

SEQ ID NO: 10575 - RNA, 19 nt, Human
cuucuccacuccugcccca

SEQ ID NO: 10576 - RNA, 21 nt, Human
cuuacagugaagauguuuacu

SEQ ID NO: 10577 - RNA, 22 nt, Human
accuguaaucccaacauuuugg

SEQ ID NO: 10578 - RNA, 22 nt, Human
accguuacucugcacauggacc

SEQ ID NO: 10579 - RNA, 24 nt, Human
agagaaaagggauggagaagagaa

SEQ ID NO: 10580 - RNA, 21 nt, Human
cauguaagauaaaaguacuug

SEQ ID NO: 10581 - RNA, 22 nt, Human
auugcuugaaccggggagacgg

SEQ ID NO: 10582 - RNA, 24 nt, Human
aauuccacagggaccagggccacc

SEQ ID NO: 10583 - RNA, 21 nt, Human
ccugccuggccugcucagagg

SEQ ID NO: 10584 - RNA, 22 nt, Human
aagcuguugaugagagcuguug

SEQ ID NO: 10585 - RNA, 22 nt, Human
uugccaggcuagagugcagugg

SEQ ID NO: 10586 - RNA, 20 nt, Human
gcuaccccaguuccaucugu

SEQ ID NO: 10587 - RNA, 26 nt, Human
uggaaagaaauguagaugauauguuu

SEQ ID NO: 10588 - RNA, 19 nt, Human
ucagaagcagaacaaguga

SEQ ID NO: 10589 - RNA, 18 nt, Human
aggugccccccaccagcu

SEQ ID NO: 10590 - RNA, 26 nt, Human
gagggagggguggggaggggauccug

SEQ ID NO: 10591 - RNA, 21 nt, Human
gucuuccucuguugcccaggc

SEQ ID NO: 10592 - RNA, 25 nt, Human
acauggucugucaaugagagcauaa

SEQ ID NO: 10593 - RNA, 23 nt, Human
ucauccagcaugaugcagcguga

SEQ ID NO: 10594 - RNA, 22 nt, Human
caggcugggguucagaccugca

SEQ ID NO: 10595 - RNA, 18 nt, Human
gagcucaggcuuuuccag

SEQ ID NO: 10596 - RNA, 22 nt, Human
ucucagcuagaaccauccacug

SEQ ID NO: 10597 - RNA, 21 nt, Human
aguggguuuggggcugaaaug

SEQ ID NO: 10598 - RNA, 27 nt, Human
auagcacuuauucacauuuaggaaaag

SEQ ID NO: 10599 - RNA, 20 nt, Human
cuggguccaagaaugccuca

SEQ ID NO: 10600 - RNA, 20 nt, Human
cucaguaagacagugcagug

SEQ ID NO: 10601 - RNA, 18 nt, Human
ugucugcugcuauucucc

SEQ ID NO: 10602 - RNA, 25 nt, Human
ucagcaucaccucuagcccuggcaa

SEQ ID NO: 10603 - RNA, 22 nt, Human
ggaggcugaggcgggcagauca

SEQ ID NO: 10604 - RNA, 22 nt, Human
ucauuucugccugacugcucca

SEQ ID NO: 10605 - RNA, 21 nt, Human
aagggaggggaagagagaggc

SEQ ID NO: 10606 - RNA, 21 nt, Human
ucaaccccccucuucuccaac

SEQ ID NO: 10607 - RNA, 19 nt, Human
agggcauuugccuccaucu

SEQ ID NO: 10608 - RNA, 22 nt, Human
cuggucaacauggcgaaauccc

SEQ ID NO: 10609 - RNA, 26 nt, Human
aagaauugcagcuguggcuggaaccu

SEQ ID NO: 10610 - RNA, 22 nt, Human
aagaagaguuugcaaaugcaac

SEQ ID NO: 10611 - RNA, 21 nt, Human
aauaacuguuuaguugaggcu

SEQ ID NO: 10612 - RNA, 26 nt, Human
cgccucagucucccaaagcgcuggga

SEQ ID NO: 10613 - RNA, 23 nt, Human
cucagcccucucccacauuuucc

SEQ ID NO: 10614 - RNA, 19 nt, Human
ucccucccucccuggagug

SEQ ID NO: 10615 - RNA, 27 nt, Human
cucuaggguagagggguggggacagaa

SEQ ID NO: 10616 - RNA, 26 nt, Human
ggccccuacaggcuggcccugcaaug

SEQ ID NO: 10617 - RNA, 23 nt, Human
ugcuggcauuugcaccuaccuca

SEQ ID NO: 10618 - RNA, 20 nt, Human
gucuguaauccauucacauu

SEQ ID NO: 10619 - RNA, 22 nt, Human
ccaagaauggaagcuugugagg

SEQ ID NO: 10620 - RNA, 22 nt, Human
guggggcagguugagacuagaa

SEQ ID NO: 10621 - RNA, 21 nt, Human
gcaguguuuugccuucacccc

SEQ ID NO: 10622 - RNA, 19 nt, Human
aguaguuuuuacagcugug

SEQ ID NO: 10623 - RNA, 22 nt, Human
guguuccagggccagugcucuu

SEQ ID NO: 10624 - RNA, 22 nt, Human
auugauacaauauugugcaugc

SEQ ID NO: 10625 - RNA, 22 nt, Human
gagggauugacucugaggaccu

SEQ ID NO: 10626 - RNA, 27 nt, Human
cuguuguuuuucacuguuuccaaagga

SEQ ID NO: 10627 - RNA, 22 nt, Human
ccaggcccugaaccccaacgcc

SEQ ID NO: 10628 - RNA, 28 nt, Human
gggaugaggcccuggcagaggugaagga

SEQ ID NO: 10629 - RNA, 24 nt, Human
ucugggagugugacguuguaaucu

SEQ ID NO: 10630 - RNA, 26 nt, Human
caccaguguagcaucuuccucugcag

SEQ ID NO: 10631 - RNA, 29 nt, Human
ggauuugcuuggcuucuuugagcauguaa

SEQ ID NO: 10632 - RNA, 20 nt, Human
auaucaaggagcucuucuag

SEQ ID NO: 10633 - RNA, 23 nt, Human
uggcuucucuucuuccuuuccug

SEQ ID NO: 10634 - RNA, 22 nt, Human
augggcuuggagcgggggccac

SEQ ID NO: 10635 - RNA, 20 nt, Human
guucagagguaagaaauacu

SEQ ID NO: 10636 - RNA, 25 nt, Human
agaggaugagcagagggaggaagau

SEQ ID NO: 10637 - RNA, 22 nt, Human
uaacuccugggcuuaagugauc

SEQ ID NO: 10638 - RNA, 27 nt, Human
cagacuaccugcccucagcuuggauaa

SEQ ID NO: 10639 - RNA, 23 nt, Human
auggcucuuuuguguaauuguuu

SEQ ID NO: 10640 - RNA, 21 nt, Human
uaugauacucugcacgcugcc

SEQ ID NO: 10641 - RNA, 21 nt, Human
agcuuaaauuauaauauugcu

SEQ ID NO: 10642 - RNA, 22 nt, Human
augccuguaauccuagcacuuu

SEQ ID NO: 10643 - RNA, 23 nt, Human
caaaacaacccuagaguguuguu

SEQ ID NO: 10644 - RNA, 19 nt, Human
uggcugucccuucucccau

SEQ ID NO: 10645 - RNA, 21 nt, Human
gccgccgccaccacugccacc

SEQ ID NO: 10646 - RNA, 21 nt, Human
accaccccauaccagucaccu

SEQ ID NO: 10647 - RNA, 23 nt, Human
gacucuaaucaacauuccuuuug

SEQ ID NO: 10648 - RNA, 26 nt, Human
cccuccagaggcagccuggccugugg

SEQ ID NO: 10649 - RNA, 24 nt, Human
uuaccucuugccaaaggccauuua

SEQ ID NO: 10650 - RNA, 24 nt, Human
aaauguucuucauccaggccugcc

SEQ ID NO: 10651 - RNA, 23 nt, Human
agggcuguauucaggaacguugg

SEQ ID NO: 10652 - RNA, 30 nt, Human
cuccuugaaaaaccucuuuauuaaucucac

SEQ ID NO: 10653 - RNA, 24 nt, Human
ucggcaaaucuugaaagcugcacg

SEQ ID NO: 10654 - RNA, 23 nt, Human
ccuuucucauauugagauguacu

SEQ ID NO: 10655 - RNA, 27 nt, Human
acaaucccuuucccagaauuaguugua

SEQ ID NO: 10656 - RNA, 23 nt, Human
ucccacauuguuuaacuuguaua

SEQ ID NO: 10657 - RNA, 20 nt, Human
caagguggggauggaagcac

SEQ ID NO: 10658 - RNA, 19 nt, Human
cagcauccagaagguucgu

SEQ ID NO: 10659 - RNA, 26 nt, Human
cugccuuuuaaaauuucauuacaaua

SEQ ID NO: 10660 - RNA, 24 nt, Human
agccucuccacggcuccugcgccu

SEQ ID NO: 10661 - RNA, 22 nt, Human
gcgugagccacagcucccagcc

SEQ ID NO: 10662 - RNA, 22 nt, Human
agcuauuuacaaccuucauuuc

SEQ ID NO: 10663 - RNA, 21 nt, Human
gggagagaggggaagagucgg

SEQ ID NO: 10664 - RNA, 22 nt, Human
uaccuccuggguucaagcaaau

SEQ ID NO: 10665 - RNA, 25 nt, Human
aucaugggaguacuguaaguucagu

SEQ ID NO: 10666 - RNA, 22 nt, Human
cuaccagcacauuaaaagugau

SEQ ID NO: 10667 - RNA, 21 nt, Human
ucauauuuacuguucucuaaa

SEQ ID NO: 10668 - RNA, 26 nt, Human
ugaccucaauuucaauuuugucugua

SEQ ID NO: 10669 - RNA, 24 nt, Human
cuucaucucaauagugauuuuugu

SEQ ID NO: 10670 - RNA, 22 nt, Human
gagggaggagccgcugguggag

SEQ ID NO: 10671 - RNA, 22 nt, Human
auugcuucaaccugggaggcag

SEQ ID NO: 10672 - RNA, 23 nt, Human
uggcagccacacccacucgcccg

SEQ ID NO: 10673 - RNA, 23 nt, Human
cucucaucauccuccucaugcca

SEQ ID NO: 10674 - RNA, 25 nt, Human
cgcugaucuucuauuuaauucccca

SEQ ID NO: 10675 - RNA, 20 nt, Human
acuuguaaagauuacuccaa

SEQ ID NO: 10676 - RNA, 24 nt, Human
ugaagggagaagacacugcaguga

SEQ ID NO: 10677 - RNA, 23 nt, Human
cagagauucugugccugcuuuau

SEQ ID NO: 10678 - RNA, 20 nt, Human
aucagcggcagaucucucca

SEQ ID NO: 10679 - RNA, 25 nt, Human
cgggcaccuguaaucccagcuacuc

SEQ ID NO: 10680 - RNA, 25 nt, Human
ugggcaccuguaaucccagcuacuu

SEQ ID NO: 10681 - RNA, 22 nt, Human
gaacuaucugaaaucugcucag

SEQ ID NO: 10682 - RNA, 22 nt, Human
ggacguguccagcucugcucug

SEQ ID NO: 10683 - RNA, 24 nt, Human
guuucauagaguccucuccucugc

SEQ ID NO: 10684 - RNA, 27 nt, Human
ccacagccagagucccuuggcagcccc

SEQ ID NO: 10685 - RNA, 17 nt, Human
accaauaaaaauccuac

SEQ ID NO: 10686 - RNA, 27 nt, Human
acauguguaacacuuuucagucugugg

SEQ ID NO: 10687 - RNA, 18 nt, Human
ucgccuaggcuggagugc

SEQ ID NO: 10688 - RNA, 20 nt, Human
cccuucagugcccugccugu

SEQ ID NO: 10689 - RNA, 27 nt, Human
ggucuucccacuggcagugcagcagcc

SEQ ID NO: 10690 - RNA, 22 nt, Human
cucucuggcuccugugcauucu

SEQ ID NO: 10691 - RNA, 29 nt, Human
ccugucacuggcccugaagacuggcccca

SEQ ID NO: 10692 - RNA, 21 nt, Human
cucucugcccugccaugcggc

SEQ ID NO: 10693 - RNA, 24 nt, Human
uacucugucucccaggcugcugga

SEQ ID NO: 10694 - RNA, 17 nt, Human
aaccugacaaaaccuca

SEQ ID NO: 10695 - RNA, 25 nt, Human
uucuuuaaaaauaaaggauuuugga

SEQ ID NO: 10696 - RNA, 19 nt, Human
uggggagagggagggccgg

SEQ ID NO: 10697 - RNA, 19 nt, Human
cagccuaugggaaguaguc

SEQ ID NO: 10698 - RNA, 27 nt, Human
guuuaacuguuugacucuuaugauacu

SEQ ID NO: 10699 - RNA, 22 nt, Human
uagaguuagaccugucuuugga

SEQ ID NO: 10700 - RNA, 22 nt, Human
gccccuggucugaggaggaggg

SEQ ID NO: 10701 - RNA, 26 nt, Human
cugagaugccuguucaucugcugacu

SEQ ID NO: 10702 - RNA, 23 nt, Human
gcgugcccacggcggcauuauuc

SEQ ID NO: 10703 - RNA, 23 nt, Human
gcaggcauuaaaauauguacaca

SEQ ID NO: 10704 - RNA, 21 nt, Human
uucugucucauuaucaccuca

SEQ ID NO: 10705 - RNA, 24 nt, Human
gugagguagugccaaugacaggac

SEQ ID NO: 10706 - RNA, 22 nt, Human
gcucaugccuguaaucccgaca

SEQ ID NO: 10707 - RNA, 22 nt, Human
aaaugauuucauauugaucuuu

SEQ ID NO: 10708 - RNA, 22 nt, Human
aacccaggcuggaaugcaaugg

SEQ ID NO: 10709 - RNA, 19 nt, Human
cuucccuucccccuggccu

SEQ ID NO: 10710 - RNA, 23 nt, Human
acagauggugaaguaacaugcau

SEQ ID NO: 10711 - RNA, 21 nt, Human
ucaguauuuuaaaagcucaaa

SEQ ID NO: 10712 - RNA, 27 nt, Human
gcuucuucgguugcaguccucuugcuu

SEQ ID NO: 10713 - RNA, 25 nt, Human
ucccuaggcaagagcagcagcacaa

SEQ ID NO: 10714 - RNA, 19 nt, Human
ucucccuucagcucuggga

SEQ ID NO: 10715 - RNA, 21 nt, Human
uauucaucaccccuguccucu

SEQ ID NO: 10716 - RNA, 21 nt, Human
gcugucuucccugucugaucc

SEQ ID NO: 10717 - RNA, 28 nt, Human
gccagacccuggccagcaugguuguccu

SEQ ID NO: 10718 - RNA, 27 nt, Human
gccccacucccaguccuccugggaucc

SEQ ID NO: 10719 - RNA, 32 nt, Human
gcugcugcugcugcuacugccaccgcugccac

SEQ ID NO: 10720 - RNA, 27 nt, Human
agggcgucacguggcagcguggggccc

SEQ ID NO: 10721 - RNA, 22 nt, Human
aaccucaaacuccuggacucau

SEQ ID NO: 10722 - RNA, 21 nt, Human
cucacccaggcuggaaugcag

SEQ ID NO: 10723 - RNA, 22 nt, Human
caggcuagagugcaguggugcg

SEQ ID NO: 10724 - RNA, 22 nt, Human
uucauucuuguauuauaauuaa

SEQ ID NO: 10725 - RNA, 26 nt, Human
uuggagccuugggugggcagggacgg

SEQ ID NO: 10726 - RNA, 22 nt, Human
gucugggcagaggagggaccac

SEQ ID NO: 10727 - RNA, 26 nt, Human
guucacugcaaugcuggacacuacag

SEQ ID NO: 10728 - RNA, 24 nt, Human
ugccucggcucaccucuuccucca

SEQ ID NO: 10729 - RNA, 21 nt, Human
aagaccaucuauaaagaauac

SEQ ID NO: 10730 - RNA, 20 nt, Human
gggggaggggcugggggagu

SEQ ID NO: 10731 - RNA, 21 nt, Human
cagagcuggcucuggggagcu

SEQ ID NO: 10732 - RNA, 21 nt, Human
cccaagugccugugcccagag

SEQ ID NO: 10733 - RNA, 22 nt, Human
gaccucugauaugaaugugauc

SEQ ID NO: 10734 - RNA, 25 nt, Human
gcaacuuuuucuuuauaguaagagc

SEQ ID NO: 10735 - RNA, 21 nt, Human
ccugcaccggggccugggcag

SEQ ID NO: 10736 - RNA, 27 nt, Human
ucacccugggagcagucggcacagugc

SEQ ID NO: 10737 - RNA, 24 nt, Human
gauccgcccacuucggucucccaa

SEQ ID NO: 10738 - RNA, 20 nt, Human
caccuaggcaagagugcaau

SEQ ID NO: 10739 - RNA, 19 nt, Human
cauuaccaaguuacuugaa

SEQ ID NO: 10740 - RNA, 25 nt, Human
cucagcuuagaagaaaucugugugg

SEQ ID NO: 10741 - RNA, 27 nt, Human
ucacagcuguauagcugcuuccagugu

SEQ ID NO: 10742 - RNA, 21 nt, Human
gaaggaugagaggugaaauug

SEQ ID NO: 10743 - RNA, 23 nt, Human
uuagcuggcagacccaggggaag

SEQ ID NO: 10744 - RNA, 26 nt, Human
gcaguugaucaaauacaauagaccau

SEQ ID NO: 10745 - RNA, 24 nt, Human
ugcaggguuugccuugaaaccauu

SEQ ID NO: 10746 - RNA, 24 nt, Human
gcagcuacuuuuucuuuacuguau

SEQ ID NO: 10747 - RNA, 21 nt, Human
ccagcguucauguucugugau

SEQ ID NO: 10748 - RNA, 22 nt, Human
ugaagaaacccacccacuguga

SEQ ID NO: 10749 - RNA, 20 nt, Human
ggacgcugcagcucucucca

SEQ ID NO: 10750 - RNA, 27 nt, Human
uugcccaggcuggucuugaaguccugg

SEQ ID NO: 10751 - RNA, 22 nt, Human
uacucccucucuguuccugucu

SEQ ID NO: 10752 - RNA, 21 nt, Human
auucuugugugcugcuuucca

SEQ ID NO: 10753 - RNA, 24 nt, Human
gcaucagugucuuuccacuccucc

SEQ ID NO: 10754 - RNA, 21 nt, Human
guuugagaccagccugggcag

SEQ ID NO: 10755 - RNA, 22 nt, Human
agaccagccugggcaacagggu

SEQ ID NO: 10756 - RNA, 22 nt, Human
auacagacacacacauauaugu

SEQ ID NO: 10757 - RNA, 22 nt, Human
aacaacaaaaguccauucauau

SEQ ID NO: 10758 - RNA, 22 nt, Human
uuccaggggccuuuggucugcc

SEQ ID NO: 10759 - RNA, 26 nt, Human
ugggguugugugugagugcccgucag

SEQ ID NO: 10760 - RNA, 18 nt, Human
gugcagagaggugucaca

SEQ ID NO: 10761 - RNA, 23 nt, Human
ggccaucuugguuuucuucugga

SEQ ID NO: 10762 - RNA, 26 nt, Human
ccuccaagguccucugggcagcaggc

SEQ ID NO: 10763 - RNA, 23 nt, Human
aguauuuuaauccuauuacuuga

SEQ ID NO: 10764 - RNA, 24 nt, Human
cugaguugaccucugguucagcca

SEQ ID NO: 10765 - RNA, 27 nt, Human
cagccuaucuuugugugacaugugagc

SEQ ID NO: 10766 - RNA, 25 nt, Human
ccuccugcuugcuguacuugggaug

SEQ ID NO: 10767 - RNA, 23 nt, Human
aggaccacaaugagauuccauuu

SEQ ID NO: 10768 - RNA, 21 nt, Human
aggaggcacaacaguucucuu

SEQ ID NO: 10769 - RNA, 27 nt, Human
cucagcccccaccacaaacacagcccu

SEQ ID NO: 10770 - RNA, 22 nt, Human
ccagggaggaacggaggaggac

SEQ ID NO: 10771 - RNA, 23 nt, Human
uugaggggcgaguagcagcucug

SEQ ID NO: 10772 - RNA, 22 nt, Human
guaaggugaauggggaggcugg

SEQ ID NO: 10773 - RNA, 22 nt, Human
gugugcaugugugugcacacgu

SEQ ID NO: 10774 - RNA, 26 nt, Human
ugagccagaggcguagggcccaggag

SEQ ID NO: 10775 - RNA, 21 nt, Human
ggggcuaaggcaggaggauca

SEQ ID NO: 10776 - RNA, 26 nt, Human
acugccugguucagccucuucgcuga

SEQ ID NO: 10777 - RNA, 20 nt, Human
gcugcugcuacugcugcccc

SEQ ID NO: 10778 - RNA, 25 nt, Human
gggugguggggugcuagagcuguuu

SEQ ID NO: 10779 - RNA, 26 nt, Human
aggaaagagaagacuuucauugacgg

SEQ ID NO: 10780 - RNA, 21 nt, Human
caggagguugaggugggagga

SEQ ID NO: 10781 - RNA, 19 nt, Human
gcugcccaggcugaggcaa

SEQ ID NO: 10782 - RNA, 22 nt, Human
ccugcagcugccucacaccgcc

SEQ ID NO: 10783 - RNA, 21 nt, Human
cuguugaaccacagcaccagg

SEQ ID NO: 10784 - RNA, 22 nt, Human
gcuuccaggcagaacagcugca

SEQ ID NO: 10785 - RNA, 19 nt, Human
gccucagguagccagggaa

SEQ ID NO: 10786 - RNA, 22 nt, Human
aacauggguucuuagucuuuag

SEQ ID NO: 10787 - RNA, 26 nt, Human
gaacagucuucagccacaguugugau

SEQ ID NO: 10788 - RNA, 26 nt, Human
ggcucugggggcagauuuguggggac

SEQ ID NO: 10789 - RNA, 27 nt, Human
ccuguuuuuagcuuauuuaaugacggg

SEQ ID NO: 10790 - RNA, 26 nt, Human
uguccuuuuaauuuauaauuuaugua

SEQ ID NO: 10791 - RNA, 24 nt, Human
ugggaggugcugaaggggcauugg

SEQ ID NO: 10792 - RNA, 21 nt, Human
gccuggggccuccagccuggg

SEQ ID NO: 10793 - RNA, 28 nt, Human
ggagagagaagaagaugaaguuugccag

SEQ ID NO: 10794 - RNA, 25 nt, Human
ccuccuagacuccugggccccauga

SEQ ID NO: 10795 - RNA, 23 nt, Human
uuaguaaugucugcaacaaugac

SEQ ID NO: 10796 - RNA, 21 nt, Human
aaucaaucuuaucauauuuca

SEQ ID NO: 10797 - RNA, 22 nt, Human
gucucccaggcuggagugcagu

SEQ ID NO: 10798 - RNA, 22 nt, Human
uugcagcauccaguucaucuua

SEQ ID NO: 10799 - RNA, 26 nt, Human
gucuugaacuccuggccuuaagugau

SEQ ID NO: 10800 - RNA, 20 nt, Human
gucuuauuuguucauccugg

SEQ ID NO: 10801 - RNA, 19 nt, Human
agccauggucacgugacau

SEQ ID NO: 10802 - RNA, 21 nt, Human
guucacugcaacuucugccuc

SEQ ID NO: 10803 - RNA, 21 nt, Human
guucacugcaaccucugccuu

SEQ ID NO: 10804 - RNA, 27 nt, Human
uuguggaauuugugacugcagggaaaa

SEQ ID NO: 10805 - RNA, 26 nt, Human
caauuucaccaccaaaugccaagaaa

SEQ ID NO: 10806 - RNA, 19 nt, Human
aaaucagcuacuguauucc

SEQ ID NO: 10807 - RNA, 21 nt, Human
cacguuauuuuuuaauuacua

SEQ ID NO: 10808 - RNA, 21 nt, Human
cuggggaagucaagaaugggg

SEQ ID NO: 10809 - RNA, 23 nt, Human
ccaggagcccugccaggggcugu

SEQ ID NO: 10810 - RNA, 22 nt, Human
caagugauucuucuugccucag

SEQ ID NO: 10811 - RNA, 20 nt, Human
cuccuaguagcuuuccuccc

SEQ ID NO: 10812 - RNA, 22 nt, Human
ggcaggguggaguggaggggga

SEQ ID NO: 10813 - RNA, 23 nt, Human
cccaaagugcugggauuaacagg

SEQ ID NO: 10814 - RNA, 25 nt, Human
caggcaacacccucaaccggcucca

SEQ ID NO: 10815 - RNA, 22 nt, Human
aggcaagccccauauaaugaag

SEQ ID NO: 10816 - RNA, 24 nt, Human
cgagaguguuguaaaguguggaaa

SEQ ID NO: 10817 - RNA, 17 nt, Human
augcagaugcagucuga

SEQ ID NO: 10818 - RNA, 26 nt, Human
cagagcccuggcuggugacaugcugg

SEQ ID NO: 10819 - RNA, 24 nt, Human
uugccagaucucccucccucucuc

SEQ ID NO: 10820 - RNA, 20 nt, Human
ggcgguugaggcugcaguga

SEQ ID NO: 10821 - RNA, 27 nt, Human
uuccagccuggugccuggggugcugag

SEQ ID NO: 10822 - RNA, 21 nt, Human
cucgugauccgccugccucgg

SEQ ID NO: 10823 - RNA, 23 nt, Human
uagcagcgggcugggcacauccu

SEQ ID NO: 10824 - RNA, 22 nt, Human
gccucccagguugacaccauuc

SEQ ID NO: 10825 - RNA, 29 nt, Human
ucacacgaaucaggaaacugcucucccuc

SEQ ID NO: 10826 - RNA, 18 nt, Human
uguaauaaaucugagccu

SEQ ID NO: 10827 - RNA, 24 nt, Human
ugugcugucuaucuuccugguuuu

SEQ ID NO: 10828 - RNA, 26 nt, Human
ccugcaaccuccgccuccuggauucc

SEQ ID NO: 10829 - RNA, 27 nt, Human
uggucucagggauugcuccuauguauu

SEQ ID NO: 10830 - RNA, 23 nt, Human
augagggagagagagccagagac

SEQ ID NO: 10831 - RNA, 23 nt, Human
guaaguuaccugaaagcugcagu

SEQ ID NO: 10832 - RNA, 19 nt, Human
ccuccaggaacagacaugg

SEQ ID NO: 10833 - RNA, 22 nt, Human
ugcuuaagaaagggaggggggu

SEQ ID NO: 10834 - RNA, 26 nt, Human
acugcugcuacugccccucuccgaaa

SEQ ID NO: 10835 - RNA, 14 nt, Human
cccaggaauacuca

SEQ ID NO: 10836 - RNA, 22 nt, Human
cacugcacuccagcuugggcaa

SEQ ID NO: 10837 - RNA, 26 nt, Human
uguggaaacuggaugaacaggaugua

SEQ ID NO: 10838 - RNA, 26 nt, Human
cugaguuuuaaaaaugaaauacuuua

SEQ ID NO: 10839 - RNA, 21 nt, Human
ccugcagcuuugagucuugcc

SEQ ID NO: 10840 - RNA, 23 nt, Human
gacuuugaggagaggcugugaug

SEQ ID NO: 10841 - RNA, 27 nt, Human
ucuauaauuccuuaaaauuuucauucu

SEQ ID NO: 10842 - RNA, 22 nt, Human
acucugggauguguagccuucu

SEQ ID NO: 10843 - RNA, 20 nt, Human
gaguucuucuuucuuucuua

SEQ ID NO: 10844 - RNA, 22 nt, Human
uacucacacaucuuugcguucu

SEQ ID NO: 10845 - RNA, 23 nt, Human
uuuucgcuugcgagcaagggagu

SEQ ID NO: 10846 - RNA, 27 nt, Human
cagaugaccccagucacuccucucuag

SEQ ID NO: 10847 - RNA, 22 nt, Human
uacccuuuuguucuucccccug

SEQ ID NO: 10848 - RNA, 22 nt, Human
gaucagccuggcuaacauggcg

SEQ ID NO: 10849 - RNA, 21 nt, Human
gaggcugagacuaggguuuua

SEQ ID NO: 10850 - RNA, 21 nt, Human
ggugagccaccacgcccagcc

SEQ ID NO: 10851 - RNA, 26 nt, Human
cugcuucgucgccuccuuucucuccc

SEQ ID NO: 10852 - RNA, 22 nt, Human
cccugcucacccuauguggucc

SEQ ID NO: 10853 - RNA, 22 nt, Human
cuuccuccaggagucucuggug

SEQ ID NO: 10854 - RNA, 21 nt, Human
acacagccccugcagggaaag

SEQ ID NO: 10855 - RNA, 21 nt, Human
aucaucucugauuguccucag

SEQ ID NO: 10856 - RNA, 19 nt, Human
ccucucauucugugucccu

SEQ ID NO: 10857 - RNA, 25 nt, Human
gccuuucuccugcccggccucggaa

SEQ ID NO: 10858 - RNA, 26 nt, Human
cgacgcuucagggccgggagcaggga

SEQ ID NO: 10859 - RNA, 25 nt, Human
acuuaauagaagucaguuacuccag

SEQ ID NO: 10860 - RNA, 19 nt, Human
cccucauucugcagggcca

SEQ ID NO: 10861 - RNA, 20 nt, Human
ggggagggagagggagcuuu

SEQ ID NO: 10862 - RNA, 21 nt, Human
gaggcugagguggaaggauca

SEQ ID NO: 10863 - RNA, 26 nt, Human
acaaguguuuacugucgcaguuuccc

SEQ ID NO: 10864 - RNA, 20 nt, Human
ccucuacuauucaggaggcc

SEQ ID NO: 10865 - RNA, 23 nt, Human
cccuacugaagcccuugugaauc

SEQ ID NO: 10866 - RNA, 20 nt, Human
uugccuagggccucugugau

SEQ ID NO: 10867 - RNA, 24 nt, Human
aggccagaggacagagcagaggau

SEQ ID NO: 10868 - RNA, 22 nt, Human
agagggcaaagggccuaccucg

SEQ ID NO: 10869 - RNA, 20 nt, Human
gugcccagguggaguuagaa

SEQ ID NO: 10870 - RNA, 23 nt, Human
ccaaugccuucugguacugccau

SEQ ID NO: 10871 - RNA, 22 nt, Human
cagcugcgaggaccucuguggu

SEQ ID NO: 10872 - RNA, 24 nt, Human
guuccccaggaugcacauugaagg

SEQ ID NO: 10873 - RNA, 26 nt, Human
uggucugcuguggggggcaugcagga

SEQ ID NO: 10874 - RNA, 22 nt, Human
agagccacacaugggcaucuau

SEQ ID NO: 10875 - RNA, 22 nt, Human
agugacaugaucuuagcucacu

SEQ ID NO: 10876 - RNA, 20 nt, Human
uacacuuugaacuacuagaa

SEQ ID NO: 10877 - RNA, 22 nt, Human
ugggaggcagugcucugcuagu

SEQ ID NO: 10878 - RNA, 23 nt, Human
uugagacagagucucacucuguu

SEQ ID NO: 10879 - RNA, 21 nt, Human
ggcaagccggcccccaccucu

SEQ ID NO: 10880 - RNA, 25 nt, Human
gccucacgcucugggcacagcugag

SEQ ID NO: 10881 - RNA, 21 nt, Human
cucaucaccuugcucaccaac

SEQ ID NO: 10882 - RNA, 23 nt, Human
uugauuccagugguucugcuuca

SEQ ID NO: 10883 - RNA, 20 nt, Human
aacucuugucuauuuuuguc

SEQ ID NO: 10884 - RNA, 21 nt, Human
gcacuauagucaguugggagu

SEQ ID NO: 10885 - RNA, 27 nt, Human
uguaauaaauaucuggaaaaaacauua

SEQ ID NO: 10886 - RNA, 23 nt, Human
auaauuuuugcugaauucuuuac

SEQ ID NO: 10887 - RNA, 26 nt, Human
cccuccagcucccugugcccccaggg

SEQ ID NO: 10888 - RNA, 26 nt, Human
aggguagguucucgggacugaaggaa

SEQ ID NO: 10889 - RNA, 20 nt, Human
aaaugauuuuauucauuuuu

SEQ ID NO: 10890 - RNA, 28 nt, Human
agcacguuucacaccucccccuucccuc

SEQ ID NO: 10891 - RNA, 26 nt, Human
gggugcaccugucaccgcaguccugg

SEQ ID NO: 10892 - RNA, 21 nt, Human
gagagggagcgcgcgggcagc

SEQ ID NO: 10893 - RNA, 27 nt, Human
gucccuggaugaggugaugauuucccg

SEQ ID NO: 10894 - RNA, 27 nt, Human
ccugcagcugaccgggucacacaaagg

SEQ ID NO: 10895 - RNA, 21 nt, Human
aaacucaucguucuaaaauca

SEQ ID NO: 10896 - RNA, 24 nt, Human
uacagcugagcacauucuggcuca

SEQ ID NO: 10897 - RNA, 27 nt, Human
gaucagggcauugccugugacugaggc

SEQ ID NO: 10898 - RNA, 22 nt, Human
cagugacacaccucuccccuca

SEQ ID NO: 10899 - RNA, 25 nt, Human
ccuccugccagcaguucuugaagcu

SEQ ID NO: 10900 - RNA, 21 nt, Human
cuucuaccagggaugccuuca

SEQ ID NO: 10901 - RNA, 27 nt, Human
ugcuucaaagcagagguuucucauggg

SEQ ID NO: 10902 - RNA, 29 nt, Human
gcugcaauauuccguccugggugucuggg

SEQ ID NO: 10903 - RNA, 23 nt, Human
cucuccaggaguccggagcaugg

SEQ ID NO: 10904 - RNA, 23 nt, Human
guacaucuuccaucuuacuuuua

SEQ ID NO: 10905 - RNA, 18 nt, Human
auaugcagagcggaggcu

SEQ ID NO: 10906 - RNA, 22 nt, Human
ccuguucuguugacuggggccc

SEQ ID NO: 10907 - RNA, 21 nt, Human
aacacaugcuguuucuacuug

SEQ ID NO: 10908 - RNA, 23 nt, Human
uuauccaccucccuaccaaaaau

SEQ ID NO: 10909 - RNA, 21 nt, Human
ucacaugcaccuaaauccuca

SEQ ID NO: 10910 - RNA, 27 nt, Human
caggcuggagugcaguggcgccaucuu

SEQ ID NO: 10911 - RNA, 23 nt, Human
gccauucuucuggugcuacucca

SEQ ID NO: 10912 - RNA, 21 nt, Human
cuugaaucugggaggcagagg

SEQ ID NO: 10913 - RNA, 22 nt, Human
agucuccgcccccuucccgccu

SEQ ID NO: 10914 - RNA, 27 nt, Human
uaaagaagaaaagaaaaacuugaauug

SEQ ID NO: 10915 - RNA, 22 nt, Human
cacauaccacugcacccagcua

SEQ ID NO: 10916 - RNA, 22 nt, Human
gcccaggcugcagugcaguggc

SEQ ID NO: 10917 - RNA, 22 nt, Human
guuaucaaauacaucuccagua

SEQ ID NO: 10918 - RNA, 24 nt, Human
auccagagaguccuaugaaaagac

SEQ ID NO: 10919 - RNA, 26 nt, Human
gucccauuucuuauccuuuuugcucu

SEQ ID NO: 10920 - RNA, 21 nt, Human
cuuguagcuuccugggguggg

SEQ ID NO: 10921 - RNA, 20 nt, Human
agcccaggcuuggaggccag

SEQ ID NO: 10922 - RNA, 21 nt, Human
cagacagagccagaagggccu

SEQ ID NO: 10923 - RNA, 27 nt, Human
ucuucuuucuuagauucucuuuguugu

SEQ ID NO: 10924 - RNA, 20 nt, Human
ucugggagcuucuuccguuu

SEQ ID NO: 10925 - RNA, 28 nt, Human
ccacauaccuggcccaaccagacuucuc

SEQ ID NO: 10926 - RNA, 27 nt, Human
gucauugucaagugcuugcgaucuuuu

SEQ ID NO: 10927 - RNA, 21 nt, Human
ccugaccuccccuuggggacc

SEQ ID NO: 10928 - RNA, 19 nt, Human
cccagcucugucauggugc

SEQ ID NO: 10929 - RNA, 27 nt, Human
ccugcagcuccagcuuugugcucugcc

SEQ ID NO: 10930 - RNA, 19 nt, Human
aggcuucaucuucucccug

SEQ ID NO: 10931 - RNA, 24 nt, Human
acgugcaugcuguagcugcagccu

SEQ ID NO: 10932 - RNA, 25 nt, Human
accagcacaagucugcagaucaucu

SEQ ID NO: 10933 - RNA, 20 nt, Human
aaagaacuaguccucuuaga

SEQ ID NO: 10934 - RNA, 19 nt, Human
gugccaccugggccagcaa

SEQ ID NO: 10935 - RNA, 25 nt, Human
cucaaggaggcacugggcucagccu

SEQ ID NO: 10936 - RNA, 21 nt, Human
caggaccuaugcaacgcacag

SEQ ID NO: 10937 - RNA, 25 nt, Human
acagauggauaauuggacuuaagcc

SEQ ID NO: 10938 - RNA, 23 nt, Human
ugacucaucuuccuguuguucca

SEQ ID NO: 10939 - RNA, 20 nt, Human
cugccccugggaaaccagag

SEQ ID NO: 10940 - RNA, 24 nt, Human
cugacaguguuuuaggugccugga

SEQ ID NO: 10941 - RNA, 23 nt, Human
uaugucuucuuuugagaaaugcc

SEQ ID NO: 10942 - RNA, 20 nt, Human
ggcuuacugaauggcuucau

SEQ ID NO: 10943 - RNA, 21 nt, Human
cuccacccuuccuguuguucc

SEQ ID NO: 10944 - RNA, 21 nt, Human
gcagugucucuaaaggaggca

SEQ ID NO: 10945 - RNA, 19 nt, Human
ucugccuggggcccacugc

SEQ ID NO: 10946 - RNA, 19 nt, Human
acacacaccggcacuuuca

SEQ ID NO: 10947 - RNA, 27 nt, Human
ccuguucugugcuugaaugugcugaau

SEQ ID NO: 10948 - RNA, 24 nt, Human
ucagacauugccaucggcugugaa

SEQ ID NO: 10949 - RNA, 25 nt, Human
uugcaguaaaguauguuguuuucau

SEQ ID NO: 10950 - RNA, 27 nt, Human
gggagcacccuucuacuccuagccacg

SEQ ID NO: 10951 - RNA, 20 nt, Human
uugcuuugguuuccuuuuga

SEQ ID NO: 10952 - RNA, 21 nt, Human
gcucuguggaguuuucccuuu

SEQ ID NO: 10953 - RNA, 25 nt, Human
augcuguuugcugcaguucuguguc

SEQ ID NO: 10954 - RNA, 23 nt, Human
uauccucucaguguuuuaucuuc

SEQ ID NO: 10955 - RNA, 27 nt, Human
uaaacucagaaaaaagaagaccucagu

SEQ ID NO: 10956 - RNA, 22 nt, Human
ccacaggaaacaucaagaagcc

SEQ ID NO: 10957 - RNA, 23 nt, Human
agguguugaaagcacaggcagag

SEQ ID NO: 10958 - RNA, 22 nt, Human
accccagcaggagugggagggu

SEQ ID NO: 10959 - RNA, 26 nt, Human
uggcugcuguucugaaaccaucugau

SEQ ID NO: 10960 - RNA, 22 nt, Human
ccaaagugcugagauuacagac

SEQ ID NO: 10961 - RNA, 20 nt, Human
ggauggccgcuguccggcag

SEQ ID NO: 10962 - RNA, 22 nt, Human
uggagccucaguuaaagugccu

SEQ ID NO: 10963 - RNA, 21 nt, Human
cuggacccacuuucucucuca

SEQ ID NO: 10964 - RNA, 21 nt, Human
gagagggagccaucgggccgc

SEQ ID NO: 10965 - RNA, 20 nt, Human
uucaaacuacuuugcugcua

SEQ ID NO: 10966 - RNA, 27 nt, Human
aggugucuggaggcugaaggguggagg

SEQ ID NO: 10967 - RNA, 21 nt, Human
gcacgccugaaaugugcucau

SEQ ID NO: 10968 - RNA, 21 nt, Human
cuuuacugcugagcuccugcu

SEQ ID NO: 10969 - RNA, 22 nt, Human
uucagccaggcuggagcaaggu

SEQ ID NO: 10970 - RNA, 26 nt, Human
aggaagagaagagccguguggccgcg

SEQ ID NO: 10971 - RNA, 32 nt, Human
ccagguucuccacauggugaaugaacuuuauc

SEQ ID NO: 10972 - RNA, 20 nt, Human
caucccuucgccugcagccu

SEQ ID NO: 10973 - RNA, 24 nt, Human
ugcaagccaacaguucaguguuuu

SEQ ID NO: 10974 - RNA, 19 nt, Human
acagcaaaacuccaucuca

SEQ ID NO: 10975 - RNA, 27 nt, Human
uugcccaggcuggagugcaguggccug

SEQ ID NO: 10976 - RNA, 25 nt, Human
ggaugggccaaacccagacaacggg

SEQ ID NO: 10977 - RNA, 21 nt, Human
gaagaccacagaggggugucg

SEQ ID NO: 10978 - RNA, 22 nt, Human
uaugcuuuuauaugcuauucag

SEQ ID NO: 10979 - RNA, 31 nt, Human
ggaggcuuugggagagcaggaaugaaaacau

SEQ ID NO: 10980 - RNA, 28 nt, Human
gagaguguuugagagcagaagcuauggc

SEQ ID NO: 10981 - RNA, 27 nt, Human
ccccaguagcugggacuacagacgugu

SEQ ID NO: 10982 - RNA, 22 nt, Human
ucagcgugccgcucugugucau

SEQ ID NO: 10983 - RNA, 20 nt, Human
ccagccugggcaacgaguga

SEQ ID NO: 10984 - RNA, 19 nt, Human
ccgcuuucccucuggacca

SEQ ID NO: 10985 - RNA, 21 nt, Human
gggaguuagagguugcaguga

SEQ ID NO: 10986 - RNA, 22 nt, Human
ccacugccaccaugggagcuac

SEQ ID NO: 10987 - RNA, 26 nt, Human
ccagcuaccccacuguguggcuggug

SEQ ID NO: 10988 - RNA, 22 nt, Human
aagacuucuuuucauacucuca

SEQ ID NO: 10989 - RNA, 24 nt, Human
gcacuguguuccuguugucguggu

SEQ ID NO: 10990 - RNA, 25 nt, Human
aggacaccuuucucugccgccugcu

SEQ ID NO: 10991 - RNA, 26 nt, Human
ucuuccucuuuuuguccucaucacuc

SEQ ID NO: 10992 - RNA, 23 nt, Human
ucgaggcacgugaucaguguugc

SEQ ID NO: 10993 - RNA, 21 nt, Human
gggcuggggaucccacucuuc

SEQ ID NO: 10994 - RNA, 22 nt, Human
cauuugcuuucuuuucucccau

SEQ ID NO: 10995 - RNA, 21 nt, Human
gaaguuacauauuaggccaua

SEQ ID NO: 10996 - RNA, 22 nt, Human
ccacuggcuccaugauucucug

SEQ ID NO: 10997 - RNA, 19 nt, Human
auucuaacugguacuccaa

SEQ ID NO: 10998 - RNA, 18 nt, Human
auaucucaaauguuaaua

SEQ ID NO: 10999 - RNA, 23 nt, Human
ggccaggcagccaaaucuugccu

SEQ ID NO: 11000 - RNA, 23 nt, Human
gccaaccaagagcacauucuuaa

SEQ ID NO: 11001 - RNA, 21 nt, Human
acaucucccuucuggguguca

SEQ ID NO: 11002 - RNA, 20 nt, Human
aacggcuucucugauauuua

SEQ ID NO: 11003 - RNA, 23 nt, Human
caaugccaaagccucacugucac

SEQ ID NO: 11004 - RNA, 24 nt, Human
cuuccacugcuccuuuaugacugc

SEQ ID NO: 11005 - RNA, 29 nt, Human
gccucuaacucccugugucugcaugagca

SEQ ID NO: 11006 - RNA, 22 nt, Human
aguucagcuccacgugugccau

SEQ ID NO: 11007 - RNA, 24 nt, Human
auuacuggacucucuuagcacagg

SEQ ID NO: 11008 - RNA, 24 nt, Human
gggcuaaauacuuacauuuacaag

SEQ ID NO: 11009 - RNA, 24 nt, Human
cugcggcccuguguuccugcuaca

SEQ ID NO: 11010 - RNA, 27 nt, Human
uggaaagaccuuugcucaaaauucagc

SEQ ID NO: 11011 - RNA, 24 nt, Human
uuacacguugcauacuacaaagca

SEQ ID NO: 11012 - RNA, 24 nt, Human
ugagugagacugagggaucguaga

SEQ ID NO: 11013 - RNA, 23 nt, Human
gcugcuggcugggcaaguguuca

SEQ ID NO: 11014 - RNA, 22 nt, Human
gguguggucccauaggagcagc

SEQ ID NO: 11015 - RNA, 21 nt, Human
gccuuucucccaggccaggcu

SEQ ID NO: 11016 - RNA, 22 nt, Human
acaugguuaaaaacaagcacaa

SEQ ID NO: 11017 - RNA, 22 nt, Human
auuucucugcuguaagaugacu

SEQ ID NO: 11018 - RNA, 28 nt, Human
ggcauuuuccacaccuguccacuccuug

SEQ ID NO: 11019 - RNA, 22 nt, Human
ggcaggagaaggaccaagagag

SEQ ID NO: 11020 - RNA, 22 nt, Human
aggcugaggcagguggaucacc

SEQ ID NO: 11021 - RNA, 21 nt, Human
gaguacuguuuuuagauguga

SEQ ID NO: 11022 - RNA, 25 nt, Human
ccaggguggaagcgccaggagcagc

SEQ ID NO: 11023 - RNA, 23 nt, Human
gugcaguggcacagucuuggcuc

SEQ ID NO: 11024 - RNA, 25 nt, Human
ucaggugccaacccaaaaauuggcu

SEQ ID NO: 11025 - RNA, 21 nt, Human
gucuaagagguacauucuucc

SEQ ID NO: 11026 - RNA, 27 nt, Human
uucauggauuucauuuguugguacaua

SEQ ID NO: 11027 - RNA, 27 nt, Human
uuccagccauggcucucagaguccuuc

SEQ ID NO: 11028 - RNA, 21 nt, Human
cauuccugccugacaggacca

SEQ ID NO: 11029 - RNA, 19 nt, Human
acacagucuguauauuuua

SEQ ID NO: 11030 - RNA, 27 nt, Human
gcuguccucccuucauuucuguggacc

SEQ ID NO: 11031 - RNA, 27 nt, Human
gccccugggguggaagugggguagggg

SEQ ID NO: 11032 - RNA, 20 nt, Human
cugggaggucagguggggug

SEQ ID NO: 11033 - RNA, 23 nt, Human
uucauucucccuuuauugauuca

SEQ ID NO: 11034 - RNA, 27 nt, Human
uaagccuuuuguuucaaauaaaacuug

SEQ ID NO: 11035 - RNA, 21 nt, Human
auuaugggcugugggcuguua

SEQ ID NO: 11036 - RNA, 24 nt, Human
ggucacuuggaacuuuggagcaga

SEQ ID NO: 11037 - RNA, 20 nt, Human
ucugcuuccuuucucgcucc

SEQ ID NO: 11038 - RNA, 20 nt, Human
cuauaggaccuccuaaugag

SEQ ID NO: 11039 - RNA, 27 nt, Human
ccaacauggggaaacugaggcucggcu

SEQ ID NO: 11040 - RNA, 20 nt, Human
cuuuuuccccaacagaccug

SEQ ID NO: 11041 - RNA, 21 nt, Human
cagugcccaguacacagcugc

SEQ ID NO: 11042 - RNA, 23 nt, Human
agagggauauggagagcaggugg

SEQ ID NO: 11043 - RNA, 20 nt, Human
guucacugcagccucaaccu

SEQ ID NO: 11044 - RNA, 27 nt, Human
guguggccccgcuggggugcccccucc

SEQ ID NO: 11045 - RNA, 27 nt, Human
agcauuuuccugcuccuucguauguag

SEQ ID NO: 11046 - RNA, 30 nt, Human
uacagguguaagccaucacaccuggcccua

SEQ ID NO: 11047 - RNA, 20 nt, Human
gcuaccugauuucagcacaa

SEQ ID NO: 11048 - RNA, 20 nt, Human
caggcuggagugcagcagca

SEQ ID NO: 11049 - RNA, 24 nt, Human
ugugugccuucaaagaaacugaca

SEQ ID NO: 11050 - RNA, 22 nt, Human
uuuuuggggggaaugacauguu

SEQ ID NO: 11051 - RNA, 26 nt, Human
ucagauugcugaagugcugcugguaa

SEQ ID NO: 11052 - RNA, 27 nt, Human
cacaggcaauaacugcccaucucagcu

SEQ ID NO: 11053 - RNA, 27 nt, Human
uagaaccuucuaauccaugugcugcug

SEQ ID NO: 11054 - RNA, 25 nt, Human
uugucagccaaauguuagaugaaau

SEQ ID NO: 11055 - RNA, 27 nt, Human
cacugccuguggggaccugcccugccc

SEQ ID NO: 11056 - RNA, 24 nt, Human
guaaaaaagucuucuuuacuaucu

SEQ ID NO: 11057 - RNA, 24 nt, Human
uaacauccauugucauacagcucc

SEQ ID NO: 11058 - RNA, 22 nt, Human
uuccaggccacucaggacauuu

SEQ ID NO: 11059 - RNA, 23 nt, Human
acaucuguacaugacuguauaau

SEQ ID NO: 11060 - RNA, 25 nt, Human
gguggcaggagcugaggaagggcca

SEQ ID NO: 11061 - RNA, 28 nt, Human
acacaacugcaccuucccucauuucagu

SEQ ID NO: 11062 - RNA, 22 nt, Human
aaggggaagcaacggcucucac

SEQ ID NO: 11063 - RNA, 27 nt, Human
ccuguagcugcugcgccacccaccauc

SEQ ID NO: 11064 - RNA, 25 nt, Human
aggcuggaaaguaagggaagcagaa

SEQ ID NO: 11065 - RNA, 26 nt, Human
ugcaggagauggcuaggauuagccuu

SEQ ID NO: 11066 - RNA, 20 nt, Human
ccaaguguccgggauucaga

SEQ ID NO: 11067 - RNA, 21 nt, Human
ggucuuuauugggucugcacc

SEQ ID NO: 11068 - RNA, 22 nt, Human
cagggaggggaggcagauggag

SEQ ID NO: 11069 - RNA, 24 nt, Human
ccuguucugaccucaugaguguca

SEQ ID NO: 11070 - RNA, 21 nt, Human
guucacugcaaccucugccuc

SEQ ID NO: 11071 - RNA, 28 nt, Human
aggcucacaccuguaauccuaaguaaca

SEQ ID NO: 11072 - RNA, 22 nt, Human
acugcaacauccgccucccggg

SEQ ID NO: 11073 - RNA, 22 nt, Human
guguaaugaaauaaaaugugau

SEQ ID NO: 11074 - RNA, 23 nt, Human
gccccaaaccacaggggcucagg

SEQ ID NO: 11075 - RNA, 26 nt, Human
ccucaaggaguucaccaguuuauggg

SEQ ID NO: 11076 - RNA, 24 nt, Human
ucuccauuucguaccaucuguguu

SEQ ID NO: 11077 - RNA, 28 nt, Human
cgcuuccucacaucugugcuccgugccc

SEQ ID NO: 11078 - RNA, 27 nt, Human
ucacugcauccuggagugcaaaaauaa

SEQ ID NO: 11079 - RNA, 27 nt, Human
ugugacccccuccugcccagcaaccug

SEQ ID NO: 11080 - RNA, 27 nt, Human
agcaguugugucagcuacugcggaaaa

SEQ ID NO: 11081 - RNA, 22 nt, Human
cuguuuauuuuugcacaucugu

SEQ ID NO: 11082 - RNA, 24 nt, Human
cuucccaucuguuucugugucuua

SEQ ID NO: 11083 - RNA, 24 nt, Human
aaugucacaaagcucuagugcaau

SEQ ID NO: 11084 - RNA, 21 nt, Human
uagagcaagaaaccaguugua

SEQ ID NO: 11085 - RNA, 22 nt, Human
cuuccugguugcaaccucucuu

SEQ ID NO: 11086 - RNA, 23 nt, Human
agcacugcagcucccaccuccuc

SEQ ID NO: 11087 - RNA, 27 nt, Human
gaugccagcuguguccuucgggggcgu

SEQ ID NO: 11088 - RNA, 22 nt, Human
aaagaaugcagugugcaguggc

SEQ ID NO: 11089 - RNA, 22 nt, Human
ggcccuggcuggaguucagugg

SEQ ID NO: 11090 - RNA, 23 nt, Human
cucuuccuugcugugucauacca

SEQ ID NO: 11091 - RNA, 26 nt, Human
uccagccugggcaacauaguaagacc

SEQ ID NO: 11092 - RNA, 27 nt, Human
cacuggcugggacgcuagaagggucau

SEQ ID NO: 11093 - RNA, 21 nt, Human
cugccuggagaugguugcugc

SEQ ID NO: 11094 - RNA, 20 nt, Human
cuuccccaucuugcauugga

SEQ ID NO: 11095 - RNA, 20 nt, Human
ggcggaggcagcuggggagg

SEQ ID NO: 11096 - RNA, 28 nt, Human
aaaguagcugggauuacaggcacccacc

SEQ ID NO: 11097 - RNA, 19 nt, Human
aucugccuuuauuguguuu

SEQ ID NO: 11098 - RNA, 27 nt, Human
uaaaugaugagucgguccucuuuccag

SEQ ID NO: 11099 - RNA, 24 nt, Human
uuuuccucuucugaaaauucugua

SEQ ID NO: 11100 - RNA, 23 nt, Human
agagaggcucucuugugagcucu

SEQ ID NO: 11101 - RNA, 24 nt, Human
auuuguuuuuuagcaauugucaua

SEQ ID NO: 11102 - RNA, 21 nt, Human
uugacugggcaacacugcagg

SEQ ID NO: 11103 - RNA, 21 nt, Human
aagucuuggaaacuugcugga

SEQ ID NO: 11104 - RNA, 24 nt, Human
aucauuuuguuguaauacagaaag

SEQ ID NO: 11105 - RNA, 30 nt, Human
uggacucugggauguguagccuucucccca

SEQ ID NO: 11106 - RNA, 24 nt, Human
cguggagguggagccugcggcugg

SEQ ID NO: 11107 - RNA, 20 nt, Human
acagcauuuuccucugcuuu

SEQ ID NO: 11108 - RNA, 27 nt, Human
cccagucugggacuccaccugccuccu

SEQ ID NO: 11109 - RNA, 23 nt, Human
augucuguacauaaaggcaguuc

SEQ ID NO: 11110 - RNA, 24 nt, Human
uuuguuguguaggagcagggaggg

SEQ ID NO: 11111 - RNA, 22 nt, Human
acuccucuguccaggcacugcu

SEQ ID NO: 11112 - RNA, 25 nt, Human
ggucuaguuuugggaggaaaaaagc

SEQ ID NO: 11113 - RNA, 27 nt, Human
acuaaaaugaacaugcuauucugucag

SEQ ID NO: 11114 - RNA, 29 nt, Human
cacugcagucuccagccugagccaugggc

SEQ ID NO: 11115 - RNA, 22 nt, Human
auugcuugagccuaggaguuga

SEQ ID NO: 11116 - RNA, 22 nt, Human
ugcccuccguccuggcagggca

SEQ ID NO: 11117 - RNA, 22 nt, Human
gaugcugguggacugugugccc

SEQ ID NO: 11118 - RNA, 21 nt, Human
acuaucaggaguccacugccu

SEQ ID NO: 11119 - RNA, 26 nt, Human
cccauucugcgucaugcuuguguuau

SEQ ID NO: 11120 - RNA, 23 nt, Human
cuuugcuccauguucaagaccag

SEQ ID NO: 11121 - RNA, 23 nt, Human
ccagaguagcugggacuacaaac

SEQ ID NO: 11122 - RNA, 20 nt, Human
uucugcuccaaacgaccauu

SEQ ID NO: 11123 - RNA, 23 nt, Human
guugcucaggcuggaguacagug

SEQ ID NO: 11124 - RNA, 27 nt, Human
uccgcagacuucuuucugcaaauuauu

SEQ ID NO: 11125 - RNA, 28 nt, Human
ggagagagaagacguggagggagggaca

SEQ ID NO: 11126 - RNA, 26 nt, Human
aggcacagccguagagcuguggcuaa

SEQ ID NO: 11127 - RNA, 23 nt, Human
ugcuagugccgugagcaccgccc

SEQ ID NO: 11128 - RNA, 23 nt, Human
cuccagccaccacuuuccugugc

SEQ ID NO: 11129 - RNA, 27 nt, Human
gcucugucacccaggcuggagugcagu

SEQ ID NO: 11130 - RNA, 27 nt, Human
gcucugucacccaggcuagagugcaau

SEQ ID NO: 11131 - RNA, 20 nt, Human
ucauagaaauucuuuauaca

SEQ ID NO: 11132 - RNA, 21 nt, Human
auucucaucugcacccuucuu

SEQ ID NO: 11133 - RNA, 20 nt, Human
ccagaaacauuacuuuggau

SEQ ID NO: 11134 - RNA, 22 nt, Human
caugccugcaauuccagcacuu

SEQ ID NO: 11135 - RNA, 23 nt, Human
ugucacccaggcuggagugcagu

SEQ ID NO: 11136 - RNA, 27 nt, Human
agguggagugggcagaggugcaagaga

SEQ ID NO: 11137 - RNA, 22 nt, Human
ggcaugaaccugggaggcagag

SEQ ID NO: 11138 - RNA, 24 nt, Human
ugcuaucuuugcucuucuccuacu

SEQ ID NO: 11139 - RNA, 22 nt, Human
uucccaggugauauuuuucuua

SEQ ID NO: 11140 - RNA, 26 nt, Human
ccccgcucugggcaccaccugccuuc

SEQ ID NO: 11141 - RNA, 21 nt, Human
gcugcaguugcaacuaugcac

SEQ ID NO: 11142 - RNA, 21 nt, Human
ugcagucggaggaacacgugg

SEQ ID NO: 11143 - RNA, 23 nt, Human
cuucacagccuccauccuuagcu

SEQ ID NO: 11144 - RNA, 22 nt, Human
ucuaugcuuauuuacaucuucu

SEQ ID NO: 11145 - RNA, 20 nt, Human
cgcgucugcggcucucucca

SEQ ID NO: 11146 - RNA, 15 nt, Human
uguuuuuaaaaccug

SEQ ID NO: 11147 - RNA, 24 nt, Human
gagggagaccuguugguuauugug

SEQ ID NO: 11148 - RNA, 26 nt, Human
uggaagagaaaugagcuuggcuugca

SEQ ID NO: 11149 - RNA, 22 nt, Human
cguuaugugucugccacauuaa

SEQ ID NO: 11150 - RNA, 18 nt, Human
cuuccuggacgggacccg

SEQ ID NO: 11151 - RNA, 21 nt, Human
ccugcuagagugacuuguaca

SEQ ID NO: 11152 - RNA, 21 nt, Human
cuggggcaggcaggaggcagu

SEQ ID NO: 11153 - RNA, 19 nt, Human
gcauggugccuggaccuga

SEQ ID NO: 11154 - RNA, 21 nt, Human
auuaccugaauuuuggcugug

SEQ ID NO: 11155 - RNA, 27 nt, Human
ccaacuuccccuccaaaccccgaagug

SEQ ID NO: 11156 - RNA, 18 nt, Human
acagagagcagaucaaug

SEQ ID NO: 11157 - RNA, 22 nt, Human
gggcgggaaucagaccuacucc

SEQ ID NO: 11158 - RNA, 18 nt, Human
ccaaaggcugaggaaaug

SEQ ID NO: 11159 - RNA, 27 nt, Human
gcugcccagggacaaagcagagugcag

SEQ ID NO: 11160 - RNA, 21 nt, Human
ccagcacgggcuucaguaugg

SEQ ID NO: 11161 - RNA, 27 nt, Human
gaccagccugggcaacauagcaaaacc

SEQ ID NO: 11162 - RNA, 26 nt, Human
uccuucuccaccacccauucucccaa

SEQ ID NO: 11163 - RNA, 26 nt, Human
gacaacaaaaauaucuucauacuucc

SEQ ID NO: 11164 - RNA, 23 nt, Human
agcucugcuuccucaguuuccaa

SEQ ID NO: 11165 - RNA, 26 nt, Human
agaauuuaccagaaauauuugcucaa

SEQ ID NO: 11166 - RNA, 18 nt, Human
ugcuaaaguaauuuacaa

SEQ ID NO: 11167 - RNA, 25 nt, Human
aacacaaaaauuagccagguguggc

SEQ ID NO: 11168 - RNA, 26 nt, Human
gccuccaguccugcccaggcccuggg

SEQ ID NO: 11169 - RNA, 18 nt, Human
cucugcugcaacaagcuc

SEQ ID NO: 11170 - RNA, 20 nt, Human
uggggugcagcugggugggg

SEQ ID NO: 11171 - RNA, 26 nt, Human
aaccaaaaauaaauagccauaauuug

SEQ ID NO: 11172 - RNA, 27 nt, Human
gccuuucucccaagcugguggauaaug

SEQ ID NO: 11173 - RNA, 22 nt, Human
gagggaggcucugucucaaaag

SEQ ID NO: 11174 - RNA, 27 nt, Human
ccugcauuuccugucaugccacagacu

SEQ ID NO: 11175 - RNA, 27 nt, Human
cagaacaauccgauucacguagggaaa

SEQ ID NO: 11176 - RNA, 19 nt, Human
auuguauaggcagaaaaau

SEQ ID NO: 11177 - RNA, 22 nt, Human
auggagaggagaacacuagaca

SEQ ID NO: 11178 - RNA, 25 nt, Human
gccuaacgcuggugucucacucauc

SEQ ID NO: 11179 - RNA, 22 nt, Human
gcucucaccagaacugagacuc

SEQ ID NO: 11180 - RNA, 21 nt, Human
gcaaugcuucucucauagugu

SEQ ID NO: 11181 - RNA, 23 nt, Human
cauuuaacuccagccuuggguuu

SEQ ID NO: 11182 - RNA, 24 nt, Human
uagcagccacguggggcacuucuc

SEQ ID NO: 11183 - RNA, 32 nt, Human
ggcuuauaaaggugccuggccugugccaaccc

SEQ ID NO: 11184 - RNA, 19 nt, Human
caccuccccggccucucuc

SEQ ID NO: 11185 - RNA, 21 nt, Human
ugaccucucagucagacuggg

SEQ ID NO: 11186 - RNA, 27 nt, Human
auagaguguuuugcugauagugcugua

SEQ ID NO: 11187 - RNA, 30 nt, Human
ccauauagcuucaaaaacaaaaacaaaugu

SEQ ID NO: 11188 - RNA, 26 nt, Human
gcuuguaauucuacaaauuucacauu

SEQ ID NO: 11189 - RNA, 25 nt, Human
cugagcucuguaacugucacacugc

SEQ ID NO: 11190 - RNA, 20 nt, Human
ugugcuaaaaauacuuuuua

SEQ ID NO: 11191 - RNA, 21 nt, Human
aaaucuuacucugcuguuaug

SEQ ID NO: 11192 - RNA, 22 nt, Human
auuauauuuagggaaagguagu

SEQ ID NO: 11193 - RNA, 26 nt, Human
auguuauuuuccuucccuuucuugaa

SEQ ID NO: 11194 - RNA, 23 nt, Human
ugcauuuuuuaaagcaccacucu

SEQ ID NO: 11195 - RNA, 19 nt, Human
agggagggagaggagggga

SEQ ID NO: 11196 - RNA, 26 nt, Human
ggggugagacaaggaagaggaugucu

SEQ ID NO: 11197 - RNA, 19 nt, Human
gcucacugggcccgagccu

SEQ ID NO: 11198 - RNA, 27 nt, Human
agcagccgcauuggaucccacagcuua

SEQ ID NO: 11199 - RNA, 26 nt, Human
cggcaacaagaacuccacaguuccca

SEQ ID NO: 11200 - RNA, 23 nt, Human
uguugcccaggcuggagugcaac

SEQ ID NO: 11201 - RNA, 22 nt, Human
ggcccgaucugggcugccucca

SEQ ID NO: 11202 - RNA, 25 nt, Human
cccgcccaggagccuugcaggcugg

SEQ ID NO: 11203 - RNA, 21 nt, Human
auuuuuaaaaaagugaucuua

SEQ ID NO: 11204 - RNA, 21 nt, Human
acuucuauuuaguauuguugg

SEQ ID NO: 11205 - RNA, 21 nt, Human
cagcaggaagugccacugccu

SEQ ID NO: 11206 - RNA, 25 nt, Human
ggcagugagagggaggcuaugccug

SEQ ID NO: 11207 - RNA, 22 nt, Human
ccaggagaccugauucccugug

SEQ ID NO: 11208 - RNA, 25 nt, Human
agacaaccgcacucgcagcggugug

SEQ ID NO: 11209 - RNA, 27 nt, Human
uagcccccuuccuggauggaggcuuga

SEQ ID NO: 11210 - RNA, 21 nt, Human
ccuaaaccaggaagcugcguu

SEQ ID NO: 11211 - RNA, 26 nt, Human
uguucccuccugguccuggacaccuc

SEQ ID NO: 11212 - RNA, 22 nt, Human
gaccugacagcccaaacuguca

SEQ ID NO: 11213 - RNA, 26 nt, Human
accaagaauauaugcuacagauauaa

SEQ ID NO: 11214 - RNA, 22 nt, Human
ggcauuugugggacuccagcac

SEQ ID NO: 11215 - RNA, 23 nt, Human
cucuggagagaggggggugaggg

SEQ ID NO: 11216 - RNA, 23 nt, Human
ucagugacaaaggccuuugcugu

SEQ ID NO: 11217 - RNA, 21 nt, Human
gugcccaggaggcaggcagug

SEQ ID NO: 11218 - RNA, 21 nt, Human
cuaaaugcuacuaaccuuccu

SEQ ID NO: 11219 - RNA, 24 nt, Human
ccucuuguucgguuaaccagcaca

SEQ ID NO: 11220 - RNA, 22 nt, Human
agaaauuuguauguuuguuaaa

SEQ ID NO: 11221 - RNA, 18 nt, Human
accaagugccuucuguag

SEQ ID NO: 11222 - RNA, 25 nt, Human
cggcggaagaaggugggagggucau

SEQ ID NO: 11223 - RNA, 21 nt, Human
ggugaggaucauguguuguau

SEQ ID NO: 11224 - RNA, 24 nt, Human
ccaggagguggcuggauugcaggg

SEQ ID NO: 11225 - RNA, 23 nt, Human
guguuggugcugaccuccaggcc

SEQ ID NO: 11226 - RNA, 23 nt, Human
cuauuuucacacuuuuaaucuca

SEQ ID NO: 11227 - RNA, 24 nt, Human
ggugugggaaaaacuugaucugaa

SEQ ID NO: 11228 - RNA, 24 nt, Human
gacuucugcucuuuuuucuuuguu

SEQ ID NO: 11229 - RNA, 21 nt, Human
agucacuuauuguccagguga

SEQ ID NO: 11230 - RNA, 24 nt, Human
aggcccccugguguguguggugca

SEQ ID NO: 11231 - RNA, 22 nt, Human
cgaguuccggaaagccuuccuc

SEQ ID NO: 11232 - RNA, 27 nt, Human
gaccagucuggccaauauggagaaacc

SEQ ID NO: 11233 - RNA, 19 nt, Human
uugccaggaguacagugcu

SEQ ID NO: 11234 - RNA, 22 nt, Human
gcccaggccuccugggugacag

SEQ ID NO: 11235 - RNA, 21 nt, Human
gugcugggugcauaucaucca

SEQ ID NO: 11236 - RNA, 21 nt, Human
ugcucccuccagaaccggcgu

SEQ ID NO: 11237 - RNA, 26 nt, Human
ucagcccucgucacacugcggcacag

SEQ ID NO: 11238 - RNA, 18 nt, Human
uccucugcuaaauuugca

SEQ ID NO: 11239 - RNA, 20 nt, Human
gggcugacugggcagaggaa

SEQ ID NO: 11240 - RNA, 19 nt, Human
cuaagcuguguagaagucc

SEQ ID NO: 11241 - RNA, 21 nt, Human
ggcaggaggauggugccugga

SEQ ID NO: 11242 - RNA, 21 nt, Human
cuugcagcaccaugccgagcu

SEQ ID NO: 11243 - RNA, 24 nt, Human
cuuaaaaaugcuguuucuggcugg

SEQ ID NO: 11244 - RNA, 21 nt, Human
gguaagacaacaaccucccag

SEQ ID NO: 11245 - RNA, 21 nt, Human
cugccccacucugggcuuuuc

SEQ ID NO: 11246 - RNA, 19 nt, Human
gugaagccuuucuguucag

SEQ ID NO: 11247 - RNA, 21 nt, Human
cuaucugaucacuucagcgua

SEQ ID NO: 11248 - RNA, 22 nt, Human
gcucacgccuguaaucccaaca

SEQ ID NO: 11249 - RNA, 28 nt, Human
uccaguuaaaauggggcuucaguaccag

SEQ ID NO: 11250 - RNA, 23 nt, Human
uuccuaggccuuccacuaccucc

SEQ ID NO: 11251 - RNA, 23 nt, Human
gcccaugucucaaaacaaacaca

SEQ ID NO: 11252 - RNA, 19 nt, Human
uccaugucaccaccuuuga

SEQ ID NO: 11253 - RNA, 23 nt, Human
gagggagaagaaacgccugcucu

SEQ ID NO: 11254 - RNA, 22 nt, Human
aaacuccuggccuucugugguu

SEQ ID NO: 11255 - RNA, 21 nt, Human
cguagccgccuccgagcccgc

SEQ ID NO: 11256 - RNA, 22 nt, Human
accaugacgccuacugcuguuc

SEQ ID NO: 11257 - RNA, 23 nt, Human
cacucuuguuugucccuggacug

SEQ ID NO: 11258 - RNA, 21 nt, Human
ccaacauuccucugcuucaua

SEQ ID NO: 11259 - RNA, 17 nt, Human
acccccacuccagcucc

SEQ ID NO: 11260 - RNA, 24 nt, Human
cucuggauuguccaguguaaugca

SEQ ID NO: 11261 - RNA, 25 nt, Human
aaggacguuucuuucaucugccuuu

SEQ ID NO: 11262 - RNA, 29 nt, Human
uuaccauugagccaggagugcggcaggca

SEQ ID NO: 11263 - RNA, 26 nt, Human
aggccaggcuggugucggaaguaaua

SEQ ID NO: 11264 - RNA, 22 nt, Human
ggacaacagccccagcucuuuu

SEQ ID NO: 11265 - RNA, 22 nt, Human
uccgaguagcugggaucgcagg

SEQ ID NO: 11266 - RNA, 22 nt, Human
cccgaguagcugggauugcagg

SEQ ID NO: 11267 - RNA, 27 nt, Human
ggaagagggagucugagcaugagcugc

SEQ ID NO: 11268 - RNA, 26 nt, Human
ucacccaggcugagggugccuuugug

SEQ ID NO: 11269 - RNA, 21 nt, Human
cuaccucuucuuugucuaguu

SEQ ID NO: 11270 - RNA, 22 nt, Human
acacaagccuuuucacacagca

SEQ ID NO: 11271 - RNA, 22 nt, Human
gacccugaggaauucaccagga

SEQ ID NO: 11272 - RNA, 23 nt, Human
ugcacccugcgccuccagagguc

SEQ ID NO: 11273 - RNA, 22 nt, Human
cuccaucucuagauaaguguca

SEQ ID NO: 11274 - RNA, 21 nt, Human
uccugaagggugcucagucuc

SEQ ID NO: 11275 - RNA, 20 nt, Human
gcccuauuuguuacuaccug

SEQ ID NO: 11276 - RNA, 25 nt, Human
ccuaggccuugcuaucacuauuucc

SEQ ID NO: 11277 - RNA, 27 nt, Human
cuuccuuccuguucuaacugccaguac

SEQ ID NO: 11278 - RNA, 23 nt, Human
ugucgcccaggcugguuuugaac

SEQ ID NO: 11279 - RNA, 29 nt, Human
ccuuuuccauccuccuccucugccuucaa

SEQ ID NO: 11280 - RNA, 27 nt, Human
cuccaucuugaaggaacucaaagacuc

SEQ ID NO: 11281 - RNA, 21 nt, Human
cccagcacugugggaggcuga

SEQ ID NO: 11282 - RNA, 27 nt, Human
uugcccaggcugguuucgaacucggcu

SEQ ID NO: 11283 - RNA, 23 nt, Human
cacccaggccagggguccagagc

SEQ ID NO: 11284 - RNA, 23 nt, Human
auaugcuucauugucaaaugcau

SEQ ID NO: 11285 - RNA, 20 nt, Human
gcaagcaaucaaauaauaaa

SEQ ID NO: 11286 - RNA, 23 nt, Human
cuuugaacuuugaagcuagugca

SEQ ID NO: 11287 - RNA, 25 nt, Human
cccaagauaucagcccaaaaaucaa

SEQ ID NO: 11288 - RNA, 21 nt, Human
uccagcaccugucuccccugc

SEQ ID NO: 11289 - RNA, 22 nt, Human
ugcugggacuuggaucccaggg

SEQ ID NO: 11290 - RNA, 18 nt, Human
auuaaaagugcacaaaaa

SEQ ID NO: 11291 - RNA, 20 nt, Human
uugccgucguuuucucuccc

SEQ ID NO: 11292 - RNA, 19 nt, Human
uccagccugggcaacagug

SEQ ID NO: 11293 - RNA, 20 nt, Human
uaggcagagucagucacuuu

SEQ ID NO: 11294 - RNA, 22 nt, Human
accugcacuugucccucuccag

SEQ ID NO: 11295 - RNA, 30 nt, Human
gcgcuauugcacuccagucuggguaacagg

SEQ ID NO: 11296 - RNA, 21 nt, Human
guuccgacugcaccuucuuua

SEQ ID NO: 11297 - RNA, 22 nt, Human
uacagcucccaggaacagcuag

SEQ ID NO: 11298 - RNA, 20 nt, Human
gacacuuguaugcuagucua

SEQ ID NO: 11299 - RNA, 23 nt, Human
cuagcuuugggagaaaagggcau

SEQ ID NO: 11300 - RNA, 22 nt, Human
ccauguccaaguucuucaccuc

SEQ ID NO: 11301 - RNA, 20 nt, Human
cuuccgcuuccuccccaccg

SEQ ID NO: 11302 - RNA, 27 nt, Human
ccugcagcugguuacaagaaugugaca

SEQ ID NO: 11303 - RNA, 22 nt, Human
gaagagauuccagaaucaucau

SEQ ID NO: 11304 - RNA, 21 nt, Human
ucaagccaguguugcuuaaua

SEQ ID NO: 11305 - RNA, 26 nt, Human
aguagcugggauuacaggcgcacacc

SEQ ID NO: 11306 - RNA, 26 nt, Human
cagcccaggcugcugggcuguagcca

SEQ ID NO: 11307 - RNA, 23 nt, Human
accugugaucccagcuacuuggg

SEQ ID NO: 11308 - RNA, 27 nt, Human
cccugcaggcaggcagaccacggugug

SEQ ID NO: 11309 - RNA, 22 nt, Human
ccuguaauccuagcuacucggg

SEQ ID NO: 11310 - RNA, 22 nt, Human
ccuguaaucccagcuacuuggg

SEQ ID NO: 11311 - RNA, 24 nt, Human
ggagguggagggaccgaggaacca

SEQ ID NO: 11312 - RNA, 19 nt, Human
uaguaacuacaaugguugc

SEQ ID NO: 11313 - RNA, 23 nt, Human
agcccaggcuuggaggccagcug

SEQ ID NO: 11314 - RNA, 22 nt, Human
agccaggcuggagugcaguggu

SEQ ID NO: 11315 - RNA, 20 nt, Human
agagaagaaauccacaaaga

SEQ ID NO: 11316 - RNA, 23 nt, Human
uuuaucucucucaacuuccugca

SEQ ID NO: 11317 - RNA, 24 nt, Human
ucucucccccagcucaucaucagu

SEQ ID NO: 11318 - RNA, 24 nt, Human
gacuucugaaaaaugaauguaaaa

SEQ ID NO: 11319 - RNA, 19 nt, Human
gcccaggcagccuccgggc

SEQ ID NO: 11320 - RNA, 21 nt, Human
gugagcuccaugagggcaggg

SEQ ID NO: 11321 - RNA, 27 nt, Human
cggcuccaguccauagacguucccccc

SEQ ID NO: 11322 - RNA, 22 nt, Human
aguauagcauugaacauuucuu

SEQ ID NO: 11323 - RNA, 27 nt, Human
gggcuaaaucugauccucagcccacuc

SEQ ID NO: 11324 - RNA, 23 nt, Human
cauuaguugugauuucugccucc

SEQ ID NO: 11325 - RNA, 23 nt, Human
gagaagcaggaagagcacuggac

SEQ ID NO: 11326 - RNA, 21 nt, Human
ccgagccaaugccagugacau

SEQ ID NO: 11327 - RNA, 23 nt, Human
uugcacgaaaucacacagccaag

SEQ ID NO: 11328 - RNA, 22 nt, Human
uugcugagagagcaaauuuucu

SEQ ID NO: 11329 - RNA, 27 nt, Human
gggagaaaccugagucucagagcaggg

SEQ ID NO: 11330 - RNA, 22 nt, Human
ccaagcccaguuguugcaguga

SEQ ID NO: 11331 - RNA, 20 nt, Human
acauuuucacccagcucuuu

SEQ ID NO: 11332 - RNA, 21 nt, Human
ucccucugagcaaccagaaca

SEQ ID NO: 11333 - RNA, 22 nt, Human
auguauugugucuuuuucuccu

SEQ ID NO: 11334 - RNA, 21 nt, Human
cccagagauugccuggaacac

SEQ ID NO: 11335 - RNA, 27 nt, Human
uggaaggcagaagcuagcgguuguauc

SEQ ID NO: 11336 - RNA, 21 nt, Human
cugaagugcugggauuacagg

SEQ ID NO: 11337 - RNA, 22 nt, Human
ugccacugcacuccauccuggg

SEQ ID NO: 11338 - RNA, 25 nt, Human
uuuggccuuuaauuuaaaaagccua

SEQ ID NO: 11339 - RNA, 28 nt, Human
guauccuuucacacauuugccuugacaa

SEQ ID NO: 11340 - RNA, 22 nt, Human
cgcugcgcgcaugggccuguuc

SEQ ID NO: 11341 - RNA, 21 nt, Human
aaaguacaaaaaauuagccag

SEQ ID NO: 11342 - RNA, 22 nt, Human
gaugggguuucaccauguugcc

SEQ ID NO: 11343 - RNA, 22 nt, Human
gacaggguuuugccauguugcc

SEQ ID NO: 11344 - RNA, 21 nt, Human
aaaauacaaaaaauuagccgg

SEQ ID NO: 11345 - RNA, 23 nt, Human
cuggcaggcggagguugcaguga

SEQ ID NO: 11346 - RNA, 20 nt, Human
agacuccuggguucaugacu

SEQ ID NO: 11347 - RNA, 23 nt, Human
guaauagccuuuccuuacuguug

SEQ ID NO: 11348 - RNA, 25 nt, Human
ucuucccauccccagcgauucccuc

SEQ ID NO: 11349 - RNA, 21 nt, Human
cacugcacuccagccugggga

SEQ ID NO: 11350 - RNA, 21 nt, Human
uaggcuguauucccagcaguc

SEQ ID NO: 11351 - RNA, 20 nt, Human
cacucacuccacccugccuc

SEQ ID NO: 11352 - RNA, 28 nt, Human
ccacaccuggcccuggggccuguacaaa

SEQ ID NO: 11353 - RNA, 20 nt, Human
cuuccccuuacccagggcug

SEQ ID NO: 11354 - RNA, 22 nt, Human
ggagagaaggccucaucucucu

SEQ ID NO: 11355 - RNA, 26 nt, Human
gacguucaacauggugaggggcuaca

SEQ ID NO: 11356 - RNA, 23 nt, Human
ccucagccccggcagcgcccagc

SEQ ID NO: 11357 - RNA, 24 nt, Human
agcacagaccucuaccguguuucu

SEQ ID NO: 11358 - RNA, 23 nt, Human
acauuuauugcuauccaguguca

SEQ ID NO: 11359 - RNA, 19 nt, Human
cuccacugcucauauuuuu

SEQ ID NO: 11360 - RNA, 26 nt, Human
uuuguuguuuccaugaaauccugcgc

SEQ ID NO: 11361 - RNA, 22 nt, Human
ucaagagcuuuaguuacuuaac

SEQ ID NO: 11362 - RNA, 22 nt, Human
aaggaugacaugcuuucuucac

SEQ ID NO: 11363 - RNA, 21 nt, Human
gcaggcaucgagggggcgcgg

SEQ ID NO: 11364 - RNA, 21 nt, Human
ccugcugcuugccagcucugu

SEQ ID NO: 11365 - RNA, 23 nt, Human
ugucaccgaggcuggagugcaau

SEQ ID NO: 11366 - RNA, 28 nt, Human
ucuaggcagaaccuggagucggccuugc

SEQ ID NO: 11367 - RNA, 27 nt, Human
guuucucuucaccccuacacugugaag

SEQ ID NO: 11368 - RNA, 21 nt, Human
ccuacuucaaaccccuacuga

SEQ ID NO: 11369 - RNA, 19 nt, Human
acucugucgcucaggcugg

SEQ ID NO: 11370 - RNA, 21 nt, Human
auuagguuauaaaagacacug

SEQ ID NO: 11371 - RNA, 27 nt, Human
uugcccaggcuggucuucuggcuucug

SEQ ID NO: 11372 - RNA, 22 nt, Human
cgggaggcccgggcagggagaa

SEQ ID NO: 11373 - RNA, 27 nt, Human
agaccaucagaccagggccaaccaauc

SEQ ID NO: 11374 - RNA, 25 nt, Human
ccucccaggugauccucccaccuca

SEQ ID NO: 11375 - RNA, 23 nt, Human
uggaaacaacuucuaguauugga

SEQ ID NO: 11376 - RNA, 23 nt, Human
acuuacccugagcaugacuggga

SEQ ID NO: 11377 - RNA, 21 nt, Human
aagccuggccacccucgcugu

SEQ ID NO: 11378 - RNA, 25 nt, Human
agcgagaagugcccugggcuugcca

SEQ ID NO: 11379 - RNA, 20 nt, Human
agcacagccaacagccacca

SEQ ID NO: 11380 - RNA, 23 nt, Human
ggagaaagggaaccacagagcca

SEQ ID NO: 11381 - RNA, 25 nt, Human
acaaucagugaguaaauagacagcc

SEQ ID NO: 11382 - RNA, 24 nt, Human
cugucacacaggcuggagugcagu

SEQ ID NO: 11383 - RNA, 25 nt, Human
cgcacacacaccgccaaucagcuca

SEQ ID NO: 11384 - RNA, 17 nt, Human
cuucccuuacuaggcuc

SEQ ID NO: 11385 - RNA, 19 nt, Human
uuuuccaggcaccccacca

SEQ ID NO: 11386 - RNA, 27 nt, Human
ggaggcugaaggguggagggguuccug

SEQ ID NO: 11387 - RNA, 24 nt, Human
agagaggcguccugggugaaggaa

SEQ ID NO: 11388 - RNA, 20 nt, Human
uauaaaaauauuaucaaaag

SEQ ID NO: 11389 - RNA, 22 nt, Human
uuacaucugcauuucuacaugu

SEQ ID NO: 11390 - RNA, 27 nt, Human
augaggaguuauacugcuuuucauuca

SEQ ID NO: 11391 - RNA, 22 nt, Human
gcugcacuuaacccuuugugau

SEQ ID NO: 11392 - RNA, 23 nt, Human
auuacaggucacaugaaaccaaa

SEQ ID NO: 11393 - RNA, 22 nt, Human
aggccgaggcagggggacugcu

SEQ ID NO: 11394 - RNA, 24 nt, Human
uacacaggagucuucagacccaga

SEQ ID NO: 11395 - RNA, 20 nt, Human
cacccagguuggagugcagu

SEQ ID NO: 11396 - RNA, 20 nt, Human
ugcccaggcuggagugcggu

SEQ ID NO: 11397 - RNA, 20 nt, Human
cacccaggcuggaguguagu

SEQ ID NO: 11398 - RNA, 19 nt, Human
aaggaggcaggcuguggug

SEQ ID NO: 11399 - RNA, 22 nt, Human
guacaggcugagacacagccca

SEQ ID NO: 11400 - RNA, 20 nt, Human
uacccaggcuggagugcagu

SEQ ID NO: 11401 - RNA, 22 nt, Human
ccucccggauacuccugccuca

SEQ ID NO: 11402 - RNA, 21 nt, Human
agggagguagagguugcagug

SEQ ID NO: 11403 - RNA, 22 nt, Human
cagccaggcuggagugcagugg

SEQ ID NO: 11404 - RNA, 22 nt, Human
acaagugacaugcugugcucag

SEQ ID NO: 11405 - RNA, 22 nt, Human
caaauuauguggaucuaauaaa

SEQ ID NO: 11406 - RNA, 22 nt, Human
acaaguguucagagcagacaga

SEQ ID NO: 11407 - RNA, 31 nt, Human
gggguuggggacagagcaggugcagaggcac

SEQ ID NO: 11408 - RNA, 25 nt, Human
uucuccucgccuucaggaugaaagc

SEQ ID NO: 11409 - RNA, 23 nt, Human
ucuccuaaacugaacacaugacu

SEQ ID NO: 11410 - RNA, 31 nt, Human
ugcacaugacucggggguggggaaagggguc

SEQ ID NO: 11411 - RNA, 18 nt, Human
uguagcccuggaccugcc

SEQ ID NO: 11412 - RNA, 26 nt, Human
auuacuuauuugugcgaagugccuua

SEQ ID NO: 11413 - RNA, 22 nt, Human
ccaacuccugagcucaggugau

SEQ ID NO: 11414 - RNA, 19 nt, Human
guuucuggugaaauugaag

SEQ ID NO: 11415 - RNA, 21 nt, Human
acuauuuauaucacacaauau

SEQ ID NO: 11416 - RNA, 25 nt, Human
caucaaucaagauucuaggucucca

SEQ ID NO: 11417 - RNA, 21 nt, Human
gcugcugcuggagauucaaag

SEQ ID NO: 11418 - RNA, 21 nt, Human
gcucagucacuggugccugag

SEQ ID NO: 11419 - RNA, 21 nt, Human
ugugagccacugugccuggcc

SEQ ID NO: 11420 - RNA, 21 nt, Human
accaucacuagaaaugccuuu

SEQ ID NO: 11421 - RNA, 22 nt, Human
uaaauuacagccagaccucugg

SEQ ID NO: 11422 - RNA, 27 nt, Human
cuccucggggaggggaagcaccagggu

SEQ ID NO: 11423 - RNA, 22 nt, Human
aggcugcagcaggcagaggagg

SEQ ID NO: 11424 - RNA, 20 nt, Human
acagcaucucuaugaagaga

SEQ ID NO: 11425 - RNA, 24 nt, Human
aauagucuugcagaaaaugaauga

SEQ ID NO: 11426 - RNA, 21 nt, Human
uaugcuacuauugcuacuucu

SEQ ID NO: 11427 - RNA, 22 nt, Human
cuguguacucugguguguggcc

SEQ ID NO: 11428 - RNA, 27 nt, Human
aauauaacucugcagacuugcugugug

SEQ ID NO: 11429 - RNA, 25 nt, Human
ugaagucaucgugaccaauguuaca

SEQ ID NO: 11430 - RNA, 27 nt, Human
ucaugcugccacuuuuaauggguccuc

SEQ ID NO: 11431 - RNA, 23 nt, Human
aacaaaugccuuucauauauacg

SEQ ID NO: 11432 - RNA, 23 nt, Human
ccucugccucuccccaccuucuu

SEQ ID NO: 11433 - RNA, 22 nt, Human
acugugucaugggucauggccc

SEQ ID NO: 11434 - RNA, 21 nt, Human
cagugucuucucucccugugu

SEQ ID NO: 11435 - RNA, 20 nt, Human
aagagggaggaaggggcggc

SEQ ID NO: 11436 - RNA, 20 nt, Human
ccuuucucauccucuuugcc

SEQ ID NO: 11437 - RNA, 27 nt, Human
ugcugggacucagccuucagacagaga

SEQ ID NO: 11438 - RNA, 20 nt, Human
ucucccauuugcagguuucu

SEQ ID NO: 11439 - RNA, 30 nt, Human
uuaguuaauuacacauuugccuacaucugu

SEQ ID NO: 11440 - RNA, 22 nt, Human
ugggcaaugugauaaaacccca

SEQ ID NO: 11441 - RNA, 20 nt, Human
caggaggaggaggcugcagu

SEQ ID NO: 11442 - RNA, 23 nt, Human
ggugcauaccaccaugccuggcu

SEQ ID NO: 11443 - RNA, 20 nt, Human
uuugcauuugaaauuuugga

SEQ ID NO: 11444 - RNA, 26 nt, Human
cagagcuguguguucaccugggcaga

SEQ ID NO: 11445 - RNA, 22 nt, Human
guuucaccgccuuccucacucc

SEQ ID NO: 11446 - RNA, 23 nt, Human
augucccuggaguugggagggag

SEQ ID NO: 11447 - RNA, 27 nt, Human
ggcucacugcagcgcgcuccugacccc

SEQ ID NO: 11448 - RNA, 26 nt, Human
cccugcagccuccuguacccgccuca

SEQ ID NO: 11449 - RNA, 22 nt, Human
ugucaccgaggcuggagugcaa

SEQ ID NO: 11450 - RNA, 23 nt, Human
ccuuccuaaggucccugccuggc

SEQ ID NO: 11451 - RNA, 25 nt, Human
ccuccaggugaccucacucggacgg

SEQ ID NO: 11452 - RNA, 22 nt, Human
cauggcuggaccugccacccag

SEQ ID NO: 11453 - RNA, 25 nt, Human
ugcauuuuaaaaacagcacuggcug

SEQ ID NO: 11454 - RNA, 21 nt, Human
gcuggauuugggagcucugcu

SEQ ID NO: 11455 - RNA, 18 nt, Human
cagcucuuucucuuugua

SEQ ID NO: 11456 - RNA, 19 nt, Human
auuugguagagcuuggggg

SEQ ID NO: 11457 - RNA, 27 nt, Human
cccucauuccccaagaaggcccccagc

SEQ ID NO: 11458 - RNA, 27 nt, Human
agacgucugccucagccacugccuccg

SEQ ID NO: 11459 - RNA, 21 nt, Human
guauaccacacccugggcccc

SEQ ID NO: 11460 - RNA, 27 nt, Human
caggcuggagugcaauggcacgaucuu

SEQ ID NO: 11461 - RNA, 20 nt, Human
cgccgaguacuccagccggg

SEQ ID NO: 11462 - RNA, 27 nt, Human
cagcccuccccagcugcccaggaagag

SEQ ID NO: 11463 - RNA, 21 nt, Human
cuacugccucggaucucucca

SEQ ID NO: 11464 - RNA, 19 nt, Human
cccacgcuggagugcagug

SEQ ID NO: 11465 - RNA, 23 nt, Human
cuguaucgcugauguucaccucc

SEQ ID NO: 11466 - RNA, 21 nt, Human
cagccaggcugggggagccgg

SEQ ID NO: 11467 - RNA, 21 nt, Human
cagcugcagagaucacccugc

SEQ ID NO: 11468 - RNA, 27 nt, Human
ggacacuaaguuagagcacaacaaaac

SEQ ID NO: 11469 - RNA, 20 nt, Human
uuaguaaaaccauuuaacca

SEQ ID NO: 11470 - RNA, 24 nt, Human
ccuccacugucacauuguaacuga

SEQ ID NO: 11471 - RNA, 27 nt, Human
guaaaacacagagggccaguaacgggu

SEQ ID NO: 11472 - RNA, 21 nt, Human
agugcuggcaaccacuaagaa

SEQ ID NO: 11473 - RNA, 19 nt, Human
ccaugaucaccccuuugag

SEQ ID NO: 11474 - RNA, 20 nt, Human
ccugaggaauucaccaggag

SEQ ID NO: 11475 - RNA, 19 nt, Human
cuggggcagcugaacugag

SEQ ID NO: 11476 - RNA, 25 nt, Human
cauguagagauuugagugcaguugg

SEQ ID NO: 11477 - RNA, 23 nt, Human
acauuuaaaaaauuaguugccag

SEQ ID NO: 11478 - RNA, 22 nt, Human
ugaaaucccagucuccuggccc

SEQ ID NO: 11479 - RNA, 22 nt, Human
ucuugacccguucagugcugcc

SEQ ID NO: 11480 - RNA, 22 nt, Human
ucuaaauccaaaugcuucucca

SEQ ID NO: 11481 - RNA, 18 nt, Human
uugccagcuacugcuuuu

SEQ ID NO: 11482 - RNA, 22 nt, Human
uauuaaaauuguuuaauguuua

SEQ ID NO: 11483 - RNA, 27 nt, Human
cugagagaagcagggacaggagggagc

SEQ ID NO: 11484 - RNA, 24 nt, Human
cacugcucccuaagccagccuggu

SEQ ID NO: 11485 - RNA, 21 nt, Human
uccaggcagugggaagccaau

SEQ ID NO: 11486 - RNA, 25 nt, Human
cucuucagucucccagucaucuggu

SEQ ID NO: 11487 - RNA, 25 nt, Human
cagucuuagagguugcaguacuaua

SEQ ID NO: 11488 - RNA, 20 nt, Human
gggacuuuuuguguuuuuau

SEQ ID NO: 11489 - RNA, 26 nt, Human
cugggauuacaggcuugagcuaccgc

SEQ ID NO: 11490 - RNA, 20 nt, Human
cgagaacaacaguugggcug

SEQ ID NO: 11491 - RNA, 20 nt, Human
cuuccuguagugagcacuuu

SEQ ID NO: 11492 - RNA, 25 nt, Human
gaggaauuugaagaaggaacugagg

SEQ ID NO: 11493 - RNA, 20 nt, Human
gcaucauuauuuauguauug

SEQ ID NO: 11494 - RNA, 23 nt, Human
uuucauaaacaaagcagaugaca

SEQ ID NO: 11495 - RNA, 20 nt, Human
ggcagacugugaacuugacu

SEQ ID NO: 11496 - RNA, 21 nt, Human
gggagcacucauugucuacac

SEQ ID NO: 11497 - RNA, 25 nt, Human
ugaaaaaguauuuugccuucauuuu

SEQ ID NO: 11498 - RNA, 21 nt, Human
agggucagggaaacuuuucuc

SEQ ID NO: 11499 - RNA, 21 nt, Human
agaggggaccuugggagccug

SEQ ID NO: 11500 - RNA, 21 nt, Human
cacggaggggagcaggaaugc

SEQ ID NO: 11501 - RNA, 21 nt, Human
agcuaaaaauuccuuuuuauc

SEQ ID NO: 11502 - RNA, 22 nt, Human
ucgcccaggcuggagugcaguc

SEQ ID NO: 11503 - RNA, 20 nt, Human
gugaaugugaaguggagagg

SEQ ID NO: 11504 - RNA, 24 nt, Human
uguggggaccucagaacacuguga

SEQ ID NO: 11505 - RNA, 20 nt, Human
caguccucaguucccacugc

SEQ ID NO: 11506 - RNA, 22 nt, Human
aggcugaggugggaagaucauu

SEQ ID NO: 11507 - RNA, 21 nt, Human
uuuucuuuuuugcuuccuguc

SEQ ID NO: 11508 - RNA, 22 nt, Human
gcuuacugaggcugguggaggg

SEQ ID NO: 11509 - RNA, 18 nt, Human
gggaggcggagggguggg

SEQ ID NO: 11510 - RNA, 21 nt, Human
agaacuuaccucuugccaaag

SEQ ID NO: 11511 - RNA, 24 nt, Human
ugcuugauauugugaaaaggugaa

SEQ ID NO: 11512 - RNA, 23 nt, Human
agcaacuugucugaugacuggga

SEQ ID NO: 11513 - RNA, 19 nt, Human
ccucccuggcugugucuuu

SEQ ID NO: 11514 - RNA, 20 nt, Human
guuccuuaguuuugcacugg

SEQ ID NO: 11515 - RNA, 27 nt, Human
ccacgcuccaaaccccaggguagccau

SEQ ID NO: 11516 - RNA, 23 nt, Human
agauccugaggaaaucuccagcu

SEQ ID NO: 11517 - RNA, 23 nt, Human
uaaaccuguugggccaaugagaa

SEQ ID NO: 11518 - RNA, 24 nt, Human
ggcucuggguaugaccugccucug

SEQ ID NO: 11519 - RNA, 22 nt, Human
gcgcauaccuguaaucccagcu

SEQ ID NO: 11520 - RNA, 26 nt, Human
uggcaaaaacugccaauaggaggacu

SEQ ID NO: 11521 - RNA, 25 nt, Human
ugcccaguccccguuacucuuagag

SEQ ID NO: 11522 - RNA, 24 nt, Human
ccaagaccccagcuucauuaugca

SEQ ID NO: 11523 - RNA, 27 nt, Human
caccacagcgcuccagccuggucgaca

SEQ ID NO: 11524 - RNA, 20 nt, Human
gcugguguccauccagcacu

SEQ ID NO: 11525 - RNA, 23 nt, Human
agcaguagcauuugcuuccuccc

SEQ ID NO: 11526 - RNA, 20 nt, Human
caugggcugggagaucauag

SEQ ID NO: 11527 - RNA, 27 nt, Human
ccaccacccuccagccugggcaacgua

SEQ ID NO: 11528 - RNA, 21 nt, Human
cccaccccaucuuugcugcca

SEQ ID NO: 11529 - RNA, 20 nt, Human
ccuccuuccucaugccucca

SEQ ID NO: 11530 - RNA, 28 nt, Human
uuacucuaaucaaggcaggagaugcagc

SEQ ID NO: 11531 - RNA, 26 nt, Human
guuuugaaccugaucugcauaaaacc

SEQ ID NO: 11532 - RNA, 25 nt, Human
uggaaagguaacuggcaaugcacuu

SEQ ID NO: 11533 - RNA, 19 nt, Human
ggcauccauuuccauacag

SEQ ID NO: 11534 - RNA, 20 nt, Human
gacuaaaauauuccucuacu

SEQ ID NO: 11535 - RNA, 22 nt, Human
cgagagaagcaggggagcucgg

SEQ ID NO: 11536 - RNA, 20 nt, Human
ugcaucuauguacagagccu

SEQ ID NO: 11537 - RNA, 20 nt, Human
ugguucccuggauuauggaa

SEQ ID NO: 11538 - RNA, 23 nt, Human
cuuauccuuauccccuccagucu

SEQ ID NO: 11539 - RNA, 31 nt, Human
cucuccagucucugcugaugaaaugggaucc

SEQ ID NO: 11540 - RNA, 20 nt, Human
uauaaaaauauuaaagagaa

SEQ ID NO: 11541 - RNA, 20 nt, Human
uuaauggaauauugggugaa

SEQ ID NO: 11542 - RNA, 27 nt, Human
ggcccccaaccucagggcucccagggg

SEQ ID NO: 11543 - RNA, 26 nt, Human
ucaguauacauucucuagucugugau

SEQ ID NO: 11544 - RNA, 21 nt, Human
cucuuucugagggaaaggaca

SEQ ID NO: 11545 - RNA, 30 nt, Human
cccucccaccucuuccucuggccguucaga

SEQ ID NO: 11546 - RNA, 20 nt, Human
ccaacagcucaagucuuccc

SEQ ID NO: 11547 - RNA, 26 nt, Human
auauucugaaacauuucuacuuucug

SEQ ID NO: 11548 - RNA, 23 nt, Human
acuguugucugugccuuuuugaa

SEQ ID NO: 11549 - RNA, 26 nt, Human
gccacugcauucucuuuuguuugcaa

SEQ ID NO: 11550 - RNA, 25 nt, Human
acccagucuuauuuuucuagucagu

SEQ ID NO: 11551 - RNA, 21 nt, Human
guauaguuuaaaaaucugcca

SEQ ID NO: 11552 - RNA, 24 nt, Human
ggcaaagcuguucuuccuggugac

SEQ ID NO: 11553 - RNA, 21 nt, Human
guugcugaucuguaguacagu

SEQ ID NO: 11554 - RNA, 21 nt, Human
ucuggcagauguagguaaaga

SEQ ID NO: 11555 - RNA, 22 nt, Human
ggguucggagggugggggcgca

SEQ ID NO: 11556 - RNA, 27 nt, Human
aaauguccccucacugcagaucaaaug

SEQ ID NO: 11557 - RNA, 22 nt, Human
gaugggguuucacuauguugcc

SEQ ID NO: 11558 - RNA, 24 nt, Human
uccgcucucccccgggcgugggcc

SEQ ID NO: 11559 - RNA, 25 nt, Human
cccucucucccuggugucaacucga

SEQ ID NO: 11560 - RNA, 21 nt, Human
uugaucaugaaucacugcacc

SEQ ID NO: 11561 - RNA, 23 nt, Human
uuucaccucuuccuugauuacuc

SEQ ID NO: 11562 - RNA, 24 nt, Human
cuggcugccauacuuuccuguaua

SEQ ID NO: 11563 - RNA, 20 nt, Human
ucaguuauucauucugugau

SEQ ID NO: 11564 - RNA, 26 nt, Human
gccucagccucacccacagcagcccc

SEQ ID NO: 11565 - RNA, 22 nt, Human
ugucucccggguucaagcgauu

SEQ ID NO: 11566 - RNA, 26 nt, Human
uccgggucucuaggaugccagaggca

SEQ ID NO: 11567 - RNA, 23 nt, Human
aaaguuaaucaggacccaagucu

SEQ ID NO: 11568 - RNA, 22 nt, Human
cagaacccaugaugaacuguga

SEQ ID NO: 11569 - RNA, 25 nt, Human
uggcgcuggaggcagcagcggcugg

SEQ ID NO: 11570 - RNA, 22 nt, Human
uuugggaauaaacuucuauaga

SEQ ID NO: 11571 - RNA, 24 nt, Human
uuccaaugcccugguuuuccugcu

SEQ ID NO: 11572 - RNA, 22 nt, Human
ccuugcccuugagugcuuguua

SEQ ID NO: 11573 - RNA, 22 nt, Human
cucugcugagcaauuguggccc

SEQ ID NO: 11574 - RNA, 26 nt, Human
cccuccugacccagggauggaggcuu

SEQ ID NO: 11575 - RNA, 20 nt, Human
uagcugggugugguggugca

SEQ ID NO: 11576 - RNA, 22 nt, Human
gccuuccuggccagccaggugg

SEQ ID NO: 11577 - RNA, 24 nt, Human
ggcuuuuugcaagcauuuacuugg

SEQ ID NO: 11578 - RNA, 20 nt, Human
uucuagaaauaugcuuucua

SEQ ID NO: 11579 - RNA, 23 nt, Human
cuuauaacuuccauuuuauuacu

SEQ ID NO: 11580 - RNA, 23 nt, Human
aggcuggaguggaguggcacgau

SEQ ID NO: 11581 - RNA, 24 nt, Human
guauuauauguaacuacuuggaaa

SEQ ID NO: 11582 - RNA, 21 nt, Human
gcuugaggcuaccucuaccuu

SEQ ID NO: 11583 - RNA, 30 nt, Human
ccuacgcaucuccuccuccuuggacauucu

SEQ ID NO: 11584 - RNA, 22 nt, Human
gcucaugccuguaaucccaaca

SEQ ID NO: 11585 - RNA, 19 nt, Human
gccuuuuaaaaaugcuuau

SEQ ID NO: 11586 - RNA, 19 nt, Human
cagugcacucccuaggaaa

SEQ ID NO: 11587 - RNA, 25 nt, Human
uggucccauuccagacaggggccuc

SEQ ID NO: 11588 - RNA, 24 nt, Human
uauaguggagacccagaggaugag

SEQ ID NO: 11589 - RNA, 27 nt, Human
caguacacauacgugcauacacaugcc

SEQ ID NO: 11590 - RNA, 21 nt, Human
cggcgaagccuggauuggugg

SEQ ID NO: 11591 - RNA, 22 nt, Human
gaucaccguuuauuuucauaau

SEQ ID NO: 11592 - RNA, 20 nt, Human
ggcugugccuacaggacuuc

SEQ ID NO: 11593 - RNA, 22 nt, Human
cguccugccccuuccuccuuca

SEQ ID NO: 11594 - RNA, 22 nt, Human
ccaacauggugaaacccuguau

SEQ ID NO: 11595 - RNA, 29 nt, Human
cggccaaggcggaggcugcggcuccgacg

SEQ ID NO: 11596 - RNA, 20 nt, Human
uucuuaacugccucuuaccg

SEQ ID NO: 11597 - RNA, 22 nt, Human
uucccuccaaaccccaaguaag

SEQ ID NO: 11598 - RNA, 23 nt, Human
uaagcaccauggccuugaugauu

SEQ ID NO: 11599 - RNA, 26 nt, Human
gguaaucacagcuggggagugaaaag

SEQ ID NO: 11600 - RNA, 22 nt, Human
cagggcugcggggaggccaggc

SEQ ID NO: 11601 - RNA, 26 nt, Human
cugccugggucucugcucuagcaccc

SEQ ID NO: 11602 - RNA, 23 nt, Human
ccugccccagccccugccucugc

SEQ ID NO: 11603 - RNA, 25 nt, Human
agagacugcggcgggagggccaggc

SEQ ID NO: 11604 - RNA, 22 nt, Human
gagggacgacuuucuuuaacau

SEQ ID NO: 11605 - RNA, 23 nt, Human
accauuuugagaaccauggaacc

SEQ ID NO: 11606 - RNA, 19 nt, Human
gaagccccaacgggaaagg

SEQ ID NO: 11607 - RNA, 25 nt, Human
gagagggagaggaaacaaaagcugu

SEQ ID NO: 11608 - RNA, 22 nt, Human
gugcuccccuaagucuucuucc

SEQ ID NO: 11609 - RNA, 20 nt, Human
ccauucucugccuuuuuaca

SEQ ID NO: 11610 - RNA, 20 nt, Human
ccaucaucccucaaaguguc

SEQ ID NO: 11611 - RNA, 20 nt, Human
uaggggcaguucucuguccc

SEQ ID NO: 11612 - RNA, 16 nt, Human
cuucccuuaagaguca

SEQ ID NO: 11613 - RNA, 26 nt, Human
ucuuuuucauguauuuuccucaugau

SEQ ID NO: 11614 - RNA, 26 nt, Human
agcccuaccagcauguuauagggcaa

SEQ ID NO: 11615 - RNA, 21 nt, Human
uccucagacuauuuuucagcc

SEQ ID NO: 11616 - RNA, 23 nt, Human
agauggggucuugcuauauugcc

SEQ ID NO: 11617 - RNA, 27 nt, Human
ggaggcugggcccuggaggcaacgugc

SEQ ID NO: 11618 - RNA, 25 nt, Human
aguuauacacugaacuuuacuguag

SEQ ID NO: 11619 - RNA, 24 nt, Human
cuucugcucgacggggugucuccu

SEQ ID NO: 11620 - RNA, 20 nt, Human
ccaccucccucugccagucg

SEQ ID NO: 11621 - RNA, 26 nt, Human
cuuuuuucuuuugaugucuacucaaa

SEQ ID NO: 11622 - RNA, 26 nt, Human
ccugauugcugacccagucucaggcc

SEQ ID NO: 11623 - RNA, 20 nt, Human
cucagggucuacauuucauu

SEQ ID NO: 11624 - RNA, 20 nt, Human
cuuaccugcagggaucauag

SEQ ID NO: 11625 - RNA, 19 nt, Human
ucuccacugccuucugucc

SEQ ID NO: 11626 - RNA, 21 nt, Human
uaaaacacagaaacuauaugc

SEQ ID NO: 11627 - RNA, 25 nt, Human
agggugaggcccacucuguuccuac

SEQ ID NO: 11628 - RNA, 22 nt, Human
gaccagccuggccaaccuggug

SEQ ID NO: 11629 - RNA, 20 nt, Human
gcacggcugcucacgacgcc

SEQ ID NO: 11630 - RNA, 22 nt, Human
aaacuccugggcucaagugauc

SEQ ID NO: 11631 - RNA, 23 nt, Human
ccuguggguguagccagguaugg

SEQ ID NO: 11632 - RNA, 24 nt, Human
cuggaaaggcaaaaaugagaaaga

SEQ ID NO: 11633 - RNA, 21 nt, Human
agcacaaaaucauucuuugca

SEQ ID NO: 11634 - RNA, 19 nt, Human
guucuccuuaccuaaguuu

SEQ ID NO: 11635 - RNA, 21 nt, Human
ucugaaacauguggcuaccuu

SEQ ID NO: 11636 - RNA, 24 nt, Human
ucugccuucuuccucuguugccau

SEQ ID NO: 11637 - RNA, 20 nt, Human
uuggacaggacagugaccuu

SEQ ID NO: 11638 - RNA, 21 nt, Human
cugcagcugacuauguauucc

SEQ ID NO: 11639 - RNA, 28 nt, Human
ggcugggguggagggcgggacagagggg

SEQ ID NO: 11640 - RNA, 19 nt, Human
gccagacuggagugcagug

SEQ ID NO: 11641 - RNA, 26 nt, Human
agcaguuucugguuccuuuaacagca

SEQ ID NO: 11642 - RNA, 20 nt, Human
gccacuccacuccagguggg

SEQ ID NO: 11643 - RNA, 21 nt, Human
gaggaagagcaggcaccagca

SEQ ID NO: 11644 - RNA, 19 nt, Human
aaaaagaguuguauaaucu

SEQ ID NO: 11645 - RNA, 22 nt, Human
uuuucucaucagcagaacagaa

SEQ ID NO: 11646 - RNA, 20 nt, Human
caugcaugugacuccucaaa

SEQ ID NO: 11647 - RNA, 24 nt, Human
ccaggguuuuucacuucuccccac

SEQ ID NO: 11648 - RNA, 24 nt, Human
accugcaagugcugccaaugggaa

SEQ ID NO: 11649 - RNA, 23 nt, Human
aacccuucaucuuccuguguccu

SEQ ID NO: 11650 - RNA, 19 nt, Human
ggagauugucuuucugcca

SEQ ID NO: 11651 - RNA, 23 nt, Human
ccccaucauaagggcacugagcc

SEQ ID NO: 11652 - RNA, 22 nt, Human
cucugccaccacuagguaccug

SEQ ID NO: 11653 - RNA, 22 nt, Human
uguuuuucucacaguuucuuua

SEQ ID NO: 11654 - RNA, 26 nt, Human
aacuguauaaugagguuacuacuagu

SEQ ID NO: 11655 - RNA, 26 nt, Human
cugcuccuucgcccucuuguagugug

SEQ ID NO: 11656 - RNA, 21 nt, Human
agauuguauuuuugcaccuua

SEQ ID NO: 11657 - RNA, 32 nt, Human
ugcagucucugggcaucucccauugggccacg

SEQ ID NO: 11658 - RNA, 21 nt, Human
gucaccugcuucucugcccag

SEQ ID NO: 11659 - RNA, 26 nt, Human
acaagugucugugcaugucccccagg

SEQ ID NO: 11660 - RNA, 25 nt, Human
uuuuagcaaccccaguauuccuuca

SEQ ID NO: 11661 - RNA, 25 nt, Human
cacuccacucugggcugggcuguga

SEQ ID NO: 11662 - RNA, 28 nt, Human
gggcuugccacccacuccuuugcuguca

SEQ ID NO: 11663 - RNA, 19 nt, Human
ccugccuggcauccucugc

SEQ ID NO: 11664 - RNA, 22 nt, Human
guugcaaauuauucuagucaac

SEQ ID NO: 11665 - RNA, 19 nt, Human
cacugcaaccucugccucc

SEQ ID NO: 11666 - RNA, 24 nt, Human
guaacuucaaaagaagauuugauu

SEQ ID NO: 11667 - RNA, 24 nt, Human
uacuacugcaauugcuucccuucu

SEQ ID NO: 11668 - RNA, 23 nt, Human
acacauuuauuauagcuuugucc

SEQ ID NO: 11669 - RNA, 18 nt, Human
uguuaaaaauguuuauau

SEQ ID NO: 11670 - RNA, 19 nt, Human
ccaguucuuacacucugau

SEQ ID NO: 11671 - RNA, 22 nt, Human
aggccaaggcaggaggauggcu

SEQ ID NO: 11672 - RNA, 23 nt, Human
aggcaugccuguacucucuuuca

SEQ ID NO: 11673 - RNA, 23 nt, Human
gggggcaacucuaaucagaggaa

SEQ ID NO: 11674 - RNA, 21 nt, Human
aaacugagaaaacucaaucca

SEQ ID NO: 11675 - RNA, 20 nt, Human
gauuucuuuucuuccuggcu

SEQ ID NO: 11676 - RNA, 22 nt, Human
ggaaaacaagcugugucuucuu

SEQ ID NO: 11677 - RNA, 23 nt, Human
uguccgcccaggcugggugcagu

SEQ ID NO: 11678 - RNA, 21 nt, Human
accauuucuggcugggcaggg

SEQ ID NO: 11679 - RNA, 22 nt, Human
ugccuccagaggaugacuggcc

SEQ ID NO: 11680 - RNA, 23 nt, Human
acuuccccuuauuuugacccauc

SEQ ID NO: 11681 - RNA, 25 nt, Human
ucaguuaaauauuggaagcugugug

SEQ ID NO: 11682 - RNA, 23 nt, Human
gaaggagaguccccugaaggucu

SEQ ID NO: 11683 - RNA, 22 nt, Human
cagcagacuucuacauguacuu

SEQ ID NO: 11684 - RNA, 27 nt, Human
ucugauugaaacaugaaacaacucaug

SEQ ID NO: 11685 - RNA, 21 nt, Human
guauucugggccuucugccca

SEQ ID NO: 11686 - RNA, 25 nt, Human
uugggagaggauacuguccagaaaa

SEQ ID NO: 11687 - RNA, 21 nt, Human
cacucugcuggcuucucccag

SEQ ID NO: 11688 - RNA, 22 nt, Human
agcaugacuuauuuaguauucu

SEQ ID NO: 11689 - RNA, 24 nt, Human
acaaguugugccuuucacagcuuc

SEQ ID NO: 11690 - RNA, 22 nt, Human
cgggaagggagacgagcgucug

SEQ ID NO: 11691 - RNA, 22 nt, Human
ucucuuguccuugcacacuuua

SEQ ID NO: 11692 - RNA, 24 nt, Human
ucugcccuuuucucucacccaucc

SEQ ID NO: 11693 - RNA, 27 nt, Human
ucacccaggcuggcagaucaugguagc

SEQ ID NO: 11694 - RNA, 22 nt, Human
gucauccuaggccgagaagaac

SEQ ID NO: 11695 - RNA, 24 nt, Human
gucuucagaaaaccuagaggccga

SEQ ID NO: 11696 - RNA, 20 nt, Human
uuggcagguggagccaggug

SEQ ID NO: 11697 - RNA, 22 nt, Human
gcaucucgcucucggagccggc

SEQ ID NO: 11698 - RNA, 27 nt, Human
gagacagucaaacugcaaaccauggug

SEQ ID NO: 11699 - RNA, 22 nt, Human
cgggagguggagcuugcaguga

SEQ ID NO: 11700 - RNA, 22 nt, Human
uaaucagaguguggcauagaag

SEQ ID NO: 11701 - RNA, 27 nt, Human
cacugcacccuggguugggugcacagc

SEQ ID NO: 11702 - RNA, 25 nt, Human
uguccaacagagaaaccugcagcag

SEQ ID NO: 11703 - RNA, 23 nt, Human
aggcuugagugcaguggugcgau

SEQ ID NO: 11704 - RNA, 23 nt, Human
ccuccucccacauuucuggagcu

SEQ ID NO: 11705 - RNA, 20 nt, Human
cuuucccaccucucucccca

SEQ ID NO: 11706 - RNA, 22 nt, Human
augguguuuauuuucuuucuua

SEQ ID NO: 11707 - RNA, 21 nt, Human
gcaguguaccaagacuagcaa

SEQ ID NO: 11708 - RNA, 26 nt, Human
caucauuuccagucaucuguguguuu

SEQ ID NO: 11709 - RNA, 28 nt, Human
caauuucaaagacucacuucuauaacca

SEQ ID NO: 11710 - RNA, 27 nt, Human
ugcuucaaaacaauauaaauggauaau

SEQ ID NO: 11711 - RNA, 19 nt, Human
ugaaaugauuccacaaaga

SEQ ID NO: 11712 - RNA, 22 nt, Human
gugggugacagagaugggugga

SEQ ID NO: 11713 - RNA, 22 nt, Human
ccuccacuaggaguuaacuacc

SEQ ID NO: 11714 - RNA, 21 nt, Human
ccugcuggggaaggcuggggg

SEQ ID NO: 11715 - RNA, 27 nt, Human
cacgccucagugucuccucaggcacag

SEQ ID NO: 11716 - RNA, 22 nt, Human
gcuuucuuuuggugguuuuguu

SEQ ID NO: 11717 - RNA, 23 nt, Human
guuacacccacugcacucugcaa

SEQ ID NO: 11718 - RNA, 22 nt, Human
ggcucuuggcccucccaccugg

SEQ ID NO: 11719 - RNA, 21 nt, Human
uuuccugaucacuaugcauuu

SEQ ID NO: 11720 - RNA, 20 nt, Human
gggaaguucuggaaggaagc

SEQ ID NO: 11721 - RNA, 22 nt, Human
uacaacaaccugaagcacaagu

SEQ ID NO: 11722 - RNA, 27 nt, Human
ucaggaggcggaggcugcagucaacca

SEQ ID NO: 11723 - RNA, 25 nt, Human
cuuaccucccccagugccuucuuca

SEQ ID NO: 11724 - RNA, 20 nt, Human
ggaaauagaaaacaugugaa

SEQ ID NO: 11725 - RNA, 24 nt, Human
aaccauuccucuguccucuucucu

SEQ ID NO: 11726 - RNA, 20 nt, Human
auggaaaggccagaggcaga

SEQ ID NO: 11727 - RNA, 26 nt, Human
gaagcaagcuauuggagcugaaggaa

SEQ ID NO: 11728 - RNA, 25 nt, Human
aaggauccacucccccagcuccuuu

SEQ ID NO: 11729 - RNA, 26 nt, Human
guggguggaaccugggggcaccucgu

SEQ ID NO: 11730 - RNA, 21 nt, Human
ucugaugucaaaaaugucuug

SEQ ID NO: 11731 - RNA, 20 nt, Human
gcacacacacccauaccucu

SEQ ID NO: 11732 - RNA, 30 nt, Human
augccaccuaugccacagugccuaagggcu

SEQ ID NO: 11733 - RNA, 23 nt, Human
gcccuugccucauguuugaauga

SEQ ID NO: 11734 - RNA, 19 nt, Human
uccagugucugucaugccc

SEQ ID NO: 11735 - RNA, 18 nt, Human
ucucauguacucuaccuu

SEQ ID NO: 11736 - RNA, 26 nt, Human
ccuguaauccuagcacuuugagacca

SEQ ID NO: 11737 - RNA, 22 nt, Human
ucguguacggguuccucccucc

SEQ ID NO: 11738 - RNA, 19 nt, Human
ggagagggcggugggaggc

SEQ ID NO: 11739 - RNA, 22 nt, Human
caguuguuauauucauucuuua

SEQ ID NO: 11740 - RNA, 25 nt, Human
guuggguggaggauggacgagugag

SEQ ID NO: 11741 - RNA, 19 nt, Human
cugaggaccccaagagcag

SEQ ID NO: 11742 - RNA, 16 nt, Human
acuuuguuaugccuua

SEQ ID NO: 11743 - RNA, 21 nt, Human
ggcccuggcugacucucgccg

SEQ ID NO: 11744 - RNA, 22 nt, Human
uggguguccauccuggggcagg

SEQ ID NO: 11745 - RNA, 21 nt, Human
cugcauguuccaagacaguau

SEQ ID NO: 11746 - RNA, 23 nt, Human
cuuaacauguugagucucugaga

SEQ ID NO: 11747 - RNA, 27 nt, Human
gcaucuuucacaccucccagcuucugc

SEQ ID NO: 11748 - RNA, 24 nt, Human
aaucaguuucucaaacugagcuuc

SEQ ID NO: 11749 - RNA, 20 nt, Human
aauuacucugaaguuaugaa

SEQ ID NO: 11750 - RNA, 23 nt, Human
ugcccaggcugggagggcaaugg

SEQ ID NO: 11751 - RNA, 21 nt, Human
cagggcugugagcugggcuuc

SEQ ID NO: 11752 - RNA, 21 nt, Human
ggcucuaaaagaugauuuccc

SEQ ID NO: 11753 - RNA, 23 nt, Human
cacauugcacgccuccccccuca

SEQ ID NO: 11754 - RNA, 21 nt, Human
aggaccacguggacuccgccc

SEQ ID NO: 11755 - RNA, 21 nt, Human
acaaacccauagaaaagugag

SEQ ID NO: 11756 - RNA, 24 nt, Human
gcugcccucugcugccuguugggg

SEQ ID NO: 11757 - RNA, 18 nt, Human
agcucccuccuggaaugc

SEQ ID NO: 11758 - RNA, 21 nt, Human
cuagcuggugugguugcagug

SEQ ID NO: 11759 - RNA, 23 nt, Human
uuaguauuuuugcacuucacaaa

SEQ ID NO: 11760 - RNA, 22 nt, Human
aucagcaccagccgccauggcc

SEQ ID NO: 11761 - RNA, 20 nt, Human
cagaauuaugcuuuauucaa

SEQ ID NO: 11762 - RNA, 18 nt, Human
uucuuagaacuuguuuua

SEQ ID NO: 11763 - RNA, 23 nt, Human
uuaguaaagacaggguuucucca

SEQ ID NO: 11764 - RNA, 27 nt, Human
cuuccacugccugaaagacuuggguug

SEQ ID NO: 11765 - RNA, 23 nt, Human
ggaccuacaggcugacguuccgg

SEQ ID NO: 11766 - RNA, 20 nt, Human
gcaggcagaucaugagguca

SEQ ID NO: 11767 - RNA, 23 nt, Human
ucuuccuugccaaguuuuccuac

SEQ ID NO: 11768 - RNA, 22 nt, Human
gacuacaggcaccugccaccac

SEQ ID NO: 11769 - RNA, 22 nt, Human
uggaauggcugagggaggcagg

SEQ ID NO: 11770 - RNA, 22 nt, Human
cugcaagcccacccagaugggg

SEQ ID NO: 11771 - RNA, 23 nt, Human
uggaaggcacugccuucagcuga

SEQ ID NO: 11772 - RNA, 23 nt, Human
gguuuuauaguucauugaaaauc

SEQ ID NO: 11773 - RNA, 24 nt, Human
cacagucggcugggcggugcaaug

SEQ ID NO: 11774 - RNA, 27 nt, Human
cagugggcuuguuugcagacuggguga

SEQ ID NO: 11775 - RNA, 27 nt, Human
ccuguucucugacauccguggagcccc

SEQ ID NO: 11776 - RNA, 22 nt, Human
cagaccuguuuuuauuugcuca

SEQ ID NO: 11777 - RNA, 23 nt, Human
ccuccuuuccccucccucaggcc

SEQ ID NO: 11778 - RNA, 23 nt, Human
uuccagcuccggccucuggacua

SEQ ID NO: 11779 - RNA, 22 nt, Human
ggggccaguggcuggagcuuga

SEQ ID NO: 11780 - RNA, 25 nt, Human
gggaggagcagagccagggagccau

SEQ ID NO: 11781 - RNA, 22 nt, Human
caggaauauaaauaguuucugg

SEQ ID NO: 11782 - RNA, 21 nt, Human
acuuagacuucucuagcuuuu

SEQ ID NO: 11783 - RNA, 21 nt, Human
ggagagaagacgagccucccg

SEQ ID NO: 11784 - RNA, 21 nt, Human
gaaggggaagagggugaccuc

SEQ ID NO: 11785 - RNA, 27 nt, Human
gcucugucgcccaggcuggagugcagu

SEQ ID NO: 11786 - RNA, 27 nt, Human
guucugucguccaggcuggagugcagu

SEQ ID NO: 11787 - RNA, 27 nt, Human
gcucugucacccaggcuggagugcggu

SEQ ID NO: 11788 - RNA, 22 nt, Human
ucucccauuucuugcuagcuau

SEQ ID NO: 11789 - RNA, 22 nt, Human
ccuaccucugucauuagcaaug

SEQ ID NO: 11790 - RNA, 22 nt, Human
ucucccacaugcucuguuaugg

SEQ ID NO: 11791 - RNA, 19 nt, Human
aagggggaugcuguggaaa

SEQ ID NO: 11792 - RNA, 21 nt, Human
aaugggucucauuugagucuc

SEQ ID NO: 11793 - RNA, 28 nt, Human
cacccuggcccagacugccagcccugac

SEQ ID NO: 11794 - RNA, 19 nt, Human
ggcucugaggcucccuggg

SEQ ID NO: 11795 - RNA, 26 nt, Human
gggaaugaaauggaaagggaggcuga

SEQ ID NO: 11796 - RNA, 21 nt, Human
gcacugaccacacccaccccg

SEQ ID NO: 11797 - RNA, 20 nt, Human
ccaugcccccucccaaaaag

SEQ ID NO: 11798 - RNA, 19 nt, Human
caucaucugggaacuuguc

SEQ ID NO: 11799 - RNA, 25 nt, Human
agccgcuccuccacgccuguccuua

SEQ ID NO: 11800 - RNA, 24 nt, Human
gcgcuuccucccugugcacugucc

SEQ ID NO: 11801 - RNA, 22 nt, Human
uacaguaccuuguugauauauu

SEQ ID NO: 11802 - RNA, 22 nt, Human
ugggcagcccaagguugcaugg

SEQ ID NO: 11803 - RNA, 26 nt, Human
ggguucuaaaggacagcaccagcggg

SEQ ID NO: 11804 - RNA, 23 nt, Human
accccagguagccucuuggagau

SEQ ID NO: 11805 - RNA, 27 nt, Human
cugggaggacucugaugcagggcgucu

SEQ ID NO: 11806 - RNA, 19 nt, Human
cagaagccauggggccaag

SEQ ID NO: 11807 - RNA, 22 nt, Human
cugcaaccuccgccucuugggu

SEQ ID NO: 11808 - RNA, 27 nt, Human
ggguaaugaauacauggaguuucauua

SEQ ID NO: 11809 - RNA, 25 nt, Human
ccuucagguuccuccuaggcgcuca

SEQ ID NO: 11810 - RNA, 20 nt, Human
accaugccuggagaggucag

SEQ ID NO: 11811 - RNA, 20 nt, Human
agcacauucuggcucaggga

SEQ ID NO: 11812 - RNA, 23 nt, Human
cagagccccaaaaaucgaaacag

SEQ ID NO: 11813 - RNA, 24 nt, Human
gaucaaauuaaauaauagauguga

SEQ ID NO: 11814 - RNA, 26 nt, Human
acacggccaggcugggcucugggauu

SEQ ID NO: 11815 - RNA, 22 nt, Human
auguauauauaugcauaugcag

SEQ ID NO: 11816 - RNA, 22 nt, Human
gugccucuucuuuuucuucuug

SEQ ID NO: 11817 - RNA, 21 nt, Human
acaacaacaacaacuuauuua

SEQ ID NO: 11818 - RNA, 23 nt, Human
cuuuuuaaaaacuagacuucgua

SEQ ID NO: 11819 - RNA, 24 nt, Human
uuuguucuguucugucaugugcca

SEQ ID NO: 11820 - RNA, 21 nt, Human
cauccagcuggcccgccaggg

SEQ ID NO: 11821 - RNA, 21 nt, Human
ggagagagggaagaggggcgu

SEQ ID NO: 11822 - RNA, 22 nt, Human
cagcccagauaucaccccugag

SEQ ID NO: 11823 - RNA, 25 nt, Human
aauaauauguauagacaacaacaac

SEQ ID NO: 11824 - RNA, 22 nt, Human
ucagaaaugugaauguaguaag

SEQ ID NO: 11825 - RNA, 26 nt, Human
gacuggaggcagggauccugcgcggg

SEQ ID NO: 11826 - RNA, 26 nt, Human
gacuguuugcuuucugcugagauaag

SEQ ID NO: 11827 - RNA, 20 nt, Human
uuuguuguucaccugaaauu

SEQ ID NO: 11828 - RNA, 22 nt, Human
aaacuccugaccucaggugaug

SEQ ID NO: 11829 - RNA, 23 nt, Human
ggcagcccugggcugaggcacag

SEQ ID NO: 11830 - RNA, 19 nt, Human
ccgaggcagcucgagccca

SEQ ID NO: 11831 - RNA, 25 nt, Human
gggacagcgaaagaugaggguggca

SEQ ID NO: 11832 - RNA, 25 nt, Human
ucugccucugggccuuugcuuugug

SEQ ID NO: 11833 - RNA, 21 nt, Human
gggggagggggacuggagagg

SEQ ID NO: 11834 - RNA, 20 nt, Human
uuucccuuaaaggaauguca

SEQ ID NO: 11835 - RNA, 23 nt, Human
gccauccugucagcacagucuuc

SEQ ID NO: 11836 - RNA, 21 nt, Human
guccccaaugccuggaaauuc

SEQ ID NO: 11837 - RNA, 23 nt, Human
ggggcuuggaggugggcggcugg

SEQ ID NO: 11838 - RNA, 21 nt, Human
agcuuugguucuuuaggguga

SEQ ID NO: 11839 - RNA, 22 nt, Human
ccauauuugcaaggggagggga

SEQ ID NO: 11840 - RNA, 22 nt, Human
ggggcugguucuguaauugugu

SEQ ID NO: 11841 - RNA, 24 nt, Human
gcaguggugcaaucacagcucacc

SEQ ID NO: 11842 - RNA, 23 nt, Human
uagcucaguucccagacagcuuu

SEQ ID NO: 11843 - RNA, 19 nt, Human
gggacaaggagguugcuga

SEQ ID NO: 11844 - RNA, 26 nt, Human
ccaucccaccaccucuaccugcucau

SEQ ID NO: 11845 - RNA, 22 nt, Human
cacuaccagucucccaaauaga

SEQ ID NO: 11846 - RNA, 22 nt, Human
cuggcgugaacccaggaggcgg

SEQ ID NO: 11847 - RNA, 24 nt, Human
cuuuucucugcugauacgguugcu

SEQ ID NO: 11848 - RNA, 26 nt, Human
auccaaugcugcaccacuuguaauga

SEQ ID NO: 11849 - RNA, 21 nt, Human
cacgccuagacugaguguggu

SEQ ID NO: 11850 - RNA, 22 nt, Human
gaaccugggaggcagagguuuc

SEQ ID NO: 11851 - RNA, 24 nt, Human
gacaguuucucugcagguccuguc

SEQ ID NO: 11852 - RNA, 24 nt, Human
ggucggcgggugcugccgcuuuaa

SEQ ID NO: 11853 - RNA, 22 nt, Human
uuauaaaucacuauuuugguca

SEQ ID NO: 11854 - RNA, 27 nt, Human
gcagagcagaggcugaggcacggggag

SEQ ID NO: 11855 - RNA, 20 nt, Human
cuggaaucuggagaccaggg

SEQ ID NO: 11856 - RNA, 26 nt, Human
uuacaugcucagcuugguuuuggaca

SEQ ID NO: 11857 - RNA, 17 nt, Human
gaccugacagagucuca

SEQ ID NO: 11858 - RNA, 23 nt, Human
aucuuccggcccucugauuggcc

SEQ ID NO: 11859 - RNA, 21 nt, Human
uuuucugguucuguguccucu

SEQ ID NO: 11860 - RNA, 26 nt, Human
gugaugucugucuccauccuucccuc

SEQ ID NO: 11861 - RNA, 24 nt, Human
aacccuguaaguuacuuuaaagcu

SEQ ID NO: 11862 - RNA, 18 nt, Human
aucaugcucgcuucccuu

SEQ ID NO: 11863 - RNA, 26 nt, Human
auuguuguuuacuuuaguucuggaac

SEQ ID NO: 11864 - RNA, 19 nt, Human
gugaacaaaagaugcucuu

SEQ ID NO: 11865 - RNA, 19 nt, Human
ccagcacuuugggaggcug

SEQ ID NO: 11866 - RNA, 22 nt, Human
ccaaguugcugggauuacugac

SEQ ID NO: 11867 - RNA, 23 nt, Human
aacucucgcuuucuuuuuaaucc

SEQ ID NO: 11868 - RNA, 22 nt, Human
caccuccccccggccugggcag

SEQ ID NO: 11869 - RNA, 19 nt, Human
cucuuauggggcaggcugg

SEQ ID NO: 11870 - RNA, 21 nt, Human
cucuaccaauaaaagccacuu

SEQ ID NO: 11871 - RNA, 22 nt, Human
uggcuaacacagugaaacccca

SEQ ID NO: 11872 - RNA, 20 nt, Human
cuuugacagaagauguuucg

SEQ ID NO: 11873 - RNA, 20 nt, Human
aggaagggaagguggcagaa

SEQ ID NO: 11874 - RNA, 20 nt, Human
aaagaagaaaaguaaaagua

SEQ ID NO: 11875 - RNA, 23 nt, Human
uccucaaggugggguucgggggg

SEQ ID NO: 11876 - RNA, 23 nt, Human
ugccguggagcuuggagcccccu

SEQ ID NO: 11877 - RNA, 26 nt, Human
ccagaggccauauucaaaacaggguc

SEQ ID NO: 11878 - RNA, 21 nt, Human
agaagcagauuuuauacuuuu

SEQ ID NO: 11879 - RNA, 23 nt, Human
uaacuggagggugggcuggggag

SEQ ID NO: 11880 - RNA, 21 nt, Human
uuccacugagguuggggugua

SEQ ID NO: 11881 - RNA, 20 nt, Human
cggagcuuuuucuccaguua

SEQ ID NO: 11882 - RNA, 27 nt, Human
ucuguucugccuguccucgcucucucc

SEQ ID NO: 11883 - RNA, 26 nt, Human
gggaugggacagggaggccacacgca

SEQ ID NO: 11884 - RNA, 27 nt, Human
gucacccacagagcaugggguaauggu

SEQ ID NO: 11885 - RNA, 17 nt, Human
aggaagugaggccaggu

SEQ ID NO: 11886 - RNA, 23 nt, Human
caaaauaagcaacuaaaugagac

SEQ ID NO: 11887 - RNA, 26 nt, Human
ugucauaacaggcauugccaaccuca

SEQ ID NO: 11888 - RNA, 23 nt, Human
cccaccccacacucuaguugccc

SEQ ID NO: 11889 - RNA, 24 nt, Human
cagucuuacagaggcuggagcggu

SEQ ID NO: 11890 - RNA, 27 nt, Human
uuuaauucuucacgguaagaaaaugaa

SEQ ID NO: 11891 - RNA, 26 nt, Human
agaacuccaggcgugcggacgcaaca

SEQ ID NO: 11892 - RNA, 21 nt, Human
caggaaaagaagcuggaacac

SEQ ID NO: 11893 - RNA, 23 nt, Human
caguagaaaaggaucuaagggaa

SEQ ID NO: 11894 - RNA, 27 nt, Human
ugaaaacagcccuuuuccaagcccauu

SEQ ID NO: 11895 - RNA, 23 nt, Human
ucgcuguccggucgcgcuucacu

SEQ ID NO: 11896 - RNA, 23 nt, Human
gugcagaacaaacaaggcauuca

SEQ ID NO: 11897 - RNA, 24 nt, Human
cccugcuagccucagccuccauug

SEQ ID NO: 11898 - RNA, 27 nt, Human
ggaugccugacgagguguagccuuuua

SEQ ID NO: 11899 - RNA, 27 nt, Human
cccugcucuuccugcuugcuggcagag

SEQ ID NO: 11900 - RNA, 24 nt, Human
ccugaccuugugauccaccuccuc

SEQ ID NO: 11901 - RNA, 26 nt, Human
ggagagggacuggcagagcugaggcc

SEQ ID NO: 11902 - RNA, 30 nt, Human
gugacacagccccuuucacacucuguccuc

SEQ ID NO: 11903 - RNA, 23 nt, Human
uucaaccaaaauugauucuugga

SEQ ID NO: 11904 - RNA, 21 nt, Human
ugccugucccagccuccuggc

SEQ ID NO: 11905 - RNA, 26 nt, Human
ccaacaaaccauccagugacaaacca

SEQ ID NO: 11906 - RNA, 22 nt, Human
uucccuucauguugcacacucu

SEQ ID NO: 11907 - RNA, 20 nt, Human
ggcagguugcgagaaggaga

SEQ ID NO: 11908 - RNA, 19 nt, Human
caggcagcacaguguguga

SEQ ID NO: 11909 - RNA, 17 nt, Human
ugggcacagauugaaga

SEQ ID NO: 11910 - RNA, 21 nt, Human
ugggcaucauuccucagugga

SEQ ID NO: 11911 - RNA, 25 nt, Human
cugggcugggcagguaagggcuggu

SEQ ID NO: 11912 - RNA, 27 nt, Human
gggagguggagguugcagugaaccaag

SEQ ID NO: 11913 - RNA, 22 nt, Human
cuccugagaccuccguccucug

SEQ ID NO: 11914 - RNA, 27 nt, Human
ugcagcucugcucucgggauggugcuu

SEQ ID NO: 11915 - RNA, 27 nt, Human
aguucucgauuugauccgcauccccug

SEQ ID NO: 11916 - RNA, 21 nt, Human
aacccuguaucuacuaaaaau

SEQ ID NO: 11917 - RNA, 20 nt, Human
uuucuuccuggcaucaugcc

SEQ ID NO: 11918 - RNA, 24 nt, Human
agcucgccugcugcccucuugcgc

SEQ ID NO: 11919 - RNA, 24 nt, Human
gaggaagaaauccagacccuagca

SEQ ID NO: 11920 - RNA, 22 nt, Human
uggcuaauacagugaaacccca

SEQ ID NO: 11921 - RNA, 27 nt, Human
auuguaucugacgcauccuguaauacu

SEQ ID NO: 11922 - RNA, 23 nt, Human
cuuaaaaaauucugaugaccggg

SEQ ID NO: 11923 - RNA, 20 nt, Human
acgagcccucacacaccugg

SEQ ID NO: 11924 - RNA, 25 nt, Human
ggcagcuguggccuaggcuaccuca

SEQ ID NO: 11925 - RNA, 21 nt, Human
uuaccugcaugcaggcaccag

SEQ ID NO: 11926 - RNA, 21 nt, Human
gucuguguccuugcugccuuc

SEQ ID NO: 11927 - RNA, 25 nt, Human
ggacaaugccacauacuuuguggau

SEQ ID NO: 11928 - RNA, 22 nt, Human
cgguaguggugcccacccugga

SEQ ID NO: 11929 - RNA, 26 nt, Human
accuccagagccaggguugugccuua

SEQ ID NO: 11930 - RNA, 27 nt, Human
ccaauacaaaauaacaaaaauguaaug

SEQ ID NO: 11931 - RNA, 21 nt, Human
ucacccaggcuagagugcagu

SEQ ID NO: 11932 - RNA, 21 nt, Human
ucuuugauaguuucugccuca

SEQ ID NO: 11933 - RNA, 18 nt, Human
cuccagccuuuuccuggc

SEQ ID NO: 11934 - RNA, 18 nt, Human
acuccugauaugucucuc

SEQ ID NO: 11935 - RNA, 27 nt, Human
gcucuuggcugcugcccuucugaggcc

SEQ ID NO: 11936 - RNA, 24 nt, Human
cagaaaugccuaaugguuucucua

SEQ ID NO: 11937 - RNA, 27 nt, Human
uggcgcacaccuguauucccaucuagu

SEQ ID NO: 11938 - RNA, 19 nt, Human
agcaguuuuaauaacuuua

SEQ ID NO: 11939 - RNA, 21 nt, Human
cccaauuauauucuaguuccu

SEQ ID NO: 11940 - RNA, 20 nt, Human
uuugcugacuugagcauuuu

SEQ ID NO: 11941 - RNA, 26 nt, Human
uccgcccucagccuccuggggacucg

SEQ ID NO: 11942 - RNA, 23 nt, Human
gugucagagacagaagggagcug

SEQ ID NO: 11943 - RNA, 26 nt, Human
cccuagcccugcuccaacuccauacu

SEQ ID NO: 11944 - RNA, 22 nt, Human
uauuaaaauaagcacugugcua

SEQ ID NO: 11945 - RNA, 22 nt, Human
aggcaaagagaaaagccacgga

SEQ ID NO: 11946 - RNA, 19 nt, Human
gcccaggcuggagcgcagu

SEQ ID NO: 11947 - RNA, 24 nt, Human
uacuuuuaccuuugucucuaaaga

SEQ ID NO: 11948 - RNA, 24 nt, Human
gacgugcacaaaccuucuuuucaa

SEQ ID NO: 11949 - RNA, 26 nt, Human
ugacccuuccaggcagacagccucag

SEQ ID NO: 11950 - RNA, 27 nt, Human
uuugggucucccauacugcguauagau

SEQ ID NO: 11951 - RNA, 26 nt, Human
gugaucauucaccaguacauucucag

SEQ ID NO: 11952 - RNA, 27 nt, Human
ggauacuuucacaauuucccuucauau

SEQ ID NO: 11953 - RNA, 22 nt, Human
gaugucuuuuccuucuccauca

SEQ ID NO: 11954 - RNA, 21 nt, Human
ucccuggguuugggagccagg

SEQ ID NO: 11955 - RNA, 22 nt, Human
gagggcagaggcuggaggcagg

SEQ ID NO: 11956 - RNA, 18 nt, Human
uccagaccccaugccuua

SEQ ID NO: 11957 - RNA, 23 nt, Human
cacucauauaaaggaagcaguca

SEQ ID NO: 11958 - RNA, 26 nt, Human
ggaggaguccaggccauggaggcaga

SEQ ID NO: 11959 - RNA, 21 nt, Human
augguuuuaaaacucuugagc

SEQ ID NO: 11960 - RNA, 26 nt, Human
ugauaacauggaaaauucaaggauug

SEQ ID NO: 11961 - RNA, 22 nt, Human
acuuguaaucccagcacuuuga

SEQ ID NO: 11962 - RNA, 27 nt, Human
gcuauguugauguguaagugaaaucag

SEQ ID NO: 11963 - RNA, 22 nt, Human
uuugggugggagggcugggaca

SEQ ID NO: 11964 - RNA, 22 nt, Human
aaaucuuuguuaugaucauguc

SEQ ID NO: 11965 - RNA, 19 nt, Human
uucuuauguuuaucuugcu

SEQ ID NO: 11966 - RNA, 23 nt, Human
uucaguuaucacaugugaaagcu

SEQ ID NO: 11967 - RNA, 17 nt, Human
ggccucggcccggagcg

SEQ ID NO: 11968 - RNA, 23 nt, Human
augccagccagggcccgggagag

SEQ ID NO: 11969 - RNA, 21 nt, Human
caguguuggcgguucuuagag

SEQ ID NO: 11970 - RNA, 21 nt, Human
cccuuucaucaucuuuuugcc

SEQ ID NO: 11971 - RNA, 24 nt, Human
ugagccauacacccuccauugcuu

SEQ ID NO: 11972 - RNA, 27 nt, Human
uggccaacauguuguaaaccccgucuc

SEQ ID NO: 11973 - RNA, 19 nt, Human
cauggggaggaaaaaggaa

SEQ ID NO: 11974 - RNA, 21 nt, Human
gaggucaggaguucaagacca

SEQ ID NO: 11975 - RNA, 28 nt, Human
ccgggcugguuucaaacuccugaccuca

SEQ ID NO: 11976 - RNA, 26 nt, Human
cccugccucugaccagucuguuccgg

SEQ ID NO: 11977 - RNA, 21 nt, Human
uuguauacacaugcugccuuc

SEQ ID NO: 11978 - RNA, 23 nt, Human
ugacaagagcgaaacuccaucuc

SEQ ID NO: 11979 - RNA, 22 nt, Human
auccuaccuggucccaucugcc

SEQ ID NO: 11980 - RNA, 27 nt, Human
caccuacuggaagugugaauuacuuga

SEQ ID NO: 11981 - RNA, 22 nt, Human
uuuucacuuucugucaauguca

SEQ ID NO: 11982 - RNA, 22 nt, Human
gcgucuccccucccggcgaucc

SEQ ID NO: 11983 - RNA, 24 nt, Human
aaauguuccucacucugcgaggcu

SEQ ID NO: 11984 - RNA, 29 nt, Human
ccucugagccauggugucgagugaagagu

SEQ ID NO: 11985 - RNA, 23 nt, Human
ucucugugucucuccaucauucc

SEQ ID NO: 11986 - RNA, 27 nt, Human
cacacagucuucacugugcugcagcca

SEQ ID NO: 11987 - RNA, 20 nt, Human
cuuaggcuggagugcagugg

SEQ ID NO: 11988 - RNA, 20 nt, Human
ccuaggcuggagugcagcgg

SEQ ID NO: 11989 - RNA, 23 nt, Human
cuggucaaucucuccacugaggc

SEQ ID NO: 11990 - RNA, 24 nt, Human
uccaggaaaaauguaagugugagg

SEQ ID NO: 11991 - RNA, 22 nt, Human
agggugucucacaaccaaccag

SEQ ID NO: 11992 - RNA, 22 nt, Human
ugccucacaugaaccaaagacu

SEQ ID NO: 11993 - RNA, 20 nt, Human
agcugcguccccaugaggag

SEQ ID NO: 11994 - RNA, 32 nt, Human
gaggagaaggcggcggcucucugguccgcagc

SEQ ID NO: 11995 - RNA, 21 nt, Human
ucaacuuggaaaacuuggaaa

SEQ ID NO: 11996 - RNA, 26 nt, Human
cagagggagagguucaggagucaggu

SEQ ID NO: 11997 - RNA, 26 nt, Human
uauguaugcuucuugucuugguuacu

SEQ ID NO: 11998 - RNA, 22 nt, Human
cccugcauuccagccuaggcga

SEQ ID NO: 11999 - RNA, 18 nt, Human
ccagggcuucuggaacac

SEQ ID NO: 12000 - RNA, 24 nt, Human
uggcacacagaguucauguuugcc

SEQ ID NO: 12001 - RNA, 22 nt, Human
cugcaaccucugccucccggau

SEQ ID NO: 12002 - RNA, 23 nt, Human
cuuccuuuucuuuuuccuuuugc

SEQ ID NO: 12003 - RNA, 26 nt, Human
aaacccaguggacugggcugggucug

SEQ ID NO: 12004 - RNA, 24 nt, Human
guuuggcugguuucucucacugaa

SEQ ID NO: 12005 - RNA, 22 nt, Human
agacggccaagggcagaggcau

SEQ ID NO: 12006 - RNA, 19 nt, Human
uagagauggaggaggaggc

SEQ ID NO: 12007 - RNA, 27 nt, Human
gggggcagaagauggaagcccuuggca

SEQ ID NO: 12008 - RNA, 20 nt, Human
aaaguugccgaagaugagac

SEQ ID NO: 12009 - RNA, 26 nt, Human
gcacccuucaagugggugugggugau

SEQ ID NO: 12010 - RNA, 25 nt, Human
ggacauaacuauuguaacuauucag

SEQ ID NO: 12011 - RNA, 25 nt, Human
ucugcucuggccaagccaccuccuc

SEQ ID NO: 12012 - RNA, 23 nt, Human
ggaugaaaauuuggaggaaaagu

SEQ ID NO: 12013 - RNA, 18 nt, Human
ugugccuggaugggggug

SEQ ID NO: 12014 - RNA, 27 nt, Human
cccuccagggugcccccggcuuucucc

SEQ ID NO: 12015 - RNA, 22 nt, Human
ucuuuuuauguggaaacugcua

SEQ ID NO: 12016 - RNA, 19 nt, Human
aagacuuguuuuccagaca

SEQ ID NO: 12017 - RNA, 23 nt, Human
cuugaugucuccauggugaccuc

SEQ ID NO: 12018 - RNA, 26 nt, Human
uuuuuggggaggaguugauaugcaac

SEQ ID NO: 12019 - RNA, 25 nt, Human
acauagugcuguuuauauaguuuag

SEQ ID NO: 12020 - RNA, 24 nt, Human
uuguccuagaugcuggagugagau

SEQ ID NO: 12021 - RNA, 22 nt, Human
guuuuucuguuuuguaaaucuu

SEQ ID NO: 12022 - RNA, 21 nt, Human
agauacuugccagucucucca

SEQ ID NO: 12023 - RNA, 22 nt, Human
aggggaucuggaagggccaagg

SEQ ID NO: 12024 - RNA, 22 nt, Human
ugcagugagcuaugauugugcc

SEQ ID NO: 12025 - RNA, 24 nt, Human
ggauggccgcugcucaggacacag

SEQ ID NO: 12026 - RNA, 26 nt, Human
gcccaggccuaagggcuauguuuggu

SEQ ID NO: 12027 - RNA, 27 nt, Human
ucauacagcacaagagaaaacuacuaa

SEQ ID NO: 12028 - RNA, 20 nt, Human
gcgcuguugcgaucuggacc

SEQ ID NO: 12029 - RNA, 22 nt, Human
guugcaaauaucuucucccaga

SEQ ID NO: 12030 - RNA, 26 nt, Human
gcauccaggcuggccagugcugccca

SEQ ID NO: 12031 - RNA, 18 nt, Human
guauuuuuagaauggcag

SEQ ID NO: 12032 - RNA, 24 nt, Human
gaaaugaggaggccaugcacaggg

SEQ ID NO: 12033 - RNA, 25 nt, Human
ugaggacaucugcaaugcuccagaa

SEQ ID NO: 12034 - RNA, 23 nt, Human
auugugauauuuuagcacuuugg

SEQ ID NO: 12035 - RNA, 23 nt, Human
ggggaaagagggaggcugaaaug

SEQ ID NO: 12036 - RNA, 24 nt, Human
gggugccaccaucggucuggcugc

SEQ ID NO: 12037 - RNA, 27 nt, Human
uggggggacugccuugucucuaguagu

SEQ ID NO: 12038 - RNA, 18 nt, Human
ucuccaccccgccgagcc

SEQ ID NO: 12039 - RNA, 18 nt, Human
cccggcugaagugcagug

SEQ ID NO: 12040 - RNA, 19 nt, Human
cugcagcucuguaaaugcc

SEQ ID NO: 12041 - RNA, 23 nt, Human
aauaagaaacauuuaccaaggga

SEQ ID NO: 12042 - RNA, 21 nt, Human
ggggugagcccccagagcugg

SEQ ID NO: 12043 - RNA, 21 nt, Human
ggugcuggugacuuucuguuc

SEQ ID NO: 12044 - RNA, 23 nt, Human
uaaaugcucauugaaacaaucag

SEQ ID NO: 12045 - RNA, 27 nt, Human
ugucuucuguccccaucuuccugccga

SEQ ID NO: 12046 - RNA, 27 nt, Human
cgggagggaggggugugcaggagccgc

SEQ ID NO: 12047 - RNA, 24 nt, Human
ggugaagaaaucaggggauugaga

SEQ ID NO: 12048 - RNA, 26 nt, Human
ugaagcccgggaggcuuggcgccggc

SEQ ID NO: 12049 - RNA, 22 nt, Human
gccugccuccagggcuggacug

SEQ ID NO: 12050 - RNA, 24 nt, Human
ugaugccgauauuuucuugcugga

SEQ ID NO: 12051 - RNA, 24 nt, Human
augcuuauuucugugccuacugua

SEQ ID NO: 12052 - RNA, 24 nt, Human
auuauuauaauaaaacaauguuug

SEQ ID NO: 12053 - RNA, 28 nt, Human
agguugcgccacuacacuccagccuggg

SEQ ID NO: 12054 - RNA, 22 nt, Human
acagauuguugagccuaccaua

SEQ ID NO: 12055 - RNA, 19 nt, Human
agugaaggcaagugcaaua

SEQ ID NO: 12056 - RNA, 22 nt, Human
gccuuccuuagcaucaguuuga

SEQ ID NO: 12057 - RNA, 21 nt, Human
ucucagccaguacaccagagc

SEQ ID NO: 12058 - RNA, 21 nt, Human
aaucuuuuucucuuuaucuuu

SEQ ID NO: 12059 - RNA, 26 nt, Human
auuuuucugauagaaaugguuuccuc

SEQ ID NO: 12060 - RNA, 25 nt, Human
cugcuacgagagaaggaaagagcga

SEQ ID NO: 12061 - RNA, 21 nt, Human
ccagauuuggugacucaucaa

SEQ ID NO: 12062 - RNA, 22 nt, Human
cucagccucccaaaaugcuggg

SEQ ID NO: 12063 - RNA, 27 nt, Human
ugggacccuccuuugaaacauccuuua

SEQ ID NO: 12064 - RNA, 32 nt, Human
ccauuugcagaguccugcacaguuuucuggcu

SEQ ID NO: 12065 - RNA, 16 nt, Human
ggcuacugugcauucc

SEQ ID NO: 12066 - RNA, 26 nt, Human
gcucucauguauuuuggaauuuucca

SEQ ID NO: 12067 - RNA, 25 nt, Human
caaauaaagaugcccuaaaugagug

SEQ ID NO: 12068 - RNA, 22 nt, Human
ucccuaucaguucuagcauagu

SEQ ID NO: 12069 - RNA, 21 nt, Human
caucagccacugaggccagug

SEQ ID NO: 12070 - RNA, 25 nt, Human
aaaauugagaaagaaguauauaugg

SEQ ID NO: 12071 - RNA, 17 nt, Human
ccaaacacuguugugcc

SEQ ID NO: 12072 - RNA, 22 nt, Human
ggcucacugcaacgucugccuc

SEQ ID NO: 12073 - RNA, 21 nt, Human
ccgguggagcuucaggucuug

SEQ ID NO: 12074 - RNA, 21 nt, Human
uucuagcugccuuuauucaca

SEQ ID NO: 12075 - RNA, 22 nt, Human
cucccaugucaucaccccacca

SEQ ID NO: 12076 - RNA, 27 nt, Human
ccacacugacggcaucuucccaguucc

SEQ ID NO: 12077 - RNA, 27 nt, Human
agguauuuacuguggagaacauugcau

SEQ ID NO: 12078 - RNA, 22 nt, Human
cacucuuuucucugugcauuuu

SEQ ID NO: 12079 - RNA, 22 nt, Human
ucuucuccgcguguggagggag

SEQ ID NO: 12080 - RNA, 26 nt, Human
ucuuccacucuggagugaaguuaaug

SEQ ID NO: 12081 - RNA, 22 nt, Human
gaguuuauuggaggaucaaaga

SEQ ID NO: 12082 - RNA, 23 nt, Human
acacuucagaagcaaugggggca

SEQ ID NO: 12083 - RNA, 22 nt, Human
gacuuuacaaaucacuuugcca

SEQ ID NO: 12084 - RNA, 20 nt, Human
agguuucagcacacaacuua

SEQ ID NO: 12085 - RNA, 19 nt, Human
gagaaagagaaugggagca

SEQ ID NO: 12086 - RNA, 24 nt, Human
acacuccucaagcucagugaaugu

SEQ ID NO: 12087 - RNA, 27 nt, Human
uggccaauauggagaaaccuugucucu

SEQ ID NO: 12088 - RNA, 26 nt, Human
gccugagcuccugaagaguuccuggg

SEQ ID NO: 12089 - RNA, 19 nt, Human
cgggccccaugcacccaac

SEQ ID NO: 12090 - RNA, 26 nt, Human
gcuuaucugaaaguagugcuuaaacc

SEQ ID NO: 12091 - RNA, 24 nt, Human
gggaggcggcacauuggcagugug

SEQ ID NO: 12092 - RNA, 22 nt, Human
uguccaggcuggagugcaauag

SEQ ID NO: 12093 - RNA, 31 nt, Human
gggguccaaggaagagaggguggccucgaca

SEQ ID NO: 12094 - RNA, 21 nt, Human
uccagaccuauguuggauguu

SEQ ID NO: 12095 - RNA, 26 nt, Human
agcuuccucaguuuccuacugccuua

SEQ ID NO: 12096 - RNA, 23 nt, Human
aggacaaccauuccagacugcuu

SEQ ID NO: 12097 - RNA, 22 nt, Human
uggagccaauggagacugucuc

SEQ ID NO: 12098 - RNA, 22 nt, Human
uggcaaaaagaaucccaauguu

SEQ ID NO: 12099 - RNA, 25 nt, Human
acacaaccccuucccccaauuuuug

SEQ ID NO: 12100 - RNA, 20 nt, Human
agaggugcagggaggaaggc

SEQ ID NO: 12101 - RNA, 26 nt, Human
uuuucugccuucccaggauucuuccu

SEQ ID NO: 12102 - RNA, 19 nt, Human
agccucucugggcacuugc

SEQ ID NO: 12103 - RNA, 24 nt, Human
ccaaagccaccaccguccuuccaa

SEQ ID NO: 12104 - RNA, 23 nt, Human
cgcucacugcaaccucugcuucc

SEQ ID NO: 12105 - RNA, 24 nt, Human
acauucuuaauaaacagccuuugu

SEQ ID NO: 12106 - RNA, 24 nt, Human
ucacccagggacacuccaacucua

SEQ ID NO: 12107 - RNA, 19 nt, Human
acaagugugugauguuaga

SEQ ID NO: 12108 - RNA, 21 nt, Human
cacugcacuccagccugggug

SEQ ID NO: 12109 - RNA, 22 nt, Human
aacugguuggagggaaggugaa

SEQ ID NO: 12110 - RNA, 21 nt, Human
ccagggaggccucucugcccu

SEQ ID NO: 12111 - RNA, 26 nt, Human
cuguuauuuccuaaucaaaaaggucu

SEQ ID NO: 12112 - RNA, 21 nt, Human
ugggcuuggucccaggagcag

SEQ ID NO: 12113 - RNA, 20 nt, Human
acugccucugccucccuggg

SEQ ID NO: 12114 - RNA, 28 nt, Human
cgcggacgacuggcugggcgcgaaucag

SEQ ID NO: 12115 - RNA, 25 nt, Human
ggcugggggcugccagccaggcuag

SEQ ID NO: 12116 - RNA, 21 nt, Human
ucauuuauuuugcuauacagg

SEQ ID NO: 12117 - RNA, 22 nt, Human
aauggguaccuguaauaauacu

SEQ ID NO: 12118 - RNA, 23 nt, Human
uauguaaacuugaaaaauauuuc

SEQ ID NO: 12119 - RNA, 22 nt, Human
gcaauacuggucaacuuaaggu

SEQ ID NO: 12120 - RNA, 20 nt, Human
ucagugugcccaucuguaaa

SEQ ID NO: 12121 - RNA, 22 nt, Human
ccugcugcuggugcacagccac

SEQ ID NO: 12122 - RNA, 21 nt, Human
uaagugcuuuaccuaaguguu

SEQ ID NO: 12123 - RNA, 27 nt, Human
uuccugggccuggcgggggaggcaggg

SEQ ID NO: 12124 - RNA, 21 nt, Human
cauguaaauagauauuacuuc

SEQ ID NO: 12125 - RNA, 27 nt, Human
gcuuugcagguuaucagagaucaaaga

SEQ ID NO: 12126 - RNA, 17 nt, Human
guggcaucuugccaagg

SEQ ID NO: 12127 - RNA, 32 nt, Human
cagagagaccugaguuugugcuguagacaaaa

SEQ ID NO: 12128 - RNA, 24 nt, Human
cuucucuccauccuuggaccuuca

SEQ ID NO: 12129 - RNA, 23 nt, Human
cacagagauaauucuagcuuuga

SEQ ID NO: 12130 - RNA, 22 nt, Human
ggaggcugaggcacaagaauca

SEQ ID NO: 12131 - RNA, 23 nt, Human
uauucuucuacugcccuuaacuc

SEQ ID NO: 12132 - RNA, 26 nt, Human
ucucacagucaaaaggaacugggugg

SEQ ID NO: 12133 - RNA, 22 nt, Human
caccuguaaugccagcccuuug

SEQ ID NO: 12134 - RNA, 22 nt, Human
ugucuucagcgugaacuaaagu

SEQ ID NO: 12135 - RNA, 17 nt, Human
gacacccacagacuuca

SEQ ID NO: 12136 - RNA, 22 nt, Human
cccucauuuaugauuccugcca

SEQ ID NO: 12137 - RNA, 27 nt, Human
agaagcagccagacuugcuuugugaac

SEQ ID NO: 12138 - RNA, 23 nt, Human
guugcccaggcuggcgugcagug

SEQ ID NO: 12139 - RNA, 22 nt, Human
ggcaaggacagggcuuuggaau

SEQ ID NO: 12140 - RNA, 18 nt, Human
aggcagcugcgcgcggcu

SEQ ID NO: 12141 - RNA, 21 nt, Human
cuggcugaagcuaggcauuca

SEQ ID NO: 12142 - RNA, 18 nt, Human
ccgcacugggcuugggga

SEQ ID NO: 12143 - RNA, 23 nt, Human
accugcccugugcccccuccucc

SEQ ID NO: 12144 - RNA, 20 nt, Human
ugcuggcauccugcuucccc

SEQ ID NO: 12145 - RNA, 19 nt, Human
acuguucaaaaauagacug

SEQ ID NO: 12146 - RNA, 21 nt, Human
cuacuagguggcugugauuaa

SEQ ID NO: 12147 - RNA, 22 nt, Human
uguggaggaggaagaugggagc

SEQ ID NO: 12148 - RNA, 19 nt, Human
ggaggcuccuggggugggg

SEQ ID NO: 12149 - RNA, 27 nt, Human
gaagaauauauugucagaaacacaagg

SEQ ID NO: 12150 - RNA, 20 nt, Human
aggccagcugugguuuucuu

SEQ ID NO: 12151 - RNA, 20 nt, Human
ccagccgcauuucagcagug

SEQ ID NO: 12152 - RNA, 16 nt, Human
gauggcagaacccacc

SEQ ID NO: 12153 - RNA, 22 nt, Human
agccuaaauuuguauuuuuuga

SEQ ID NO: 12154 - RNA, 21 nt, Human
uggaugggaacgcaagagaua

SEQ ID NO: 12155 - RNA, 20 nt, Human
caggaccugcggcggcggcg

SEQ ID NO: 12156 - RNA, 24 nt, Human
agcauuuuuccaucaguuucuuua

SEQ ID NO: 12157 - RNA, 22 nt, Human
ugcagaggugccagcugccauu

SEQ ID NO: 12158 - RNA, 20 nt, Human
ccacagcugcugcucacuua

SEQ ID NO: 12159 - RNA, 22 nt, Human
uggugcacaccugugaucccag

SEQ ID NO: 12160 - RNA, 21 nt, Human
cagguucugaaaauauugugc

SEQ ID NO: 12161 - RNA, 26 nt, Human
cccugccuccggcccagcaugcgccu

SEQ ID NO: 12162 - RNA, 28 nt, Human
accacguugggacagggaggugugaggc

SEQ ID NO: 12163 - RNA, 19 nt, Human
cagugccagcaccugccca

SEQ ID NO: 12164 - RNA, 20 nt, Human
gcaugaugcuuucacacaca

SEQ ID NO: 12165 - RNA, 21 nt, Human
guauaagcaucucccaucugc

SEQ ID NO: 12166 - RNA, 23 nt, Human
aauuauacuagauggaagacuug

SEQ ID NO: 12167 - RNA, 24 nt, Human
auugguuuuaugaugacguacaag

SEQ ID NO: 12168 - RNA, 26 nt, Human
uacuccugcucugcuaacccugcgug

SEQ ID NO: 12169 - RNA, 25 nt, Human
aaucaggaaaaauagcuuuugacag

SEQ ID NO: 12170 - RNA, 21 nt, Human
uccaggcccagauaacuuucg

SEQ ID NO: 12171 - RNA, 28 nt, Human
aaagucagaccuguuucuuguaacuggg

SEQ ID NO: 12172 - RNA, 22 nt, Human
ugcuuuugugccaucuauuccu

SEQ ID NO: 12173 - RNA, 26 nt, Human
cagcccagucccccucacugcuugag

SEQ ID NO: 12174 - RNA, 24 nt, Human
uugcaauggcuauauggcaagaaa

SEQ ID NO: 12175 - RNA, 21 nt, Human
ccauuguacuaggccauucca

SEQ ID NO: 12176 - RNA, 20 nt, Human
ucugucacuugucauggucu

SEQ ID NO: 12177 - RNA, 28 nt, Human
gcaaugcuuaaccccaggaagauuucaa

SEQ ID NO: 12178 - RNA, 17 nt, Human
ggucucaagugacuuca

SEQ ID NO: 12179 - RNA, 23 nt, Human
ggccagacggcacgaggucucca

SEQ ID NO: 12180 - RNA, 23 nt, Human
gccuggaugggcuucacuggggc

SEQ ID NO: 12181 - RNA, 22 nt, Human
uuagguagcugguuguacaucu

SEQ ID NO: 12182 - RNA, 29 nt, Human
ugcucuucccacuccagcugacagccaca

SEQ ID NO: 12183 - RNA, 25 nt, Human
cugcugcgccgugccucacacagcc

SEQ ID NO: 12184 - RNA, 22 nt, Human
uuuccuggcugaaguuucucuu

SEQ ID NO: 12185 - RNA, 20 nt, Human
ccaaagcucaaaacaaucaa

SEQ ID NO: 12186 - RNA, 22 nt, Human
caucagaaagaauaaaauagga

SEQ ID NO: 12187 - RNA, 30 nt, Human
gcuucauaguauuggagcacauguuacugc

SEQ ID NO: 12188 - RNA, 24 nt, Human
gcagggagggggcgcgggagccgc

SEQ ID NO: 12189 - RNA, 30 nt, Human
ccugcccccuugggugccucuuguaccccc

SEQ ID NO: 12190 - RNA, 20 nt, Human
cagacuucaguguauaccca

SEQ ID NO: 12191 - RNA, 20 nt, Human
gggaagugccuacucucugg

SEQ ID NO: 12192 - RNA, 26 nt, Human
aggaagagaauggcugccaguggcug

SEQ ID NO: 12193 - RNA, 27 nt, Human
agaucauaguuauuauacaauguagug

SEQ ID NO: 12194 - RNA, 26 nt, Human
cggaagacauggauugucuggaagau

SEQ ID NO: 12195 - RNA, 21 nt, Human
ggagagaaggauggacuccag

SEQ ID NO: 12196 - RNA, 22 nt, Human
gcacggugcacagcccaccaga

SEQ ID NO: 12197 - RNA, 21 nt, Human
gggacggcucacagggcuugg

SEQ ID NO: 12198 - RNA, 22 nt, Human
cucugcauucugcacagagccg

SEQ ID NO: 12199 - RNA, 22 nt, Human
uguaacugucaguuugcacugg

SEQ ID NO: 12200 - RNA, 22 nt, Human
cgagggaggggcguggggaagg

SEQ ID NO: 12201 - RNA, 23 nt, Human
ccaggacaugaagaaaaggaaau

SEQ ID NO: 12202 - RNA, 22 nt, Human
uacucagguggcuaaggcagga

SEQ ID NO: 12203 - RNA, 26 nt, Human
agcuuccuucaggacccugcuucuga

SEQ ID NO: 12204 - RNA, 26 nt, Human
ugagccaggaggccggugcugggcca

SEQ ID NO: 12205 - RNA, 22 nt, Human
cuccucccccuccucucuggca

SEQ ID NO: 12206 - RNA, 20 nt, Human
auaaaguuuuacugauuuuu

SEQ ID NO: 12207 - RNA, 20 nt, Human
uagaccugcagauguguaca

SEQ ID NO: 12208 - RNA, 24 nt, Human
ucccuugcgccucagcaguuugca

SEQ ID NO: 12209 - RNA, 22 nt, Human
cguuuuguugcccugguauuug

SEQ ID NO: 12210 - RNA, 24 nt, Human
cucagauuucucacauccugccca

SEQ ID NO: 12211 - RNA, 23 nt, Human
ggccuguaaucccagcauuuugg

SEQ ID NO: 12212 - RNA, 22 nt, Human
guuccccaggcucacaguguag

SEQ ID NO: 12213 - RNA, 23 nt, Human
ugaggggaaagaggaucuuccag

SEQ ID NO: 12214 - RNA, 19 nt, Human
uacaagcuuuuaacuuuuu

SEQ ID NO: 12215 - RNA, 22 nt, Human
ggagguggggguggggguaguu

SEQ ID NO: 12216 - RNA, 24 nt, Human
cuguuauaguuggcggcaguauua

SEQ ID NO: 12217 - RNA, 20 nt, Human
agggagaaacguuauacucc

SEQ ID NO: 12218 - RNA, 26 nt, Human
cugcaaccuagcagcaggugaccuug

SEQ ID NO: 12219 - RNA, 22 nt, Human
uuugaaaguucucuuuuugaaa

SEQ ID NO: 12220 - RNA, 27 nt, Human
ucaggucucagugucccuaucuguaag

SEQ ID NO: 12221 - RNA, 27 nt, Human
auugagucuucauguucccacuucaaa

SEQ ID NO: 12222 - RNA, 23 nt, Human
gaccucaugaucugcccaccucg

SEQ ID NO: 12223 - RNA, 23 nt, Human
gaccucgugaucugcccaccuca

SEQ ID NO: 12224 - RNA, 22 nt, Human
ccgaguagcugggauuacaggc

SEQ ID NO: 12225 - RNA, 22 nt, Human
cugaguagcugggauuauaggc

SEQ ID NO: 12226 - RNA, 22 nt, Human
cccuuugaguguuuuaacuggu

SEQ ID NO: 12227 - RNA, 18 nt, Human
ggugguuaggaaugugau

SEQ ID NO: 12228 - RNA, 27 nt, Human
agcauuuuaaaagcccuuuuuaaaaac

SEQ ID NO: 12229 - RNA, 25 nt, Human
uucuccucuuguuuuccuuuugggc

SEQ ID NO: 12230 - RNA, 22 nt, Human
aagacccuguguucauuuggug

SEQ ID NO: 12231 - RNA, 27 nt, Human
ugcccugccacuuugcaugguuugauu

SEQ ID NO: 12232 - RNA, 20 nt, Human
uccagcugccuauugauuua

SEQ ID NO: 12233 - RNA, 22 nt, Human
agaccagccugggcaacauagg

SEQ ID NO: 12234 - RNA, 21 nt, Human
aggccuggccccuuccugugc

SEQ ID NO: 12235 - RNA, 26 nt, Human
caggcuuagugugaggacgagcuuga

SEQ ID NO: 12236 - RNA, 27 nt, Human
gccaagcaccagcuuuccagucccuuc

SEQ ID NO: 12237 - RNA, 22 nt, Human
augugagugaccucacuucugg

SEQ ID NO: 12238 - RNA, 22 nt, Human
uguauaugaauaaguaucagac

SEQ ID NO: 12239 - RNA, 26 nt, Human
ccucccggcccugccugcuggugggc

SEQ ID NO: 12240 - RNA, 22 nt, Human
cuuuauuuuuccacaucaugcu

SEQ ID NO: 12241 - RNA, 27 nt, Human
ucaucccucgcagcagucuccaggcga

SEQ ID NO: 12242 - RNA, 20 nt, Human
uguuuugaacuaauucuggu

SEQ ID NO: 12243 - RNA, 25 nt, Human
uccccagcuccccaggacucacccu

SEQ ID NO: 12244 - RNA, 22 nt, Human
aaaguccugggauuacaggugu

SEQ ID NO: 12245 - RNA, 27 nt, Human
gcccagccugcacgucugucccucucu

SEQ ID NO: 12246 - RNA, 22 nt, Human
uccagugagcauugugguaguu

SEQ ID NO: 12247 - RNA, 21 nt, Human
gggcccaggaggucagguuca

SEQ ID NO: 12248 - RNA, 27 nt, Human
ccacugcaaaccggcacugaagggcug

SEQ ID NO: 12249 - RNA, 22 nt, Human
aaugccaauccuccauucuucc

SEQ ID NO: 12250 - RNA, 25 nt, Human
aaggaauucgggcuuucauugucua

SEQ ID NO: 12251 - RNA, 21 nt, Human
aucagaggccaugacuuuucc

SEQ ID NO: 12252 - RNA, 26 nt, Human
uugccucucuuugacaccuguuuuag

SEQ ID NO: 12253 - RNA, 26 nt, Human
aggccugaccacagauucccagaggg

SEQ ID NO: 12254 - RNA, 19 nt, Human
cuccagccucuccagugcu

SEQ ID NO: 12255 - RNA, 23 nt, Human
ccagaagccugggcuuagggugg

SEQ ID NO: 12256 - RNA, 28 nt, Human
ccaccagccaugagugggugacgcugag

SEQ ID NO: 12257 - RNA, 24 nt, Human
ucuagaacagugucauccaacaua

SEQ ID NO: 12258 - RNA, 22 nt, Human
ugugagccagcggggggugcau

SEQ ID NO: 12259 - RNA, 26 nt, Human
gcacucuccacccuggcugggaucag

SEQ ID NO: 12260 - RNA, 23 nt, Human
cugcacacaccagaaauggacau

SEQ ID NO: 12261 - RNA, 21 nt, Human
acacauuucacauugaaucau

SEQ ID NO: 12262 - RNA, 27 nt, Human
ugguggagacaaugggaagaccaugcu

SEQ ID NO: 12263 - RNA, 27 nt, Human
uuuucuuuacuguaugaaaacaggaaa

SEQ ID NO: 12264 - RNA, 21 nt, Human
uuugggaggcuaaggugggug

SEQ ID NO: 12265 - RNA, 24 nt, Human
ccuacuccaccuguuacuacuucu

SEQ ID NO: 12266 - RNA, 25 nt, Human
caggaucauucuuccccuccuccag

SEQ ID NO: 12267 - RNA, 21 nt, Human
ccuuugugcucccaccucuuc

SEQ ID NO: 12268 - RNA, 21 nt, Human
acacuugccacacugugucgu

SEQ ID NO: 12269 - RNA, 30 nt, Human; identical to SEQ ID NO: 5352

SEQ ID NO: 12270 - RNA, 20 nt, Human
cagcccaguccacaccagag

SEQ ID NO: 12271 - RNA, 23 nt, Human
uuccuaagcugccaccucugugu

SEQ ID NO: 12272 - RNA, 22 nt, Human
guggagguggagccugcggcug

SEQ ID NO: 12273 - RNA, 23 nt, Human
agagaggcagagagcagggcagc

SEQ ID NO: 12274 - RNA, 19 nt, Human
uuguuuugaacuauacugc

SEQ ID NO: 12275 - RNA, 17 nt, Human
gaccagccuguguagug

SEQ ID NO: 12276 - RNA, 27 nt, Human
caggcuggagugcaguggcacgaucau

SEQ ID NO: 12277 - RNA, 25 nt, Human
ucuaaucugccuaucaaucuaucua

SEQ ID NO: 12278 - RNA, 25 nt, Human
aucuguuuuuucacacugauccgua

SEQ ID NO: 12279 - RNA, 20 nt, Human
ucauuacagugugagcugcc

SEQ ID NO: 12280 - RNA, 21 nt, Human
auggguggaaugauggcagaa

SEQ ID NO: 12281 - RNA, 19 nt, Human
ugagacuaauauaggccau

SEQ ID NO: 12282 - RNA, 21 nt, Human
ccucaacugacaugaaauacu

SEQ ID NO: 12283 - RNA, 23 nt, Human
uccuggcucaagaauuacuccga

SEQ ID NO: 12284 - RNA, 23 nt, Human
agagcauaucuguuauauguuua

SEQ ID NO: 12285 - RNA, 21 nt, Human
uugauuuaaaauaaaauagcu

SEQ ID NO: 12286 - RNA, 22 nt, Human
gcaaucuuggcugaugugcaca

SEQ ID NO: 12287 - RNA, 21 nt, Human
acauuuauuuuuucaggauga

SEQ ID NO: 12288 - RNA, 25 nt, Human
gggcgccaagacucaggggaucggc

SEQ ID NO: 12289 - RNA, 20 nt, Human
uggagagagcagacuggcgg

SEQ ID NO: 12290 - RNA, 21 nt, Human
uauuugggcuguggcgugagg

SEQ ID NO: 12291 - RNA, 27 nt, Human
ugcagugagccgagaucgucccacugc

SEQ ID NO: 12292 - RNA, 21 nt, Human
uaucugugcuauugcaaacac

SEQ ID NO: 12293 - RNA, 23 nt, Human
uaggggguagggggagccugggu

SEQ ID NO: 12294 - RNA, 20 nt, Human
cgugcuuguaaugcucacuu

SEQ ID NO: 12295 - RNA, 22 nt, Human
gcaccuuaaaagacagcuagau

SEQ ID NO: 12296 - RNA, 22 nt, Human
ccaagcccccagccccgaucug

SEQ ID NO: 12297 - RNA, 22 nt, Human
uccucacuccaggacugccaga

SEQ ID NO: 12298 - RNA, 27 nt, Human
ugggaggcagagggcagcuacugcagg

SEQ ID NO: 12299 - RNA, 22 nt, Human
gcggucaaccacggucugacaa

SEQ ID NO: 12300 - RNA, 24 nt, Human
ucucucuuccuuuuggagauuagg

SEQ ID NO: 12301 - RNA, 26 nt, Human
uauccacccucugcauccccuuggcc

SEQ ID NO: 12302 - RNA, 22 nt, Human
gcucacugcaagcuccgccucc

SEQ ID NO: 12303 - RNA, 23 nt, Human
ggagaagaguccucaaugagccu

SEQ ID NO: 12304 - RNA, 27 nt, Human
gagacaaaacuccuacucucaaccuca

SEQ ID NO: 12305 - RNA, 22 nt, Human
ugcagugagccaagauugcgcc

SEQ ID NO: 12306 - RNA, 22 nt, Human
ugcggugagccgagauugcgcc

SEQ ID NO: 12307 - RNA, 24 nt, Human
cuuuaaaauauuggguuguuuucu

SEQ ID NO: 12308 - RNA, 27 nt, Human
ggagucaggacaaauggaucgggcugc

SEQ ID NO: 12309 - RNA, 31 nt, Human
augccauuguuuuaaggaaauacacagugaa

SEQ ID NO: 12310 - RNA, 19 nt, Human
aaaugcauucauacaauua

SEQ ID NO: 12311 - RNA, 23 nt, Human
cucaggcuggagugcaguggcac

SEQ ID NO: 12312 - RNA, 19 nt, Human
uccuagaggguaaauauga

SEQ ID NO: 12313 - RNA, 30 nt, Human
gggagagccuguggcccaccuuggccuugc

SEQ ID NO: 12314 - RNA, 26 nt, Human
acaggcugggacugaggaaaggauaa

SEQ ID NO: 12315 - RNA, 21 nt, Human
cgcucacaccuguaaucucag

SEQ ID NO: 12316 - RNA, 20 nt, Human
uguucaaguuaaucaacauc

SEQ ID NO: 12317 - RNA, 22 nt, Human
uggugugcgccuguaaucccag

SEQ ID NO: 12318 - RNA, 20 nt, Human
cucugcacacccuccagaga

SEQ ID NO: 12319 - RNA, 19 nt, Human
ugaacaacuuuuccacuuu

SEQ ID NO: 12320 - RNA, 22 nt, Human
cuguucccacgcuuccucucuc

SEQ ID NO: 12321 - RNA, 28 nt, Human
gggggaagaagagagggugggagauucu

SEQ ID NO: 12322 - RNA, 21 nt, Human
agauauaaaacaguuuuguca

SEQ ID NO: 12323 - RNA, 23 nt, Human
ucgaguacagagucuccgaggcc

SEQ ID NO: 12324 - RNA, 23 nt, Human
gcucgcuccgccccuccuuccca

SEQ ID NO: 12325 - RNA, 18 nt, Human
cuagcugcuccucucaca

SEQ ID NO: 12326 - RNA, 22 nt, Human
agaccagcagagacugcuguga

SEQ ID NO: 12327 - RNA, 27 nt, Human
uuggaaccugucuuuggccacauaggg

SEQ ID NO: 12328 - RNA, 23 nt, Human
uguccucuuugagaaaauguaaa

SEQ ID NO: 12329 - RNA, 19 nt, Human
guuucuccaaaagugguca

SEQ ID NO: 12330 - RNA, 24 nt, Human
ccggcugucugcacauuuuuugua

SEQ ID NO: 12331 - RNA, 18 nt, Human
gccacuuauucaccagag

SEQ ID NO: 12332 - RNA, 25 nt, Human
uacaaacucacaggucagaaaaacc

SEQ ID NO: 12333 - RNA, 28 nt, Human
ggaucuuggcaugcacccaccuaaccca

SEQ ID NO: 12334 - RNA, 23 nt, Human
ccagcucaccuggccagaguggg

SEQ ID NO: 12335 - RNA, 27 nt, Human
ccucuccaggcucugcucugcagcaca

SEQ ID NO: 12336 - RNA, 28 nt, Human
acagccacuacugacugcagccagccac

SEQ ID NO: 12337 - RNA, 21 nt, Human
ccuuaaugaagagccagccca

SEQ ID NO: 12338 - RNA, 22 nt, Human
aggcugaggcaguagaaucgcu

SEQ ID NO: 12339 - RNA, 21 nt, Human
aguagcugggacuacaggcau

SEQ ID NO: 12340 - RNA, 23 nt, Human
ugauggagggagggggaagucga

SEQ ID NO: 12341 - RNA, 23 nt, Human
cugcuucugcucccuggggcaua

SEQ ID NO: 12342 - RNA, 23 nt, Human
caugccuuaaaccuaccucccac

SEQ ID NO: 12343 - RNA, 23 nt, Human
cucaggugauccuccugccucgg

SEQ ID NO: 12344 - RNA, 24 nt, Human
gccaaacccuugcuuuccugggcc

SEQ ID NO: 12345 - RNA, 21 nt, Human
guuggaggcuggagcgcaaug

SEQ ID NO: 12346 - RNA, 19 nt, Human
aagccaucauauuacuugg

SEQ ID NO: 12347 - RNA, 23 nt, Human
gacgcagccaccuuccucaccag

SEQ ID NO: 12348 - RNA, 25 nt, Human
gcccaggcuggagugcaguagcacg

SEQ ID NO: 12349 - RNA, 25 nt, Human
gcccaggcuggggugcaguggcacg

SEQ ID NO: 12350 - RNA, 26 nt, Human
ccugccugccccuuccucccagcuuc

SEQ ID NO: 12351 - RNA, 20 nt, Human
cguccagccaagagcucuuc

SEQ ID NO: 12352 - RNA, 20 nt, Human
accuucaccugcauugguuu

SEQ ID NO: 12353 - RNA, 25 nt, Human
ggguagacguguggggaaaauaaau

SEQ ID NO: 12354 - RNA, 20 nt, Human
cccagacccuggcuggccag

SEQ ID NO: 12355 - RNA, 27 nt, Human
accaucauccugguaaaucccagugca

SEQ ID NO: 12356 - RNA, 22 nt, Human
gggcuggaggcagggagacacu

SEQ ID NO: 12357 - RNA, 22 nt, Human
uggucucaaacucccgaccuca

SEQ ID NO: 12358 - RNA, 22 nt, Human
uugaggcuagacccaugaucac

SEQ ID NO: 12359 - RNA, 32 nt, Human
uauauucauuucguugguuucucuccugccca

SEQ ID NO: 12360 - RNA, 23 nt, Human
gucugccauggacugugcacuuu

SEQ ID NO: 12361 - RNA, 24 nt, Human
aacagguuuccaggagaugguaga

SEQ ID NO: 12362 - RNA, 21 nt, Human
aguagagucugacugcaguuu

SEQ ID NO: 12363 - RNA, 25 nt, Human
ggagagggguggcgggcccgacagc

SEQ ID NO: 12364 - RNA, 23 nt, Human
ugcugaugcaauaguccuguguc

SEQ ID NO: 12365 - RNA, 21 nt, Human
uggcuuuuauucccugccuuu

SEQ ID NO: 12366 - RNA, 21 nt, Human
uuugcuuuuucccugccuguc

SEQ ID NO: 12367 - RNA, 24 nt, Human
gggcggaggcaaagggggagccag

SEQ ID NO: 12368 - RNA, 20 nt, Human
gugcccgguuuuacucucau

SEQ ID NO: 12369 - RNA, 19 nt, Human
cgcaaccaccaccaaccac

SEQ ID NO: 12370 - RNA, 26 nt, Human
ggagaaagggaagucaggguucuagg

SEQ ID NO: 12371 - RNA, 24 nt, Human
ccugucugcucacuucuagcuauu

SEQ ID NO: 12372 - RNA, 31 nt, Human
uuuucuuucuuucuuuguaaauaguucugag

SEQ ID NO: 12373 - RNA, 21 nt, Human
agcugugucuuguucaugccc

SEQ ID NO: 12374 - RNA, 28 nt, Human
cuguuccucuguggugucugucaguccg

SEQ ID NO: 12375 - RNA, 20 nt, Human
gugaagcccgcggcgccuag

SEQ ID NO: 12376 - RNA, 21 nt, Human
agaggcggagguugcagugag

SEQ ID NO: 12377 - RNA, 26 nt, Human
gcugcuggcaggugggccugccugug

SEQ ID NO: 12378 - RNA, 22 nt, Human
cccucaucugcaucuucagauc

SEQ ID NO: 12379 - RNA, 19 nt, Human
ucaacauggagccuugccu

SEQ ID NO: 12380 - RNA, 21 nt, Human
caaacuucccugaauugcagu

SEQ ID NO: 12381 - RNA, 23 nt, Human
ccccagccccagcucccuccggc

SEQ ID NO: 12382 - RNA, 23 nt, Human
guguggguggcgggugcacagag

SEQ ID NO: 12383 - RNA, 23 nt, Human
cauguuauuucagaauuaugcaa

SEQ ID NO: 12384 - RNA, 21 nt, Human
gauuguuccaacacuuguuuc

SEQ ID NO: 12385 - RNA, 26 nt, Human
cuggagagcucacagacuuaacagcc

SEQ ID NO: 12386 - RNA, 20 nt, Human
uguguauguaacuuaucacu

SEQ ID NO: 12387 - RNA, 21 nt, Human
uguccccgccucaguccccgc

SEQ ID NO: 12388 - RNA, 21 nt, Human
uaccucuuucucucuccugua

SEQ ID NO: 12389 - RNA, 23 nt, Human
uccuuuuuaauguguauuacaaa

SEQ ID NO: 12390 - RNA, 23 nt, Human
agagacacgggcugcggcgcggc

SEQ ID NO: 12391 - RNA, 26 nt, Human
gggaaugggguacuugggaauccgga

SEQ ID NO: 12392 - RNA, 24 nt, Human
cuccacacccucuggccuucugcc

SEQ ID NO: 12393 - RNA, 20 nt, Human
agcccuuuuaaaguucuauc

SEQ ID NO: 12394 - RNA, 20 nt, Human
uuggcauugguuucuucuca

SEQ ID NO: 12395 - RNA, 22 nt, Human
uccugugaggagccccaucugu

SEQ ID NO: 12396 - RNA, 23 nt, Human
gacaauguccaagacacagcaga

SEQ ID NO: 12397 - RNA, 23 nt, Human
ccugcauccagcuucccugccaa

SEQ ID NO: 12398 - RNA, 22 nt, Human
cacgccuguaauuccaucauuu

SEQ ID NO: 12399 - RNA, 25 nt, Human
ucuaccccccaggcugaagugcagu

SEQ ID NO: 12400 - RNA, 27 nt, Human
gagugggccggggaggcugggagccgg

SEQ ID NO: 12401 - RNA, 24 nt, Human
guuguaauagccuuuccuuacugu

SEQ ID NO: 12402 - RNA, 22 nt, Human
acucuuuuggacaaaggaauca

SEQ ID NO: 12403 - RNA, 18 nt, Human
ggguaggggccaggcuag

SEQ ID NO: 12404 - RNA, 21 nt, Human
cuguuccccaacuuuucuccc

SEQ ID NO: 12405 - RNA, 26 nt, Human
cugcuccaucaugcuugauugagugc

SEQ ID NO: 12406 - RNA, 25 nt, Human
gugggaugucagaacauccaaguca

SEQ ID NO: 12407 - RNA, 22 nt, Human
ugguccaccuccugagccccuc

SEQ ID NO: 12408 - RNA, 23 nt, Human
ggcucacagugcaaccucugcuu

SEQ ID NO: 12409 - RNA, 22 nt, Human
ccacccuagcaagugcccugca

SEQ ID NO: 12410 - RNA, 21 nt, Human
ggagcagggacggagggggag

SEQ ID NO: 12411 - RNA, 22 nt, Human
ggccaccaccuccugcuccuga

SEQ ID NO: 12412 - RNA, 21 nt, Human
ucugcugucugaagaucuuuc

SEQ ID NO: 12413 - RNA, 25 nt, Human
uuugggcuuucagauuucucuuuuu

SEQ ID NO: 12414 - RNA, 22 nt, Human
agaccugagccacacccaggcc

SEQ ID NO: 12415 - RNA, 22 nt, Human
guauuuauacuucauuuuguga

SEQ ID NO: 12416 - RNA, 23 nt, Human
cuuuuauggcaucuaucuugaaa

SEQ ID NO: 12417 - RNA, 27 nt, Human
gucucaaacuccugggcucaagugauc

SEQ ID NO: 12418 - RNA, 17 nt, Human
cuucccuuuuguuuaca

SEQ ID NO: 12419 - RNA, 21 nt, Human
cccuaccuugaaaagaagguu

SEQ ID NO: 12420 - RNA, 23 nt, Human
gggccuugaugaaauaacacagc

SEQ ID NO: 12421 - RNA, 22 nt, Human
cuuacuuccuguucaucucuaa

SEQ ID NO: 12422 - RNA, 25 nt, Human
ucagugguuuguuccuucuuauuuc

SEQ ID NO: 12423 - RNA, 21 nt, Human
agcuauaaucucagcacuuug

SEQ ID NO: 12424 - RNA, 26 nt, Human
cuucugcucuccucagaggucccggg

SEQ ID NO: 12425 - RNA, 26 nt, Human
gugcaaccucugucugacccugcaug

SEQ ID NO: 12426 - RNA, 21 nt, Human
ggagagggaagaugggcccca

SEQ ID NO: 12427 - RNA, 23 nt, Human
cauagcuccuagcacagugccuu

SEQ ID NO: 12428 - RNA, 26 nt, Human
ccccaucccugggcuggaggacccgc

SEQ ID NO: 12429 - RNA, 21 nt, Human
augacuucugccauuucaaag

SEQ ID NO: 12430 - RNA, 21 nt, Human
uuugguggggauggggaggcc

SEQ ID NO: 12431 - RNA, 23 nt, Human
uacuauacugugguuuguuuucc

SEQ ID NO: 12432 - RNA, 20 nt, Human
ggugcgcuccagccgggcag

SEQ ID NO: 12433 - RNA, 22 nt, Human
ccgcccaggcugcagugcagug

SEQ ID NO: 12434 - RNA, 23 nt, Human
gcucauacccuguccuuucuccc

SEQ ID NO: 12435 - RNA, 24 nt, Human
gcacagaaggaaaaauaaaaagaa

SEQ ID NO: 12436 - RNA, 20 nt, Human
gcuuauacugcuguaauauu

SEQ ID NO: 12437 - RNA, 24 nt, Human
ucacauuuaauuuauaaaguuaac

SEQ ID NO: 12438 - RNA, 24 nt, Human
ugugaaaggcaucucagcggcugc

SEQ ID NO: 12439 - RNA, 20 nt, Human
ucauaagacuuaauuuguac

SEQ ID NO: 12440 - RNA, 27 nt, Human
aaccaaaacauaaacucaugucugugu

SEQ ID NO: 12441 - RNA, 22 nt, Human
aaagugcugggaugacaggugu

SEQ ID NO: 12442 - RNA, 19 nt, Human
caucagauggaagcuuacu

SEQ ID NO: 12443 - RNA, 20 nt, Human
ggagacggagguugcaguga

SEQ ID NO: 12444 - RNA, 27 nt, Human
ucguggaagaagggccacccugagcag

SEQ ID NO: 12445 - RNA, 23 nt, Human
ccacuguccacacacugccuccc

SEQ ID NO: 12446 - RNA, 23 nt, Human
cucagcuuccugaagugcuggga

SEQ ID NO: 12447 - RNA, 22 nt, Human
uacauuucucauaccuucccca

SEQ ID NO: 12448 - RNA, 22 nt, Human
uuucucggcaccagugccucag

SEQ ID NO: 12449 - RNA, 29 nt, Human
gaaagucagaccuguuucuuguaacuggg

SEQ ID NO: 12450 - RNA, 22 nt, Human
gacuuaugguuggucauauaga

SEQ ID NO: 12451 - RNA, 20 nt, Human
ggacacgccgucuguccuca

SEQ ID NO: 12452 - RNA, 15 nt, Human
accauaaaauccuga

SEQ ID NO: 12453 - RNA, 22 nt, Human
gcucaccgcaaccucugccucc

SEQ ID NO: 12454 - RNA, 21 nt, Human
ugggggagagaagggcagcag

SEQ ID NO: 12455 - RNA, 28 nt, Human
agaggaagacgagacaggacgaggcaga

SEQ ID NO: 12456 - RNA, 22 nt, Human
cauugcacuccaaccuggacga

SEQ ID NO: 12457 - RNA, 20 nt, Human
ucuucuaucaccucucucca

SEQ ID NO: 12458 - RNA, 21 nt, Human
cucuaaauuucaaaauuauga

SEQ ID NO: 12459 - RNA, 27 nt, Human
aguguccugucuuggccacugcagucu

SEQ ID NO: 12460 - RNA, 23 nt, Human
cagacagauguugggaggauaca

SEQ ID NO: 12461 - RNA, 21 nt, Human
gaguccugcaacacuaaagau

SEQ ID NO: 12462 - RNA, 21 nt, Human
gcucacugcaaaucuaacuuc

SEQ ID NO: 12463 - RNA, 21 nt, Human
gcaagcagagagucguggaau

SEQ ID NO: 12464 - RNA, 24 nt, Human
caucuuucuguuugucauucuuau

SEQ ID NO: 12465 - RNA, 26 nt, Human
caggcauuugagaccagccuggguaa

SEQ ID NO: 12466 - RNA, 23 nt, Human
caccccaguccgcagugccccuc

SEQ ID NO: 12467 - RNA, 26 nt, Human
ccugguugggcccugcccugagcugc

SEQ ID NO: 12468 - RNA, 24 nt, Human
ggggcaggccucccucagggccag

SEQ ID NO: 12469 - RNA, 21 nt, Human
ucauuaaaacauucuguacuu

SEQ ID NO: 12470 - RNA, 22 nt, Human
gcacccagccaggcggucucuu

SEQ ID NO: 12471 - RNA, 27 nt, Human
aaauacugugaacucuaauaaugugga

SEQ ID NO: 12472 - RNA, 28 nt, Human
acauggcuuggccacagcucuugaggau

SEQ ID NO: 12473 - RNA, 25 nt, Human
aaccuagugccuauagcuaaggcag

SEQ ID NO: 12474 - RNA, 23 nt, Human
ccccucucucauugcugcaccug

SEQ ID NO: 12475 - RNA, 26 nt, Human
cacuuaaccugcuuuugucacucggc

SEQ ID NO: 12476 - RNA, 21 nt, Human
gcccuuagcccccuccucucc

SEQ ID NO: 12477 - RNA, 21 nt, Human
ucagaagcaaggaaguaaggg

SEQ ID NO: 12478 - RNA, 23 nt, Human
aucaaauuagaauucacugagaa

SEQ ID NO: 12479 - RNA, 26 nt, Human
ugagccaagaucgcgccccugcacuc

SEQ ID NO: 12480 - RNA, 26 nt, Human
aaagucagcucuggacccccucccuc

SEQ ID NO: 12481 - RNA, 26 nt, Human
uacuuccugugccauaccaaucaguu

SEQ ID NO: 12482 - RNA, 24 nt, Human
guacauuuaauacagcagugucau

SEQ ID NO: 12483 - RNA, 22 nt, Human
uaacuggauucgauuuugggau

SEQ ID NO: 12484 - RNA, 29 nt, Human
aaucaagguuuggcuucaguuuaaaucac

SEQ ID NO: 12485 - RNA, 22 nt, Human
gacuuugcuccuuccuuuccug

SEQ ID NO: 12486 - RNA, 26 nt, Human
aaugacuaccaacagugagagcccuu

SEQ ID NO: 12487 - RNA, 25 nt, Human
ugccugagcucugggccuuagcucc

SEQ ID NO: 12488 - RNA, 22 nt, Human
aggaggguaguguuuugcaaaa

SEQ ID NO: 12489 - RNA, 22 nt, Human
cucccgggaacucugccugcgc

SEQ ID NO: 12490 - RNA, 19 nt, Human
ugcccaggugggugcucug

SEQ ID NO: 12491 - RNA, 21 nt, Human
ucauacuaaacuucaccuaca

SEQ ID NO: 12492 - RNA, 21 nt, Human
gcucccaggguggacuucagu

SEQ ID NO: 12493 - RNA, 23 nt, Human
cccaggagguuguggauacagug

SEQ ID NO: 12494 - RNA, 23 nt, Human
gcgccuggcccucccucccuagc

SEQ ID NO: 12495 - RNA, 27 nt, Human
ggucucgaacuccugaccucaagugau

SEQ ID NO: 12496 - RNA, 22 nt, Human
agaagccaaagaaacacuugug

SEQ ID NO: 12497 - RNA, 26 nt, Human
agcguguuggccaguggcuguggagg

SEQ ID NO: 12498 - RNA, 22 nt, Human
ugccuguaaucccagcacuuug

SEQ ID NO: 12499 - RNA, 22 nt, Human
ugccuguaaucucagcacucug

SEQ ID NO: 12500 - RNA, 21 nt, Human
uuuucugcuuaguggcacuga

SEQ ID NO: 12501 - RNA, 20 nt, Human
cucaaugcuauucuaacuaa

SEQ ID NO: 12502 - RNA, 23 nt, Human
cacgccuuguaaucccagcacuu

SEQ ID NO: 12503 - RNA, 22 nt, Human
ggggacguagggcuaagggagg

SEQ ID NO: 12504 - RNA, 27 nt, Human
cuggggcuagagguggaggaggcaguc

SEQ ID NO: 12505 - RNA, 21 nt, Human
caggagccaccguggggagcc

SEQ ID NO: 12506 - RNA, 21 nt, Human
aauguuugucucucucuuuca

SEQ ID NO: 12507 - RNA, 21 nt, Human
cagugcaggccagccuggcag

SEQ ID NO: 12508 - RNA, 22 nt, Human
gacuauuguggcuuucucugga

SEQ ID NO: 12509 - RNA, 22 nt, Human
ucaagucugcuggaaugcagga

SEQ ID NO: 12510 - RNA, 20 nt, Human
gucaccccacauuggcaccu

SEQ ID NO: 12511 - RNA, 22 nt, Human
cgggaagaggggaccugcagcc

SEQ ID NO: 12512 - RNA, 24 nt, Human
aggugagcggaucaccugagguca

SEQ ID NO: 12513 - RNA, 23 nt, Human
ccaucuggugguauuccagcaca

SEQ ID NO: 12514 - RNA, 22 nt, Human
ugcagugagccaagauugugcc

SEQ ID NO: 12515 - RNA, 22 nt, Human
ugcagugagcugagauugcacc

SEQ ID NO: 12516 - RNA, 20 nt, Human
cugcuacugcugccgcugcu

SEQ ID NO: 12517 - RNA, 23 nt, Human
gcauuuccuuuuuaaaaaagccu

SEQ ID NO: 12518 - RNA, 23 nt, Human
cagcuuuguguaauucucuuugc

SEQ ID NO: 12519 - RNA, 22 nt, Human
ugcuacugcacuccagcuuagg

SEQ ID NO: 12520 - RNA, 22 nt, Human
ccaacauggagaagccccgucu

SEQ ID NO: 12521 - RNA, 22 nt, Human
cgccucacugcaaccuucaccu

SEQ ID NO: 12522 - RNA, 21 nt, Human
ggcucaggcgcgcuuccucaa

SEQ ID NO: 12523 - RNA, 24 nt, Human
ucaugcugucuuggggcaggguga

SEQ ID NO: 12524 - RNA, 25 nt, Human
ucugcccuauaccaucaauagggga

SEQ ID NO: 12525 - RNA, 20 nt, Human
agugauguuuuuaugauauc

SEQ ID NO: 12526 - RNA, 20 nt, Human
gcugccugccuguuugcugu

SEQ ID NO: 12527 - RNA, 32 nt, Human
ggguguguuacucacuggcacgauggagaacu

SEQ ID NO: 12528 - RNA, 21 nt, Human
uaugguauguggaugugauca

SEQ ID NO: 12529 - RNA, 21 nt, Human
cugauuccuuuuucuaaucca

SEQ ID NO: 12530 - RNA, 18 nt, Human
uucuugcggacacucccu

SEQ ID NO: 12531 - RNA, 21 nt, Human
cuuuuuaaauuuuauuuccug

SEQ ID NO: 12532 - RNA, 22 nt, Human
guguccugcuggccucugagga

SEQ ID NO: 12533 - RNA, 21 nt, Human
ccuaccccaucccucuggugu

SEQ ID NO: 12534 - RNA, 27 nt, Human
cagcccagcaugcaccagcucuuucag

SEQ ID NO: 12535 - RNA, 26 nt, Human
uagccugggcuggaguccuugcuuug

SEQ ID NO: 12536 - RNA, 22 nt, Human
cuguggucccagcuacuuggga

SEQ ID NO: 12537 - RNA, 21 nt, Human
auucaccucuuccucugguuc

SEQ ID NO: 12538 - RNA, 24 nt, Human
gaucuggaaaucaagaaaugggug

SEQ ID NO: 12539 - RNA, 19 nt, Human
gucagcaagguacaugaug

SEQ ID NO: 12540 - RNA, 27 nt, Human
ggagugguaacaagaggagcaggaagc

SEQ ID NO: 12541 - RNA, 21 nt, Human
cccauucagagacugucccug

SEQ ID NO: 12542 - RNA, 22 nt, Human
gucuuuuucucccuuaaguucc

SEQ ID NO: 12543 - RNA, 18 nt, Human
gcagugucacaagcuuca

SEQ ID NO: 12544 - RNA, 22 nt, Human
ccccaacacuucaacacuauuu

SEQ ID NO: 12545 - RNA, 21 nt, Human
caccagcccucagcaugagga

SEQ ID NO: 12546 - RNA, 23 nt, Human
cacugccaccaccagaaagcugu

SEQ ID NO: 12547 - RNA, 19 nt, Human
caugggagaagagggguau

SEQ ID NO: 12548 - RNA, 20 nt, Human
uguugcaaaugaauuguggu

SEQ ID NO: 12549 - RNA, 22 nt, Human
ucauuuuucuguuagacuaggc

SEQ ID NO: 12550 - RNA, 27 nt, Human
aucucuagccucuuuguguuuuuguug

SEQ ID NO: 12551 - RNA, 23 nt, Human
aaacaagagugaaauuccaucuc

SEQ ID NO: 12552 - RNA, 26 nt, Human
ccacagccacacucuucaacgguuac

SEQ ID NO: 12553 - RNA, 26 nt, Human
agcugcugcaaccauuguucugacac

SEQ ID NO: 12554 - RNA, 21 nt, Human
ugagccagcgaauugugcaca

SEQ ID NO: 12555 - RNA, 27 nt, Human
ucucugcauggcugcaaugaucccacu

SEQ ID NO: 12556 - RNA, 21 nt, Human
uuucuuaggcuggagugcagu

SEQ ID NO: 12557 - RNA, 24 nt, Human
agguaauccgucugccuuggccuc

SEQ ID NO: 12558 - RNA, 26 nt, Human
cccuccaguuaccaggagccgauuug

SEQ ID NO: 12559 - RNA, 23 nt, Human
agucagguccacaccuaugucca

SEQ ID NO: 12560 - RNA, 25 nt, Human
ccagcccacagagccugaauuugua

SEQ ID NO: 12561 - RNA, 29 nt, Human
ugucugugugcucuuaucaccaaucaguu

SEQ ID NO: 12562 - RNA, 23 nt, Human
ggacauauguggccuugaaggga

SEQ ID NO: 12563 - RNA, 21 nt, Human
gacugccuggccagagggggg

SEQ ID NO: 12564 - RNA, 21 nt, Human
gccaucucagagccauugaua

SEQ ID NO: 12565 - RNA, 22 nt, Human
uuccacaaaauuagaaaggaca

SEQ ID NO: 12566 - RNA, 27 nt, Human
guugcccaggcuggucuccaacaccug

SEQ ID NO: 12567 - RNA, 24 nt, Human
aacacaugcuuuuguaucuuguca

SEQ ID NO: 12568 - RNA, 22 nt, Human
aaauacugaaagcacaggggca

SEQ ID NO: 12569 - RNA, 22 nt, Human
ucuugcccaacuaaacccagaa

SEQ ID NO: 12570 - RNA, 17 nt, Human
ccccccagcgucaucuc

SEQ ID NO: 12571 - RNA, 21 nt, Human
gggcagcugccuggccaugcu

SEQ ID NO: 12572 - RNA, 27 nt, Human
ccuaaguagcucccauucccucaccuu

SEQ ID NO: 12573 - RNA, 26 nt, Human
ucuggagacauggaggcagcuguggc

SEQ ID NO: 12574 - RNA, 17 nt, Human
cuucccuuucauaucca

SEQ ID NO: 12575 - RNA, 20 nt, Human
caaacuaacucauggagaua

SEQ ID NO: 12576 - RNA, 23 nt, Human
agcgccuagggcuggagaauagc

SEQ ID NO: 12577 - RNA, 20 nt, Human
ucccagccacaccugccccu

SEQ ID NO: 12578 - RNA, 21 nt, Human
ccagguacaagcuaauacuca

SEQ ID NO: 12579 - RNA, 20 nt, Human
cugcuuaaaccucugucucu

SEQ ID NO: 12580 - RNA, 28 nt, Human
gcugcuucccaccccugccuguuccccu

SEQ ID NO: 12581 - RNA, 17 nt, Human
ucuagaaauuuaccuca

SEQ ID NO: 12582 - RNA, 21 nt, Human
cccgggcaugagcugaccuca

SEQ ID NO: 12583 - RNA, 22 nt, Human
caggcugagugcauuuggaggg

SEQ ID NO: 12584 - RNA, 30 nt, Human
cucuaguaccauaggucaagaggcuucugg

SEQ ID NO: 12585 - RNA, 29 nt, Human
ggcggagggcagagcaggcccugcggaga

SEQ ID NO: 12586 - RNA, 21 nt, Human
uggucucaagcuaugaucaga

SEQ ID NO: 12587 - RNA, 23 nt, Human
ggucaucucggaguuccaguacc

SEQ ID NO: 12588 - RNA, 27 nt, Human
uaagaaaaacaaaguuuuaaacgaaau

SEQ ID NO: 12589 - RNA, 22 nt, Human
auccuucuaaagugcugggauu

SEQ ID NO: 12590 - RNA, 24 nt, Human
caaccuccuccuccaguucugaug

SEQ ID NO: 12591 - RNA, 19 nt, Human
auugauuucaaauugucug

SEQ ID NO: 12592 - RNA, 20 nt, Human
cucagccaggcuggaggcgg

SEQ ID NO: 12593 - RNA, 21 nt, Human
cagcccuuguuucucuuccuu

SEQ ID NO: 12594 - RNA, 22 nt, Human
aaaucuuuuuuggaauauugcu

SEQ ID NO: 12595 - RNA, 21 nt, Human
gauauuaugccuucucuuuag

SEQ ID NO: 12596 - RNA, 26 nt, Human
uggggugagaggaugggugauggggu

SEQ ID NO: 12597 - RNA, 26 nt, Human
cagacaccugaaacaaucaacgccca

SEQ ID NO: 12598 - RNA, 22 nt, Human
cucaaccuugggguaaacugag

SEQ ID NO: 12599 - RNA, 17 nt, Human
uaucuguacagcacuuu

SEQ ID NO: 12600 - RNA, 22 nt, Human
cgucucaggucagcggagggag

SEQ ID NO: 12601 - RNA, 21 nt, Human
caacuuugccagcuuuuccuc

SEQ ID NO: 12602 - RNA, 22 nt, Human
agaccugauaggauugccugcu

SEQ ID NO: 12603 - RNA, 20 nt, Human
aaucacagccccugcuuuuu

SEQ ID NO: 12604 - RNA, 21 nt, Human
caugucacugcagauugagac

SEQ ID NO: 12605 - RNA, 27 nt, Human
cccugcagggcuuggucagcugccugu

SEQ ID NO: 12606 - RNA, 27 nt, Human
uaucccuugucccuucacccccauuuc

SEQ ID NO: 12607 - RNA, 21 nt, Human
uuggggucagccagggccagg

SEQ ID NO: 12608 - RNA, 24 nt, Human
aacagcuguugaagcucagagcug

SEQ ID NO: 12609 - RNA, 24 nt, Human
gaggcugcggccagcagagcccag

SEQ ID NO: 12610 - RNA, 21 nt, Human
cuuugauucugguucaucucg

SEQ ID NO: 12611 - RNA, 23 nt, Human
cgccaaggcuggagugcaguggc

SEQ ID NO: 12612 - RNA, 24 nt, Human
augugugggaaagcuggaaguugu

SEQ ID NO: 12613 - RNA, 30 nt, Human
uggugcuguccauggaaucaggccacagca

SEQ ID NO: 12614 - RNA, 24 nt, Human
aggaccuggaauguacuggcuggg

SEQ ID NO: 12615 - RNA, 26 nt, Human
ggaaggcagagaccuggguugagcag

SEQ ID NO: 12616 - RNA, 27 nt, Human
cugagugacguaggcucugagauagcu

SEQ ID NO: 12617 - RNA, 27 nt, Human
acccuugccacuuccaaagcaauagag

SEQ ID NO: 12618 - RNA, 23 nt, Human
uucuggagugauccaugaaggac

SEQ ID NO: 12619 - RNA, 19 nt, Human
cuuucugucugugaauguc

SEQ ID NO: 12620 - RNA, 21 nt, Human
ucuccucuggagcacucugcc

SEQ ID NO: 12621 - RNA, 27 nt, Human
ccgucuccauggcaucuucgucuucac

SEQ ID NO: 12622 - RNA, 20 nt, Human
gaaauuuggaaaggaccaaa

SEQ ID NO: 12623 - RNA, 27 nt, Human
uuugacagauuccucccaagucuggcu

SEQ ID NO: 12624 - RNA, 21 nt, Human
ccagcccgcgaugaggaaaag

SEQ ID NO: 12625 - RNA, 24 nt, Human
gcagaaggcaucuucucacugugc

SEQ ID NO: 12626 - RNA, 21 nt, Human
caguugaacgugggaggcgga

SEQ ID NO: 12627 - RNA, 19 nt, Human
ugcaaacuagacugaaaug

SEQ ID NO: 12628 - RNA, 21 nt, Human
gcagggaugacucaguacugc

SEQ ID NO: 12629 - RNA, 21 nt, Human
ugaaccaagaucacugaauuu

SEQ ID NO: 12630 - RNA, 26 nt, Human
gcaaagugcuuugacuucuugcuuca

SEQ ID NO: 12631 - RNA, 27 nt, Human
ugcaugcuauggggacccucuuguugg

SEQ ID NO: 12632 - RNA, 23 nt, Human
augucuagccccucccauuucca

SEQ ID NO: 12633 - RNA, 21 nt, Human
ucugcucgagcccaggaaagg

SEQ ID NO: 12634 - RNA, 24 nt, Human
ccugcuuccuggcucacacauccc

SEQ ID NO: 12635 - RNA, 19 nt, Human
uagaaagagaaucccagcu

SEQ ID NO: 12636 - RNA, 22 nt, Human
cauacagagaagucacagggca

SEQ ID NO: 12637 - RNA, 25 nt, Human
ugguagcucaugccuguaaucccag

SEQ ID NO: 12638 - RNA, 26 nt, Human
aggggauguggggaccaggagaaagu

SEQ ID NO: 12639 - RNA, 27 nt, Human
ggucuugaucuccugaccucaugaucc

SEQ ID NO: 12640 - RNA, 27 nt, Human
aaagugcugggacuuuuugguaauaga

SEQ ID NO: 12641 - RNA, 27 nt, Human
agcgagaaggaguguaugagugugagu

SEQ ID NO: 12642 - RNA, 26 nt, Human
cacucccaguucccuggacagagcua

SEQ ID NO: 12643 - RNA, 27 nt, Human
ccccucggagccggcuucucccuccgc

SEQ ID NO: 12644 - RNA, 20 nt, Human
ucccguggagcuucaucggg

SEQ ID NO: 12645 - RNA, 26 nt, Human
gccugacagucuuggcuuuugaagau

SEQ ID NO: 12646 - RNA, 18 nt, Human
ucugacaucugaugccuu

SEQ ID NO: 12647 - RNA, 24 nt, Human
gaugcugggccaguuccuccaaga

SEQ ID NO: 12648 - RNA, 22 nt, Human
uccccacccucucuccaaggcc

SEQ ID NO: 12649 - RNA, 25 nt, Human
gccacuucccagcuaggagugcacu

SEQ ID NO: 12650 - RNA, 23 nt, Human
cugugcaucaaaucacaaaaaga

SEQ ID NO: 12651 - RNA, 22 nt, Human
ucuggaugccucauuaugucaa

SEQ ID NO: 12652 - RNA, 27 nt, Human
gaugcagaugggugcuaucagagccuc

SEQ ID NO: 12653 - RNA, 22 nt, Human
cuuuucucccacccucuuuucc

SEQ ID NO: 12654 - RNA, 24 nt, Human
agggaaaacagugcaaacugagug

SEQ ID NO: 12655 - RNA, 21 nt, Human
gaaaccaggccugggccucaa

SEQ ID NO: 12656 - RNA, 22 nt, Human
uucuggaguuuguguaaaacaa

SEQ ID NO: 12657 - RNA, 23 nt, Human
gagauugaaaagcuuuguauggg

SEQ ID NO: 12658 - RNA, 25 nt, Human
uucguaaugucaaauaccaccuaua

SEQ ID NO: 12659 - RNA, 20 nt, Human
uuauuacugccuucuuuuca

SEQ ID NO: 12660 - RNA, 23 nt, Human
ccgaggccagcagccacccgaga

SEQ ID NO: 12661 - RNA, 22 nt, Human
gggccucgccauguccugcugc

SEQ ID NO: 12662 - RNA, 23 nt, Human
gggagaauggggagagggaccuc

SEQ ID NO: 12663 - RNA, 23 nt, Human
ccacacgcagcucagccugggcg

SEQ ID NO: 12664 - RNA, 19 nt, Human
uucucugaguaauucacug

SEQ ID NO: 12665 - RNA, 20 nt, Human
uuauuuuacuuucuuuugga

SEQ ID NO: 12666 - RNA, 21 nt, Human
aggccugagcccugccuaugc

SEQ ID NO: 12667 - RNA, 19 nt, Human
cucgugaugggcccgccuc

SEQ ID NO: 12668 - RNA, 31 nt, Human
gcggcagcugcagcaaguggaggggcugaac

SEQ ID NO: 12669 - RNA, 26 nt, Human
cucuccaggauccagaagggguuugg

SEQ ID NO: 12670 - RNA, 23 nt, Human
agccuccagccugcccuguggca

SEQ ID NO: 12671 - RNA, 27 nt, Human
gcucuuucgccaaggcuggagugcagu

SEQ ID NO: 12672 - RNA, 23 nt, Human
ucuccaucugcacagagguccug

SEQ ID NO: 12673 - RNA, 24 nt, Human
auugcaaauaauacuuucuucuuc

SEQ ID NO: 12674 - RNA, 22 nt, Human
augcuggggcccugcaugcugc

SEQ ID NO: 12675 - RNA, 21 nt, Human
cugagcccugcucccucugcc

SEQ ID NO: 12676 - RNA, 22 nt, Human
caccuuccgggcucaagcgauu

SEQ ID NO: 12677 - RNA, 21 nt, Human
uuccagacugcugguuugggu

SEQ ID NO: 12678 - RNA, 23 nt, Human
ccagagaggcccgugaccaggcc

SEQ ID NO: 12679 - RNA, 22 nt, Human
gcugauccagaggaacccagag

SEQ ID NO: 12680 - RNA, 20 nt, Human
cugggauuucauuuuguugc

SEQ ID NO: 12681 - RNA, 27 nt, Human
auggagauuuggacacugugugcuuuu

SEQ ID NO: 12682 - RNA, 25 nt, Human
uuguuuguuucaucuugcuuuugca

SEQ ID NO: 12683 - RNA, 22 nt, Human
gcccucugcuguucaggaugca

SEQ ID NO: 12684 - RNA, 23 nt, Human
uaaagucuucuuucauguaagua

SEQ ID NO: 12685 - RNA, 22 nt, Human
accugcauuaucucauucuggc

SEQ ID NO: 12686 - RNA, 22 nt, Human
gcuccucugcugguggugggcu

SEQ ID NO: 12687 - RNA, 22 nt, Human
acuaaaacuacuacuuacaucu

SEQ ID NO: 12688 - RNA, 22 nt, Human
ggagucagggagagcugaacua

SEQ ID NO: 12689 - RNA, 21 nt, Human
ugcaaaacuaaccacuaugua

SEQ ID NO: 12690 - RNA, 21 nt, Human
uugaccagaaaaagauuuguu

SEQ ID NO: 12691 - RNA, 19 nt, Human
cagcgucaggccuaccuca

SEQ ID NO: 12692 - RNA, 23 nt, Human
cgccuccaggguccgcucugcca

SEQ ID NO: 12693 - RNA, 24 nt, Human
cugccuggcccaugugcccacugu

SEQ ID NO: 12694 - RNA, 19 nt, Human
uggucucagaccccacucu

SEQ ID NO: 12695 - RNA, 27 nt, Human
gagagugaagcagaaacaggagcacag

SEQ ID NO: 12696 - RNA, 22 nt, Human
gucaccgaggcuggagugcaau

SEQ ID NO: 12697 - RNA, 27 nt, Human
acuuccugccaauccccaagucaucuu

SEQ ID NO: 12698 - RNA, 25 nt, Human
ggccuuaagugauccucccaccuca

SEQ ID NO: 12699 - RNA, 25 nt, Human
aaugccagcuucuuuggacuuagaa

SEQ ID NO: 12700 - RNA, 21 nt, Human
ccagaggcagagguugcagug

SEQ ID NO: 12701 - RNA, 24 nt, Human
ugcauuguugccauuccccagauu

SEQ ID NO: 12702 - RNA, 22 nt, Human
ugagguagcagugggcacuuuu

SEQ ID NO: 12703 - RNA, 27 nt, Human
auacauaccuacauucagaauugaaag

SEQ ID NO: 12704 - RNA, 23 nt, Human
ggcggcggcuccgggaggcagag

SEQ ID NO: 12705 - RNA, 22 nt, Human
gauuacaggcgugagccaccac

SEQ ID NO: 12706 - RNA, 22 nt, Human
gauuacaggcgugcgccaccaa

SEQ ID NO: 12707 - RNA, 21 nt, Human
gcagacgacuuguccugccac

SEQ ID NO: 12708 - RNA, 23 nt, Human
agggucccucccuauacuccuca

SEQ ID NO: 12709 - RNA, 26 nt, Human
ugauaaaaucugcaacacuccugcug

SEQ ID NO: 12710 - RNA, 22 nt, Human
gccagcccuggcuggagagcgg

SEQ ID NO: 12711 - RNA, 23 nt, Human
ugccuguagucccacuuacuugg

SEQ ID NO: 12712 - RNA, 24 nt, Human
caggaaggggacaggauugucugc

SEQ ID NO: 12713 - RNA, 26 nt, Human
aacagcuucagaagaaggugacuggu

SEQ ID NO: 12714 - RNA, 27 nt, Human
gcacuucuggaacugugcuucucuuua

SEQ ID NO: 12715 - RNA, 25 nt, Human
guuuguucaugcaaacuauauuugc

SEQ ID NO: 12716 - RNA, 26 nt, Human
cccacugcacuccagccugagugaca

SEQ ID NO: 12717 - RNA, 22 nt, Human
aaaucacuuaguaagcggcuca

SEQ ID NO: 12718 - RNA, 26 nt, Human
accagccugggcaacacagcaagaca

SEQ ID NO: 12719 - RNA, 22 nt, Human
gcgcgcacacacauacauacgc

SEQ ID NO: 12720 - RNA, 20 nt, Human
gggacagaaagcgcacagaa

SEQ ID NO: 12721 - RNA, 20 nt, Human
gucuuaaaaacugugguauu

SEQ ID NO: 12722 - RNA, 23 nt, Human
uguguugucauggugaacuggag

SEQ ID NO: 12723 - RNA, 24 nt, Human
agaagggugccugggaggccaggu

SEQ ID NO: 12724 - RNA, 27 nt, Human
ggauuguacuggagcagauggagaccc

SEQ ID NO: 12725 - RNA, 22 nt, Human
gccccuuggggagcaguggccg

SEQ ID NO: 12726 - RNA, 22 nt, Human
auggucccuuucuccacugcac

SEQ ID NO: 12727 - RNA, 24 nt, Human
ucuccggccucuccagccucagcc

SEQ ID NO: 12728 - RNA, 27 nt, Human
agacgcugggcaucucuccucuguggc

SEQ ID NO: 12729 - RNA, 27 nt, Human
cagggcgcaggagggaaugagcugugg

SEQ ID NO: 12730 - RNA, 22 nt, Human
gaaagguugcacucuaggguga

SEQ ID NO: 12731 - RNA, 26 nt, Human
ccucaggcuccuggguggccuguuau

SEQ ID NO: 12732 - RNA, 26 nt, Human
uagggaggguaaagggagacuauuuc

SEQ ID NO: 12733 - RNA, 19 nt, Human
agcucacuaucucuggcca

SEQ ID NO: 12734 - RNA, 21 nt, Human
accugcugugugaaaucgaag

SEQ ID NO: 12735 - RNA, 19 nt, Human
uagcacaaagguuuccuca

SEQ ID NO: 12736 - RNA, 21 nt, Human
caccagauaggugaguccuua

SEQ ID NO: 12737 - RNA, 22 nt, Human
uuuucuuucuucuuuuaagaac

SEQ ID NO: 12738 - RNA, 23 nt, Human
ccaucuacuccacacaugcagga

SEQ ID NO: 12739 - RNA, 21 nt, Human
ugaagaagaaacugagcaguu

SEQ ID NO: 12740 - RNA, 22 nt, Human
uggcuucucccuggggacgggg

SEQ ID NO: 12741 - RNA, 25 nt, Human
ggcuaauuuuuguuuaauuuuuugu

SEQ ID NO: 12742 - RNA, 23 nt, Human
gggaaagaaugagggagggagaa

SEQ ID NO: 12743 - RNA, 28 nt, Human
cagggacagacccaagcccaggcccucc

SEQ ID NO: 12744 - RNA, 27 nt, Human
uggcaauuuccuucgguuucugccuuu

SEQ ID NO: 12745 - RNA, 24 nt, Human
ggggugaggcagcggcgcggccgg

SEQ ID NO: 12746 - RNA, 21 nt, Human
aacccaggcuggaaugcaaug

SEQ ID NO: 12747 - RNA, 24 nt, Human
gccuguaaucccagcuacucauga

SEQ ID NO: 12748 - RNA, 20 nt, Human
auugaacacuauucuguuca

SEQ ID NO: 12749 - RNA, 21 nt, Human
gcauacaaguuuagccugggg

SEQ ID NO: 12750 - RNA, 21 nt, Human
uugggcugugagcuguguucu

SEQ ID NO: 12751 - RNA, 22 nt, Human
ucugggagccccaggcuggccu

SEQ ID NO: 12752 - RNA, 22 nt, Human
cugcccucucugcgcugaggcc

SEQ ID NO: 12753 - RNA, 22 nt, Human
uguggcuuucauuugaguaucu

SEQ ID NO: 12754 - RNA, 20 nt, Human
gcacguguucugaaaccacu

SEQ ID NO: 12755 - RNA, 24 nt, Human
gccuugccugugagcuaugucacu

SEQ ID NO: 12756 - RNA, 27 nt, Human
cccaaguagcugcaacaacaggcacac

SEQ ID NO: 12757 - RNA, 22 nt, Human
guuaccugcauuauuacauuag

SEQ ID NO: 12758 - RNA, 22 nt, Human
ucucuugccuuuuccccccuuu

SEQ ID NO: 12759 - RNA, 22 nt, Human
ucuagacuacauguauuacaaa

SEQ ID NO: 12760 - RNA, 19 nt, Human
ggcagugauuagcacuugg

SEQ ID NO: 12761 - RNA, 22 nt, Human
caggaaucucugauuacagugg

SEQ ID NO: 12762 - RNA, 26 nt, Human
agacccauguaaauaccagacugcag

SEQ ID NO: 12763 - RNA, 20 nt, Human
ucuccccucagcuugagacu

SEQ ID NO: 12764 - RNA, 19 nt, Human
uucugaaaauucuguaucu

SEQ ID NO: 12765 - RNA, 18 nt, Human
cugcugcugcugcuucuc

SEQ ID NO: 12766 - RNA, 26 nt, Human
uguaccuagaacacaccagccacugu

SEQ ID NO: 12767 - RNA, 22 nt, Human
gcgugaagcaccacgcccagcc

SEQ ID NO: 12768 - RNA, 26 nt, Human
ggcuguagggcugggucuauguugca

SEQ ID NO: 12769 - RNA, 21 nt, Human
gccugccugggagacuuccuu

SEQ ID NO: 12770 - RNA, 22 nt, Human
cugcagccuugaccuccugggu

SEQ ID NO: 12771 - RNA, 22 nt, Human
cgggcagcggagguugcaguga

SEQ ID NO: 12772 - RNA, 22 nt, Human
ccaggaggcggagguaguggug

SEQ ID NO: 12773 - RNA, 20 nt, Human
cugccuggcaucccuggggc

SEQ ID NO: 12774 - RNA, 22 nt, Human
cccuggguccugcacgccgccu

SEQ ID NO: 12775 - RNA, 23 nt, Human
ccauguuggcuaggagggucuca

SEQ ID NO: 12776 - RNA, 21 nt, Human
ugccuuuggggcuggagggag

SEQ ID NO: 12777 - RNA, 21 nt, Human
gauauuucuucauuuucuuuu

SEQ ID NO: 12778 - RNA, 26 nt, Human
ucgggaggcugaggcaggagaauggc

SEQ ID NO: 12779 - RNA, 25 nt, Human
uggugaaaguuucuucaacucugaa

SEQ ID NO: 12780 - RNA, 22 nt, Human
cacccaggcuugagugcagugg

SEQ ID NO: 12781 - RNA, 20 nt, Human
caccccagccuaguccucuu

SEQ ID NO: 12782 - RNA, 21 nt, Human
uggccugugcccaaugcugac

SEQ ID NO: 12783 - RNA, 19 nt, Human
gggcaguagcuguggugag

SEQ ID NO: 12784 - RNA, 29 nt, Human
ccucugucauuuuaaccucagguggcacc

SEQ ID NO: 12785 - RNA, 27 nt, Human
uaucuguguggugaugaaucgcauuuc

SEQ ID NO: 12786 - RNA, 26 nt, Human
gaggcugaggugggaggaugguuuga

SEQ ID NO: 12787 - RNA, 23 nt, Human
uuugcccaagauugggugucaag

SEQ ID NO: 12788 - RNA, 20 nt, Human
agaaugccaggaauauuguc

SEQ ID NO: 12789 - RNA, 23 nt, Human
uggucugcacuauaaaacauuuu

SEQ ID NO: 12790 - RNA, 25 nt, Human
ggggcaagauggcagagguauuggg

SEQ ID NO: 12791 - RNA, 21 nt, Human
gacccggucucccacagguga

SEQ ID NO: 12792 - RNA, 20 nt, Human
acuuccauauuuccauuugc

SEQ ID NO: 12793 - RNA, 22 nt, Human
acccaacacccccgacggccuc

SEQ ID NO: 12794 - RNA, 21 nt, Human
acuuagauuuaagaaaaagag

SEQ ID NO: 12795 - RNA, 20 nt, Human
acuuccacucugcaaaccug

SEQ ID NO: 12796 - RNA, 27 nt, Human
agcaguuuccccacugugucuguccca

SEQ ID NO: 12797 - RNA, 25 nt, Human
gcaugugcaaaguuaggucuuccca

SEQ ID NO: 12798 - RNA, 27 nt, Human
cagguuugguggacaaagcuacugaga

SEQ ID NO: 12799 - RNA, 22 nt, Human
gggagagagagccagagacagu

SEQ ID NO: 12800 - RNA, 23 nt, Human
ucuaauauccagaaaaaguaacu

SEQ ID NO: 12801 - RNA, 22 nt, Human
caggaaaugauuuucugccucc

SEQ ID NO: 12802 - RNA, 21 nt, Human
cucuggcccaggcuagagugc

SEQ ID NO: 12803 - RNA, 22 nt, Human
cucacacacuccccugccuccc

SEQ ID NO: 12804 - RNA, 25 nt, Human
cacucacugccucauguggccccuu

SEQ ID NO: 12805 - RNA, 28 nt, Human
gguuccuagaggcagagguugaagaugg

SEQ ID NO: 12806 - RNA, 23 nt, Human
acucuucuuuuuagcauucucau

SEQ ID NO: 12807 - RNA, 19 nt, Human
cuugcugccuucauccccu

SEQ ID NO: 12808 - RNA, 27 nt, Human
cugggaggcacagagugcaggucucag

SEQ ID NO: 12809 - RNA, 21 nt, Human
uaguaauccucacugagugau

SEQ ID NO: 12810 - RNA, 22 nt, Human
gagugucagaucuaucuuguca

SEQ ID NO: 12811 - RNA, 20 nt, Human
ugucugaccucaggccuuuu

SEQ ID NO: 12812 - RNA, 24 nt, Human
gccucaggucgccccgccugggcc

SEQ ID NO: 12813 - RNA, 28 nt, Human
uggcugccccggccuccucggagagcag

SEQ ID NO: 12814 - RNA, 21 nt, Human
cucaguuagaauuuuccuaaa

SEQ ID NO: 12815 - RNA, 29 nt, Human
aguuuuaucuaacggcuacugaaacaccc

SEQ ID NO: 12816 - RNA, 22 nt, Human
uuccaccaggugcaguggcuca

SEQ ID NO: 12817 - RNA, 21 nt, Human
ccccuccuccccuuccugcac

SEQ ID NO: 12818 - RNA, 21 nt, Human
gucuuccuguuuuuccuguac

SEQ ID NO: 12819 - RNA, 22 nt, Human
uuuggaauuaugucugcugaau

SEQ ID NO: 12820 - RNA, 23 nt, Human
auuauuugucugguaagcauuuu

SEQ ID NO: 12821 - RNA, 26 nt, Human
acuuucaaaaacaugaccuuccacaa

SEQ ID NO: 12822 - RNA, 24 nt, Human
gcccagccacauuccugccacccu

SEQ ID NO: 12823 - RNA, 22 nt, Human
gaaccuaggaggcagucaauaa

SEQ ID NO: 12824 - RNA, 21 nt, Human
auuuaaaaacuauauuuacag

SEQ ID NO: 12825 - RNA, 22 nt, Human
ggcaaggcaccacuuccucaca

SEQ ID NO: 12826 - RNA, 24 nt, Human
ccauuuuuagccaagagggucuga

SEQ ID NO: 12827 - RNA, 23 nt, Human
uucuuuacaaaggaaaauggcag

SEQ ID NO: 12828 - RNA, 26 nt, Human
uccucaagaaaacagagaucauuugg

SEQ ID NO: 12829 - RNA, 22 nt, Human
gccuggagcucucagcaucacu

SEQ ID NO: 12830 - RNA, 20 nt, Human
uguccaucugggccacuguc

SEQ ID NO: 12831 - RNA, 19 nt, Human
ucugccuggccgccgccgc

SEQ ID NO: 12832 - RNA, 22 nt, Human
cauggcagcaccugagggacac

SEQ ID NO: 12833 - RNA, 18 nt, Human
cucagccaaaaugaguga

SEQ ID NO: 12834 - RNA, 23 nt, Human
cauauguagcaaaaaucagggcu

SEQ ID NO: 12835 - RNA, 22 nt, Human
cucaaacacaguuacacuugug

SEQ ID NO: 12836 - RNA, 31 nt, Human
cugucuaccucacagaaauguuaaacugaga

SEQ ID NO: 12837 - RNA, 22 nt, Human
ccuugcggcccuggcucugagu

SEQ ID NO: 12838 - RNA, 21 nt, Human
gaaccauuuacaugcaccuua

SEQ ID NO: 12839 - RNA, 25 nt, Human
aagauauugccauuuuacagcuuaa

SEQ ID NO: 12840 - RNA, 22 nt, Human
ggaucucaggcuggagugcagu

SEQ ID NO: 12841 - RNA, 21 nt, Human
auugguggaaaguagggugga

SEQ ID NO: 12842 - RNA, 23 nt, Human
ccucagacaacagccucuacacc

SEQ ID NO: 12843 - RNA, 23 nt, Human
uccagcugaggcagggggauuug

SEQ ID NO: 12844 - RNA, 25 nt, Human
aggacauuacuagaaaauuaaacag

SEQ ID NO: 12845 - RNA, 25 nt, Human
gcauuucagcauccuggcuccccag

SEQ ID NO: 12846 - RNA, 24 nt, Human
uuccucggggcgggggccgggcca

SEQ ID NO: 12847 - RNA, 27 nt, Human
uuucaaacuuuuuggggagugggguca

SEQ ID NO: 12848 - RNA, 24 nt, Human
cugcuacugcuguuuccaggggcu

SEQ ID NO: 12849 - RNA, 19 nt, Human
gcagcuuucgcugcuguga

SEQ ID NO: 12850 - RNA, 21 nt, Human
uagggaggagggguucugggu

SEQ ID NO: 12851 - RNA, 22 nt, Human
caacauagugauaccccaucuc

SEQ ID NO: 12852 - RNA, 23 nt, Human
ucagguggggguaggggauggac

SEQ ID NO: 12853 - RNA, 20 nt, Human
uuuuuguuuuguugcacuga

SEQ ID NO: 12854 - RNA, 17 nt, Human
uuggcugcucauuccuu

SEQ ID NO: 12855 - RNA, 26 nt, Human
uuugaugccaucaccagccuacugca

SEQ ID NO: 12856 - RNA, 27 nt, Human
agguuggcgggaaugagacuaaagauu

SEQ ID NO: 12857 - RNA, 24 nt, Human
ggccaggcuggaggcagggauggg

SEQ ID NO: 12858 - RNA, 27 nt, Human
uaccauucuauuccauguuugcaccug

SEQ ID NO: 12859 - RNA, 27 nt, Human
ggguaaggaggagaaaauaaaccaaca

SEQ ID NO: 12860 - RNA, 26 nt, Human
uucuggaggggcaguggagaucagga

SEQ ID NO: 12861 - RNA, 25 nt, Human
guucugcuucugucaguuauucuug

SEQ ID NO: 12862 - RNA, 21 nt, Human
gccacaagggcauagugcagu

SEQ ID NO: 12863 - RNA, 21 nt, Human
ggugcgugccuguaaucccag

SEQ ID NO: 12864 - RNA, 20 nt, Human
gccacagcaaggagcucagc

SEQ ID NO: 12865 - RNA, 21 nt, Human
gcaggugcuacaacaugugag

SEQ ID NO: 12866 - RNA, 21 nt, Human
ggaaugcaggauggcggcggu

SEQ ID NO: 12867 - RNA, 21 nt, Human
uucaaugcuguggccccucag

SEQ ID NO: 12868 - RNA, 25 nt, Human
ucagugcuuugggacagauuuuaua

SEQ ID NO: 12869 - RNA, 27 nt, Human
uuaccaccuggagagaagcuuccagac

SEQ ID NO: 12870 - RNA, 22 nt, Human
ccacauggagcugcuuucuggg

SEQ ID NO: 12871 - RNA, 20 nt, Human
cccugcacucccuccuggag

SEQ ID NO: 12872 - RNA, 21 nt, Human
ggccacacccucagcugccuc

SEQ ID NO: 12873 - RNA, 22 nt, Human
gggguuuuaccauguuggccag

SEQ ID NO: 12874 - RNA, 27 nt, Human
agaguacugggauuacaggcucuuucu

SEQ ID NO: 12875 - RNA, 27 nt, Human
ucgcucgcaacccuaccuaccucucuc

SEQ ID NO: 12876 - RNA, 27 nt, Human
gugguauucauaugcuaugucucuaaa

SEQ ID NO: 12877 - RNA, 22 nt, Human
uguagcuucaguuauuggugag

SEQ ID NO: 12878 - RNA, 22 nt, Human
gaacucccaaccucaagcaauc

SEQ ID NO: 12879 - RNA, 20 nt, Human
augcccaggugggugcucug

SEQ ID NO: 12880 - RNA, 27 nt, Human
ggucuugaacuccuggucucaagugau

SEQ ID NO: 12881 - RNA, 17 nt, Human
gacuaacaacugccuug

SEQ ID NO: 12882 - RNA, 25 nt, Human
aagacagaugggcauaugugucagu

SEQ ID NO: 12883 - RNA, 25 nt, Human
ccaagccccauguagccccagucau

SEQ ID NO: 12884 - RNA, 16 nt, Human
gcugugcaaugccuua

SEQ ID NO: 12885 - RNA, 27 nt, Human
ccagaagcagcauguuggacagaaaca

SEQ ID NO: 12886 - RNA, 18 nt, Human
guuaucuacagauguuag

SEQ ID NO: 12887 - RNA, 22 nt, Human
uagcaugugugucucggaugcg

SEQ ID NO: 12888 - RNA, 27 nt, Human
ggccuggacacagaugaccucuacggg

SEQ ID NO: 12889 - RNA, 18 nt, Human
ucacguucagccgugugg

SEQ ID NO: 12890 - RNA, 22 nt, Human
gugccucuguccuuagguugua

SEQ ID NO: 12891 - RNA, 23 nt, Human
uucuucaugagaguacuagccuc

SEQ ID NO: 12892 - RNA, 23 nt, Human
gacgugcacgcacacugucugcc

SEQ ID NO: 12893 - RNA, 22 nt, Human
cugggaggcggagguugcaaug

SEQ ID NO: 12894 - RNA, 22 nt, Human
cugagaggcggagguugcagug

SEQ ID NO: 12895 - RNA, 26 nt, Human
gggaaggggagagggaaacgugcccu

SEQ ID NO: 12896 - RNA, 23 nt, Human
caucucuuccccagagaggcacu

SEQ ID NO: 12897 - RNA, 22 nt, Human
aggcugaggcaggagaauaugg

SEQ ID NO: 12898 - RNA, 21 nt, Human
ccugugcugcccgucuucagc

SEQ ID NO: 12899 - RNA, 27 nt, Human
cuguggaccucgggaccuggacgccgu

SEQ ID NO: 12900 - RNA, 27 nt, Human
caggcagcaacugaggcagcggcaggc

SEQ ID NO: 12901 - RNA, 21 nt, Human
gugagucuugaugauaagggu

SEQ ID NO: 12902 - RNA, 27 nt, Human
gacuugucauuucauguucuuauuuua

SEQ ID NO: 12903 - RNA, 21 nt, Human
agaccugacugucccccagcc

SEQ ID NO: 12904 - RNA, 24 nt, Human
cuaacguauuggcaccugccuccu

SEQ ID NO: 12905 - RNA, 30 nt, Human
uccgugcuucucagacagugccuuuucacc

SEQ ID NO: 12906 - RNA, 30 nt, Human
ggguccaucugagcuggcugugggcugaga

SEQ ID NO: 12907 - RNA, 27 nt, Human
gggguccuucuccacacccacuuuguc

SEQ ID NO: 12908 - RNA, 30 nt, Human
gggaggcugggagagguugggugcucuccu

SEQ ID NO: 12909 - RNA, 25 nt, Human
acgucucugucucugggccuuuguu

SEQ ID NO: 12910 - RNA, 26 nt, Human
cuugggacugugucucauguuugugu

SEQ ID NO: 12911 - RNA, 21 nt, Human
ucagaggaacaaaccagggga

SEQ ID NO: 12912 - RNA, 27 nt, Human
aggcaccaggacuagggcuggagugag

SEQ ID NO: 12913 - RNA, 16 nt, Human
uaguuaauuucuucca

SEQ ID NO: 12914 - RNA, 19 nt, Human
cuugccucucccucuuguu

SEQ ID NO: 12915 - RNA, 27 nt, Human
cuugggaggaugaggcaggagaaucgc

SEQ ID NO: 12916 - RNA, 20 nt, Human
aagaaucccugcagccuggu

SEQ ID NO: 12917 - RNA, 25 nt, Human
ugauuuucucauuucuucaccuaca

SEQ ID NO: 12918 - RNA, 23 nt, Human
ucuugaacuccugaccucaggua

SEQ ID NO: 12919 - RNA, 26 nt, Human
gagggaggggcacagugaagaaggga

SEQ ID NO: 12920 - RNA, 20 nt, Human
uaugagccacuggccuggcc

SEQ ID NO: 12921 - RNA, 21 nt, Human
cagaaccuggccucaccugga

SEQ ID NO: 12922 - RNA, 22 nt, Human
cggugaggcaggggagucugcu

SEQ ID NO: 12923 - RNA, 25 nt, Human
ucccaggaccuggagacaggauugu

SEQ ID NO: 12924 - RNA, 25 nt, Human
cacucacuuccaccccaaacuccuc

SEQ ID NO: 12925 - RNA, 25 nt, Human
acauuuucacaguuauguuucuuca

SEQ ID NO: 12926 - RNA, 27 nt, Human
agcucuaaauacuaaugauauugagaa

SEQ ID NO: 12927 - RNA, 19 nt, Human
ucucuuccuguucugcacc

SEQ ID NO: 12928 - RNA, 24 nt, Human
gccucuuccugcugggcucccaga

SEQ ID NO: 12929 - RNA, 21 nt, Human
cucacucaggguggggucagg

SEQ ID NO: 12930 - RNA, 23 nt, Human
gccacagcugagccuguccucgc

SEQ ID NO: 12931 - RNA, 32 nt, Human
aacucagccuucaggacucuguccuccagcag

SEQ ID NO: 12932 - RNA, 27 nt, Human
ccugcuguccuuuccuguuugcuuuca

SEQ ID NO: 12933 - RNA, 26 nt, Human
aggaaggggaagaacaggacuccagg

SEQ ID NO: 12934 - RNA, 22 nt, Human
ccauuuacauggcauucucagc

SEQ ID NO: 12935 - RNA, 22 nt, Human
ugagccggguguuaggccagcu

SEQ ID NO: 12936 - RNA, 27 nt, Human
guggguguuaaaauguuuaucaugccu

SEQ ID NO: 12937 - RNA, 21 nt, Human
cuugucagugugaugaagauu

SEQ ID NO: 12938 - RNA, 20 nt, Human
uuuuucucaaaagaaggagg

SEQ ID NO: 12939 - RNA, 24 nt, Human
guccgcgccacccacccgcaaccu

SEQ ID NO: 12940 - RNA, 22 nt, Human
augggcaagggagagcgggugg

SEQ ID NO: 12941 - RNA, 20 nt, Human
agcacacccaaagaauuuuc

SEQ ID NO: 12942 - RNA, 24 nt, Human
gcgcaaucucagcucacugcaacc

SEQ ID NO: 12943 - RNA, 22 nt, Human
guccucugaggguggaugggaa

SEQ ID NO: 12944 - RNA, 26 nt, Human
uacagaagcgauuaggauuuuucgcu

SEQ ID NO: 12945 - RNA, 24 nt, Human
uugcccaggcuucucaccacggug

SEQ ID NO: 12946 - RNA, 22 nt, Human
uuggaguagacaaaaggaaagg

SEQ ID NO: 12947 - RNA, 28 nt, Human
aaagggaaucauuuuucacuguacauua

SEQ ID NO: 12948 - RNA, 21 nt, Human
ccucuccaucucucaccaagg

SEQ ID NO: 12949 - RNA, 23 nt, Human
uucagccggcccuggagugcggg

SEQ ID NO: 12950 - RNA, 27 nt, Human
cuuguugcuccugucaugugucaccau

SEQ ID NO: 12951 - RNA, 22 nt, Human
cccagcuaauuuuuauauucuu

SEQ ID NO: 12952 - RNA, 24 nt, Human
cagggcugugaugggcgagucccg

SEQ ID NO: 12953 - RNA, 21 nt, Human
caugcugucuggcccugggga

SEQ ID NO: 12954 - RNA, 21 nt, Human
gggucuuucauggggagagaa

SEQ ID NO: 12955 - RNA, 27 nt, Human
aggaagccucucuuucuucacuuacca

SEQ ID NO: 12956 - RNA, 23 nt, Human
ccaacucuuucucucucuggugu

SEQ ID NO: 12957 - RNA, 27 nt, Human
cacacacauguggcuaccauacuccug

SEQ ID NO: 12958 - RNA, 27 nt, Human
cagcucugagauccuggagugauauga

SEQ ID NO: 12959 - RNA, 19 nt, Human
caugggagauuucuguuaa

SEQ ID NO: 12960 - RNA, 27 nt, Human
agguaacagaacaccugucccccuagg

SEQ ID NO: 12961 - RNA, 20 nt, Human
gguuagggggagcaggaagc

SEQ ID NO: 12962 - RNA, 23 nt, Human
cuccaucuuagagagacagguca

SEQ ID NO: 12963 - RNA, 23 nt, Human
ucucccacucucucuuuccggug

SEQ ID NO: 12964 - RNA, 19 nt, Human
guaguuucaguccaucaca

SEQ ID NO: 12965 - RNA, 23 nt, Human
aggcugaagugcaguggugugau

SEQ ID NO: 12966 - RNA, 20 nt, Human
aaaucuucccuccucaccag

SEQ ID NO: 12967 - RNA, 25 nt, Human
ugggagaggacacgggcaugggcug

SEQ ID NO: 12968 - RNA, 22 nt, Human
ucaaagcugggauuacaggugu

SEQ ID NO: 12969 - RNA, 26 nt, Human
aggaaugacuuuauuaacuauaauau

SEQ ID NO: 12970 - RNA, 24 nt, Human
ugugagugcaagcuggcuugggga

SEQ ID NO: 12971 - RNA, 24 nt, Human
cugacugccugaacaucgagaugc

SEQ ID NO: 12972 - RNA, 21 nt, Human
uaaaaaccauuuaaacugcua

SEQ ID NO: 12973 - RNA, 24 nt, Human
ucucccagacuugcgugggucagu

SEQ ID NO: 12974 - RNA, 23 nt, Human
gugacugccggccgccgggaccc

SEQ ID NO: 12975 - RNA, 20 nt, Human
uugcuucagccagugcagug

SEQ ID NO: 12976 - RNA, 23 nt, Human
auuuugccucuccugucucccac

SEQ ID NO: 12977 - RNA, 18 nt, Human
accacuggaaaugccucc

SEQ ID NO: 12978 - RNA, 19 nt, Human
ggcccugggccugccucac

SEQ ID NO: 12979 - RNA, 26 nt, Human
uguaccccagcucucuucuaaaagag

SEQ ID NO: 12980 - RNA, 28 nt, Human
ggaggaagggggguugcaguggagaggg

SEQ ID NO: 12981 - RNA, 21 nt, Human
gccuguaauccuagcaguuug

SEQ ID NO: 12982 - RNA, 22 nt, Human
ugaacucacucccucacgggga

SEQ ID NO: 12983 - RNA, 21 nt, Human
uuauaaucauuaaagcacuuu

SEQ ID NO: 12984 - RNA, 19 nt, Human
uccuccaggcuggggcagg

SEQ ID NO: 12985 - RNA, 21 nt, Human
aacagcaugguaaauaauuga

SEQ ID NO: 12986 - RNA, 24 nt, Human
auuucuccuuaauugcuuaaggcc

SEQ ID NO: 12987 - RNA, 22 nt, Human
guuuuguuucucccuccaggcc

SEQ ID NO: 12988 - RNA, 25 nt, Human
ucugccuggucuauagcgugugugu

SEQ ID NO: 12989 - RNA, 22 nt, Human
aaaugagaagucauuaacugga

SEQ ID NO: 12990 - RNA, 23 nt, Human
guuguucuccgcccuccugcugg

SEQ ID NO: 12991 - RNA, 24 nt, Human
gccugcccgccugccccuccugcc

SEQ ID NO: 12992 - RNA, 26 nt, Human
gccuuucugugccuuuaaugaggacu

SEQ ID NO: 12993 - RNA, 21 nt, Human
uuguugggcaaggaugcuguc

SEQ ID NO: 12994 - RNA, 22 nt, Human
cccccucucucccuccuguguc

SEQ ID NO: 12995 - RNA, 22 nt, Human
uucagcuaagcuaggaaugaaa

SEQ ID NO: 12996 - RNA, 24 nt, Human
ccucuuucuccggcucccugcccc

SEQ ID NO: 12997 - RNA, 23 nt, Human
caguucccauugcuugugcucag

SEQ ID NO: 12998 - RNA, 22 nt, Human
uguaccugaagcagauccugua

SEQ ID NO: 12999 - RNA, 22 nt, Human
accuguaaucccagaacuuugg

SEQ ID NO: 13000 - RNA, 22 nt, Human
cagccaggcagcuucucugccu

SEQ ID NO: 13001 - RNA, 21 nt, Human
auaaaaauuauucacugugug

SEQ ID NO: 13002 - RNA, 27 nt, Human
cacaaguccuuguuccacugugccuug

SEQ ID NO: 13003 - RNA, 22 nt, Human
ccugccuccuaucagggccaga

SEQ ID NO: 13004 - RNA, 21 nt, Human
cugaagagacccaagucucuu

SEQ ID NO: 13005 - RNA, 21 nt, Human
cgggaggcagagguugcagug

SEQ ID NO: 13006 - RNA, 20 nt, Human
cgcagcacuccaguuccgcc

SEQ ID NO: 13007 - RNA, 22 nt, Human
cugcccaggcagcugguggugg

SEQ ID NO: 13008 - RNA, 22 nt, Human
gaggggaggggcgaggggaagc

SEQ ID NO: 13009 - RNA, 21 nt, Human
guuuuaagcccacacuaccca

SEQ ID NO: 13010 - RNA, 21 nt, Human
gauguucuugucuuuggagcu

SEQ ID NO: 13011 - RNA, 19 nt, Human
aggaaaccaggcagaggag

SEQ ID NO: 13012 - RNA, 22 nt, Human
uuucaguaauguugacuguauu

SEQ ID NO: 13013 - RNA, 21 nt, Human
ggagaagggagaacagggguc

SEQ ID NO: 13014 - RNA, 26 nt, Human
uauggacugggggccagaguccuuuc

SEQ ID NO: 13015 - RNA, 23 nt, Human
cuguggcuaggaggcucaaagga

SEQ ID NO: 13016 - RNA, 22 nt, Human
ggcccugugccugggcccuggg

SEQ ID NO: 13017 - RNA, 20 nt, Human
ggcuucaguccugccccugc

SEQ ID NO: 13018 - RNA, 26 nt, Human
cuauuuuugugcaauuacaucauguu

SEQ ID NO: 13019 - RNA, 28 nt, Human
caucuuuauauuaaacuuccccuguuca

SEQ ID NO: 13020 - RNA, 25 nt, Human
cacccaggcugccaggcuggagugg

SEQ ID NO: 13021 - RNA, 20 nt, Human
gcuccagguugggagcagug

SEQ ID NO: 13022 - RNA, 21 nt, Human
ugcccucugcuuuacucucau

SEQ ID NO: 13023 - RNA, 21 nt, Human
auccugagagaccugcccucu

SEQ ID NO: 13024 - RNA, 22 nt, Human
cugcaaccucuaccuccugggu

SEQ ID NO: 13025 - RNA, 22 nt, Human
cugcaaccucugccuccugagu

SEQ ID NO: 13026 - RNA, 21 nt, Human
acagucccuuugugagauaau

SEQ ID NO: 13027 - RNA, 26 nt, Human
ugacaccucugcacucccuugggcag

SEQ ID NO: 13028 - RNA, 22 nt, Human
cauccucccuucucuguccaca

SEQ ID NO: 13029 - RNA, 22 nt, Human
ggcaaggacccacucuggaaug

SEQ ID NO: 13030 - RNA, 21 nt, Human
ugugagccauggugcccggcu

SEQ ID NO: 13031 - RNA, 26 nt, Human
ggccucucucugccaaaaagcauuuu

SEQ ID NO: 13032 - RNA, 25 nt, Human
ccacagagaugagaauagaucaugu

SEQ ID NO: 13033 - RNA, 25 nt, Human
ugguaucagagcuaagaaugggacc

SEQ ID NO: 13034 - RNA, 22 nt, Human
ucuaggcacagauaaucuuuaa

SEQ ID NO: 13035 - RNA, 25 nt, Human
uugcuaugccgaaugcagccaaaau

SEQ ID NO: 13036 - RNA, 23 nt, Human
agcgcugggcuggugugcagugg

SEQ ID NO: 13037 - RNA, 20 nt, Human
ggguuucagccccacccuca

SEQ ID NO: 13038 - RNA, 22 nt, Human
gcucugccccaagacacacccu

SEQ ID NO: 13039 - RNA, 18 nt, Human
aaauggacacugugccca

SEQ ID NO: 13040 - RNA, 29 nt, Human
ugucacccaggcuggagugcaguagcgcg

SEQ ID NO: 13041 - RNA, 20 nt, Human
cuagacccuggaaggcaggg

SEQ ID NO: 13042 - RNA, 16 nt, Human
gcuuaaaaaugcuguu

SEQ ID NO: 13043 - RNA, 22 nt, Human
aggccagccugggaaacauggc

SEQ ID NO: 13044 - RNA, 27 nt, Human
aguucucuucuuuccacccugucccua

SEQ ID NO: 13045 - RNA, 20 nt, Human
uacuugguuuugcacauuaa

SEQ ID NO: 13046 - RNA, 23 nt, Human
agcagccaguaccgcagugccuu

SEQ ID NO: 13047 - RNA, 27 nt, Human
cccugcacuuucuuuagaugccuugau

SEQ ID NO: 13048 - RNA, 21 nt, Human
cccugcacuccagccugggug

SEQ ID NO: 13049 - RNA, 19 nt, Human
gacauaaaucacaggugca

SEQ ID NO: 13050 - RNA, 20 nt, Human
gcugcccucugcucuuuuca

SEQ ID NO: 13051 - RNA, 21 nt, Human
uguccgccccgcuucucuuau

SEQ ID NO: 13052 - RNA, 16 nt, Human
uucacaguaaugagua

SEQ ID NO: 13053 - RNA, 23 nt, Human
gaaccugaaugaacuggcuucau

SEQ ID NO: 13054 - RNA, 22 nt, Human
ccucugggcagcuccuggaaug

SEQ ID NO: 13055 - RNA, 27 nt, Human
aauacaaauacacaauccuccaagaau

SEQ ID NO: 13056 - RNA, 29 nt, Human
gcugcuugaaggggagacucccuccucug

SEQ ID NO: 13057 - RNA, 18 nt, Human
uuucagaugugaaccauu

SEQ ID NO: 13058 - RNA, 22 nt, Human
ugggauacagauuuuugcucag

SEQ ID NO: 13059 - RNA, 25 nt, Human
uugcagacgucugugccuagcaaua

SEQ ID NO: 13060 - RNA, 23 nt, Human
ccaaagugcugggauuacaaggg

SEQ ID NO: 13061 - RNA, 23 nt, Human
ucugccucuccuuugcuuuccuc

SEQ ID NO: 13062 - RNA, 23 nt, Human
gggcagcagcagggaucuggugg

SEQ ID NO: 13063 - RNA, 21 nt, Human
uaguauccccuccacuauccc

SEQ ID NO: 13064 - RNA, 23 nt, Human
gcaguguccaaggaacaagaaga

SEQ ID NO: 13065 - RNA, 22 nt, Human
acuuuugcaucugaccaaagga

SEQ ID NO: 13066 - RNA, 20 nt, Human
gcugcucauccuccugggcc

SEQ ID NO: 13067 - RNA, 23 nt, Human
uuccagcgauucuccugccucag

SEQ ID NO: 13068 - RNA, 23 nt, Human
gaucaagauauuuacuguugauc

SEQ ID NO: 13069 - RNA, 21 nt, Human
uucauuuguuuugagcaauaa

SEQ ID NO: 13070 - RNA, 21 nt, Human
uccuggcauucagcacugcuu

SEQ ID NO: 13071 - RNA, 20 nt, Human
uugucccaggcuuucuggug

SEQ ID NO: 13072 - RNA, 20 nt, Human
ggaccugcaggcagagacug

SEQ ID NO: 13073 - RNA, 20 nt, Human
gcuuggguuggaaaagagaa

SEQ ID NO: 13074 - RNA, 22 nt, Human
cuuuuugggaccaucacugaga

SEQ ID NO: 13075 - RNA, 26 nt, Human
cucugcccgcagccugaccucuagcc

SEQ ID NO: 13076 - RNA, 23 nt, Human
uguuguugccacccugugugacu

SEQ ID NO: 13077 - RNA, 22 nt, Human
caacauagugaaaccccgucuc

SEQ ID NO: 13078 - RNA, 22 nt, Human
uaacauagugaaacccugucuc

SEQ ID NO: 13079 - RNA, 20 nt, Human
ccagcucccaaauggcccau

SEQ ID NO: 13080 - RNA, 22 nt, Human
cauguggcaggcacugugcugg

SEQ ID NO: 13081 - RNA, 21 nt, Human
ugauuauuaaauguaaaauua

SEQ ID NO: 13082 - RNA, 25 nt, Human
ucccugcacacggcacagagcaucc

SEQ ID NO: 13083 - RNA, 23 nt, Human
ucuccccgccccuuccuggagcu

SEQ ID NO: 13084 - RNA, 24 nt, Human
ggcuccacccuccagcauguucuc

SEQ ID NO: 13085 - RNA, 24 nt, Human
gagccucaaacuauaguaacuuca

SEQ ID NO: 13086 - RNA, 21 nt, Human
uccuccaggggcagaacaugg

SEQ ID NO: 13087 - RNA, 23 nt, Human
caagaucacaccacuggcacucc

SEQ ID NO: 13088 - RNA, 24 nt, Human
ugucugccauggaugcaguagagg

SEQ ID NO: 13089 - RNA, 21 nt, Human
uggcuccaaucccaccugccu

SEQ ID NO: 13090 - RNA, 21 nt, Human
ugaagugaaguacagagcugg

SEQ ID NO: 13091 - RNA, 22 nt, Human
uuguaucccaauuuugcuuccc

SEQ ID NO: 13092 - RNA, 24 nt, Human
gggcaccaacagcguuccuccucc

SEQ ID NO: 13093 - RNA, 21 nt, Human
caaauucugcuugcuugcuuu

SEQ ID NO: 13094 - RNA, 25 nt, Human
ucucgaucuccugaccucaugaucc

SEQ ID NO: 13095 - RNA, 31 nt, Human
aucauguccuuacacuccagccuggauaaca

SEQ ID NO: 13096 - RNA, 25 nt, Human
aggcuauauguaguguaugugucuu

SEQ ID NO: 13097 - RNA, 21 nt, Human
ugccacugaccacagcucuuu

SEQ ID NO: 13098 - RNA, 19 nt, Human
caggagacaggaagguggu

SEQ ID NO: 13099 - RNA, 26 nt, Human
gccucauccuccucagcggcaggcca

SEQ ID NO: 13100 - RNA, 21 nt, Human
guucagucacuuguuuguguu

SEQ ID NO: 13101 - RNA, 20 nt, Human
cugggggagaggggaacagu

SEQ ID NO: 13102 - RNA, 24 nt, Human
gagcuaggacuacuaugggcgugc

SEQ ID NO: 13103 - RNA, 21 nt, Human
ggaggcaccaggcucaaaaga

SEQ ID NO: 13104 - RNA, 24 nt, Human
gggggaagcaaaguuucagggcag

SEQ ID NO: 13105 - RNA, 22 nt, Human
acagagccugggcugggcccgg

SEQ ID NO: 13106 - RNA, 22 nt, Human
guagggagaaaugagaaaucgc

SEQ ID NO: 13107 - RNA, 24 nt, Human
gagcuggcugugccugcuucugug

SEQ ID NO: 13108 - RNA, 27 nt, Human
cucacuggcccagugguguucuaccuc

SEQ ID NO: 13109 - RNA, 15 nt, Human
acuccaguguuacuu

SEQ ID NO: 13110 - RNA, 21 nt, Human
uuuuuuggugaaguacugaac

SEQ ID NO: 13111 - RNA, 23 nt, Human
gucucggaacuccugaccucagg

SEQ ID NO: 13112 - RNA, 21 nt, Human
uacuuugccagcacugccuuu

SEQ ID NO: 13113 - RNA, 25 nt, Human
ucugucauucaggcuggagugcagu

SEQ ID NO: 13114 - RNA, 26 nt, Human
ggaaaagaagagacuaggaaagcugg

SEQ ID NO: 13115 - RNA, 18 nt, Human
uagcugccaugcaccugu

SEQ ID NO: 13116 - RNA, 21 nt, Human
guucucuucugcucuagacag

SEQ ID NO: 13117 - RNA, 32 nt, Human
aaaaugucuugacauuuuacucuuaaacauga

SEQ ID NO: 13118 - RNA, 21 nt, Human
cagggaggaggaacggugggg

SEQ ID NO: 13119 - RNA, 27 nt, Human
guaggucugggauggacaggaaagggc

SEQ ID NO: 13120 - RNA, 21 nt, Human
gcucccggccacaggcagugg

SEQ ID NO: 13121 - RNA, 26 nt, Human
cagucugcaagauucugaaacauugc

SEQ ID NO: 13122 - RNA, 21 nt, Human
uguuggccaggcuggucucaa

SEQ ID NO: 13123 - RNA, 21 nt, Human
uguuggccaggauggucucca

SEQ ID NO: 13124 - RNA, 26 nt, Human
gcccuugggccccagccuccugcuca

SEQ ID NO: 13125 - RNA, 22 nt, Human
cagacuccugggcucaagcgau

SEQ ID NO: 13126 - RNA, 22 nt, Human
cuggggccaccacccugaccac

SEQ ID NO: 13127 - RNA, 17 nt, Human
cucucacuaugcugcua

SEQ ID NO: 13128 - RNA, 22 nt, Human
cccaucaaaucacagugccccu

SEQ ID NO: 13129 - RNA, 20 nt, Human
uauucuccuuucauccuggc

SEQ ID NO: 13130 - RNA, 22 nt, Human
cauucuccauccucauccucug

SEQ ID NO: 13131 - RNA, 25 nt, Human
uuuuccuuauuauuuugcuuaacuu

SEQ ID NO: 13132 - RNA, 23 nt, Human
ggcucagucaaucaaugcuuuau

SEQ ID NO: 13133 - RNA, 18 nt, Human
acagcccauuucuccaua

SEQ ID NO: 13134 - RNA, 22 nt, Human
gguuggaccuagugguguuguc

SEQ ID NO: 13135 - RNA, 21 nt, Human
caguagccuggccuuuuucug

SEQ ID NO: 13136 - RNA, 23 nt, Human
cuggccuuccucugugcaucacu

SEQ ID NO: 13137 - RNA, 20 nt, Human
gccccuccccucagccugcc

SEQ ID NO: 13138 - RNA, 20 nt, Human
caagacagauggacacugcc

SEQ ID NO: 13139 - RNA, 22 nt, Human
cgucuguaaucccagcgcuuug

SEQ ID NO: 13140 - RNA, 21 nt, Human
gugaacaaguccaugcugcca

SEQ ID NO: 13141 - RNA, 26 nt, Human
ccacagccagaauccacaggauccca

SEQ ID NO: 13142 - RNA, 26 nt, Human
aaacagccacuccuauucugagucuu

SEQ ID NO: 13143 - RNA, 27 nt, Human
ccccuggguacaugguggaugauuuua

SEQ ID NO: 13144 - RNA, 20 nt, Human
aguccugucccauuuccuca

SEQ ID NO: 13145 - RNA, 20 nt, Human
uuuugguuucucucuacuga

SEQ ID NO: 13146 - RNA, 28 nt, Human
uuucccgagggucuucugaggcaccgcg

SEQ ID NO: 13147 - RNA, 22 nt, Human
acuuuauuacgauuaguauaug

SEQ ID NO: 13148 - RNA, 25 nt, Human
cugcguucuggaggaggggggcaca

SEQ ID NO: 13149 - RNA, 24 nt, Human
ucuuguaaacaugaaaagggcuuu

SEQ ID NO: 13150 - RNA, 22 nt, Human
cuggccugcauccaggaaauag

SEQ ID NO: 13151 - RNA, 19 nt, Human
ggcuggcugggcguguagg

SEQ ID NO: 13152 - RNA, 19 nt, Human
uuccugcccccaucaugcc

SEQ ID NO: 13153 - RNA, 24 nt, Human
aaggcagcauccggggcugggugg

SEQ ID NO: 13154 - RNA, 19 nt, Human
cgugagccucccuguagcc

SEQ ID NO: 13155 - RNA, 28 nt, Human
auaguucccaaauaucauauagcuacug

SEQ ID NO: 13156 - RNA, 21 nt, Human
uuacauuuacugaauaagauu

SEQ ID NO: 13157 - RNA, 20 nt, Human
ccuccugcgcuccugccgcc

SEQ ID NO: 13158 - RNA, 22 nt, Human
ucagcuuuuguuccauuacugu

SEQ ID NO: 13159 - RNA, 23 nt, Human
ugcccccaaaggucucaacuccu

SEQ ID NO: 13160 - RNA, 22 nt, Human
auggaaaugauaugagauucga

SEQ ID NO: 13161 - RNA, 19 nt, Human
caaaagcuagaacacugcc

SEQ ID NO: 13162 - RNA, 24 nt, Human
uuugagauacaugauucucuuaga

SEQ ID NO: 13163 - RNA, 22 nt, Human
ccucuugccuuccccuguggcc

SEQ ID NO: 13164 - RNA, 21 nt, Human
gugggugggaggcacggggaa

SEQ ID NO: 13165 - RNA, 24 nt, Human
cucuuuccgucucaggucgccgcu

SEQ ID NO: 13166 - RNA, 26 nt, Human
uccuccucucugagggacuggaggga

SEQ ID NO: 13167 - RNA, 26 nt, Human
uguguucugaucacuggucugugccc

SEQ ID NO: 13168 - RNA, 24 nt, Human
cuccagccucuucggccuccucgc

SEQ ID NO: 13169 - RNA, 23 nt, Human
cauucccaguccccagcuggggc

SEQ ID NO: 13170 - RNA, 21 nt, Human
cugcuuugucccucaggugga

SEQ ID NO: 13171 - RNA, 24 nt, Human
guguucucuuugguguuacacagc

SEQ ID NO: 13172 - RNA, 26 nt, Human
gaugccauuaguugaagaaacuucuu

SEQ ID NO: 13173 - RNA, 25 nt, Human
ccagcucuccagccuggcaggaaag

SEQ ID NO: 13174 - RNA, 19 nt, Human
gaagcaucugcugucauga

SEQ ID NO: 13175 - RNA, 23 nt, Human
uauuuauagucacaagagcccag

SEQ ID NO: 13176 - RNA, 27 nt, Human
agugggcuggaugucuccaucucuguc

SEQ ID NO: 13177 - RNA, 25 nt, Human
gccgacuuggaaaugugaacgcaag

SEQ ID NO: 13178 - RNA, 21 nt, Human
ccuaggacugcgggcaaggga

SEQ ID NO: 13179 - RNA, 21 nt, Human
gaagagcaccuguugcugcaa

SEQ ID NO: 13180 - RNA, 22 nt, Human
uucuguguaucucuuucacauu

SEQ ID NO: 13181 - RNA, 25 nt, Human
agcuacuucugaaacugcagcagug

SEQ ID NO: 13182 - RNA, 25 nt, Human
gaguacaccugcucacguaggcguc

SEQ ID NO: 13183 - RNA, 22 nt, Human
aggcugaggcggguggaucaca

SEQ ID NO: 13184 - RNA, 23 nt, Human
gaaaaccaccaaaaggccagugc

SEQ ID NO: 13185 - RNA, 23 nt, Human
agacauuaaacauuuuagugcua

SEQ ID NO: 13186 - RNA, 24 nt, Human
caacauccuucaucaauacuuucc

SEQ ID NO: 13187 - RNA, 22 nt, Human
gugucccuggacacagcucuuc

SEQ ID NO: 13188 - RNA, 22 nt, Human
ccaccuccuggguucaagcagu

SEQ ID NO: 13189 - RNA, 22 nt, Human
ugauaguuaccuaaagugacac

SEQ ID NO: 13190 - RNA, 23 nt, Human
cuguauuuccacagauuucuccc

SEQ ID NO: 13191 - RNA, 26 nt, Human
ggcccaggaaggugccuggcccagaa

SEQ ID NO: 13192 - RNA, 22 nt, Human
uccuaaccugaggccugggguu

SEQ ID NO: 13193 - RNA, 18 nt, Human
gggcuucugacugcucca

SEQ ID NO: 13194 - RNA, 26 nt, Human
cagagcuguggcggggggcgccgucc

SEQ ID NO: 13195 - RNA, 24 nt, Human
agauuuaaccccuccacugcuggg

SEQ ID NO: 13196 - RNA, 19 nt, Human
uaaucaggaaaaauagcuu

SEQ ID NO: 13197 - RNA, 27 nt, Human
aaguccccaagagacucgccugagcag

SEQ ID NO: 13198 - RNA, 19 nt, Human
cuugcaguucuaugauaga

SEQ ID NO: 13199 - RNA, 23 nt, Human
ccugaaagccuggccugcuccgc

SEQ ID NO: 13200 - RNA, 21 nt, Human
guucucuucugcauuuuucag

SEQ ID NO: 13201 - RNA, 27 nt, Human
gccucccaccuggugugcacagcugcc

SEQ ID NO: 13202 - RNA, 23 nt, Human
ggaggaggggcgagcuguggagc

SEQ ID NO: 13203 - RNA, 21 nt, Human
ugcucaggcugggaggcagag

SEQ ID NO: 13204 - RNA, 25 nt, Human
agggaaaguagggcagaaacuggau

SEQ ID NO: 13205 - RNA, 22 nt, Human
gaaauggacacagggaucuucu

SEQ ID NO: 13206 - RNA, 21 nt, Human
agggaaaggcugggagaacac

SEQ ID NO: 13207 - RNA, 23 nt, Human
ugccaggaaggaagagcagcagc

SEQ ID NO: 13208 - RNA, 27 nt, Human
uguguauggagggucuagccuggguga

SEQ ID NO: 13209 - RNA, 18 nt, Human
uacuuccugguugcaacc

SEQ ID NO: 13210 - RNA, 22 nt, Human
cacucuguugguggccucugcu

SEQ ID NO: 13211 - RNA, 22 nt, Human
agccuccugaguagcugggauu

SEQ ID NO: 13212 - RNA, 21 nt, Human
cagaauccagcuguuacucgu

SEQ ID NO: 13213 - RNA, 22 nt, Human
auuguaaccuccgucucccagg

SEQ ID NO: 13214 - RNA, 23 nt, Human
uguggugaugggagggaggaagc

SEQ ID NO: 13215 - RNA, 27 nt, Human
acugcaaccuccgacucccugguucaa

SEQ ID NO: 13216 - RNA, 22 nt, Human
cugcccaggaggcugaggcaug

SEQ ID NO: 13217 - RNA, 23 nt, Human
aggaaggggaauggaauagguua

SEQ ID NO: 13218 - RNA, 25 nt, Human
agaugcccaccgugacagugcccca

SEQ ID NO: 13219 - RNA, 20 nt, Human
uuuuuauaccaaaggugcua

SEQ ID NO: 13220 - RNA, 16 nt, Human
cuucccuucuugguuu

SEQ ID NO: 13221 - RNA, 27 nt, Human
cacggagccuggagggaugccacccag

SEQ ID NO: 13222 - RNA, 28 nt, Human
ugucuguugccaaacagccugcccuccc

SEQ ID NO: 13223 - RNA, 27 nt, Human
cucgaguagcugggaccacacagacag

SEQ ID NO: 13224 - RNA, 23 nt, Human
ggcgacugucauguggcuugguu

SEQ ID NO: 13225 - RNA, 26 nt, Human
aacacuacugaauuauaaaaauucaa

SEQ ID NO: 13226 - RNA, 26 nt, Human
ucucuuuuuacaaggcuguauucagc

SEQ ID NO: 13227 - RNA, 20 nt, Human
gccaggauguuggcagccgg

SEQ ID NO: 13228 - RNA, 27 nt, Human
ccuucucugcuuaaagaaugcccuuua

SEQ ID NO: 13229 - RNA, 21 nt, Human
cucuccaagcaggaagggaaa

SEQ ID NO: 13230 - RNA, 22 nt, Human
gcucagagccacccacagccgc

SEQ ID NO: 13231 - RNA, 21 nt, Human
gaaugcauauaucucccaaca

SEQ ID NO: 13232 - RNA, 26 nt, Human
gccagccucuguuucugggaggauga

SEQ ID NO: 13233 - RNA, 22 nt, Human
ccaaagcguugggauuauaggc

SEQ ID NO: 13234 - RNA, 23 nt, Human
ucaaaacaacccccacacagacc

SEQ ID NO: 13235 - RNA, 26 nt, Human
cucaacaaaugaggagcuggucuuug

SEQ ID NO: 13236 - RNA, 24 nt, Human
uggaaucccagauaugguugcaca

SEQ ID NO: 13237 - RNA, 21 nt, Human
agaacaaugugaggucauucu

SEQ ID NO: 13238 - RNA, 26 nt, Human
cccaaaugcugggauuacagacauga

SEQ ID NO: 13239 - RNA, 19 nt, Human
aguccuuaacaucuaccuc

SEQ ID NO: 13240 - RNA, 25 nt, Human
cacccaggaggugcgaguguggcug

SEQ ID NO: 13241 - RNA, 20 nt, Human
cuaaaaaguuguauuacaaa

SEQ ID NO: 13242 - RNA, 24 nt, Human
uccuuucaccccaggacucuaaau

SEQ ID NO: 13243 - RNA, 21 nt, Human
aaauuugauaaugacacuguu

SEQ ID NO: 13244 - RNA, 21 nt, Human
ggucaccccaaccucuggcuc

SEQ ID NO: 13245 - RNA, 24 nt, Human
gcuguccuuggggcguuccagggc

SEQ ID NO: 13246 - RNA, 19 nt, Human
uucaaaccuuuuagcccua

SEQ ID NO: 13247 - RNA, 24 nt, Human
ccagagccacagacucacagccca

SEQ ID NO: 13248 - RNA, 22 nt, Human
agccgcaggcuccucucuggca

SEQ ID NO: 13249 - RNA, 27 nt, Human
acaugggcagagauagccgugugagca

SEQ ID NO: 13250 - RNA, 23 nt, Human
cuuggauuggacaggagaucagc

SEQ ID NO: 13251 - RNA, 23 nt, Human
cuuccugguucauguguucuggg

SEQ ID NO: 13252 - RNA, 21 nt, Human
ccuccacuccuauguguaucc

SEQ ID NO: 13253 - RNA, 22 nt, Human
ucaugccacugcacugcagccu

SEQ ID NO: 13254 - RNA, 21 nt, Human
uuccuguuucuccucaguucc

SEQ ID NO: 13255 - RNA, 22 nt, Human
cuggggcgagggucagagcugg

SEQ ID NO: 13256 - RNA, 21 nt, Human
cagcuuugggguuccuuuuau

SEQ ID NO: 13257 - RNA, 22 nt, Human
ccugaacagcagcugcagcagc

SEQ ID NO: 13258 - RNA, 21 nt, Human
auacauacuguccaauuuuca

SEQ ID NO: 13259 - RNA, 22 nt, Human
gcucacuacaagcucugccucc

SEQ ID NO: 13260 - RNA, 21 nt, Human
cugcagccacacacccacccg

SEQ ID NO: 13261 - RNA, 27 nt, Human
cuccagccucagcccccugcuucaguc

SEQ ID NO: 13262 - RNA, 18 nt, Human
ucucucugcugugucgcc

SEQ ID NO: 13263 - RNA, 21 nt, Human
ggagcuugggcaggccagcuu

SEQ ID NO: 13264 - RNA, 26 nt, Human
aguugaguuaauacaagugacauagc

SEQ ID NO: 13265 - RNA, 21 nt, Human
cauuuccugggaucagccuga

SEQ ID NO: 13266 - RNA, 25 nt, Human
ugccauccugcagcugaaaugggaa

SEQ ID NO: 13267 - RNA, 22 nt, Human
ccgggagguggagauugcagug

SEQ ID NO: 13268 - RNA, 26 nt, Human
cgcuucuguccccuuccugucugccc

SEQ ID NO: 13269 - RNA, 20 nt, Human
agacacuguccuuccccuca

SEQ ID NO: 13270 - RNA, 22 nt, Human
ucuucuuuucauuauuucuaau

SEQ ID NO: 13271 - RNA, 22 nt, Human
acaaucucccuccauaauguga

SEQ ID NO: 13272 - RNA, 19 nt, Human
aggcaauucuccugccuuu

SEQ ID NO: 13273 - RNA, 26 nt, Human
accauggauaccacacauuucucauc

SEQ ID NO: 13274 - RNA, 20 nt, Human
ccaggacacgcagggaccac

SEQ ID NO: 13275 - RNA, 24 nt, Human
ccuucugcuccuaggaggcugcuu

SEQ ID NO: 13276 - RNA, 25 nt, Human
ugagccaagauugcacacugcacuc

SEQ ID NO: 13277 - RNA, 24 nt, Human
agauacugaagacauuuuguuucc

SEQ ID NO: 13278 - RNA, 23 nt, Human
aucuucuuugagacaaggcaggc

SEQ ID NO: 13279 - RNA, 21 nt, Human
uguucauguccccucucuccc

SEQ ID NO: 13280 - RNA, 24 nt, Human
guuucccuuuguucacauucucug

SEQ ID NO: 13281 - RNA, 20 nt, Human
ccgcuuccugcaucuugccc

SEQ ID NO: 13282 - RNA, 25 nt, Human
uucauucuuguaguauuucaucaca

SEQ ID NO: 13283 - RNA, 22 nt, Human
guuuuacaaaaagggagauuuu

SEQ ID NO: 13284 - RNA, 23 nt, Human
ggugguuccaauugguggagaga

SEQ ID NO: 13285 - RNA, 20 nt, Human
aaucauaauaaucaugauaa

SEQ ID NO: 13286 - RNA, 25 nt, Human
agaaagggagagagggccaggcagu

SEQ ID NO: 13287 - RNA, 27 nt, Human
ggcuggguuuuuaucugaauaacucac

SEQ ID NO: 13288 - RNA, 23 nt, Human
ucccugugugccuuccuuuccca

SEQ ID NO: 13289 - RNA, 21 nt, Human
uagaacaauauuccauauaaa

SEQ ID NO: 13290 - RNA, 20 nt, Human
ccuuaaagcacagcccaggg

SEQ ID NO: 13291 - RNA, 23 nt, Human
aaacuuuaaaauaccugcuuuau

SEQ ID NO: 13292 - RNA, 19 nt, Human
gucgagaccuguucacgga

SEQ ID NO: 13293 - RNA, 19 nt, Human
guggggaaagauggcggaa

SEQ ID NO: 13294 - RNA, 24 nt, Human
ucuccccucugcacccuuggcucu

SEQ ID NO: 13295 - RNA, 21 nt, Human
gugcuuuucgcuuucuuucug

SEQ ID NO: 13296 - RNA, 22 nt, Human
gcugugaugcccagcuucccuu

SEQ ID NO: 13297 - RNA, 26 nt, Human
ucacccuguuggccaggcuggagugc

SEQ ID NO: 13298 - RNA, 22 nt, Human
cacuuccucccuccgggggauu

SEQ ID NO: 13299 - RNA, 27 nt, Human
uugcccagucuucagcggagcaguuuu

SEQ ID NO: 13300 - RNA, 23 nt, Human
gccuggucaaccaucacuuccuu

SEQ ID NO: 13301 - RNA, 19 nt, Human
acaaggcagaaguugguga

SEQ ID NO: 13302 - RNA, 27 nt, Human
cuaccugcauuaagucaggacugagca

SEQ ID NO: 13303 - RNA, 20 nt, Human
aggcaucaccauugcaauca

SEQ ID NO: 13304 - RNA, 20 nt, Human
ucugggcaaagaggauccga

SEQ ID NO: 13305 - RNA, 27 nt, Human
gagcccaagaugccucugcugcuccuu

SEQ ID NO: 13306 - RNA, 27 nt, Human
caggcuggggucgcugcguugcugugc

SEQ ID NO: 13307 - RNA, 21 nt, Human
cagcagguuccagugccugac

SEQ ID NO: 13308 - RNA, 24 nt, Human
uuuggcugccuuaucccagggcug

SEQ ID NO: 13309 - RNA, 24 nt, Human
gguuuaaaucuacucucacaugga

SEQ ID NO: 13310 - RNA, 26 nt, Human
uuauuacccuguguaccuugucccuc

SEQ ID NO: 13311 - RNA, 19 nt, Human
ggccuggacaaugcuggaa

SEQ ID NO: 13312 - RNA, 27 nt, Human
cugggugacaagagcaaaacuccaucu

SEQ ID NO: 13313 - RNA, 21 nt, Human
cuugacagaaugaggugcgcg

SEQ ID NO: 13314 - RNA, 29 nt, Human
cccuuaugauccuucacauucauuuuaug

SEQ ID NO: 13315 - RNA, 29 nt, Human
cgcaccguggcuggaguccugagcagcac

SEQ ID NO: 13316 - RNA, 21 nt, Human
ucucuugccagcuuuuucccg

SEQ ID NO: 13317 - RNA, 21 nt, Human
guugcccaggagggucucgaa

SEQ ID NO: 13318 - RNA, 28 nt, Human
aggagacggcuccaggcacucagggucg

SEQ ID NO: 13319 - RNA, 21 nt, Human
ggugaauucucaggugaacuu

SEQ ID NO: 13320 - RNA, 26 nt, Human
acacauuuagccuuauagacauugcc

SEQ ID NO: 13321 - RNA, 21 nt, Human
uguuggccaggcugguuucaa

SEQ ID NO: 13322 - RNA, 19 nt, Human
uuuaguaguaaaagacugg

SEQ ID NO: 13323 - RNA, 27 nt, Human
uguaccucccucacuucucuccuauca

SEQ ID NO: 13324 - RNA, 24 nt, Human
ucacaagaacacacacauauacac

SEQ ID NO: 13325 - RNA, 27 nt, Human
gcaugccaucccaagauuauguccuca

SEQ ID NO: 13326 - RNA, 23 nt, Human
agcaaaaaucuuggcugggugga

SEQ ID NO: 13327 - RNA, 30 nt, Human
ccaccugcgugucccuuccuccccgaguca

SEQ ID NO: 13328 - RNA, 25 nt, Human
gcaagcuaacugcuugaacccagaa

SEQ ID NO: 13329 - RNA, 28 nt, Human
ccugccccacagcccugccuggauuugu

SEQ ID NO: 13330 - RNA, 20 nt, Human
acccaggcuggagugcagug

SEQ ID NO: 13331 - RNA, 22 nt, Human
ucauucucuacucuggccaaca

SEQ ID NO: 13332 - RNA, 25 nt, Human
ccagcgccggcaucuggagacccua

SEQ ID NO: 13333 - RNA, 24 nt, Human
ucauguugccauuuaaugcaugga

SEQ ID NO: 13334 - RNA, 20 nt, Human
uggaggugggguguuuggga

SEQ ID NO: 13335 - RNA, 21 nt, Human
gguuaucaaauucuguucacu

SEQ ID NO: 13336 - RNA, 23 nt, Human
agagaaacucuguaaguggaauc

SEQ ID NO: 13337 - RNA, 22 nt, Human
ugauggccaccgcagggggcag

SEQ ID NO: 13338 - RNA, 20 nt, Human
agcaguuuuaguuuuaauua

SEQ ID NO: 13339 - RNA, 26 nt, Human
gcuuccucuguuuuguuuuaagcauc

SEQ ID NO: 13340 - RNA, 22 nt, Human
gugauucuccugccacagccuc

SEQ ID NO: 13341 - RNA, 18 nt, Human
ggacuguguucuuucugg

SEQ ID NO: 13342 - RNA, 27 nt, Human
gucgcccaggcuagaguggauuggcgu

SEQ ID NO: 13343 - RNA, 21 nt, Human
gccgugagcugaagagguuuc

SEQ ID NO: 13344 - RNA, 20 nt, Human
uagacaaugcaaaauuugua

SEQ ID NO: 13345 - RNA, 22 nt, Human
cgcccaggcuggagggcagugg

SEQ ID NO: 13346 - RNA, 22 nt, Human
cgcccaugcuggagugcagugg

SEQ ID NO: 13347 - RNA, 20 nt, Human
gccaaacacuguaagcuuuu

SEQ ID NO: 13348 - RNA, 22 nt, Human
cuguagucccagcuaugcgaga

SEQ ID NO: 13349 - RNA, 22 nt, Human
gucauuuacacauauuuuugca

SEQ ID NO: 13350 - RNA, 23 nt, Human
auucauacuggggagaaacccca

SEQ ID NO: 13351 - RNA, 22 nt, Human
cugcaaccuccaccucgcaggu

SEQ ID NO: 13352 - RNA, 22 nt, Human
gcaugagccaccgcacccagcc

SEQ ID NO: 13353 - RNA, 27 nt, Human
gaaagagaacugcauucguagcauugu

SEQ ID NO: 13354 - RNA, 21 nt, Human
gcugcagcugcugcagcugcu

SEQ ID NO: 13355 - RNA, 21 nt, Human
aagaggagacugggaggcagc

SEQ ID NO: 13356 - RNA, 25 nt, Human
uuucauuuuguugcauucauccugc

SEQ ID NO: 13357 - RNA, 20 nt, Human
gaguuagagguugcagugag

SEQ ID NO: 13358 - RNA, 23 nt, Human
gcaguaaaauuaacuacaguguu

SEQ ID NO: 13359 - RNA, 22 nt, Human
gccagaacuuaaaaucugcugg

SEQ ID NO: 13360 - RNA, 20 nt, Human
gaugcagaagguuucucugg

SEQ ID NO: 13361 - RNA, 23 nt, Human
cgaguugcugggauugcgggcau

SEQ ID NO: 13362 - RNA, 18 nt, Human
ucaagugccauucauccu

SEQ ID NO: 13363 - RNA, 27 nt, Human
gcucugucacccaggcuggagugcuau

SEQ ID NO: 13364 - RNA, 21 nt, Human
gcauguggacacucagucaca

SEQ ID NO: 13365 - RNA, 22 nt, Human
ugcauaguacaugaaucuauug

SEQ ID NO: 13366 - RNA, 26 nt, Human
gccucucucccugaucuuacgugcuc

SEQ ID NO: 13367 - RNA, 27 nt, Human
gggcugggccauggagcuggcccagag

SEQ ID NO: 13368 - RNA, 25 nt, Human
agaugggaagagcaucuccaggcaa

SEQ ID NO: 13369 - RNA, 20 nt, Human
guuccuguccaucacugaug

SEQ ID NO: 13370 - RNA, 21 nt, Human
cgcccccgccucaacgcccag

SEQ ID NO: 13371 - RNA, 22 nt, Human
ggcugagacaggggagugagaa

SEQ ID NO: 13372 - RNA, 21 nt, Human
caguccagcuuccuguccucc

SEQ ID NO: 13373 - RNA, 24 nt, Human
gaagggucagggcuucuguggaac

SEQ ID NO: 13374 - RNA, 26 nt, Human
uagaaaacauuaguuuucuucuguug

SEQ ID NO: 13375 - RNA, 24 nt, Human
gccucaguuaagccuuuguggacu

SEQ ID NO: 13376 - RNA, 26 nt, Human
acacacacaugcuucccuuuccugag

SEQ ID NO: 13377 - RNA, 32 nt, Human
uccuccacgaagcccuccucaggcacaucgag

SEQ ID NO: 13378 - RNA, 22 nt, Human
uuuuaaauuacuuaucuucuau

SEQ ID NO: 13379 - RNA, 21 nt, Human
cugcauccucaaccuccuggg

SEQ ID NO: 13380 - RNA, 22 nt, Human
gcucacugcagccucaaacucc

SEQ ID NO: 13381 - RNA, 22 nt, Human
cccgcucccaggacccgcuuau

SEQ ID NO: 13382 - RNA, 23 nt, Human
agucguuggaggcuggagcgcaa

SEQ ID NO: 13383 - RNA, 24 nt, Human
ucuguacauacuggccucugugau

SEQ ID NO: 13384 - RNA, 21 nt, Human
ugcccugccugggcucauagg

SEQ ID NO: 13385 - RNA, 23 nt, Human
gucugcacucuaacccuaggcau

SEQ ID NO: 13386 - RNA, 28 nt, Human
aggauucccagagagacgcugugauugg

SEQ ID NO: 13387 - RNA, 23 nt, Human
ggucucuuugcauuucuccaugc

SEQ ID NO: 13388 - RNA, 27 nt, Human
gcccagccuguggagagacccugcaag

SEQ ID NO: 13389 - RNA, 25 nt, Human
uggguggaaagagaggcuguuuucu

SEQ ID NO: 13390 - RNA, 24 nt, Human
acaugugccuuccguccagagcag

SEQ ID NO: 13391 - RNA, 25 nt, Human
cuauuguacauauuuuuauauucuc

SEQ ID NO: 13392 - RNA, 17 nt, Human
cagcucuuccuugccug

SEQ ID NO: 13393 - RNA, 21 nt, Human
cugccuggcgaacccuggugu

SEQ ID NO: 13394 - RNA, 26 nt, Human
caucucgggaagugggagagccccca

SEQ ID NO: 13395 - RNA, 22 nt, Human
ucuuccuugugucuuucgcucc

SEQ ID NO: 13396 - RNA, 23 nt, Human
aucaggaggggacagcugggggc

SEQ ID NO: 13397 - RNA, 22 nt, Human
cugcuucuuuguccucgccaca

SEQ ID NO: 13398 - RNA, 21 nt, Human
agugaagucuugcccucucug

SEQ ID NO: 13399 - RNA, 21 nt, Human
uacugcauauggcacaauguu

SEQ ID NO: 13400 - RNA, 21 nt, Human
ggcucacugcaagcucggccu

SEQ ID NO: 13401 - RNA, 22 nt, Human
ggaaguugaaaguggggaauga

SEQ ID NO: 13402 - RNA, 20 nt, Human
ggcagcgucuggacuccagg

SEQ ID NO: 13403 - RNA, 21 nt, Human
uacccaggcuggggcuucugg

SEQ ID NO: 13404 - RNA, 22 nt, Human
cucuuuccuccucacucaggcu

SEQ ID NO: 13405 - RNA, 21 nt, Human
uuaguuccuuaaucauuucac

SEQ ID NO: 13406 - RNA, 24 nt, Human
cuuuuguuaugacuuagcugacuu

SEQ ID NO: 13407 - RNA, 26 nt, Human
ccgcccagccccaggucuccccaggc

SEQ ID NO: 13408 - RNA, 23 nt, Human
cagcccaccccuccaccucucuc

SEQ ID NO: 13409 - RNA, 21 nt, Human
aaaaagaguggaccaaaacac

SEQ ID NO: 13410 - RNA, 24 nt, Human
aagguuuuuuacauguguaacaau

SEQ ID NO: 13411 - RNA, 27 nt, Human
uuucuuuauaaaugcaaauggcuaccg

SEQ ID NO: 13412 - RNA, 27 nt, Human
guaggccagaaguccagggcugcacug

SEQ ID NO: 13413 - RNA, 22 nt, Human
guacuguuccagcaucuucccu

SEQ ID NO: 13414 - RNA, 23 nt, Human
cucuguuuauaaaaacaaaaaca

SEQ ID NO: 13415 - RNA, 21 nt, Human
gagggaggaaaacugauggag

SEQ ID NO: 13416 - RNA, 18 nt, Human
ccccucgggggcagcaca

SEQ ID NO: 13417 - RNA, 21 nt, Human
gacggcccuggcagaggucgg

SEQ ID NO: 13418 - RNA, 24 nt, Human
uggugggcagugggcaaggcggug

SEQ ID NO: 13419 - RNA, 26 nt, Human
ccugcuguguugcugcccagccgcuc

SEQ ID NO: 13420 - RNA, 23 nt, Human
agaagaaggagggagggagccag

SEQ ID NO: 13421 - RNA, 21 nt, Human
agggcccuucacuuccaucac

SEQ ID NO: 13422 - RNA, 25 nt, Human
aaccccuuucccaccccaaccugcu

SEQ ID NO: 13423 - RNA, 20 nt, Human
auaguauuuuuguugucaaa

SEQ ID NO: 13424 - RNA, 21 nt, Human
aaacuauauaggugcuaugua

SEQ ID NO: 13425 - RNA, 18 nt, Human
guauguuugugaaagaca

SEQ ID NO: 13426 - RNA, 26 nt, Human
cgcgccgccucucacucacagccucc

SEQ ID NO: 13427 - RNA, 24 nt, Human
ggaguauuuggccugaaauuggga

SEQ ID NO: 13428 - RNA, 22 nt, Human
gugcccucaccagacacccugu

SEQ ID NO: 13429 - RNA, 22 nt, Human
auuuauuuccaccacagcagau

SEQ ID NO: 13430 - RNA, 25 nt, Human
auacaacaauguucuuuuuuguuac

SEQ ID NO: 13431 - RNA, 18 nt, Human
ggccucggcccggccuca

SEQ ID NO: 13432 - RNA, 27 nt, Human
uucuccucugcugcagcaugauuuucu

SEQ ID NO: 13433 - RNA, 24 nt, Human
gaccacguuucucacuaguacuuu

SEQ ID NO: 13434 - RNA, 19 nt, Human
ggagccaccuccaacucua

SEQ ID NO: 13435 - RNA, 26 nt, Human
gcagggcuagcaacaucguagguguu

SEQ ID NO: 13436 - RNA, 23 nt, Human
ugaguagcugggauuacaggcgu

SEQ ID NO: 13437 - RNA, 22 nt, Human
acaccugccuauacucacuaau

SEQ ID NO: 13438 - RNA, 22 nt, Human
cccugcuacacauacaggauuu

SEQ ID NO: 13439 - RNA, 21 nt, Human
uggccucccagaguccugcca

SEQ ID NO: 13440 - RNA, 20 nt, Human
agccccucgccccaacuucu

SEQ ID NO: 13441 - RNA, 22 nt, Human
caggcugcagugcaguggugug

SEQ ID NO: 13442 - RNA, 22 nt, Human
cccacagugcugggauuacagg

SEQ ID NO: 13443 - RNA, 27 nt, Human
cucugcaggaaauggcuguggagugug

SEQ ID NO: 13444 - RNA, 23 nt, Human
gagaagggagaccuggcagugga

SEQ ID NO: 13445 - RNA, 20 nt, Human
uauuacccuuucuaacucug

SEQ ID NO: 13446 - RNA, 24 nt, Human
uaugaucucagcucacugcagccu

SEQ ID NO: 13447 - RNA, 24 nt, Human
cgugaucuuggcucacugcagccu

SEQ ID NO: 13448 - RNA, 21 nt, Human
ucuggagaagcuugugguguu

SEQ ID NO: 13449 - RNA, 20 nt, Human
caguuguguuagccucuugc

SEQ ID NO: 13450 - RNA, 22 nt, Human
cccagccaugaguguggagcug

SEQ ID NO: 13451 - RNA, 21 nt, Human
gaagaaagaggaggggcuggc

SEQ ID NO: 13452 - RNA, 29 nt, Human
ucagauccagaaggagcaagaaucaaguu

SEQ ID NO: 13453 - RNA, 25 nt, Human
ccugaguccuguucccugaaacugg

SEQ ID NO: 13454 - RNA, 26 nt, Human
ucugccuucuuccuccacuuguguca

SEQ ID NO: 13455 - RNA, 23 nt, Human
agagcacccucccucccggcccc

SEQ ID NO: 13456 - RNA, 23 nt, Human
guguaaugguucuccuggggcug

SEQ ID NO: 13457 - RNA, 21 nt, Human
uuugguauuauauaugaucau

SEQ ID NO: 13458 - RNA, 25 nt, Human
gggagagaagcuggacugcagcugg

SEQ ID NO: 13459 - RNA, 21 nt, Human
guugucauugcuccugcagcc

SEQ ID NO: 13460 - RNA, 26 nt, Human
gugcagcuggaggcagagcaguccuc

SEQ ID NO: 13461 - RNA, 25 nt, Human
agcuuagaaacuggaaauacuagau

SEQ ID NO: 13462 - RNA, 22 nt, Human
ccucgcucgccuccuguaccca

SEQ ID NO: 13463 - RNA, 28 nt, Human
ggaagcaaaggcagaggcccuggggugg

SEQ ID NO: 13464 - RNA, 17 nt, Human
ugucccaccccuagcca

SEQ ID NO: 13465 - RNA, 23 nt, Human
uggagacucacugcaaguuccug

SEQ ID NO: 13466 - RNA, 22 nt, Human
gccuccccaccuucuucagcca

SEQ ID NO: 13467 - RNA, 27 nt, Human
cacugcacucagaccagaaaucuagaa

SEQ ID NO: 13468 - RNA, 27 nt, Human
gggagcuggauccagagcuggaggggg

SEQ ID NO: 13469 - RNA, 22 nt, Human
cgaggugggcagguaggugggc

SEQ ID NO: 13470 - RNA, 21 nt, Human
gaaaccauggcagcuccaucu

SEQ ID NO: 13471 - RNA, 22 nt, Human
caaucuccuguggauggagcua

SEQ ID NO: 13472 - RNA, 20 nt, Human
auccgguuuguuguggugug

SEQ ID NO: 13473 - RNA, 26 nt, Human
uucgcaccauucuccugccucagccu

SEQ ID NO: 13474 - RNA, 20 nt, Human
auagccacuggcagcuuuga

SEQ ID NO: 13475 - RNA, 19 nt, Human
accuuuccuuuagcauuag

SEQ ID NO: 13476 - RNA, 20 nt, Human
ucccucuccccaaaugggcc

SEQ ID NO: 13477 - RNA, 19 nt, Human
ucugcacucccuugggcag

SEQ ID NO: 13478 - RNA, 25 nt, Human
ccagaagaaagaccuauaugaugcg

SEQ ID NO: 13479 - RNA, 22 nt, Human
uccaaggguaggcaaccaccuu

SEQ ID NO: 13480 - RNA, 21 nt, Human
uggccaccccgccuccuuggc

SEQ ID NO: 13481 - RNA, 20 nt, Human
ccacaucuggcuuucucagc

SEQ ID NO: 13482 - RNA, 20 nt, Human
ugcccacgcuggagugcagu

SEQ ID NO: 13483 - RNA, 23 nt, Human
gucuuucugacauacacacugca

SEQ ID NO: 13484 - RNA, 20 nt, Human
ucucuugccgacccgccacg

SEQ ID NO: 13485 - RNA, 22 nt, Human
cacuggcagacuuccagaaggg

SEQ ID NO: 13486 - RNA, 26 nt, Human
cuccuggggugcaguggugagucugg

SEQ ID NO: 13487 - RNA, 20 nt, Human
uuugccuuugcagaaugugc

SEQ ID NO: 13488 - RNA, 22 nt, Human
gugugagccacggugcccggcc

SEQ ID NO: 13489 - RNA, 26 nt, Human
ugacugucucccuuucucuaccagac

SEQ ID NO: 13490 - RNA, 20 nt, Human
gcuggucucaaacuccuggg

SEQ ID NO: 13491 - RNA, 25 nt, Human
agagcuacguauuuaauagcaaaga

SEQ ID NO: 13492 - RNA, 23 nt, Human
caucuaaacucccuccauccuga

SEQ ID NO: 13493 - RNA, 23 nt, Human
ggugccuaccaccaugccaggcu

SEQ ID NO: 13494 - RNA, 22 nt, Human
aggcuggaguacacuggcacua

SEQ ID NO: 13495 - RNA, 20 nt, Human
gcuggccacaccacggcaag

SEQ ID NO: 13496 - RNA, 22 nt, Human
cacuacacuccagccugggaga

SEQ ID NO: 13497 - RNA, 21 nt, Human
uuguaaacuugaaagcaagac

SEQ ID NO: 13498 - RNA, 23 nt, Human
gcucccacccuugccugccucua

SEQ ID NO: 13499 - RNA, 22 nt, Human
cugugugaccuugggcaugugg

SEQ ID NO: 13500 - RNA, 21 nt, Human
gcgugccaggguggugacagu

SEQ ID NO: 13501 - RNA, 29 nt, Human
ucagcauugccuuuacugugucaauucug

SEQ ID NO: 13502 - RNA, 23 nt, Human
uccaagcacuuucaguccaauag

SEQ ID NO: 13503 - RNA, 22 nt, Human
accagucuggccaacaucguga

SEQ ID NO: 13504 - RNA, 20 nt, Human
gacuuuccuuccuccaucuc

SEQ ID NO: 13505 - RNA, 19 nt, Human
ggguggccaccacagccuu

SEQ ID NO: 13506 - RNA, 26 nt, Human
uucccaauaggugaucuuaauuacuu

SEQ ID NO: 13507 - RNA, 24 nt, Human
agugcucucagcuggcagugcaau

SEQ ID NO: 13508 - RNA, 20 nt, Human
uuccacaacccaaguuuaga

SEQ ID NO: 13509 - RNA, 21 nt, Human
ugaaauucagcuuccuucuca

SEQ ID NO: 13510 - RNA, 23 nt, Human
uccuucuuuccaaccagcuuugc

SEQ ID NO: 13511 - RNA, 21 nt, Human
uccacauucgucacagauaua

SEQ ID NO: 13512 - RNA, 22 nt, Human
gcaugagccacugcacucaacc

SEQ ID NO: 13513 - RNA, 24 nt, Human
gggcagggaggaggcagggccugu

SEQ ID NO: 13514 - RNA, 26 nt, Human
gguccuggggguaugggggcugccag

SEQ ID NO: 13515 - RNA, 18 nt, Human
ccacugcacuccaucuug

SEQ ID NO: 13516 - RNA, 21 nt, Human
ccauuaacauauuuuuguggc

SEQ ID NO: 13517 - RNA, 23 nt, Human
uuuuaauccuggaagcuguugcc

SEQ ID NO: 13518 - RNA, 19 nt, Human
gcuguugcaggccuuugcu

SEQ ID NO: 13519 - RNA, 21 nt, Human
gugcaagagcguugcugccuc

SEQ ID NO: 13520 - RNA, 23 nt, Human
ucucaauaaucaaugaaguagcu

SEQ ID NO: 13521 - RNA, 25 nt, Human
uggagccugcaaaugcauuguguuu

SEQ ID NO: 13522 - RNA, 21 nt, Human
ggaggcagagguugcagcgag

SEQ ID NO: 13523 - RNA, 19 nt, Human
uuuccugacauugucuccu

SEQ ID NO: 13524 - RNA, 21 nt, Human
ccuuucuguucaaggcuguuu

SEQ ID NO: 13525 - RNA, 21 nt, Human
acucccacucugccagacacc

SEQ ID NO: 13526 - RNA, 21 nt, Human
guuacugccuaucagcauuuu

SEQ ID NO: 13527 - RNA, 26 nt, Human
uuggggagcaggcucggcuccccagc

SEQ ID NO: 13528 - RNA, 19 nt, Human
ugggugaggcaggagcugg

SEQ ID NO: 13529 - RNA, 20 nt, Human
cgcccaggcuggagcgcagu

SEQ ID NO: 13530 - RNA, 19 nt, Human
ugccaggcugcgaugcgug

SEQ ID NO: 13531 - RNA, 21 nt, Human
uguacucugggcaagagccca

SEQ ID NO: 13532 - RNA, 20 nt, Human
cuucccuuuacccagggcgg

SEQ ID NO: 13533 - RNA, 24 nt, Human
cuucaaagccccaaauuccugggc

SEQ ID NO: 13534 - RNA, 25 nt, Human
cauguacuguacuucccaauugcca

SEQ ID NO: 13535 - RNA, 21 nt, Human
ccugcugcaaccccucuccgg

SEQ ID NO: 13536 - RNA, 25 nt, Human
acccaggcuggagugcaguggugcc

SEQ ID NO: 13537 - RNA, 24 nt, Human
accagaaucuggucuguuuccugu

SEQ ID NO: 13538 - RNA, 21 nt, Human
uuagagacagagucucacccu

SEQ ID NO: 13539 - RNA, 28 nt, Human
cacuagaacugaccuaagccacugauua

SEQ ID NO: 13540 - RNA, 22 nt, Human
gacuuuugcagauggaggaauu

SEQ ID NO: 13541 - RNA, 22 nt, Human
ugccugaggugggaggauguga

SEQ ID NO: 13542 - RNA, 21 nt, Human
ccucagugagccccugccucc

SEQ ID NO: 13543 - RNA, 26 nt, Human
gggaaaggagggaaaauaauagccca

SEQ ID NO: 13544 - RNA, 27 nt, Human
guacagcgugcauagggacucuugccu

SEQ ID NO: 13545 - RNA, 23 nt, Human
uggaaagaagggggaguuccagg

SEQ ID NO: 13546 - RNA, 27 nt, Human
ugccuguaauccuagcuacuuggcagg

SEQ ID NO: 13547 - RNA, 26 nt, Human
gaugcgggagcagcagaaggagcagc

SEQ ID NO: 13548 - RNA, 20 nt, Human
aacaguuugaauacugugaa

SEQ ID NO: 13549 - RNA, 22 nt, Human
gaggcuccccuggggcuguggg

SEQ ID NO: 13550 - RNA, 20 nt, Human
cuuucucucucaaacugucu

SEQ ID NO: 13551 - RNA, 24 nt, Human
augucuccagggccagugucugcu

SEQ ID NO: 13552 - RNA, 20 nt, Human
gcuccuguugcuccuucaca

SEQ ID NO: 13553 - RNA, 20 nt, Human
cugagcagcugggagcaggc

SEQ ID NO: 13554 - RNA, 21 nt, Human
aaauacgccaaaauguugaca

SEQ ID NO: 13555 - RNA, 23 nt, Human
ccucugggcucuggccucaggcc

SEQ ID NO: 13556 - RNA, 22 nt, Human
aagggaauucuugugugcugcu

SEQ ID NO: 13557 - RNA, 22 nt, Human
uuugagacucagucucgcucug

SEQ ID NO: 13558 - RNA, 24 nt, Human
uuuuuggggaaaaaagcacauaca

SEQ ID NO: 13559 - RNA, 19 nt, Human
gcccaggcuagagugcagu

SEQ ID NO: 13560 - RNA, 22 nt, Human
ccaagaauagaagaaugaagca

SEQ ID NO: 13561 - RNA, 27 nt, Human
ccagcacuuuggcaggccaagguggaa

SEQ ID NO: 13562 - RNA, 27 nt, Human
agacauuucauaccugcccugguccug

SEQ ID NO: 13563 - RNA, 20 nt, Human
agcgaauuaaccugauuuau

SEQ ID NO: 13564 - RNA, 20 nt, Human
ugacucucugggaccuugcc

SEQ ID NO: 13565 - RNA, 22 nt, Human
cagcaaaucaucgggccauugg

SEQ ID NO: 13566 - RNA, 22 nt, Human
aaggaagagucugggaggcagg

SEQ ID NO: 13567 - RNA, 21 nt, Human
aggcuuccacugcauccuggc

SEQ ID NO: 13568 - RNA, 20 nt, Human
aggauuuggaucucacaaga

SEQ ID NO: 13569 - RNA, 20 nt, Human
uacucauguuaagugcaaug

SEQ ID NO: 13570 - RNA, 24 nt, Human
gucaugcccagcuuggagugccac

SEQ ID NO: 13571 - RNA, 25 nt, Human
uucuacaaauuaauuuuaaaguguc

SEQ ID NO: 13572 - RNA, 22 nt, Human
ucucugugcacuugcugucugc

SEQ ID NO: 13573 - RNA, 23 nt, Human
agacgaggucuugugauauugcc

SEQ ID NO: 13574 - RNA, 23 nt, Human
ugccuucagagguucugaccaga

SEQ ID NO: 13575 - RNA, 23 nt, Human
cagcaaaccaccauggcacaugu

SEQ ID NO: 13576 - RNA, 27 nt, Human
gaugggcugucagaauugcaagggagg

SEQ ID NO: 13577 - RNA, 21 nt, Human
gugccugagcucagugcugcu

SEQ ID NO: 13578 - RNA, 19 nt, Human
aacuuccuauguuauguca

SEQ ID NO: 13579 - RNA, 22 nt, Human
acccagcgagugcagcggcggc

SEQ ID NO: 13580 - RNA, 21 nt, Human
cggcccagagcaccggggcca

SEQ ID NO: 13581 - RNA, 25 nt, Human
acaguaggggcucaauaaauccuug

SEQ ID NO: 13582 - RNA, 31 nt, Human
ccagugucgaggccauuucucuuugccacug

SEQ ID NO: 13583 - RNA, 23 nt, Human
uuguuugucucuccuuuucuuuu

SEQ ID NO: 13584 - RNA, 20 nt, Human
cuuccuccuuccucuucuca

SEQ ID NO: 13585 - RNA, 21 nt, Human
gggagcagaggaggcgaggga

SEQ ID NO: 13586 - RNA, 21 nt, Human
aauaacugcaguguuuccgcc

SEQ ID NO: 13587 - RNA, 27 nt, Human
uugggaggccaaggugggaggauugcu

SEQ ID NO: 13588 - RNA, 21 nt, Human
aaagggaggaugggcgaugac

SEQ ID NO: 13589 - RNA, 22 nt, Human
cacauccuggguucaagugauu

SEQ ID NO: 13590 - RNA, 19 nt, Human
cuccccugaggcucaggga

SEQ ID NO: 13591 - RNA, 21 nt, Human
ugauacaacaaaaagauuuaa

SEQ ID NO: 13592 - RNA, 22 nt, Human
cauugugacacuggagucuaga

SEQ ID NO: 13593 - RNA, 27 nt, Human
ggauacuuaguucauggcuuuucucuu

SEQ ID NO: 13594 - RNA, 24 nt, Human
gauugaagaugcugcuccaauaca

SEQ ID NO: 13595 - RNA, 27 nt, Human
gcuuucucccuuccguccuagagaaca

SEQ ID NO: 13596 - RNA, 23 nt, Human
ggcagcacggcccggccccucac

SEQ ID NO: 13597 - RNA, 22 nt, Human
gacagcccuguguugugcucag

SEQ ID NO: 13598 - RNA, 21 nt, Human
uagcccacaaagaauauuguc

SEQ ID NO: 13599 - RNA, 27 nt, Human
agcuacucacuguauuggacgggagua

SEQ ID NO: 13600 - RNA, 22 nt, Human
accagccugcccaacauaguga

SEQ ID NO: 13601 - RNA, 22 nt, Human
accagccugaccaacaucguga

SEQ ID NO: 13602 - RNA, 27 nt, Human
ugcacacacaggguguugaggaaccac

SEQ ID NO: 13603 - RNA, 26 nt, Human
ccuccagggucuuaagagucaggcuc

SEQ ID NO: 13604 - RNA, 21 nt, Human
cagcccauucuuucuuucugg

SEQ ID NO: 13605 - RNA, 24 nt, Human
gaggaauauagaaugaaagacuga

SEQ ID NO: 13606 - RNA, 21 nt, Human
uggaaauguuggcuucaccag

SEQ ID NO: 13607 - RNA, 20 nt, Human
ugccuggaauuguucuguac

SEQ ID NO: 13608 - RNA, 23 nt, Human
ccaccuacucuuucaguuuucug

SEQ ID NO: 13609 - RNA, 24 nt, Human
aagacuucugguauuaucucucua

SEQ ID NO: 13610 - RNA, 26 nt, Human
ugggcccucucagcaggggaggguag

SEQ ID NO: 13611 - RNA, 26 nt, Human
uaccugcacuguccugaccaucgcac

SEQ ID NO: 13612 - RNA, 25 nt, Human
accauucuaguuuuaucuuccuugg

SEQ ID NO: 13613 - RNA, 22 nt, Human
ucgccaucuuggugacuuugaa

SEQ ID NO: 13614 - RNA, 26 nt, Human
cccuguguuuccuugcccuuuagaaa

SEQ ID NO: 13615 - RNA, 20 nt, Human
ccugacacguacagugcaaa

SEQ ID NO: 13616 - RNA, 24 nt, Human
ugucauucaggcuggagugcagug

SEQ ID NO: 13617 - RNA, 22 nt, Human
acugcucucccccgcugcaucc

SEQ ID NO: 13618 - RNA, 22 nt, Human
guuuguaaugagagcacuuucu

SEQ ID NO: 13619 - RNA, 24 nt, Human
ugagugugaagggggaacaaguca

SEQ ID NO: 13620 - RNA, 22 nt, Human
ugccgccgcuguucgugcaaua

SEQ ID NO: 13621 - RNA, 21 nt, Human
cggaaguuuacuggcucugcu

SEQ ID NO: 13622 - RNA, 26 nt, Human
aggauggggagguaggaaugagguau

SEQ ID NO: 13623 - RNA, 20 nt, Human
gacacgccccccucuccucc

SEQ ID NO: 13624 - RNA, 32 nt, Human
cauuccucagcuucuucacaggcacuccugga

SEQ ID NO: 13625 - RNA, 21 nt, Human
ugucauggaagaggaacgugc

SEQ ID NO: 13626 - RNA, 22 nt, Human
ccaccucccagguucaagcaau

SEQ ID NO: 13627 - RNA, 21 nt, Human
ggagaggguaaggcaaacagc

SEQ ID NO: 13628 - RNA, 23 nt, Human
aggacccgcagagguggcagcgg

SEQ ID NO: 13629 - RNA, 23 nt, Human
ucuuucucccacuuucuaggauc

SEQ ID NO: 13630 - RNA, 25 nt, Human
ggugagagaagagaacgcgagaagg

SEQ ID NO: 13631 - RNA, 19 nt, Human
ggccugcuggcccaccucc

SEQ ID NO: 13632 - RNA, 24 nt, Human
auuugguuuuccuuucuuuacuua

SEQ ID NO: 13633 - RNA, 19 nt, Human
gcugucccucauggagacc

SEQ ID NO: 13634 - RNA, 22 nt, Human
uguggccuggauccauccugcu

SEQ ID NO: 13635 - RNA, 21 nt, Human
ugccucgggcucucacccucc

SEQ ID NO: 13636 - RNA, 20 nt, Human
aaaugauuauauacauuuuc

SEQ ID NO: 13637 - RNA, 22 nt, Human
aaagugcuaggauuacagguau

SEQ ID NO: 13638 - RNA, 19 nt, Human
cugaucccucagugcucac

SEQ ID NO: 13639 - RNA, 21 nt, Human
accaugcugugccucaguuua

SEQ ID NO: 13640 - RNA, 24 nt, Human
ucuuugucuguucacuuucuaucu

SEQ ID NO: 13641 - RNA, 28 nt, Human
uaucuagccccaucccacaccuguuuca

SEQ ID NO: 13642 - RNA, 22 nt, Human
aggcuggagugcaguggcgcca

SEQ ID NO: 13643 - RNA, 27 nt, Human
gcccuuggacaucagagcugcaggcuc

SEQ ID NO: 13644 - RNA, 27 nt, Human
cagagccugaaaacuguuuucacuggg

SEQ ID NO: 13645 - RNA, 25 nt, Human
uaguuuagggguaagaguccuguuu

SEQ ID NO: 13646 - RNA, 23 nt, Human
ccuccugcccucugcuuggggga

SEQ ID NO: 13647 - RNA, 21 nt, Human
cccucccuccugcacuggccu

SEQ ID NO: 13648 - RNA, 22 nt, Human
cgcuugugaucccagcacuuug

SEQ ID NO: 13649 - RNA, 21 nt, Human
aggagauggaaguugcaguga

SEQ ID NO: 13650 - RNA, 19 nt, Human
ccucagccaugaggaguug

SEQ ID NO: 13651 - RNA, 22 nt, Human
uucuccuacccugaauaaguaa

SEQ ID NO: 13652 - RNA, 25 nt, Human
agggacauuucuauaaaaauacuac

SEQ ID NO: 13653 - RNA, 25 nt, Human
auuuucaggucugcagaaccauagc

SEQ ID NO: 13654 - RNA, 27 nt, Human
aacugauuuuagaaaaagaagcuuaau

SEQ ID NO: 13655 - RNA, 24 nt, Human
gcggugacaacggcacacgccuag

SEQ ID NO: 13656 - RNA, 26 nt, Human
ucuuacgugaacuguauacauucaua

SEQ ID NO: 13657 - RNA, 26 nt, Human
cgccucggucucccaaagugcuggga

SEQ ID NO: 13658 - RNA, 27 nt, Human
cucuuccucucugcugaggcagcugcc

SEQ ID NO: 13659 - RNA, 24 nt, Human
uccuugaccucagugaaagcaguc

SEQ ID NO: 13660 - RNA, 27 nt, Human
gggaugggggugcaggccagggaaaca

SEQ ID NO: 13661 - RNA, 25 nt, Human
ccugcgacucccuguuuccugggcu

SEQ ID NO: 13662 - RNA, 22 nt, Human
ccuuucuacucagaaccaauaa

SEQ ID NO: 13663 - RNA, 26 nt, Human
auuagccuugaacaaccagaugguga

SEQ ID NO: 13664 - RNA, 26 nt, Human
ugcagaccucuucaagugacacuaug

SEQ ID NO: 13665 - RNA, 23 nt, Human
ccaguuuagcuccaaaggaaaag

SEQ ID NO: 13666 - RNA, 25 nt, Human
uguauaccuuugagaacagugccuu

SEQ ID NO: 13667 - RNA, 20 nt, Human
gacuccuggguugagcuguu

SEQ ID NO: 13668 - RNA, 22 nt, Human
cgugggcucagcagggcugguc

SEQ ID NO: 13669 - RNA, 18 nt, Human
cgcagacgacuuucacac

SEQ ID NO: 13670 - RNA, 21 nt, Human
cccccaggcugaagugcagug

SEQ ID NO: 13671 - RNA, 23 nt, Human
agagcucaagaaagcugguccag

SEQ ID NO: 13672 - RNA, 18 nt, Human
gugcauuucugugauguu

SEQ ID NO: 13673 - RNA, 32 nt, Human
uccuccuccuucaugcagccaggauugccucc

SEQ ID NO: 13674 - RNA, 27 nt, Human
cccugcaggaaggagcugccuggaccc

SEQ ID NO: 13675 - RNA, 23 nt, Human
uuuuccauuuuacuuugaagauu

SEQ ID NO: 13676 - RNA, 23 nt, Human
guugcccaggcuggagugcagag

SEQ ID NO: 13677 - RNA, 19 nt, Human
cugcagcugcaugggugcc

SEQ ID NO: 13678 - RNA, 20 nt, Human
ggcaaaucugucggucucca

SEQ ID NO: 13679 - RNA, 22 nt, Human
cugaugcuccuugggugcugcu

SEQ ID NO: 13680 - RNA, 30 nt, Human
cccuguuccgggggcagccagugcccagcc

SEQ ID NO: 13681 - RNA, 26 nt, Human
guauuuuaacacuugucuucaacuug

SEQ ID NO: 13682 - RNA, 20 nt, Human
gaagcauucauguuguuaca

SEQ ID NO: 13683 - RNA, 23 nt, Human
ggagcugggaaaagggaggcaga

SEQ ID NO: 13684 - RNA, 22 nt, Human
gcuauagucucuucagcauuuu

SEQ ID NO: 13685 - RNA, 26 nt, Human
ucaacuccugucuucaggccacacca

SEQ ID NO: 13686 - RNA, 25 nt, Human
ggaggcggggagagaaacugcguuc

SEQ ID NO: 13687 - RNA, 24 nt, Human
uacuaaagauaucagagcucuuaa

SEQ ID NO: 13688 - RNA, 23 nt, Human
guaguaucaacagugacccagaa

SEQ ID NO: 13689 - RNA, 23 nt, Human
aucugccauguccauagccauaa

SEQ ID NO: 13690 - RNA, 20 nt, Human
auaaccucuuccuccaguug

SEQ ID NO: 13691 - RNA, 28 nt, Human
cuuagcagcucaucagcuuauaaacuac

SEQ ID NO: 13692 - RNA, 22 nt, Human
ggcucacugccacuggguacuc

SEQ ID NO: 13693 - RNA, 23 nt, Human
aauuagaaaauguuauuuaacag

SEQ ID NO: 13694 - RNA, 23 nt, Human
uuaaugcggccgguccucucuca

SEQ ID NO: 13695 - RNA, 15 nt, Human
cuuucagccuagcca

SEQ ID NO: 13696 - RNA, 25 nt, Human
aaagcaauggugaaaggauaaccuc

SEQ ID NO: 13697 - RNA, 21 nt, Human
uuuuguuucuuuuggccugau

SEQ ID NO: 13698 - RNA, 23 nt, Human
cucaugcaaucuuccugccucag

SEQ ID NO: 13699 - RNA, 24 nt, Human
accagugaccucagggcacuuugg

SEQ ID NO: 13700 - RNA, 19 nt, Human
ggauacuuuguucucacca

SEQ ID NO: 13701 - RNA, 26 nt, Human
ugaacaaaaacaucaacauggagucc

SEQ ID NO: 13702 - RNA, 25 nt, Human
ggggaugcuaaccacagggccugag

SEQ ID NO: 13703 - RNA, 20 nt, Human
ugaaacugccagugccugaa

SEQ ID NO: 13704 - RNA, 20 nt, Human
gagacuugggaaugagcuga

SEQ ID NO: 13705 - RNA, 27 nt, Human
gcacagccgcaggugcaccuccaggcc

SEQ ID NO: 13706 - RNA, 28 nt, Human
caucccugcgcgcccagccugccaagca

SEQ ID NO: 13707 - RNA, 23 nt, Human
gggcuccagaccuuucugagccc

SEQ ID NO: 13708 - RNA, 26 nt, Human
ugcccagggcuggaggccccuagaaa

SEQ ID NO: 13709 - RNA, 21 nt, Human
auggagggagagguugugcug

SEQ ID NO: 13710 - RNA, 20 nt, Human
uugaggaaguuuucaaucag

SEQ ID NO: 13711 - RNA, 20 nt, Human
cuagauuccuccucaaacca

SEQ ID NO: 13712 - RNA, 27 nt, Human
ccauacccucccccaucugggggcccu

SEQ ID NO: 13713 - RNA, 22 nt, Human
ucuccccuggggcugggaggcu

SEQ ID NO: 13714 - RNA, 21 nt, Human
uuuacuucuguguccuaaggg

SEQ ID NO: 13715 - RNA, 27 nt, Human
ggcacccccggaauugcucugccuugu

SEQ ID NO: 13716 - RNA, 25 nt, Human
ggcgcuauguucgugagaacugcaa

SEQ ID NO: 13717 - RNA, 29 nt, Human
uaggaauauagacaaaugacugucugggc

SEQ ID NO: 13718 - RNA, 26 nt, Human
ugccaguuuaacuugucaugcacuga

SEQ ID NO: 13719 - RNA, 21 nt, Human
ccuccauuccuugccaccaug

SEQ ID NO: 13720 - RNA, 27 nt, Human
uggacucgggaaaaagugucucuuaga

SEQ ID NO: 13721 - RNA, 24 nt, Human
gcugggcccugggauacugccuuc

SEQ ID NO: 13722 - RNA, 24 nt, Human
gggaucugaagagcuauggugaaa

SEQ ID NO: 13723 - RNA, 17 nt, Human
ucucagcccugcccugu

SEQ ID NO: 13724 - RNA, 21 nt, Human
ccagcucccaaguuuuccuuc

SEQ ID NO: 13725 - RNA, 22 nt, Human
ucaggcuggagcacaguggugu

SEQ ID NO: 13726 - RNA, 21 nt, Human
gauccuguuauuuccucugca

SEQ ID NO: 13727 - RNA, 20 nt, Human
acacauggauuuucuucaga

SEQ ID NO: 13728 - RNA, 22 nt, Human
gugugagccauugcgcccagcc

SEQ ID NO: 13729 - RNA, 24 nt, Human
aaauguacaccugauuugagaagc

SEQ ID NO: 13730 - RNA, 19 nt, Human
cuuugcccucuguuccuuc

SEQ ID NO: 13731 - RNA, 26 nt, Human
aagucgcaucgcuaaugauauuugcc

SEQ ID NO: 13732 - RNA, 26 nt, Human
cccuccagccccguccgggagucccc

SEQ ID NO: 13733 - RNA, 21 nt, Human
ugcuucuucucagcuucucug

SEQ ID NO: 13734 - RNA, 23 nt, Human
gugagggugagcuuacucagggc

SEQ ID NO: 13735 - RNA, 20 nt, Human
ucagcacucccuucuucccu

SEQ ID NO: 13736 - RNA, 28 nt, Human
cccgucauuccucacaggacagaagcag

SEQ ID NO: 13737 - RNA, 26 nt, Human
caugccacuaugagcuuucagacucc

SEQ ID NO: 13738 - RNA, 20 nt, Human
accagcaccuuacugcccag

SEQ ID NO: 13739 - RNA, 21 nt, Human
uuccuuguaucugucuuccca

SEQ ID NO: 13740 - RNA, 23 nt, Human
augaggcuuuucccaccagcucc

SEQ ID NO: 13741 - RNA, 22 nt, Human
guauuuuugugucuggucuucc

SEQ ID NO: 13742 - RNA, 18 nt, Human
ggccagggccccaccucc

SEQ ID NO: 13743 - RNA, 24 nt, Human
cugucuuggaauguaaacaucuga

SEQ ID NO: 13744 - RNA, 25 nt, Human
uggccuggcugggugcaguggcuca

SEQ ID NO: 13745 - RNA, 27 nt, Human
caggcuagagugcaguggcaugaucuc

SEQ ID NO: 13746 - RNA, 27 nt, Human
caggcuggagugcaauggcaugaucuc

SEQ ID NO: 13747 - RNA, 23 nt, Human
ggcaauagccuaagaagggggga

SEQ ID NO: 13748 - RNA, 26 nt, Human
uaaggaauauaauggacagauuaaua

SEQ ID NO: 13749 - RNA, 22 nt, Human
ugacuccgucauuuaauaaaga

SEQ ID NO: 13750 - RNA, 21 nt, Human
cauaggaauuuggaauccaag

SEQ ID NO: 13751 - RNA, 23 nt, Human
gacaagcauuuucucuguagagc

SEQ ID NO: 13752 - RNA, 26 nt, Human
ugucuggagccugcaggcaggugggg

SEQ ID NO: 13753 - RNA, 32 nt, Human
accuugaaaagaagguuggagugcagcuugaa

SEQ ID NO: 13754 - RNA, 21 nt, Human
agauugagagauacagagccg

SEQ ID NO: 13755 - RNA, 26 nt, Human
cccagcgccccagccucaccuucucu

SEQ ID NO: 13756 - RNA, 23 nt, Human
ucugggaggccuuggggcccuca

SEQ ID NO: 13757 - RNA, 27 nt, Human
ugcugagaaggagcacuccacugugug

SEQ ID NO: 13758 - RNA, 22 nt, Human
aagugacccagggagacaaaca

SEQ ID NO: 13759 - RNA, 19 nt, Human
cccuccuccucugggcaca

SEQ ID NO: 13760 - RNA, 29 nt, Human
guaccuuaaauuugcaucuucccucucau

SEQ ID NO: 13761 - RNA, 27 nt, Human
augggcugagcuagccuccagcuuugg

SEQ ID NO: 13762 - RNA, 22 nt, Human
accagccuggacagcuuaguga

SEQ ID NO: 13763 - RNA, 23 nt, Human
cacccaggcaugaagcacguugg

SEQ ID NO: 13764 - RNA, 25 nt, Human
cuucgguagaggauuucuaguuucu

SEQ ID NO: 13765 - RNA, 19 nt, Human
cuucccuugccguuggcuu

SEQ ID NO: 13766 - RNA, 27 nt, Human
ugaaugguacuguaccgguucaucugg

SEQ ID NO: 13767 - RNA, 20 nt, Human
cauacugauguucauacaaa

SEQ ID NO: 13768 - RNA, 20 nt, Human
ccucagucuucaccguuuua

SEQ ID NO: 13769 - RNA, 22 nt, Human
caggcuggagugcaguggugug

SEQ ID NO: 13770 - RNA, 21 nt, Human
agcaaggacguugauugguug

SEQ ID NO: 13771 - RNA, 19 nt, Human
uucucagaauaaaaguuug

SEQ ID NO: 13772 - RNA, 26 nt, Human
gauccuggggaagguuccagucccug

SEQ ID NO: 13773 - RNA, 21 nt, Human
agguuacugcaacccuaacuc

SEQ ID NO: 13774 - RNA, 22 nt, Human
caucuauugaggaaaaccacaa

SEQ ID NO: 13775 - RNA, 25 nt, Human
gcugccugugccugccaugggccag

SEQ ID NO: 13776 - RNA, 25 nt, Human
cuuuccagcuaucagcacuuucagc

SEQ ID NO: 13777 - RNA, 18 nt, Human
cuauuuucacagaucuca

SEQ ID NO: 13778 - RNA, 20 nt, Human
agccccaucuguggguugca

SEQ ID NO: 13779 - RNA, 22 nt, Human
cgucucacugcaaccuccgccu

SEQ ID NO: 13780 - RNA, 23 nt, Human
cuuucugccagcucccugaugac

SEQ ID NO: 13781 - RNA, 24 nt, Human
aggcugagacugcgggaugguccu

SEQ ID NO: 13782 - RNA, 22 nt, Human
cuaaaacaacaguauuugaccc

SEQ ID NO: 13783 - RNA, 19 nt, Human
gaaugagaggccagaggga

SEQ ID NO: 13784 - RNA, 20 nt, Human
cacaguucaccaagugccuu

SEQ ID NO: 13785 - RNA, 22 nt, Human
acgagcagcugugagugagggg

SEQ ID NO: 13786 - RNA, 19 nt, Human
ggugcucucuuacucuuuc

SEQ ID NO: 13787 - RNA, 27 nt, Human
uuagcaauacuggaauauaggcacauu

SEQ ID NO: 13788 - RNA, 28 nt, Human
ugagggccaagcuaugcccaggaaugug

SEQ ID NO: 13789 - RNA, 23 nt, Human
cagcguccugggcucaaaugauc

SEQ ID NO: 13790 - RNA, 21 nt, Human
caacuuugccagcuuucucca

SEQ ID NO: 13791 - RNA, 24 nt, Human
guggguggggagcuggggcaagau

SEQ ID NO: 13792 - RNA, 22 nt, Human
gcuggucuugaauuccugggcu

SEQ ID NO: 13793 - RNA, 19 nt, Human
uugugggaggagugacaug

SEQ ID NO: 13794 - RNA, 27 nt, Human
ccagcucccaugacucucccagucccu

SEQ ID NO: 13795 - RNA, 22 nt, Human
ggggcugucucccaaugaaaga

SEQ ID NO: 13796 - RNA, 24 nt, Human
uccauucccagucgcucccagccc

SEQ ID NO: 13797 - RNA, 25 nt, Human
gguuguggcugcagugagcugugau

SEQ ID NO: 13798 - RNA, 23 nt, Human
gcaauagcuaggaaaacacaggg

SEQ ID NO: 13799 - RNA, 20 nt, Human
gggccugguugaggcuggag

SEQ ID NO: 13800 - RNA, 27 nt, Human
cccuccagugccucccggcugcuagcc

SEQ ID NO: 13801 - RNA, 20 nt, Human
uucagcugcauuucacaugc

SEQ ID NO: 13802 - RNA, 26 nt, Human
gcaguuucuucacuaccaaaaugaca

SEQ ID NO: 13803 - RNA, 20 nt, Human
ccaccaucugcugucuuuuc

SEQ ID NO: 13804 - RNA, 18 nt, Human
cccuccagccucagcugg

SEQ ID NO: 13805 - RNA, 22 nt, Human
aaagugcugagauuacaggcgu

SEQ ID NO: 13806 - RNA, 20 nt, Human
guuuuuaaauguauucucug

SEQ ID NO: 13807 - RNA, 20 nt, Human
uagcuggaugugguggugca

SEQ ID NO: 13808 - RNA, 21 nt, Human
aaaucacuugaagaaagcuua

SEQ ID NO: 13809 - RNA, 27 nt, Human
uaaaggacugcucuguguacacuguga

SEQ ID NO: 13810 - RNA, 25 nt, Human
ggagcaccggguuccugcccagcac

SEQ ID NO: 13811 - RNA, 23 nt, Human
ggcucuggcugugcauucagcag

SEQ ID NO: 13812 - RNA, 21 nt, Human
caucuucccagacggaguuca

SEQ ID NO: 13813 - RNA, 23 nt, Human
agcuuucuuuacugcacuggagu

SEQ ID NO: 13814 - RNA, 20 nt, Human
caggguauggcuuacaguga

SEQ ID NO: 13815 - RNA, 26 nt, Human
ggcaggcacugcucucugcagagggg

SEQ ID NO: 13816 - RNA, 27 nt, Human
uggggcacuggcuucaaacaauucagu

SEQ ID NO: 13817 - RNA, 20 nt, Human
gcagugccauaagcaagucu

SEQ ID NO: 13818 - RNA, 19 nt, Human
gcuucuuaaaagaaccaua

SEQ ID NO: 13819 - RNA, 23 nt, Human
uuuuaaggguuccagcaucccag

SEQ ID NO: 13820 - RNA, 21 nt, Human
cagcgagauugcucugcagcc

SEQ ID NO: 13821 - RNA, 22 nt, Human
uugccugggcuggagaacagug

SEQ ID NO: 13822 - RNA, 23 nt, Human
uucaaaaaauaaaguagaaaaau

SEQ ID NO: 13823 - RNA, 20 nt, Human
ugacugccaccgugcccggc

SEQ ID NO: 13824 - RNA, 21 nt, Human
agaucacaccacuacacucca

SEQ ID NO: 13825 - RNA, 17 nt, Human
guugaccuucucuuaga

SEQ ID NO: 13826 - RNA, 21 nt, Human
uagagugcagggauuacaggc

SEQ ID NO: 13827 - RNA, 21 nt, Human
ggaaagggaagggugccacgu

SEQ ID NO: 13828 - RNA, 21 nt, Human
cgcucagccuggagugcagug

SEQ ID NO: 13829 - RNA, 23 nt, Human
ccuuccagcugaggacaggcugg

SEQ ID NO: 13830 - RNA, 25 nt, Human
aagaauugugugaauguucugauca

SEQ ID NO: 13831 - RNA, 26 nt, Human
cugacagcuugggaggaaaccugaga

SEQ ID NO: 13832 - RNA, 17 nt, Human
ggggugggagagccagc

SEQ ID NO: 13833 - RNA, 19 nt, Human
gugcauauauacuacauga

SEQ ID NO: 13834 - RNA, 24 nt, Human
augucuuaaugcauaauacugcaa

SEQ ID NO: 13835 - RNA, 22 nt, Human
auggcagauugaaaaggaucuc

SEQ ID NO: 13836 - RNA, 27 nt, Human
ugggacccuccuggugcugcccaccuu

SEQ ID NO: 13837 - RNA, 23 nt, Human
ggggaggucuuagcaggagcggg

SEQ ID NO: 13838 - RNA, 18 nt, Human
cccgccccacacccaccc

SEQ ID NO: 13839 - RNA, 22 nt, Human
caggcuggaguacagugaugug

SEQ ID NO: 13840 - RNA, 26 nt, Human
cagagccgccuuuccagcaugcaggg

SEQ ID NO: 13841 - RNA, 24 nt, Human
ccucccucggcgcugacaggcugg

SEQ ID NO: 13842 - RNA, 21 nt, Human
ugcugcugaaaugcugccucu

SEQ ID NO: 13843 - RNA, 27 nt, Human
gaugcucuaaagcugggcucaagcaag

SEQ ID NO: 13844 - RNA, 27 nt, Human
gguuuugacaagcuugcaucaugcgug

SEQ ID NO: 13845 - RNA, 20 nt, Human
ccaacuucauuuccauacuu

SEQ ID NO: 13846 - RNA, 24 nt, Human
gggggacugaguucagguuaccag

SEQ ID NO: 13847 - RNA, 27 nt, Human
ccauucaggaaccuggaccaaagcuga

SEQ ID NO: 13848 - RNA, 27 nt, Human
ccgggaaccccagaggaggucgcaguu

SEQ ID NO: 13849 - RNA, 26 nt, Human
cuugcacacuuccccaucuuugaucc

SEQ ID NO: 13850 - RNA, 20 nt, Human
uuguggacugcacucccaag

SEQ ID NO: 13851 - RNA, 26 nt, Human
ccuguaaucccagcacuuuaagaggc

SEQ ID NO: 13852 - RNA, 27 nt, Human
uccuguggcucucccguugcagaggcc

SEQ ID NO: 13853 - RNA, 21 nt, Human
gucauuguuauuacagcuaug

SEQ ID NO: 13854 - RNA, 23 nt, Human
gcucauguccuguccugguccug

SEQ ID NO: 13855 - RNA, 26 nt, Human
cccugcguugcccucugggucuguga

SEQ ID NO: 13856 - RNA, 23 nt, Human
cugcaguucuuacuugcauuccc

SEQ ID NO: 13857 - RNA, 22 nt, Human
gcccaggcuggagugcaauagc

SEQ ID NO: 13858 - RNA, 20 nt, Human
cuguuaaggggcaacugaga

SEQ ID NO: 13859 - RNA, 20 nt, Human
ucugaacccucucccagucc

SEQ ID NO: 13860 - RNA, 24 nt, Human
uccaggguuuaauaaaacugguua

SEQ ID NO: 13861 - RNA, 20 nt, Human
cggaagaugagugagcuuga

SEQ ID NO: 13862 - RNA, 26 nt, Human
ccucccccaggaccugccuagugcca

SEQ ID NO: 13863 - RNA, 21 nt, Human
cagccucugcugacagcaccu

SEQ ID NO: 13864 - RNA, 22 nt, Human
cugagguugcaggaucgcuuga

SEQ ID NO: 13865 - RNA, 22 nt, Human
uuugcccucaaaucagugaccc

SEQ ID NO: 13866 - RNA, 21 nt, Human
ggccuugccaucuuguggccg

SEQ ID NO: 13867 - RNA, 16 nt, Human
gccaggacccaggagg

SEQ ID NO: 13868 - RNA, 26 nt, Human
uccugcggcugcgacucaggcuccgg

SEQ ID NO: 13869 - RNA, 26 nt, Human
ccugcucucccugauagaugcugaga

SEQ ID NO: 13870 - RNA, 24 nt, Human
gugaugaggaggacaacacugccu

SEQ ID NO: 13871 - RNA, 20 nt, Human
uuggcuuucugugccagccu

SEQ ID NO: 13872 - RNA, 26 nt, Human
gcugguuuuauuggaaugacaguguu

SEQ ID NO: 13873 - RNA, 20 nt, Human
guuccucugcccgccaugcc

SEQ ID NO: 13874 - RNA, 23 nt, Human
cccaggaggcggagguuguagug

SEQ ID NO: 13875 - RNA, 23 nt, Human
gugugagcuguucuaggccgagg

SEQ ID NO: 13876 - RNA, 28 nt, Human
ggaccucuuacacaucugcuccgcagug

SEQ ID NO: 13877 - RNA, 22 nt, Human
cggaacagugucucaacuggcc

SEQ ID NO: 13878 - RNA, 22 nt, Human
caaggcugcuguuaucaucuca

SEQ ID NO: 13879 - RNA, 23 nt, Human
gcaagcuauuuguuuguuuucua

SEQ ID NO: 13880 - RNA, 21 nt, Human
ucugaugcuucuuuagauuua

SEQ ID NO: 13881 - RNA, 21 nt, Human
cucuggagacugaggugggag

SEQ ID NO: 13882 - RNA, 24 nt, Human
aaaaggaguugaaucaucagagua

SEQ ID NO: 13883 - RNA, 25 nt, Human
gauuucugcuuuuguguaccccacc

SEQ ID NO: 13884 - RNA, 22 nt, Human
agcuucugaaggaagacuuuaa

SEQ ID NO: 13885 - RNA, 27 nt, Human
acagauggggaaacugaggcuuaggaa

SEQ ID NO: 13886 - RNA, 30 nt, Human
ccuuauuucuuaacugugcugggauugcaa

SEQ ID NO: 13887 - RNA, 27 nt, Human
aagucuccagagagaaaucaggccuga

SEQ ID NO: 13888 - RNA, 19 nt, Human
uuauucgagucacugauga

SEQ ID NO: 13889 - RNA, 25 nt, Human
ccuuuguuauuuagcauuucgaaca

SEQ ID NO: 13890 - RNA, 22 nt, Human
uuccaggaagaggcuccaugug

SEQ ID NO: 13891 - RNA, 21 nt, Human
acucaguucaaaccauuucag

SEQ ID NO: 13892 - RNA, 16 nt, Human
gcucacugccucuccu

SEQ ID NO: 13893 - RNA, 27 nt, Human
uucucgcuccccccauccugggcuggg

SEQ ID NO: 13894 - RNA, 20 nt, Human
uuucaaacuuuguacuguua

SEQ ID NO: 13895 - RNA, 22 nt, Human
ccccaaaucuccuccuuccaca

SEQ ID NO: 13896 - RNA, 20 nt, Human
cuuugcuaugaccucagucc

SEQ ID NO: 13897 - RNA, 24 nt, Human
ugagucugacaaaaucagaguuag

SEQ ID NO: 13898 - RNA, 22 nt, Human
agcagcuuccagccugggucag

SEQ ID NO: 13899 - RNA, 24 nt, Human
caggcuggagugcagugucgugau

SEQ ID NO: 13900 - RNA, 20 nt, Human
aguccauuagcucuccaguu

SEQ ID NO: 13901 - RNA, 20 nt, Human
ugcuauucauuuaacuuuuc

SEQ ID NO: 13902 - RNA, 23 nt, Human
ucccugccccucuccaugaagcu

SEQ ID NO: 13903 - RNA, 19 nt, Human
ugcagugaaugcuccuucc

SEQ ID NO: 13904 - RNA, 22 nt, Human
uguugcccaagcuggagugaag

SEQ ID NO: 13905 - RNA, 22 nt, Human
ucaggcuggagugcaguggugc

SEQ ID NO: 13906 - RNA, 25 nt, Human
ccaucaugcugguuuuucucugagc

SEQ ID NO: 13907 - RNA, 21 nt, Human
uucauuucucacaacugggcu

SEQ ID NO: 13908 - RNA, 26 nt, Human
cuggaggacuagaaccuggagggcug

SEQ ID NO: 13909 - RNA, 21 nt, Human
cugcaccuccaccuuccgggc

SEQ ID NO: 13910 - RNA, 23 nt, Human
gauugggucaggaagagugggag

SEQ ID NO: 13911 - RNA, 21 nt, Human
ggagaggggcagaacagccgc

SEQ ID NO: 13912 - RNA, 25 nt, Human
agagaaacuaucuucucccaacauu

SEQ ID NO: 13913 - RNA, 23 nt, Human
aagauuaacaaaauuaggccggg

SEQ ID NO: 13914 - RNA, 26 nt, Human
acauucucucauccuacuuagccuac

SEQ ID NO: 13915 - RNA, 22 nt, Human
caagccccucgucucccgggag

SEQ ID NO: 13916 - RNA, 25 nt, Human
uuucucucuguguggcaaacauuua

SEQ ID NO: 13917 - RNA, 21 nt, Human
cgcagggcagaggagagcagc

SEQ ID NO: 13918 - RNA, 27 nt, Human
cacacacacuccuuccccuugucccug

SEQ ID NO: 13919 - RNA, 20 nt, Human
ucugagaugggugcugcaaa

SEQ ID NO: 13920 - RNA, 23 nt, Human
caugcuggaauugcucccugauu

SEQ ID NO: 13921 - RNA, 27 nt, Human
uucucucuuguuugagagagaaugagg

SEQ ID NO: 13922 - RNA, 24 nt, Human
gggagcaaguugcccacaugcccg

SEQ ID NO: 13923 - RNA, 26 nt, Human
gcugggacuacaggugugagucacca

SEQ ID NO: 13924 - RNA, 21 nt, Human
accacagaccucagcugugua

SEQ ID NO: 13925 - RNA, 20 nt, Human
agggugggaggcaggcagcu

SEQ ID NO: 13926 - RNA, 20 nt, Human
ugccuucuccaccugcccuc

SEQ ID NO: 13927 - RNA, 18 nt, Human
ugaaacugagagagugaa

SEQ ID NO: 13928 - RNA, 19 nt, Human
uagaaugacuccuugggua

SEQ ID NO: 13929 - RNA, 18 nt, Human
cucuggccucgcugcacu

SEQ ID NO: 13930 - RNA, 25 nt, Human
aaccuauaccaucugagaauuccua

SEQ ID NO: 13931 - RNA, 19 nt, Human
gagagugagaccuggcagc

SEQ ID NO: 13932 - RNA, 25 nt, Human
acauaccccacugggcacacgcaca

SEQ ID NO: 13933 - RNA, 18 nt, Human
acccuuuaguuugcuuga

SEQ ID NO: 13934 - RNA, 20 nt, Human
ggcgucgggaucccuuuucg

SEQ ID NO: 13935 - RNA, 26 nt, Human
ugcccagguucagguguaucgugcau

SEQ ID NO: 13936 - RNA, 22 nt, Human
acagcagaaauuacaccaucca

SEQ ID NO: 13937 - RNA, 26 nt, Human
gccuuugccagccauucuuucccuuu

SEQ ID NO: 13938 - RNA, 21 nt, Human
agcacaaaauaguacuuugug

SEQ ID NO: 13939 - RNA, 24 nt, Human
cucccugggcugggaaaacccuaa

SEQ ID NO: 13940 - RNA, 22 nt, Human
aaccuggcuuucucacagcugg

SEQ ID NO: 13941 - RNA, 26 nt, Human
acagccacuacugacugcagccagcc

SEQ ID NO: 13942 - RNA, 27 nt, Human
gcccucgccucugcacugcgggacgcc

SEQ ID NO: 13943 - RNA, 29 nt, Human
cuuacucuagguccucccugccuaaggcc

SEQ ID NO: 13944 - RNA, 22 nt, Human
ggaggcugaggcaggagaguca

SEQ ID NO: 13945 - RNA, 22 nt, Human
ggaggcugagacaggagaauca

SEQ ID NO: 13946 - RNA, 25 nt, Human
cccguguaggaaccugcacacgagc

SEQ ID NO: 13947 - RNA, 21 nt, Human
caggcagcgccaagugcgugc

SEQ ID NO: 13948 - RNA, 21 nt, Human
gcucgcacagccuccccaucc

SEQ ID NO: 13949 - RNA, 22 nt, Human
ugacaugcaugguuuaacuucc

SEQ ID NO: 13950 - RNA, 22 nt, Human
gggccugcugcgucagaccagu

SEQ ID NO: 13951 - RNA, 32 nt, Human
ggcgccaucuguaaagucuccucuggaaaugc

SEQ ID NO: 13952 - RNA, 21 nt, Human
agcuuuggguuggagcuguuc

SEQ ID NO: 13953 - RNA, 19 nt, Human
agugaggcuccaaaaugag

SEQ ID NO: 13954 - RNA, 26 nt, Human
auaggagagcugggggcaggagaaug

SEQ ID NO: 13955 - RNA, 29 nt, Human
cuugccugccucccugccucuggccaugg

SEQ ID NO: 13956 - RNA, 23 nt, Human
aaucaugaaauuaacuaacaccu

SEQ ID NO: 13957 - RNA, 23 nt, Human
ggcaggagaauugcuugaacuug

SEQ ID NO: 13958 - RNA, 18 nt, Human
ccuacuuccggcugcaaa

SEQ ID NO: 13959 - RNA, 25 nt, Human
aggacuuggggcuguagcaucaucu

SEQ ID NO: 13960 - RNA, 26 nt, Human
ggcaucgugcuggugccucuggcccc

SEQ ID NO: 13961 - RNA, 27 nt, Human
cacugcacuccagccugggcaacacag

SEQ ID NO: 13962 - RNA, 18 nt, Human
cuucaucugcuugguguc

SEQ ID NO: 13963 - RNA, 20 nt, Human
agcgcugaagcagaaguccc

SEQ ID NO: 13964 - RNA, 30 nt, Human
aggccucuggaaucagaaucuucagggugg

SEQ ID NO: 13965 - RNA, 21 nt, Human
ggaggcaccacgaagcuguga

SEQ ID NO: 13966 - RNA, 27 nt, Human
ggaaaguugcugcacaaguguguggca

SEQ ID NO: 13967 - RNA, 23 nt, Human
cggguggggugcagggagggaga

SEQ ID NO: 13968 - RNA, 27 nt, Human
cgggucgccugcccugucucccuacuu

SEQ ID NO: 13969 - RNA, 23 nt, Human
cuucugugugucccucuccccca

SEQ ID NO: 13970 - RNA, 27 nt, Human
ggcagguaaggguggaacaggaggggu

SEQ ID NO: 13971 - RNA, 22 nt, Human
acacauuuaaaaauaaauguaa

SEQ ID NO: 13972 - RNA, 23 nt, Human
caacaagaguaaaacucugucuc

SEQ ID NO: 13973 - RNA, 23 nt, Human
caacaagagcaaaacuccgucuc

SEQ ID NO: 13974 - RNA, 27 nt, Human
caagucaacugacaguccaaaggcucc

SEQ ID NO: 13975 - RNA, 23 nt, Human
ucucuguacugugccugccucaa

SEQ ID NO: 13976 - RNA, 27 nt, Human
gaguagcugggacuacaggcacaugcc

SEQ ID NO: 13977 - RNA, 20 nt, Human
ggagguggggagagaaagau

SEQ ID NO: 13978 - RNA, 21 nt, Human
uccauucaggagcaaagagca

SEQ ID NO: 13979 - RNA, 20 nt, Human
ggggaggggggaggggaacu

SEQ ID NO: 13980 - RNA, 23 nt, Human
guguaugugucugaccucaggcc

SEQ ID NO: 13981 - RNA, 27 nt, Human
ugaaagaguccuauuugcacuguagcc

SEQ ID NO: 13982 - RNA, 27 nt, Human
ugggcucaagcaauccuccugccucag

SEQ ID NO: 13983 - RNA, 18 nt, Human
ucuucuucuuuccuucca

SEQ ID NO: 13984 - RNA, 21 nt, Human
cugcugcugcugcugcuucuc

SEQ ID NO: 13985 - RNA, 21 nt, Human
cagauggggaaacugaggccc

SEQ ID NO: 13986 - RNA, 25 nt, Human
ucuguauuguguagaaugaucaugu

SEQ ID NO: 13987 - RNA, 22 nt, Human
ucuaaaguuguucccuggccgg

SEQ ID NO: 13988 - RNA, 26 nt, Human
ggaaugaggcuggauacggugcagug

SEQ ID NO: 13989 - RNA, 20 nt, Human
ucauaucaggaugaccucga

SEQ ID NO: 13990 - RNA, 22 nt, Human
aaagugcugggauuacaggcuu

SEQ ID NO: 13991 - RNA, 19 nt, Human
ggaggaagaaauguuuucu

SEQ ID NO: 13992 - RNA, 24 nt, Human
gcacagccaccgcucuguggcucg

SEQ ID NO: 13993 - RNA, 26 nt, Human
cgguucagaagcuaaagugacucucu

SEQ ID NO: 13994 - RNA, 27 nt, Human
cucaaguauucuugauccuguguuuca

SEQ ID NO: 13995 - RNA, 23 nt, Human
gagaagaguuuagugacugaggc

SEQ ID NO: 13996 - RNA, 22 nt, Human
gauucuuaauauuucuccauca

SEQ ID NO: 13997 - RNA, 21 nt, Human
ggagguggagguuguggugag

SEQ ID NO: 13998 - RNA, 23 nt, Human
ucccuugagccccagaggcagag

SEQ ID NO: 13999 - RNA, 21 nt, Human
augcuuuugguacaaauggau

SEQ ID NO: 14000 - RNA, 22 nt, Human
agaaaugugaaacuuggugggg

SEQ ID NO: 14001 - RNA, 21 nt, Human
ucucacccccucacacaggcc

SEQ ID NO: 14002 - RNA, 20 nt, Human
aaugaauucuucaacaggga

SEQ ID NO: 14003 - RNA, 26 nt, Human
uuuucauagucuucuuuguauuuugc

SEQ ID NO: 14004 - RNA, 23 nt, Human
gcagagggacucagggaugggga

SEQ ID NO: 14005 - RNA, 23 nt, Human
ggcagcccacagugcugcacgua

SEQ ID NO: 14006 - RNA, 20 nt, Human
uccagcaccuucucucucca

SEQ ID NO: 14007 - RNA, 22 nt, Human
agagugcugggaucacaggcgu

SEQ ID NO: 14008 - RNA, 22 nt, Human
acccaagaagaaaugcuuucca

SEQ ID NO: 14009 - RNA, 21 nt, Human
guuuccagcugugagcuugag

SEQ ID NO: 14010 - RNA, 20 nt, Human
gagguuugccuuuguggaaa

SEQ ID NO: 14011 - RNA, 18 nt, Human
cagccuggcaucuucuug

SEQ ID NO: 14012 - RNA, 23 nt, Human
uugagccugacuguucugcucca

SEQ ID NO: 14013 - RNA, 27 nt, Human
caggcuggagugcaguggcauaaucau

SEQ ID NO: 14014 - RNA, 22 nt, Human
agcuucugcaaugggaguugcc

SEQ ID NO: 14015 - RNA, 20 nt, Human
aucucuaguacuuuuuguca

SEQ ID NO: 14016 - RNA, 27 nt, Human
uaagccuuuuuguggcuaaguuuuguu

SEQ ID NO: 14017 - RNA, 21 nt, Human
ugucuuccaaucaucucccau

SEQ ID NO: 14018 - RNA, 19 nt, Human
uaccccuuucaagccuggg

SEQ ID NO: 14019 - RNA, 22 nt, Human
uauguuauuucucuggggucug

SEQ ID NO: 14020 - RNA, 29 nt, Human
cugcaggcucucuggccuuuggacccgag

SEQ ID NO: 14021 - RNA, 19 nt, Human
gucacaggcuggcuucugu

SEQ ID NO: 14022 - RNA, 25 nt, Human
cucccaccucagcuucucaaaguuc

SEQ ID NO: 14023 - RNA, 23 nt, Human
acaaaggcucuauggaagaaaug

SEQ ID NO: 14024 - RNA, 20 nt, Human
caccacugcuucccacuggg

SEQ ID NO: 14025 - RNA, 25 nt, Human
agaagggacaaaagguacuggugag

SEQ ID NO: 14026 - RNA, 16 nt, Human
cuucccuuucuggcuu

SEQ ID NO: 14027 - RNA, 24 nt, Human
gccauccugaggacacagccagga

SEQ ID NO: 14028 - RNA, 25 nt, Human
gaaucacuucagcccgggaggugga

SEQ ID NO: 14029 - RNA, 27 nt, Human
gaaaaacagaggaugcugaaguacagu

SEQ ID NO: 14030 - RNA, 21 nt, Human
agggacagcccugacacuccu

SEQ ID NO: 14031 - RNA, 21 nt, Human
gaguaaaucacuggauuucuu

SEQ ID NO: 14032 - RNA, 21 nt, Human
ucugccccugcccaccuccuc

SEQ ID NO: 14033 - RNA, 29 nt, Human
gcugacagcuucccgccuccuccagcugc

SEQ ID NO: 14034 - RNA, 25 nt, Human
ucaugccauucuccugccucagccu

SEQ ID NO: 14035 - RNA, 19 nt, Human
cccugccucuacccaacca

SEQ ID NO: 14036 - RNA, 19 nt, Human
caggugugugguguaaaca

SEQ ID NO: 14037 - RNA, 23 nt, Human
uuuaggaggaaggcuuggcuccu

SEQ ID NO: 14038 - RNA, 20 nt, Human
guggccuugagaagcugagc

SEQ ID NO: 14039 - RNA, 27 nt, Human
gaguaacuccuccuuuacuuuuuuccu

SEQ ID NO: 14040 - RNA, 23 nt, Human
cugccaucuugcuuuucuuugga

SEQ ID NO: 14041 - RNA, 27 nt, Human
gccggccacaccgcaucuuccggccgu

SEQ ID NO: 14042 - RNA, 19 nt, Human
aucuaagaccaucucucca

SEQ ID NO: 14043 - RNA, 21 nt, Human
gccuaugaucccagcacuuug

SEQ ID NO: 14044 - RNA, 26 nt, Human
uaagaaaccaugugugucuggaacac

SEQ ID NO: 14045 - RNA, 22 nt, Human
gcuccucuccccuacagcagcc

SEQ ID NO: 14046 - RNA, 27 nt, Human
aacccaggcugucuagcuccgggggua

SEQ ID NO: 14047 - RNA, 21 nt, Human
uugaaccugguucaacaugga

SEQ ID NO: 14048 - RNA, 20 nt, Human
uaagucaggagacuuuccuu

SEQ ID NO: 14049 - RNA, 26 nt, Human
cacugcagcagaaaacaaacacacga

SEQ ID NO: 14050 - RNA, 24 nt, Human
uagcucuucccagaccuaagcugc

SEQ ID NO: 14051 - RNA, 18 nt, Human
gcugggagcuuggccucu

SEQ ID NO: 14052 - RNA, 20 nt, Human
gugggaaaacacugccaucu

SEQ ID NO: 14053 - RNA, 24 nt, Human
cugcugcugcugcugcuaaucuuc

SEQ ID NO: 14054 - RNA, 21 nt, Human
aauguauuuccccuuguggcu

SEQ ID NO: 14055 - RNA, 24 nt, Human
uacacagugcuuuccagccuuugg

SEQ ID NO: 14056 - RNA, 27 nt, Human
ggcuguggugguguucuguugguuaca

SEQ ID NO: 14057 - RNA, 18 nt, Human
gagccuugccuagcuggu

SEQ ID NO: 14058 - RNA, 23 nt, Human
uucagagguuuaacgugcugcuu

SEQ ID NO: 14059 - RNA, 27 nt, Human
ccucgggauuggcggguccacuugcca

SEQ ID NO: 14060 - RNA, 22 nt, Human
uugcucagaacaggggcuggcu

SEQ ID NO: 14061 - RNA, 21 nt, Human
gcuccccaacuccucgcuuca

SEQ ID NO: 14062 - RNA, 21 nt, Human
ggcccaggcggggugcgagug

SEQ ID NO: 14063 - RNA, 24 nt, Human
aggauuguugaggaguaaauaaau

SEQ ID NO: 14064 - RNA, 25 nt, Human
ucagcucuuccaugauggauucccc

SEQ ID NO: 14065 - RNA, 19 nt, Human
ucauagauccuaagccaua

SEQ ID NO: 14066 - RNA, 21 nt, Human
ccguguggggacgcccccagg

SEQ ID NO: 14067 - RNA, 22 nt, Human
ugucaacaggauggaaaccagc

SEQ ID NO: 14068 - RNA, 23 nt, Human
cagggacuguaaaaccaccuuuu

SEQ ID NO: 14069 - RNA, 29 nt, Human
ucucaauuuuaaauuaauuuugaaucacu

SEQ ID NO: 14070 - RNA, 23 nt, Human
uugcagacuuugcaaaucuuaag

SEQ ID NO: 14071 - RNA, 21 nt, Human
acuucaacgcaugcacuuugu

SEQ ID NO: 14072 - RNA, 19 nt, Human
agcacuguuuucucuuuca

SEQ ID NO: 14073 - RNA, 21 nt, Human
ugcucuuuccuuccucacugg

SEQ ID NO: 14074 - RNA, 23 nt, Human
cacacgaaugucucaagcuuuga

SEQ ID NO: 14075 - RNA, 23 nt, Human
gcacucccuucuucccuuuuaua

SEQ ID NO: 14076 - RNA, 26 nt, Human
ggaggcaccgaugcccgcagagcccg

SEQ ID NO: 14077 - RNA, 23 nt, Human
ucuuccaucugacucagguuugc

SEQ ID NO: 14078 - RNA, 25 nt, Human
cuuucauagcuuuucuauuuuuugc

SEQ ID NO: 14079 - RNA, 23 nt, Human
ggugcccaggccugagguacuca

SEQ ID NO: 14080 - RNA, 27 nt, Human
ccagaacaaaucauuauguuuccuaac

SEQ ID NO: 14081 - RNA, 22 nt, Human
ggcuuacugcaaccuuugccuc

SEQ ID NO: 14082 - RNA, 21 nt, Human
ucuugccuccuuucucucagg

SEQ ID NO: 14083 - RNA, 21 nt, Human
guuguuggagcuuuccucaaa

SEQ ID NO: 14084 - RNA, 24 nt, Human
uggcuaacauggugaaaccccguc

SEQ ID NO: 14085 - RNA, 21 nt, Human
cuuuccauguggaauucaaag

SEQ ID NO: 14086 - RNA, 25 nt, Human
acucuuacugaucaauauaacucug

SEQ ID NO: 14087 - RNA, 21 nt, Human
guguuuagguauucucugcca

SEQ ID NO: 14088 - RNA, 19 nt, Human
cagcuccuuucuguccugg

SEQ ID NO: 14089 - RNA, 30 nt, Human
gcgagagagcgagagaucuccguagacugc

SEQ ID NO: 14090 - RNA, 24 nt, Human
cugcagaaccuggccucaccugga

SEQ ID NO: 14091 - RNA, 22 nt, Human
acccucuggggucuucugucca

SEQ ID NO: 14092 - RNA, 23 nt, Human
ucuuguauuaagaaugaaauacu

SEQ ID NO: 14093 - RNA, 21 nt, Human
cccagcacuuugauaggcuga

SEQ ID NO: 14094 - RNA, 22 nt, Human
uggacgacugugcaaugcugug

SEQ ID NO: 14095 - RNA, 27 nt, Human
uguaaggggaagguggcaaugggaccc

SEQ ID NO: 14096 - RNA, 20 nt, Human
cagccaggcuggagugcagu

SEQ ID NO: 14097 - RNA, 22 nt, Human
auguucaaagugucugccugug

SEQ ID NO: 14098 - RNA, 21 nt, Human
uuuacccagggcgggcagcga

SEQ ID NO: 14099 - RNA, 20 nt, Human
uuggcugugucuguguuugu

SEQ ID NO: 14100 - RNA, 21 nt, Human
gccucaaguguaguuggacuu

SEQ ID NO: 14101 - RNA, 23 nt, Human
cuauauauuaaaaacaaaaaaga

SEQ ID NO: 14102 - RNA, 22 nt, Human
ucaauucuggccugucuuccuu

SEQ ID NO: 14103 - RNA, 21 nt, Human
cuucaggcugggggcagugga

SEQ ID NO: 14104 - RNA, 24 nt, Human
accagcacagccugccccaauucc

SEQ ID NO: 14105 - RNA, 19 nt, Human
cuaagaaugaggaauaguu

SEQ ID NO: 14106 - RNA, 20 nt, Human
ggaguauuucaaacuuuaca

SEQ ID NO: 14107 - RNA, 22 nt, Human
cacuguacuccauccuggguga

SEQ ID NO: 14108 - RNA, 21 nt, Human
uguagauuuuaaacacugcug

SEQ ID NO: 14109 - RNA, 28 nt, Human
uaguacuguauuggcucugugaaaacau

SEQ ID NO: 14110 - RNA, 30 nt, Human
ccaagcaccuccaaccaaauaagacuucca

SEQ ID NO: 14111 - RNA, 21 nt, Human
aauuucagcaugaaauuugaa

SEQ ID NO: 14112 - RNA, 23 nt, Human
cuuccuggacuuuguuuucugac

SEQ ID NO: 14113 - RNA, 21 nt, Human
ucuguucuguucuguucuccu

SEQ ID NO: 14114 - RNA, 22 nt, Human
cccaaguaucugggaccacagg

SEQ ID NO: 14115 - RNA, 21 nt, Human
auguaaaauaaaccaucuuca

SEQ ID NO: 14116 - RNA, 19 nt, Human
uugucucacuugugcagug

SEQ ID NO: 14117 - RNA, 23 nt, Human
gaggcugaggcuggcacaggaca

SEQ ID NO: 14118 - RNA, 23 nt, Human
gauggacugacggacaguuccag

SEQ ID NO: 14119 - RNA, 22 nt, Human
gggcucuauauuacuugcuuga

SEQ ID NO: 14120 - RNA, 22 nt, Human
cuagcacacugccaccaucuca

SEQ ID NO: 14121 - RNA, 19 nt, Human
ccuguucugcgcuguguac

SEQ ID NO: 14122 - RNA, 20 nt, Human
acaaguguccaugaugcugg

SEQ ID NO: 14123 - RNA, 22 nt, Human
acaagaaccacaaaaacuugaa

SEQ ID NO: 14124 - RNA, 21 nt, Human
ccuuggaacacauggugccau

SEQ ID NO: 14125 - RNA, 18 nt, Human
ggaacaaacaagggacca

SEQ ID NO: 14126 - RNA, 22 nt, Human
ucacgguuccaggaacagcccu

SEQ ID NO: 14127 - RNA, 20 nt, Human
ccugcagaauaaaucugcca

SEQ ID NO: 14128 - RNA, 27 nt, Human
ccugccugagccucccgaguagcuggg

SEQ ID NO: 14129 - RNA, 27 nt, Human
ugcucucucaacaucacauacagcuuc

SEQ ID NO: 14130 - RNA, 26 nt, Human
guccaccaugcucucucaccugcuuc

SEQ ID NO: 14131 - RNA, 24 nt, Human
gcacaagggcuggagcccagagau

SEQ ID NO: 14132 - RNA, 23 nt, Human
caguucacugcaugugcugcccc

SEQ ID NO: 14133 - RNA, 20 nt, Human
gcaaucuacucaucugacaa

SEQ ID NO: 14134 - RNA, 28 nt, Human
uucauaagacuuaauuuguacaauaguu

SEQ ID NO: 14135 - RNA, 20 nt, Human
gggacccuuuugacuuucca

SEQ ID NO: 14136 - RNA, 19 nt, Human
aucauaaaacaggaaaugu

SEQ ID NO: 14137 - RNA, 21 nt, Human
caccccuuggccucugccucc

SEQ ID NO: 14138 - RNA, 25 nt, Human
agccucuccccgccgcccccaacag

SEQ ID NO: 14139 - RNA, 30 nt, Human
auccacauuugaacacagagcuaaagaaac

SEQ ID NO: 14140 - RNA, 27 nt, Human
cucacuuugcugccccaccaucuugcu

SEQ ID NO: 14141 - RNA, 28 nt, Human
gccgaagcugcugugacuguguccccuu

SEQ ID NO: 14142 - RNA, 22 nt, Human
gguuccucccuccuuuucucuu

SEQ ID NO: 14143 - RNA, 21 nt, Human
ggcuguaggagggcauggaga

SEQ ID NO: 14144 - RNA, 27 nt, Human
auugccucggccuucuuugcuuuuugu

SEQ ID NO: 14145 - RNA, 21 nt, Human
ugagcccuggcuacuaauaaa

SEQ ID NO: 14146 - RNA, 27 nt, Human
ggcugcguacuccacuggucugucuuu

SEQ ID NO: 14147 - RNA, 23 nt, Human
ucacagguuccuguuccccaggc

SEQ ID NO: 14148 - RNA, 21 nt, Human
gguaaacuucacagacauaaa

SEQ ID NO: 14149 - RNA, 22 nt, Human
gcgugcgccaccaugcccggcu

SEQ ID NO: 14150 - RNA, 25 nt, Human
uucagcaguaacaggaaaccacuua

SEQ ID NO: 14151 - RNA, 23 nt, Human
acacaucaaccuccauguccuua

SEQ ID NO: 14152 - RNA, 24 nt, Human
uaucagcccacuugaccacccagu

SEQ ID NO: 14153 - RNA, 23 nt, Human
gggauuacaggugugagccucca

SEQ ID NO: 14154 - RNA, 22 nt, Human
ggccccccaaagugcugggauu

SEQ ID NO: 14155 - RNA, 22 nt, Human
ggccucccaaagcgcugggauu

SEQ ID NO: 14156 - RNA, 20 nt, Human
caucacuuaucuuucucacu

SEQ ID NO: 14157 - RNA, 27 nt, Human
gugugguuccuggagggguggucuguu

SEQ ID NO: 14158 - RNA, 23 nt, Human
aggcugagaguggcacuaugugc

SEQ ID NO: 14159 - RNA, 21 nt, Human
gguugcuacuuuuauuuugga

SEQ ID NO: 14160 - RNA, 21 nt, Human
cagguucugcaaagcaagugc

SEQ ID NO: 14161 - RNA, 17 nt, Human
ugagccaagagcuccua

SEQ ID NO: 14162 - RNA, 22 nt, Human
augaugucauuuggaaggauuu

SEQ ID NO: 14163 - RNA, 26 nt, Human
caccuggauuuuccuggauaauuuga

SEQ ID NO: 14164 - RNA, 25 nt, Human
cguacuucuccuccauuggucccag

SEQ ID NO: 14165 - RNA, 23 nt, Human
ugacuucucauuacugugcugaa

SEQ ID NO: 14166 - RNA, 22 nt, Human
aaggucuguggccaucugugag

SEQ ID NO: 14167 - RNA, 24 nt, Human
uuggaaagaguucaagugucugua

SEQ ID NO: 14168 - RNA, 16 nt, Human
cucuccucuucaggcu

SEQ ID NO: 14169 - RNA, 19 nt, Human
auaguuuguuaguacucug

SEQ ID NO: 14170 - RNA, 20 nt, Human
gcuuuuggugggguggagag

SEQ ID NO: 14171 - RNA, 23 nt, Human
auuaagcagaaacagcauauuag

SEQ ID NO: 14172 - RNA, 22 nt, Human
aagacuguaagccugugugugc

SEQ ID NO: 14173 - RNA, 21 nt, Human
uaucugucugaauuacuucag

SEQ ID NO: 14174 - RNA, 23 nt, Human
uugcuaaaauauuuuagauguua

SEQ ID NO: 14175 - RNA, 26 nt, Human
gggaggcagagguugcagugagugga

SEQ ID NO: 14176 - RNA, 21 nt, Human
cucacaugaaugcacucaccu

SEQ ID NO: 14177 - RNA, 22 nt, Human
aaagugcugagauuacaggcau

SEQ ID NO: 14178 - RNA, 27 nt, Human
gcuguaucugugcuuugcccacaugcc

SEQ ID NO: 14179 - RNA, 25 nt, Human
cacaggggacaggaugguucccuug

SEQ ID NO: 14180 - RNA, 23 nt, Human
ccugcagcgcgcacacgcacgca

SEQ ID NO: 14181 - RNA, 21 nt, Human
caacauaaggaucuccaucug

SEQ ID NO: 14182 - RNA, 27 nt, Human
cuuacuuccucuauucucugagccgcu

SEQ ID NO: 14183 - RNA, 21 nt, Human
uuuaaaaaauacaguuccuag

SEQ ID NO: 14184 - RNA, 20 nt, Human
cucaguaacacagugcagug

SEQ ID NO: 14185 - RNA, 18 nt, Human
gcugcuccugccugcuuc

SEQ ID NO: 14186 - RNA, 21 nt, Human
ggugaucuggggaaaacgcag

SEQ ID NO: 14187 - RNA, 23 nt, Human
cucaggugacaccaccugcucca

SEQ ID NO: 14188 - RNA, 20 nt, Human
uauuugacugggcgugcaga

SEQ ID NO: 14189 - RNA, 22 nt, Human
gucacccaggcuggagugcagu

SEQ ID NO: 14190 - RNA, 22 nt, Human
gucacccaggcuagagugcaau

SEQ ID NO: 14191 - RNA, 27 nt, Human
ggaggggcccagcagggccaacuccag

SEQ ID NO: 14192 - RNA, 21 nt, Human
agggcagcggauuuguuguug

SEQ ID NO: 14193 - RNA, 26 nt, Human
cauuuccaacuugaugucaagcaaug

SEQ ID NO: 14194 - RNA, 23 nt, Human
cugagguaaaauguuccagcuca

SEQ ID NO: 14195 - RNA, 22 nt, Human
ccaaguagcugagacuacaggc

SEQ ID NO: 14196 - RNA, 22 nt, Human
aacuuugaguacagauacugug

SEQ ID NO: 14197 - RNA, 22 nt, Human
cucccccuccuucccagcugcc

SEQ ID NO: 14198 - RNA, 24 nt, Human
gcuggcuuucccugucuauugccu

SEQ ID NO: 14199 - RNA, 24 nt, Human
ggagagaaggcgcugggcugcgag

SEQ ID NO: 14200 - RNA, 21 nt, Human
caggaguugaauuuggggugg

SEQ ID NO: 14201 - RNA, 24 nt, Human
auuaucuacuaguaauaauguaau

SEQ ID NO: 14202 - RNA, 20 nt, Human
gucugccuggagugcugugc

SEQ ID NO: 14203 - RNA, 25 nt, Human
gggcucaagcaguucucccaccuca

SEQ ID NO: 14204 - RNA, 19 nt, Human
cccugugaggcugggucca

SEQ ID NO: 14205 - RNA, 25 nt, Human
uucucaaggauuauuagaaucuuag

SEQ ID NO: 14206 - RNA, 26 nt, Human
aagugguggucuuuuggaugagggaa

SEQ ID NO: 14207 - RNA, 22 nt, Human
ggcauuuuccugccugguuucu

SEQ ID NO: 14208 - RNA, 22 nt, Human
gcucacugcaacuuccgcaucc

SEQ ID NO: 14209 - RNA, 20 nt, Human
cucaagcacugacacucauu

SEQ ID NO: 14210 - RNA, 25 nt, Human
ugcaaugugguagaaaauucacgug

SEQ ID NO: 14211 - RNA, 23 nt, Human
uucucagaaggcaaaugacuuug

SEQ ID NO: 14212 - RNA, 20 nt, Human
cugcuucugccaggaccaca

SEQ ID NO: 14213 - RNA, 25 nt, Human
gaccucaggugaugcacccaccuca

SEQ ID NO: 14214 - RNA, 19 nt, Human
uuuccacuccuccuagcca

SEQ ID NO: 14215 - RNA, 28 nt, Human
gccaauuuuauagacagagaaaguauuu

SEQ ID NO: 14216 - RNA, 24 nt, Human
ccucccacacgugcucacccaccc

SEQ ID NO: 14217 - RNA, 24 nt, Human
cagagggagauaaagagagagggc

SEQ ID NO: 14218 - RNA, 22 nt, Human
cuuacacgagaagacauucaug

SEQ ID NO: 14219 - RNA, 18 nt, Human
ccaccccuggccuuugga

SEQ ID NO: 14220 - RNA, 22 nt, Human
auuuugggggguaaucagcauu

SEQ ID NO: 14221 - RNA, 29 nt, Human
uuuguggcugugcugcuugagugacgucu

SEQ ID NO: 14222 - RNA, 22 nt, Human
gaccagcccagccaacauggug

SEQ ID NO: 14223 - RNA, 21 nt, Human
ggcccagcagccuucugacaa

SEQ ID NO: 14224 - RNA, 22 nt, Human
gacuacagaugugggccaccau

SEQ ID NO: 14225 - RNA, 22 nt, Human
ugaacugcaggggcagagccag

SEQ ID NO: 14226 - RNA, 23 nt, Human
cuugcugucuguuguuguuugaa

SEQ ID NO: 14227 - RNA, 23 nt, Human
ccugccuggucacugacugcuua

SEQ ID NO: 14228 - RNA, 25 nt, Human
ccugggcguggcccuggucuguggu

SEQ ID NO: 14229 - RNA, 24 nt, Human
gcccacacccauuuauuuccuucc

SEQ ID NO: 14230 - RNA, 22 nt, Human
auuuuuaaaauagaguuuucug

SEQ ID NO: 14231 - RNA, 26 nt, Human
cuccagucguagcaagagucucgacc

SEQ ID NO: 14232 - RNA, 24 nt, Human
acugaagucuuuguggaaaccacu

SEQ ID NO: 14233 - RNA, 23 nt, Human
ucugcugccgccaccgcccacuc

SEQ ID NO: 14234 - RNA, 25 nt, Human
gacaaauugacugcaauguaauacu

SEQ ID NO: 14235 - RNA, 20 nt, Human
gggaggcugagguugcagga

SEQ ID NO: 14236 - RNA, 27 nt, Human
cuuuucuuccccuuguguuuccaguca

SEQ ID NO: 14237 - RNA, 22 nt, Human
ggggauggcuggaagugcaaug

SEQ ID NO: 14238 - RNA, 21 nt, Human
ccaagcccuagcccuaggggg

SEQ ID NO: 14239 - RNA, 26 nt, Human
uucacugcacuuucuuccugccuuag

SEQ ID NO: 14240 - RNA, 20 nt, Human
gcuuuuguugcccaggcugg

SEQ ID NO: 14241 - RNA, 22 nt, Human
ccgcaaccuccgcccccugggu

SEQ ID NO: 14242 - RNA, 27 nt, Human
aaacuuucagaccagccccacacacca

SEQ ID NO: 14243 - RNA, 20 nt, Human
ccugcagcugagucugugcc

SEQ ID NO: 14244 - RNA, 20 nt, Human
uguguaguugguagguggac

SEQ ID NO: 14245 - RNA, 25 nt, Human
ggcggaugcagccuaccuccugggc

SEQ ID NO: 14246 - RNA, 25 nt, Human
auaggucuuucucucagugaaggug

SEQ ID NO: 14247 - RNA, 22 nt, Human
gcccugggagacagcaccgugg

SEQ ID NO: 14248 - RNA, 27 nt, Human
aaaguacccauuguuucacuuccugga

SEQ ID NO: 14249 - RNA, 23 nt, Human
uaacagcaaauaaccauugguua

SEQ ID NO: 14250 - RNA, 22 nt, Human
uacauuaaacucaaauguaaua

SEQ ID NO: 14251 - RNA, 19 nt, Human
cccuggcuucuuucucuug

SEQ ID NO: 14252 - RNA, 23 nt, Human
uuugauaugggcuuucucuuugg

SEQ ID NO: 14253 - RNA, 27 nt, Human
gggaugccuugguuuuuacugcucuga

SEQ ID NO: 14254 - RNA, 22 nt, Human
uuuccucugcaggauacaguuc

SEQ ID NO: 14255 - RNA, 23 nt, Human
cuccaagcaucagcagagcccag

SEQ ID NO: 14256 - RNA, 23 nt, Human
uagccuggcuuucuugcucuccc

SEQ ID NO: 14257 - RNA, 23 nt, Human
uaaaaucagugaccuugaacaua

SEQ ID NO: 14258 - RNA, 21 nt, Human
agacugucauggaagagggug

SEQ ID NO: 14259 - RNA, 30 nt, Human
gugcucaucuucucuugucauucauccagg

SEQ ID NO: 14260 - RNA, 21 nt, Human
uccugguguuuccucugacuc

SEQ ID NO: 14261 - RNA, 23 nt, Human
ccaagcccccaggcuacagagag

SEQ ID NO: 14262 - RNA, 22 nt, Human
cucacugcaaguuccugcccag

SEQ ID NO: 14263 - RNA, 24 nt, Human
auggaaaggguggagaauggaggg

SEQ ID NO: 14264 - RNA, 28 nt, Human
ccccacgcaggaccaacuaccuccguca

SEQ ID NO: 14265 - RNA, 23 nt, Human
cuuagaagccugcucugcaucca

SEQ ID NO: 14266 - RNA, 25 nt, Human
auccagagucauugcuguggcugag

SEQ ID NO: 14267 - RNA, 21 nt, Human
uguuuccgugugaccagggga

SEQ ID NO: 14268 - RNA, 23 nt, Human
ugcagcccauccacaaccugcuc

SEQ ID NO: 14269 - RNA, 24 nt, Human
uuugauaagaaugcuuuauguuua

SEQ ID NO: 14270 - RNA, 21 nt, Human
cacacucacaagcugugggaa

SEQ ID NO: 14271 - RNA, 22 nt, Human
acacaggaagaaagucuugguu

SEQ ID NO: 14272 - RNA, 20 nt, Human
ccugccugcugcaucuuuuc

SEQ ID NO: 14273 - RNA, 26 nt, Human
ugcccaggcuggucugaagcugcugg

SEQ ID NO: 14274 - RNA, 27 nt, Human
ccugccuggcccagccugcaccccugu

SEQ ID NO: 14275 - RNA, 21 nt, Human
uccuucauccuguggagucuu

SEQ ID NO: 14276 - RNA, 18 nt, Human
uuaccagcugacacugcu

SEQ ID NO: 14277 - RNA, 22 nt, Human
gcuggggagaucaggcccagcc

SEQ ID NO: 14278 - RNA, 21 nt, Human
gaagugagauuuuucuggccu

SEQ ID NO: 14279 - RNA, 20 nt, Human
ccuccagcaaggauucagga

SEQ ID NO: 14280 - RNA, 23 nt, Human
uguugcccaggauggagugcagu

SEQ ID NO: 14281 - RNA, 25 nt, Human
gguccucacgcagacacacccacag

SEQ ID NO: 14282 - RNA, 20 nt, Human
cagaguuggaguucugcuca

SEQ ID NO: 14283 - RNA, 22 nt, Human
cugacuuuuaaaaauggugaca

SEQ ID NO: 14284 - RNA, 20 nt, Human
uauauuccuugccuguguua

SEQ ID NO: 14285 - RNA, 20 nt, Human
gacuccugcagacucuucca

SEQ ID NO: 14286 - RNA, 18 nt, Human
aaagcuguaauauauagu

SEQ ID NO: 14287 - RNA, 22 nt, Human
auguaccuagaacacaccagcc

SEQ ID NO: 14288 - RNA, 19 nt, Human
agugugccaaacaccagcu

SEQ ID NO: 14289 - RNA, 28 nt, Human
ggacuaaggcagccuggggggacacugc

SEQ ID NO: 14290 - RNA, 22 nt, Human
uuguacuuugaaaacaccagcu

SEQ ID NO: 14291 - RNA, 23 nt, Human
uuccaaacaaaugauacaacccu

SEQ ID NO: 14292 - RNA, 24 nt, Human
ccaccuucuauuugcccagaguuu

SEQ ID NO: 14293 - RNA, 22 nt, Human
ucaacagugagcaaaucuggca

SEQ ID NO: 14294 - RNA, 27 nt, Human
gccucauacuccugggcucaagcaauc

SEQ ID NO: 14295 - RNA, 25 nt, Human
augccuggcuaauuuuuugcauuuu

SEQ ID NO: 14296 - RNA, 24 nt, Human
acaacauuaugaagacauucuuuu

SEQ ID NO: 14297 - RNA, 22 nt, Human
cgccuguaaucccaacauuuug

SEQ ID NO: 14298 - RNA, 20 nt, Human
aguauuuuuaugagacucuu

SEQ ID NO: 14299 - RNA, 19 nt, Human
ugcucuggcugugucuccc

SEQ ID NO: 14300 - RNA, 23 nt, Human
ugcagcucuaccuggccugcuua

SEQ ID NO: 14301 - RNA, 23 nt, Human
ccugugguuguuucuccagaguc

SEQ ID NO: 14302 - RNA, 23 nt, Human
cuucauuaaaacaagagaccacu

SEQ ID NO: 14303 - RNA, 21 nt, Human
gcacaacucuccucuaacccu

SEQ ID NO: 14304 - RNA, 27 nt, Human
gcugcggcuccauccucggcuccuggg

SEQ ID NO: 14305 - RNA, 23 nt, Human
gggagccccgcccucccaaaaag

SEQ ID NO: 14306 - RNA, 27 nt, Human
agcccuccagcccucuugugcuuuccc

SEQ ID NO: 14307 - RNA, 18 nt, Human
cccaccccgcgcacaccu

SEQ ID NO: 14308 - RNA, 21 nt, Human
ccaauuaagaguuaggccaga

SEQ ID NO: 14309 - RNA, 25 nt, Human
cuucaucuuauauuguguaauugua

SEQ ID NO: 14310 - RNA, 23 nt, Human
gcaugcauaucauuaaacaaaua

SEQ ID NO: 14311 - RNA, 31 nt, Human
ccagccucuguggcccugugaccugcaggua

SEQ ID NO: 14312 - RNA, 23 nt, Human
ugagauugcagccugcugccucc

SEQ ID NO: 14313 - RNA, 22 nt, Human
cccaaugcugcccuuucugcuc

SEQ ID NO: 14314 - RNA, 21 nt, Human
gcugcugcugcugcugccucc

SEQ ID NO: 14315 - RNA, 27 nt, Human
cucauccaccccuccccaucuggacca

SEQ ID NO: 14316 - RNA, 22 nt, Human
ggucaguuucacacagaaguca

SEQ ID NO: 14317 - RNA, 21 nt, Human
aauugcugggauuacaggugu

SEQ ID NO: 14318 - RNA, 23 nt, Human
gcaggcagaugaugaaguacugg

SEQ ID NO: 14319 - RNA, 21 nt, Human
cugccaccugcugcugcugcu

SEQ ID NO: 14320 - RNA, 24 nt, Human
ugcuccugucucugccucuggguc

SEQ ID NO: 14321 - RNA, 21 nt, Human
aaccucugaacucugaccuca

SEQ ID NO: 14322 - RNA, 22 nt, Human
gccuauacacccagcacuuugg

SEQ ID NO: 14323 - RNA, 20 nt, Human
ggcccccacuggagcgugua

SEQ ID NO: 14324 - RNA, 22 nt, Human
cuacaucuucacaguuccuccg

SEQ ID NO: 14325 - RNA, 21 nt, Human
acaaggcagaguuuaaaguga

SEQ ID NO: 14326 - RNA, 26 nt, Human
uggaaacugccauuucauucacacaa

SEQ ID NO: 14327 - RNA, 24 nt, Human
caccacugccagcccagcgcuggg

SEQ ID NO: 14328 - RNA, 20 nt, Human
acaucacauuucuuuucucu

SEQ ID NO: 14329 - RNA, 26 nt, Human
ugggaaggaaaauauugagcuaggca

SEQ ID NO: 14330 - RNA, 27 nt, Human
cacuuccuguccuuguucauggagagc

SEQ ID NO: 14331 - RNA, 22 nt, Human
uauuuauuucagggcugggcua

SEQ ID NO: 14332 - RNA, 27 nt, Human
cugcuucuccauggccaccuuuucagc

SEQ ID NO: 14333 - RNA, 22 nt, Human
ugagacuacaggugagugccac

SEQ ID NO: 14334 - RNA, 22 nt, Human
ugcagcugggggcuuuauggau

SEQ ID NO: 14335 - RNA, 16 nt, Human
ccaaaauuagaaaaau

SEQ ID NO: 14336 - RNA, 22 nt, Human
ucgcucagccuggagugcagug

SEQ ID NO: 14337 - RNA, 27 nt, Human
ggaguucuagaaccacuuccugcuaca

SEQ ID NO: 14338 - RNA, 20 nt, Human
uggagagauaggggguaguu

SEQ ID NO: 14339 - RNA, 29 nt, Human
ggccagggguuacaccugcccuccguggu

SEQ ID NO: 14340 - RNA, 23 nt, Human
ccuuggaauuccaacuguggacc

SEQ ID NO: 14341 - RNA, 22 nt, Human
agcuagcgucccuacugccucc

SEQ ID NO: 14342 - RNA, 21 nt, Human
ccuguaaucccaacacuuugg

SEQ ID NO: 14343 - RNA, 22 nt, Human
ccggguagcuggggcuacagga

SEQ ID NO: 14344 - RNA, 29 nt, Human
ugucacccagacuggagugcaggggggca

SEQ ID NO: 14345 - RNA, 22 nt, Human
cuucuuagaggguucagucuag

SEQ ID NO: 14346 - RNA, 24 nt, Human
uuucccaaccuccugugggccuca

SEQ ID NO: 14347 - RNA, 26 nt, Human
accagaauuugaggacagcgaggagg

SEQ ID NO: 14348 - RNA, 20 nt, Human
gugaucaagaucacugauga

SEQ ID NO: 14349 - RNA, 25 nt, Human
ucagcacuaaccacauccacucuca

SEQ ID NO: 14350 - RNA, 28 nt, Human
auacucauucuggggcucaggcuugagc

SEQ ID NO: 14351 - RNA, 24 nt, Human
caccugaggucaggaguucgagac

SEQ ID NO: 14352 - RNA, 26 nt, Human
ggaaacacugggcagacgugucgguu

SEQ ID NO: 14353 - RNA, 21 nt, Human
uaguaaucauguuggcugguc

SEQ ID NO: 14354 - RNA, 22 nt, Human
uggggaggagggauuaaaagag

SEQ ID NO: 14355 - RNA, 23 nt, Human
auucugugacuuaccuaaggcca

SEQ ID NO: 14356 - RNA, 20 nt, Human
ccuuucugauuuugccucca

SEQ ID NO: 14357 - RNA, 26 nt, Human
cugagacagaaucucagucugucacc

SEQ ID NO: 14358 - RNA, 23 nt, Human
cacaggcaauauuccagcuaugg

SEQ ID NO: 14359 - RNA, 20 nt, Human
ugucacccccagucucccac

SEQ ID NO: 14360 - RNA, 18 nt, Human
acuucucugcugucaguc

SEQ ID NO: 14361 - RNA, 19 nt, Human
gagaccacaugugugcaca

SEQ ID NO: 14362 - RNA, 24 nt, Human
ccaucaccccaaccccccaaaauu

SEQ ID NO: 14363 - RNA, 22 nt, Human
ggcucacugcuaccucuaccau

SEQ ID NO: 14364 - RNA, 21 nt, Human
uuguuugcagacugggugagg

SEQ ID NO: 14365 - RNA, 21 nt, Human
ucacccagcucaggggcuuug

SEQ ID NO: 14366 - RNA, 21 nt, Human
ggaucacagaguucaggggga

SEQ ID NO: 14367 - RNA, 21 nt, Human
caacugccaccaguccccagc

SEQ ID NO: 14368 - RNA, 19 nt, Human
gucuuaaaagacuuagccc

SEQ ID NO: 14369 - RNA, 23 nt, Human
ccuucacuuucucucaugcuacc

SEQ ID NO: 14370 - RNA, 19 nt, Human
uuggucucuuuagagacca

SEQ ID NO: 14371 - RNA, 27 nt, Human
agcaguuuugaaaccuuaguaccuuuu

SEQ ID NO: 14372 - RNA, 27 nt, Human
ucuccugccucagcuuccugaguagcu

SEQ ID NO: 14373 - RNA, 24 nt, Human
gcuccuccaucuucuuccugaaga

SEQ ID NO: 14374 - RNA, 22 nt, Human
ucggcauuuguuucuuucucug

SEQ ID NO: 14375 - RNA, 27 nt, Human
agcugguggggagggucccggccggug

SEQ ID NO: 14376 - RNA, 21 nt, Human
gcuccgaguuccccuccuggg

SEQ ID NO: 14377 - RNA, 21 nt, Human
uggggaaacagaggcccaggg

SEQ ID NO: 14378 - RNA, 27 nt, Human
gcucuguggcccaggcuggagugcagu

SEQ ID NO: 14379 - RNA, 22 nt, Human
aucauuuauaccagacauuaug

SEQ ID NO: 14380 - RNA, 21 nt, Human
cgccuguaauccagcacuuug

SEQ ID NO: 14381 - RNA, 27 nt, Human
gaguuugcagauggggcugcucggcgg

SEQ ID NO: 14382 - RNA, 17 nt, Human
ucucccaccaccuaccc

SEQ ID NO: 14383 - RNA, 21 nt, Human
cauaagauauugaaccagcaa

SEQ ID NO: 14384 - RNA, 28 nt, Human
cuacucauauuccucucaguccuucuug

SEQ ID NO: 14385 - RNA, 22 nt, Human
uuuccuuacagaacuacuucuu

SEQ ID NO: 14386 - RNA, 27 nt, Human
ccugcagcuccaccaugaggcuucucg

SEQ ID NO: 14387 - RNA, 22 nt, Human
gcuuucugcuccugacguguug

SEQ ID NO: 14388 - RNA, 24 nt, Human
guuccugcucuaccuuacccacag

SEQ ID NO: 14389 - RNA, 26 nt, Human
ccaugaucccacugaccuacucuugc

SEQ ID NO: 14390 - RNA, 24 nt, Human
acuacugcaguugguggaaguucu

SEQ ID NO: 14391 - RNA, 27 nt, Human
agcagaacucuguggcuggcagccacu

SEQ ID NO: 14392 - RNA, 21 nt, Human
guggggcugccucaguccugu

SEQ ID NO: 14393 - RNA, 28 nt, Human
ccagcaggcucucaggccagcugcuugg

SEQ ID NO: 14394 - RNA, 21 nt, Human
ugucaugcugggaagugccua

SEQ ID NO: 14395 - RNA, 19 nt, Human
cauuccugccuuuaagcca

SEQ ID NO: 14396 - RNA, 25 nt, Human
uagccuccuguagguauuugcccau

SEQ ID NO: 14397 - RNA, 25 nt, Human
ccauacagauaucagagcagacgga

SEQ ID NO: 14398 - RNA, 27 nt, Human
cucuaaaacaugaacuuuuccuagaga

SEQ ID NO: 14399 - RNA, 21 nt, Human
ucaugaacugcagcugcagga

SEQ ID NO: 14400 - RNA, 21 nt, Human
gccagagcccaccucuccucc

SEQ ID NO: 14401 - RNA, 21 nt, Human
ucugggguuucaauuccucag

SEQ ID NO: 14402 - RNA, 25 nt, Human
guugccuacucugcugucuggguga

SEQ ID NO: 14403 - RNA, 32 nt, Human
gguggacuuugaggacaacuaccaguuugcua

SEQ ID NO: 14404 - RNA, 26 nt, Human
accccuuccacaaauuacguuacuca

SEQ ID NO: 14405 - RNA, 22 nt, Human
agaccagccugggcaacacggu

SEQ ID NO: 14406 - RNA, 18 nt, Human
gaaacacuuucucacuua

SEQ ID NO: 14407 - RNA, 21 nt, Human
ugucauggaauagaaugcugu

SEQ ID NO: 14408 - RNA, 22 nt, Human
ccuguaaucccagcuacugggg

SEQ ID NO: 14409 - RNA, 26 nt, Human
agauugccucuucuaggcaguugcuc

SEQ ID NO: 14410 - RNA, 26 nt, Human
cugccucugagagaccugcuacaagc

SEQ ID NO: 14411 - RNA, 21 nt, Human
cgugagccaccacagcuggcu

SEQ ID NO: 14412 - RNA, 24 nt, Human
cuccccucagccuccugaguagcu

SEQ ID NO: 14413 - RNA, 24 nt, Human
acugccuguuccccacugccugug

SEQ ID NO: 14414 - RNA, 22 nt, Human
accagcccagccaacaugguga

SEQ ID NO: 14415 - RNA, 25 nt, Human
uuagucacaaaauauauuuuguuua

SEQ ID NO: 14416 - RNA, 18 nt, Human
gugcacuaggaagugaau

SEQ ID NO: 14417 - RNA, 25 nt, Human
gggcucaagcgauccucccaccuca

SEQ ID NO: 14418 - RNA, 18 nt, Human
ggggugaggccgggcugu

SEQ ID NO: 14419 - RNA, 27 nt, Human
accgcaaccuccaccuuccugguucaa

SEQ ID NO: 14420 - RNA, 23 nt, Human
uuccuucucucaauaugcuuaca

SEQ ID NO: 14421 - RNA, 21 nt, Human
acccugugaucagaaccucca

SEQ ID NO: 14422 - RNA, 27 nt, Human
guagggaggaagagggugccggggaag

SEQ ID NO: 14423 - RNA, 22 nt, Human
cagacagaucaccugaggucag

SEQ ID NO: 14424 - RNA, 20 nt, Human
auggauaguacguguguaca

SEQ ID NO: 14425 - RNA, 25 nt, Human
gcgagugagcgagcggaggagcagc

SEQ ID NO: 14426 - RNA, 28 nt, Human
gcuugagaugaagggaagacucuuacca

SEQ ID NO: 14427 - RNA, 21 nt, Human
uagggacaauaaguugaaaua

SEQ ID NO: 14428 - RNA, 26 nt, Human
uuucuauucauuccucaggcacuuga

SEQ ID NO: 14429 - RNA, 20 nt, Human
ccucccaccagcugagaaug

SEQ ID NO: 14430 - RNA, 22 nt, Human
uauuuuaaaaugugauuuucua

SEQ ID NO: 14431 - RNA, 22 nt, Human
aagauuugcaaagguugggucu

SEQ ID NO: 14432 - RNA, 20 nt, Human
acuuugagcugcuguuacuc

SEQ ID NO: 14433 - RNA, 23 nt, Human
ucuggcacaaaaccuccuccucc

SEQ ID NO: 14434 - RNA, 27 nt, Human
uccugcacugcuccuuuccaaacacug

SEQ ID NO: 14435 - RNA, 22 nt, Human
ucaggucucuagaugucuaggg

SEQ ID NO: 14436 - RNA, 19 nt, Human
uggaagcuuuuugaagagc

SEQ ID NO: 14437 - RNA, 22 nt, Human
acgcacaggcuggagugcagug

SEQ ID NO: 14438 - RNA, 20 nt, Human
caacaaaaaacuuaagcuuu

SEQ ID NO: 14439 - RNA, 23 nt, Human
ccuccuccaccccagccugcugc

SEQ ID NO: 14440 - RNA, 19 nt, Human
augucguuuugacacugcc

SEQ ID NO: 14441 - RNA, 23 nt, Human
gagagagcuuucccugugauuau

SEQ ID NO: 14442 - RNA, 23 nt, Human
auguaacauuguagaagcagcau

SEQ ID NO: 14443 - RNA, 25 nt, Human
uuucugcuggugacuucugaccaua

SEQ ID NO: 14444 - RNA, 25 nt, Human
cugcagcuccuugucgacaucaucc

SEQ ID NO: 14445 - RNA, 19 nt, Human
gugaaggacaggaaggggc

SEQ ID NO: 14446 - RNA, 21 nt, Human
cagugcugggauuaccggcgu

SEQ ID NO: 14447 - RNA, 17 nt, Human
uuaaggacaaaaaugaa

SEQ ID NO: 14448 - RNA, 23 nt, Human
gcucguaaaauguucucauucca

SEQ ID NO: 14449 - RNA, 22 nt, Human
uaagugcugggauuauaggcgu

SEQ ID NO: 14450 - RNA, 22 nt, Human
guaaccucugucuuggcagggc

SEQ ID NO: 14451 - RNA, 23 nt, Human
uauaccaagcagguuucuggguu

SEQ ID NO: 14452 - RNA, 19 nt, Human
aaugucccaccuuggagcu

SEQ ID NO: 14453 - RNA, 25 nt, Human
ucacaugcaagacacauacagcccu

SEQ ID NO: 14454 - RNA, 27 nt, Human
gcaccuugcacuagaggcuucugacuc

SEQ ID NO: 14455 - RNA, 20 nt, Human
ucugggucuccucuggagca

SEQ ID NO: 14456 - RNA, 21 nt, Human
acuuggaguuguguacuccaa

SEQ ID NO: 14457 - RNA, 22 nt, Human
gccagccuggccaacaugguga

SEQ ID NO: 14458 - RNA, 20 nt, Human
gauuaguuuuaguuuuuugu

SEQ ID NO: 14459 - RNA, 22 nt, Human
agccugaggcaggagaauggca

SEQ ID NO: 14460 - RNA, 21 nt, Human
aaucuuuguuaugaucauguc

SEQ ID NO: 14461 - RNA, 24 nt, Human
ugacuucccaggaauuuucugucu

SEQ ID NO: 14462 - RNA, 22 nt, Human
gggaaucggagacuuugcaacc

SEQ ID NO: 14463 - RNA, 20 nt, Human
ggcucuaguuuccugguuug

SEQ ID NO: 14464 - RNA, 24 nt, Human
uugggaugucaucuuccuggaagc

SEQ ID NO: 14465 - RNA, 22 nt, Human
agccaggcugggccgcaagggc

SEQ ID NO: 14466 - RNA, 24 nt, Human
guugggagcuugggcaggccagcu

SEQ ID NO: 14467 - RNA, 21 nt, Human
ucaugacauuauguggaaucc

SEQ ID NO: 14468 - RNA, 21 nt, Human
gggaggaggaggcugggaucc

SEQ ID NO: 14469 - RNA, 24 nt, Human
ucuacuuccccaaaucacugugga

SEQ ID NO: 14470 - RNA, 22 nt, Human
acagaaggaaagaggaggaguu

SEQ ID NO: 14471 - RNA, 22 nt, Human
cugacucucuccuggugcucaa

SEQ ID NO: 14472 - RNA, 22 nt, Human
uucuggguugcuuguuuuuuag

SEQ ID NO: 14473 - RNA, 30 nt, Human
cgucuaucuggccccuccucccggcuggac

SEQ ID NO: 14474 - RNA, 19 nt, Human
cuccugccuccaccugggg

SEQ ID NO: 14475 - RNA, 24 nt, Human
agaagcagccgagacgccacuugg

SEQ ID NO: 14476 - RNA, 22 nt, Human
ggggaaagagaaaucacugaca

SEQ ID NO: 14477 - RNA, 21 nt, Human
auccugauuuauauugcagug

SEQ ID NO: 14478 - RNA, 20 nt, Human
uggccaucuucuuucuucca

SEQ ID NO: 14479 - RNA, 27 nt, Human
ucucuucccacuugcugacccuuugcu

SEQ ID NO: 14480 - RNA, 23 nt, Human
cccucaugcugggcucuggacca

SEQ ID NO: 14481 - RNA, 26 nt, Human
accagccuggccaacaugcugaaacc

SEQ ID NO: 14482 - RNA, 24 nt, Human
agucagggcgacuuccacagcagc

SEQ ID NO: 14483 - RNA, 21 nt, Human
acugccucuuuccuguuguug

SEQ ID NO: 14484 - RNA, 27 nt, Human
ccugugcacacacccccucagcacucc

SEQ ID NO: 14485 - RNA, 23 nt, Human
cagccuguguccacagugcugug

SEQ ID NO: 14486 - RNA, 22 nt, Human
agcagcagguggacaugcaggu

SEQ ID NO: 14487 - RNA, 21 nt, Human
aggacagcauuucauauguaa

SEQ ID NO: 14488 - RNA, 25 nt, Human
gacgaugcagccgcuuuucuuuuug

SEQ ID NO: 14489 - RNA, 17 nt, Human
gaaagagaaaucuguga

SEQ ID NO: 14490 - RNA, 27 nt, Human
cugggaggcugggcccuggaggcaacg

SEQ ID NO: 14491 - RNA, 24 nt, Human
ucucauucaaauggagacgcccuc

SEQ ID NO: 14492 - RNA, 20 nt, Human
cgggcacaguccccucugcc

SEQ ID NO: 14493 - RNA, 19 nt, Human
gaaaacacugaaaauugaa

SEQ ID NO: 14494 - RNA, 21 nt, Human
ggccauggaggcaguaggaca

SEQ ID NO: 14495 - RNA, 29 nt, Human
uauccacaauucaaaagcaccuaaaaaga

SEQ ID NO: 14496 - RNA, 19 nt, Human
cacccucagccuaagggag

SEQ ID NO: 14497 - RNA, 21 nt, Human
cacugcccucucugugccuug

SEQ ID NO: 14498 - RNA, 20 nt, Human
gcagaaacaauaaaaccacu

SEQ ID NO: 14499 - RNA, 17 nt, Human
cucuccuuaccuaguua

SEQ ID NO: 14500 - RNA, 22 nt, Human
uccuguggucugccucaguuuc

SEQ ID NO: 14501 - RNA, 27 nt, Human
gccucucuaccauacaguauuucaucc

SEQ ID NO: 14502 - RNA, 25 nt, Human
ggcgagggagaugagagacggcggc

SEQ ID NO: 14503 - RNA, 22 nt, Human
caccauggacagcucccauuaa

SEQ ID NO: 14504 - RNA, 23 nt, Human
aggcuggagugcagugagcuauu

SEQ ID NO: 14505 - RNA, 24 nt, Human
cacagcccuaaauccaugauaaag

SEQ ID NO: 14506 - RNA, 22 nt, Human
ccuaaagugcugggauuacagg

SEQ ID NO: 14507 - RNA, 22 nt, Human
ugagcacgggccuggcuggcac

SEQ ID NO: 14508 - RNA, 21 nt, Human
uggcaccccccuagacuuugc

SEQ ID NO: 14509 - RNA, 20 nt, Human
ggcccuccagccagccuucu

SEQ ID NO: 14510 - RNA, 21 nt, Human
uuguuucuuugcuuucuacau

SEQ ID NO: 14511 - RNA, 22 nt, Human
cagagucuggcucugucaccca

SEQ ID NO: 14512 - RNA, 23 nt, Human
auauuucuucauuuucuuuugga

SEQ ID NO: 14513 - RNA, 21 nt, Human
cagaggcugagaauugcuuga

SEQ ID NO: 14514 - RNA, 26 nt, Human
gggaagagaagggaagccucuucagg

SEQ ID NO: 14515 - RNA, 22 nt, Human
ccacugcaccuggccuuauaaa

SEQ ID NO: 14516 - RNA, 21 nt, Human
auugcacuccagccugggcga

SEQ ID NO: 14517 - RNA, 21 nt, Human
aucgcacuccagccuggguga

SEQ ID NO: 14518 - RNA, 22 nt, Human
cugcccgggugguuugggggug

SEQ ID NO: 14519 - RNA, 20 nt, Human
aucucaguaugaaggacaca

SEQ ID NO: 14520 - RNA, 25 nt, Human
ugccccaucuauuuaugucuccgcu

SEQ ID NO: 14521 - RNA, 29 nt, Human
ccaaguucauuaccucccuaucaguucua

SEQ ID NO: 14522 - RNA, 27 nt, Human
cugccugcugugccuaaccacagccau

SEQ ID NO: 14523 - RNA, 19 nt, Human
aaaugagagaagagccgga

SEQ ID NO: 14524 - RNA, 26 nt, Human
uugucuaauuaucaauauugaggauc

SEQ ID NO: 14525 - RNA, 27 nt, Human
agaaauucucugaaaguuucuucccuu

SEQ ID NO: 14526 - RNA, 18 nt, Human
aucauaaaugcauucaua

SEQ ID NO: 14527 - RNA, 23 nt, Human
uuuuaggcuccuuuuuugaccca

SEQ ID NO: 14528 - RNA, 18 nt, Human
gguacuuccuccuucuga

SEQ ID NO: 14529 - RNA, 21 nt, Human
guauuguugcagcaucuggca

SEQ ID NO: 14530 - RNA, 21 nt, Human
ugagcugagaucacaccacug

SEQ ID NO: 14531 - RNA, 24 nt, Human
cccaggaggccaaacggugcaaca

SEQ ID NO: 14532 - RNA, 21 nt, Human
gccuuaauguauuugauguau

SEQ ID NO: 14533 - RNA, 22 nt, Human
ccuuaucucccuucacugacuc

SEQ ID NO: 14534 - RNA, 27 nt, Human
ccaagcccuaagccuguccccagacca

SEQ ID NO: 14535 - RNA, 21 nt, Human
acgaauguuaaaacauuucag

SEQ ID NO: 14536 - RNA, 27 nt, Human
gccuuuccaccugcuuucuccugggcc

SEQ ID NO: 14537 - RNA, 26 nt, Human
cugcaaggauuuuuuaaaaauuggca

SEQ ID NO: 14538 - RNA, 22 nt, Human
acuuuuguggugagaacacuua

SEQ ID NO: 14539 - RNA, 19 nt, Human
auggccuuuuaaacaagac

SEQ ID NO: 14540 - RNA, 20 nt, Human
cuaauggaagaaaucugcug

SEQ ID NO: 14541 - RNA, 18 nt, Human
cuucagaaaugugucaca

SEQ ID NO: 14542 - RNA, 20 nt, Human
gccucuauuuuucuuguuug

SEQ ID NO: 14543 - RNA, 20 nt, Human
cacccaggcugcaguguagu

SEQ ID NO: 14544 - RNA, 20 nt, Human
uccuguagugagcacuuugu

SEQ ID NO: 14545 - RNA, 27 nt, Human
ggcucacaccuguaauuccagcacuuu

SEQ ID NO: 14546 - RNA, 24 nt, Human
ccuuaggacucugaaggguaugga

SEQ ID NO: 14547 - RNA, 27 nt, Human
acauggagaaagagcgagagacucugc

SEQ ID NO: 14548 - RNA, 24 nt, Human
ugcuuggaguucuuuuugccucag

SEQ ID NO: 14549 - RNA, 20 nt, Human
uucuauagauaagaucaugu

SEQ ID NO: 14550 - RNA, 18 nt, Human
uaucagaaggaaaaagag

SEQ ID NO: 14551 - RNA, 27 nt, Human
cauuuagugccagccuaggcacaacuu

SEQ ID NO: 14552 - RNA, 20 nt, Human
caguguuggauugcagagac

SEQ ID NO: 14553 - RNA, 22 nt, Human
aacgcuccucaccuagccccug

SEQ ID NO: 14554 - RNA, 23 nt, Human
auggagagaaaacauuuugagga

SEQ ID NO: 14555 - RNA, 21 nt, Human
cuccccagaagccagccuuuc

SEQ ID NO: 14556 - RNA, 23 nt, Human
aaacaaaaagggaaacucacuug

SEQ ID NO: 14557 - RNA, 19 nt, Human
caaacagauuucauagcca

SEQ ID NO: 14558 - RNA, 27 nt, Human
ccuuggaugagacucaggcugauacac

SEQ ID NO: 14559 - RNA, 17 nt, Human
auuuuucuuagcaccuu

SEQ ID NO: 14560 - RNA, 22 nt, Human
agggcagucuuucucaaacuau

SEQ ID NO: 14561 - RNA, 23 nt, Human
cagacaaagccgcgagcccaggg

SEQ ID NO: 14562 - RNA, 20 nt, Human
uccuggcuccaacacugcug

SEQ ID NO: 14563 - RNA, 21 nt, Human
cauuuuccaccagucuguccc

SEQ ID NO: 14564 - RNA, 22 nt, Human
auggaaaggcguaaauaacagc

SEQ ID NO: 14565 - RNA, 19 nt, Human
acauauuuaacuggugcac

SEQ ID NO: 14566 - RNA, 22 nt, Human
aaucucacucucucgcccaggc

SEQ ID NO: 14567 - RNA, 21 nt, Human
aguguuggaauuuggaggcag

SEQ ID NO: 14568 - RNA, 20 nt, Human
aacauguuuuucuucucccu

SEQ ID NO: 14569 - RNA, 27 nt, Human
uuuugggccgagcuggaggcggcgggg

SEQ ID NO: 14570 - RNA, 22 nt, Human
ugaccucccaggcucaagcgau

SEQ ID NO: 14571 - RNA, 22 nt, Human
cgaacuccuagccucaagcaau

SEQ ID NO: 14572 - RNA, 21 nt, Human
gcaaucaguaaaacauugagc

SEQ ID NO: 14573 - RNA, 27 nt, Human
aucagcuguuuaaucuauuugggaaau

SEQ ID NO: 14574 - RNA, 21 nt, Human
gucuugaagcagcugcccuca

SEQ ID NO: 14575 - RNA, 26 nt, Human
ugccaacucacaggugcuuuuaggcu

SEQ ID NO: 14576 - RNA, 22 nt, Human
ugcugggacccucggggcagga

SEQ ID NO: 14577 - RNA, 20 nt, Human
cccauccauagcuuaccuca

SEQ ID NO: 14578 - RNA, 27 nt, Human
ggcaacuugguuugggagaugaugccu

SEQ ID NO: 14579 - RNA, 23 nt, Human
ugccuguaaucucagcuacucag

SEQ ID NO: 14580 - RNA, 28 nt, Human
gcagagucuaccuugaaaccaauuaagc

SEQ ID NO: 14581 - RNA, 26 nt, Human
ggucauguaguaaugacuuuguuaua

SEQ ID NO: 14582 - RNA, 25 nt, Human
gggaugcuccagaccuuguaugauu

SEQ ID NO: 14583 - RNA, 25 nt, Human
ggcacagaccuucaugauaucacac

SEQ ID NO: 14584 - RNA, 27 nt, Human
ugcuuggggaauguuguuuucugacua

SEQ ID NO: 14585 - RNA, 23 nt, Human
gaaggcaagagaaacauucuuuc

SEQ ID NO: 14586 - RNA, 18 nt, Human
cuggggaaaacuccaccu

SEQ ID NO: 14587 - RNA, 20 nt, Human
ucuugaagccacacauggcu

SEQ ID NO: 14588 - RNA, 20 nt, Human
gcaagccucagacuccaggc

SEQ ID NO: 14589 - RNA, 21 nt, Human
uuacaguguccuaccacucua

SEQ ID NO: 14590 - RNA, 24 nt, Human
gguagcagcaggcucaggcacaua

SEQ ID NO: 14591 - RNA, 28 nt, Human
ugccauggacacagacucucagcguucu

SEQ ID NO: 14592 - RNA, 24 nt, Human
guguggaguccuguccugccucag

SEQ ID NO: 14593 - RNA, 24 nt, Human
ccagccugggcaacaugaugugaa

SEQ ID NO: 14594 - RNA, 26 nt, Human
cccaggcagaucucagacuccugggc

SEQ ID NO: 14595 - RNA, 21 nt, Human
ggggcuagacucccucaggag

SEQ ID NO: 14596 - RNA, 27 nt, Human
cugggcuuaagcaauccuccugccucu

SEQ ID NO: 14597 - RNA, 19 nt, Human
ugggauccccuugcccaag

SEQ ID NO: 14598 - RNA, 20 nt, Human
caggggaauguauuuuucaa

SEQ ID NO: 14599 - RNA, 26 nt, Human
uugccucucuccccuuggcgucugau

SEQ ID NO: 14600 - RNA, 22 nt, Human
cucaccgcacaacucucuuuca

SEQ ID NO: 14601 - RNA, 27 nt, Human
cacugggccaagugcaguggaucaugu

SEQ ID NO: 14602 - RNA, 24 nt, Human
gcuccugugagugcuuggguguuc

SEQ ID NO: 14603 - RNA, 31 nt, Human
aggugccggcuccucacacaccauggagacu

SEQ ID NO: 14604 - RNA, 25 nt, Human
ccaaacccacccauaccagcuagaa

SEQ ID NO: 14605 - RNA, 23 nt, Human
ccagccaggcagagguuuuaaug

SEQ ID NO: 14606 - RNA, 23 nt, Human
ccugugauuucuccucugggcca

SEQ ID NO: 14607 - RNA, 21 nt, Human
ggccucacuuugucucuggca

SEQ ID NO: 14608 - RNA, 23 nt, Human
ggcuggcucgagccuggggucca

SEQ ID NO: 14609 - RNA, 27 nt, Human
ucccccgucuucucucccgcagcugcc

SEQ ID NO: 14610 - RNA, 22 nt, Human
aucaggcuuguguuaaggcaau

SEQ ID NO: 14611 - RNA, 21 nt, Human
ggcaggagaucccuucaagag

SEQ ID NO: 14612 - RNA, 27 nt, Human
cacccacacucugggccuguggcacca

SEQ ID NO: 14613 - RNA, 22 nt, Human
caagauugcucuacagacucag

SEQ ID NO: 14614 - RNA, 27 nt, Human
agaagguaaaauggaagggcugcuaau

SEQ ID NO: 14615 - RNA, 23 nt, Human
ggagagaagggggacguuucugg

SEQ ID NO: 14616 - RNA, 24 nt, Human
acugucgccacacgccucugcaua

SEQ ID NO: 14617 - RNA, 24 nt, Human
gguagaggccucacagcccuugag

SEQ ID NO: 14618 - RNA, 25 nt, Human
caggaaacagaagcccaggcacaau

SEQ ID NO: 14619 - RNA, 24 nt, Human
uuauuccuuacagcuuccuuguaa

SEQ ID NO: 14620 - RNA, 20 nt, Human
ccagaagccggcggcagugg

SEQ ID NO: 14621 - RNA, 21 nt, Human
aucucaguuuaaaugguaaag

SEQ ID NO: 14622 - RNA, 22 nt, Human
acuagauucucaccugccuuca

SEQ ID NO: 14623 - RNA, 22 nt, Human
cggcauugcacuucagccuggg

SEQ ID NO: 14624 - RNA, 24 nt, Human
guagaauugggaagcugggggaag

SEQ ID NO: 14625 - RNA, 26 nt, Human
ggacuugcauguccuaaagcacuggc

SEQ ID NO: 14626 - RNA, 20 nt, Human
acgcugguagagauggagga

SEQ ID NO: 14627 - RNA, 19 nt, Human
aggguccagcguucgagga

SEQ ID NO: 14628 - RNA, 24 nt, Human
ucauagaaauuguguuugcuaaca

SEQ ID NO: 14629 - RNA, 23 nt, Human
agauaacaaaacauguucagcuu

SEQ ID NO: 14630 - RNA, 18 nt, Human
ucuguaccuucuuugcua

SEQ ID NO: 14631 - RNA, 23 nt, Human
cagauguucuguuuuuauaaccu

SEQ ID NO: 14632 - RNA, 24 nt, Human
ugcaccuccgcgggcugacugggc

SEQ ID NO: 14633 - RNA, 21 nt, Human
gacucuuagcaaccucauuuc

SEQ ID NO: 14634 - RNA, 22 nt, Human
gcacacacagcucgcuucuuca

SEQ ID NO: 14635 - RNA, 22 nt, Human
uguugccaggcuagagugcagu

SEQ ID NO: 14636 - RNA, 22 nt, Human
ugucauccuuacaaaccacagc

SEQ ID NO: 14637 - RNA, 21 nt, Human
caccccacugguucugaggcc

SEQ ID NO: 14638 - RNA, 27 nt, Human
caggcuggagugcaauggcaguuguuu

SEQ ID NO: 14639 - RNA, 23 nt, Human
cacacuagccucuguguucccgu

SEQ ID NO: 14640 - RNA, 24 nt, Human
uuccccacucacugcagagcugcu

SEQ ID NO: 14641 - RNA, 22 nt, Human
gacuacgagaucagauuuugga

SEQ ID NO: 14642 - RNA, 22 nt, Human
aucuggggaacuuggcauucaa

SEQ ID NO: 14643 - RNA, 23 nt, Human
cucugccaguguuugggugggug

SEQ ID NO: 14644 - RNA, 21 nt, Human
accaagccucagcuuccucgc

SEQ ID NO: 14645 - RNA, 20 nt, Human
acauugugccuuucucuaga

SEQ ID NO: 14646 - RNA, 22 nt, Human
cacugcuggacuggagcugggc

SEQ ID NO: 14647 - RNA, 21 nt, Human
aacuguuuucauuuaagggaa

SEQ ID NO: 14648 - RNA, 27 nt, Human
ccugcuguauuuauuuauuuucuuuug

SEQ ID NO: 14649 - RNA, 27 nt, Human
cugcuucugauuccacaaggggcuuuu

SEQ ID NO: 14650 - RNA, 22 nt, Human
guucugacacacaggaucccag

SEQ ID NO: 14651 - RNA, 23 nt, Human
aacacacacaugcuucccuuucc

SEQ ID NO: 14652 - RNA, 27 nt, Human
ucugucccucucugcuuucucuguagg

SEQ ID NO: 14653 - RNA, 27 nt, Human
auggguucugugaccacugcuggacca

SEQ ID NO: 14654 - RNA, 22 nt, Human
gggauuuucacagugugcucca

SEQ ID NO: 14655 - RNA, 21 nt, Human
cucuccucucugcuucauaac

SEQ ID NO: 14656 - RNA, 21 nt, Human
ccgugagucuccaggucucca

SEQ ID NO: 14657 - RNA, 25 nt, Human
agcaggagaacgagaaggcugccug

SEQ ID NO: 14658 - RNA, 27 nt, Human
uucucucuccaucuaccuuccagucag

SEQ ID NO: 14659 - RNA, 19 nt, Human
ggacuucucucuucgggag

SEQ ID NO: 14660 - RNA, 19 nt, Human
gcggcuggccagaggauga

SEQ ID NO: 14661 - RNA, 25 nt, Human
uucauaaugccucugccgugcggaa

SEQ ID NO: 14662 - RNA, 21 nt, Human
accagaccuguucugaccuca

SEQ ID NO: 14663 - RNA, 20 nt, Human
caccauggcuccuacauugg

SEQ ID NO: 14664 - RNA, 20 nt, Human
gugugggaaaaacuugaucu

SEQ ID NO: 14665 - RNA, 21 nt, Human
uuuuucuccccgugcuccccc

SEQ ID NO: 14666 - RNA, 22 nt, Human
ggaaucuugccuuucccuuuca

SEQ ID NO: 14667 - RNA, 23 nt, Human
acuaaugcugcccucacugccuc

SEQ ID NO: 14668 - RNA, 21 nt, Human
uuugacucugggaaucaugcu

SEQ ID NO: 14669 - RNA, 26 nt, Human
ugagccaacaucacaccauugcacuc

SEQ ID NO: 14670 - RNA, 23 nt, Human
augaaugaucacuagaacacaaa

SEQ ID NO: 14671 - RNA, 21 nt, Human
cugcagcuccugucacaagcu

SEQ ID NO: 14672 - RNA, 25 nt, Human
uucuaguauuaauaggcuuuugcuu

SEQ ID NO: 14673 - RNA, 23 nt, Human
uucuucauauaguaaaaggcaaa

SEQ ID NO: 14674 - RNA, 17 nt, Human
cuggucccuaccugggc

SEQ ID NO: 14675 - RNA, 21 nt, Human
gcggggccaggauggcguguc

SEQ ID NO: 14676 - RNA, 21 nt, Human
ccaagccccuugccaagggag

SEQ ID NO: 14677 - RNA, 22 nt, Human
uuaagaaugaaugauuuuugca

SEQ ID NO: 14678 - RNA, 23 nt, Human
gagaaggaguugcagcggcggcu

SEQ ID NO: 14679 - RNA, 26 nt, Human
gccacaucaugagcugaggugggacc

SEQ ID NO: 14680 - RNA, 22 nt, Human
gccuaggcuggaggacaguggc

SEQ ID NO: 14681 - RNA, 26 nt, Human
acugcugcauuuccugucuuccuucc

SEQ ID NO: 14682 - RNA, 24 nt, Human
augcccccgugaccugccugcugu

SEQ ID NO: 14683 - RNA, 20 nt, Human
aacggacauuuaucacugga

SEQ ID NO: 14684 - RNA, 24 nt, Human
gaaugguugccacuguuauuagau

SEQ ID NO: 14685 - RNA, 24 nt, Human
ugaaaccaaaauauauuugcuuca

SEQ ID NO: 14686 - RNA, 21 nt, Human
gcuuccaagcugauguuugua

SEQ ID NO: 14687 - RNA, 24 nt, Human
aucccagcgcuuugggaggcagag

SEQ ID NO: 14688 - RNA, 22 nt, Human
ugcccaggcuggagugcaacgg

SEQ ID NO: 14689 - RNA, 19 nt, Human
uccuagagugaggcucugu

SEQ ID NO: 14690 - RNA, 22 nt, Human
gcugcaacgccggugccugagg

SEQ ID NO: 14691 - RNA, 26 nt, Human
cgcgggucugucaucaugucgcguua

SEQ ID NO: 14692 - RNA, 24 nt, Human
ccuucuucuacagaagacacaccu

SEQ ID NO: 14693 - RNA, 23 nt, Human
cgcuaggcucccagccuccuucc

SEQ ID NO: 14694 - RNA, 20 nt, Human
agcagacugguuugcaguga

SEQ ID NO: 14695 - RNA, 23 nt, Human
uauauacuauacaacaauguucu

SEQ ID NO: 14696 - RNA, 21 nt, Human
caauguaaugcauaggaagua

SEQ ID NO: 14697 - RNA, 21 nt, Human
aagaauugacuggggcaauaa

SEQ ID NO: 14698 - RNA, 16 nt, Human
cuguccuuuuaacacc

SEQ ID NO: 14699 - RNA, 22 nt, Human
cuaggcaccuuugugagaaaga

SEQ ID NO: 14700 - RNA, 20 nt, Human
uccuccuuccuccccggauu

SEQ ID NO: 14701 - RNA, 21 nt, Human
gcccccagccccuccucccuc

SEQ ID NO: 14702 - RNA, 22 nt, Human
aaaagagaaagcuuuauaaccu

SEQ ID NO: 14703 - RNA, 22 nt, Human
cccaaaguauugggauuacccg

SEQ ID NO: 14704 - RNA, 26 nt, Human
gaccaaaaaacuacaccaguagguug

SEQ ID NO: 14705 - RNA, 22 nt, Human
accuguaauccuagcacucugg

SEQ ID NO: 14706 - RNA, 21 nt, Human
uaggaaacuaauacagcugcu

SEQ ID NO: 14707 - RNA, 23 nt, Human
augagacagaauguauuuuguug

SEQ ID NO: 14708 - RNA, 19 nt, Human
ugcccaggcuguucuugaa

SEQ ID NO: 14709 - RNA, 26 nt, Human
aacaaaaauuacagacuuuggugaac

SEQ ID NO: 14710 - RNA, 27 nt, Human
ucaugagaguggaggccugccacccag

SEQ ID NO: 14711 - RNA, 21 nt, Human
aggcgacagaugccuccuggg

SEQ ID NO: 14712 - RNA, 20 nt, Human
ccugccuguccuccagcugu

SEQ ID NO: 14713 - RNA, 21 nt, Human
cccagcuccacauccuccucc

SEQ ID NO: 14714 - RNA, 22 nt, Human
ugacaguaucauguguauuuau

SEQ ID NO: 14715 - RNA, 31 nt, Human
uccuguggaugcuccuggaaugucccugacc

SEQ ID NO: 14716 - RNA, 25 nt, Human
acucacaacauucacuauguuugca

SEQ ID NO: 14717 - RNA, 26 nt, Human
ucugcuccucuuguuccugaaaugug

SEQ ID NO: 14718 - RNA, 20 nt, Human
ucuacauaaaugaaaucaua

SEQ ID NO: 14719 - RNA, 22 nt, Human
aucuguacagcacuuuuuacau

SEQ ID NO: 14720 - RNA, 21 nt, Human
ucaacuuggaaaggaaacaaa

SEQ ID NO: 14721 - RNA, 19 nt, Human
gcuccaauuauauuuuuaa

SEQ ID NO: 14722 - RNA, 17 nt, Human
cugccaccaucagggac

SEQ ID NO: 14723 - RNA, 23 nt, Human
ccaucucacagauucacugugug

SEQ ID NO: 14724 - RNA, 20 nt, Human
guugcuucucuuugcuauuc

SEQ ID NO: 14725 - RNA, 24 nt, Human
ggaggcaccuggguccaucagaga

SEQ ID NO: 14726 - RNA, 22 nt, Human
cucaggucccugcagggccaag

SEQ ID NO: 14727 - RNA, 18 nt, Human
gcacagcccgcuggcccc

SEQ ID NO: 14728 - RNA, 25 nt, Human
uuuaccuucauuucauccuguuggc

SEQ ID NO: 14729 - RNA, 23 nt, Human
acaucauguuuggcugggcaucg

SEQ ID NO: 14730 - RNA, 27 nt, Human
aggaagagcuauaagcacuaagugcgu

SEQ ID NO: 14731 - RNA, 22 nt, Human
agcccggggcaugaucugaucc

SEQ ID NO: 14732 - RNA, 22 nt, Human
ccagcccaggccugguggaggg

SEQ ID NO: 14733 - RNA, 23 nt, Human
ccacagaucaaauacuucaagag

SEQ ID NO: 14734 - RNA, 22 nt, Human
ggcccgcaucccacccucccgg

SEQ ID NO: 14735 - RNA, 24 nt, Human
cucuccuccccuagaugccaugcu

SEQ ID NO: 14736 - RNA, 23 nt, Human
uuaagcuggugcacagggacauc

SEQ ID NO: 14737 - RNA, 21 nt, Human
gucuuaaaagucugcauuuuc

SEQ ID NO: 14738 - RNA, 22 nt, Human
uguuacccaggguggauugcag

SEQ ID NO: 14739 - RNA, 23 nt, Human
uggccucugggcaguguggccuc

SEQ ID NO: 14740 - RNA, 23 nt, Human
aauucugcucacuuccucauucc

SEQ ID NO: 14741 - RNA, 27 nt, Human
cccuccaguguccccggagcugaaaga

SEQ ID NO: 14742 - RNA, 23 nt, Human
uuaccuuuaguuuaccuaaacuu

SEQ ID NO: 14743 - RNA, 26 nt, Human
cacaccugcacugcugugcugugccc

SEQ ID NO: 14744 - RNA, 27 nt, Human
ggagcaucucugcucuaccccugcccc

SEQ ID NO: 14745 - RNA, 24 nt, Human
agaaguuaaauugaggcuuaauga

SEQ ID NO: 14746 - RNA, 18 nt, Human
uuacaucuuuguuuacca

SEQ ID NO: 14747 - RNA, 24 nt, Human
agauauuucuuauggcacaaaaaa

SEQ ID NO: 14748 - RNA, 22 nt, Human
guccucuuggcucugagaggga

SEQ ID NO: 14749 - RNA, 21 nt, Human
ugaacuagaagcuguguuaga

SEQ ID NO: 14750 - RNA, 27 nt, Human
ucuuagcagccucuucccuagggccuu

SEQ ID NO: 14751 - RNA, 23 nt, Human
aaacccauucccucuccaggaga

SEQ ID NO: 14752 - RNA, 19 nt, Human
ggcuaugacccugcuuugu

SEQ ID NO: 14753 - RNA, 21 nt, Human
uccaacaaauggaguagcauc

SEQ ID NO: 14754 - RNA, 19 nt, Human
cuggaaccuuuuggagaga

SEQ ID NO: 14755 - RNA, 30 nt, Human
ucggccucaguuaagccuuuguggacucca

SEQ ID NO: 14756 - RNA, 24 nt, Human
gccugguuggccauucucaugccc

SEQ ID NO: 14757 - RNA, 31 nt, Human
gaccuaggaacuuggccaacauaugcaacau

SEQ ID NO: 14758 - RNA, 19 nt, Human
auuacuguuuacacacauu

SEQ ID NO: 14759 - RNA, 21 nt, Human
uccugcucuauuuuccugggc

SEQ ID NO: 14760 - RNA, 24 nt, Human
gggaagagagguggucuucuggca

SEQ ID NO: 14761 - RNA, 20 nt, Human
agaaggcagguggucacuga

SEQ ID NO: 14762 - RNA, 19 nt, Human
ugcuggugcugagcuguuu

SEQ ID NO: 14763 - RNA, 23 nt, Human
gcuaagcuguaaccgauaugcac

SEQ ID NO: 14764 - RNA, 20 nt, Human
ccauagcugggacuacaggc

SEQ ID NO: 14765 - RNA, 22 nt, Human
uugcccaggucucacugcuuug

SEQ ID NO: 14766 - RNA, 21 nt, Human
caggagccucuccccuccaga

SEQ ID NO: 14767 - RNA, 21 nt, Human
ugacuucugccugcgcuccuu

SEQ ID NO: 14768 - RNA, 27 nt, Human
uauugcacuccagucuggguaacaggg

SEQ ID NO: 14769 - RNA, 22 nt, Human
gaaagagauguggcuuuuguga

SEQ ID NO: 14770 - RNA, 20 nt, Human
gcuccuccuuuuuccuucca

SEQ ID NO: 14771 - RNA, 27 nt, Human
uuuaacaacagccacucaccuuuuccu

SEQ ID NO: 14772 - RNA, 21 nt, Human
ugggccccucugccuccauca

SEQ ID NO: 14773 - RNA, 21 nt, Human
acuauucuccagaaaaaucaa

SEQ ID NO: 14774 - RNA, 27 nt, Human
cuccugagccucaccuuuccugccguc

SEQ ID NO: 14775 - RNA, 21 nt, Human
uauuccuucaucuacugugaa

SEQ ID NO: 14776 - RNA, 28 nt, Human
gggagcaagggacagggagcagggcagg

SEQ ID NO: 14777 - RNA, 24 nt, Human
cuucauugaccucuacuugcugaa

SEQ ID NO: 14778 - RNA, 23 nt, Human
aucgcgccacugcacuccggccu

SEQ ID NO: 14779 - RNA, 18 nt, Human
aaaugagaacuaugugga

SEQ ID NO: 14780 - RNA, 23 nt, Human
augccauccagaugugugcaaug

SEQ ID NO: 14781 - RNA, 27 nt, Human
cugcagccccgcgccuccuuccuugcu

SEQ ID NO: 14782 - RNA, 26 nt, Human
ucuggcuuuguacuuugcagucugcc

SEQ ID NO: 14783 - RNA, 17 nt, Human
ucucugggaccuugcca

SEQ ID NO: 14784 - RNA, 22 nt, Human
uaagccgccuccauggccccag

SEQ ID NO: 14785 - RNA, 22 nt, Human
ucgagccacugcacuccugggc

SEQ ID NO: 14786 - RNA, 22 nt, Human
ggucucugcaagacuaaugacu

SEQ ID NO: 14787 - RNA, 25 nt, Human
ugcauuaccagcuuaaaacacuucu

SEQ ID NO: 14788 - RNA, 22 nt, Human
cucuuuugcaauaaaucuugcu

SEQ ID NO: 14789 - RNA, 28 nt, Human
ccuucauaaaacauguaacacugaucuu

SEQ ID NO: 14790 - RNA, 23 nt, Human
cggcccagggagcuacaaaccca

SEQ ID NO: 14791 - RNA, 21 nt, Human
ggccagagcugggaggcaugg

SEQ ID NO: 14792 - RNA, 23 nt, Human
guucacaucuggagacaucagcc

SEQ ID NO: 14793 - RNA, 22 nt, Human
ggguggaaggggaauaagaaga

SEQ ID NO: 14794 - RNA, 21 nt, Human
auacauuuaaaaauuaaucac

SEQ ID NO: 14795 - RNA, 21 nt, Human
cuacaccgggaagaaaggccc

SEQ ID NO: 14796 - RNA, 22 nt, Human
accacccuggccaacaugguga

SEQ ID NO: 14797 - RNA, 27 nt, Human
ccaacuuccuguugggugcuguggucc

SEQ ID NO: 14798 - RNA, 19 nt, Human
ugccuguaauuaaacuagu

SEQ ID NO: 14799 - RNA, 22 nt, Human
ucauuguuuucaaaugggcugu

SEQ ID NO: 14800 - RNA, 23 nt, Human
aggaccacauguguucucuauuu

SEQ ID NO: 14801 - RNA, 20 nt, Human
gcccccugccacccugcacu

SEQ ID NO: 14802 - RNA, 21 nt, Human
ccucucuggaccucaguuucc

SEQ ID NO: 14803 - RNA, 20 nt, Human
gaucuucugcucuucccacu

SEQ ID NO: 14804 - RNA, 23 nt, Human
caacaccgacgucuccaucggcc

SEQ ID NO: 14805 - RNA, 23 nt, Human
uguuggcagugagugagccuggc

SEQ ID NO: 14806 - RNA, 22 nt, Human
cugaguagcugggauuauaggu

SEQ ID NO: 14807 - RNA, 22 nt, Human
ccgaguagcugggauuacaggu

SEQ ID NO: 14808 - RNA, 23 nt, Human
cugagucuuaguagugauuauug

SEQ ID NO: 14809 - RNA, 18 nt, Human
ggcauguucaaagccaca

SEQ ID NO: 14810 - RNA, 23 nt, Human
ggguggcccagagccucugcugg

SEQ ID NO: 14811 - RNA, 27 nt, Human
agggaaaggcaucuggucugucuggaa

SEQ ID NO: 14812 - RNA, 22 nt, Human
cagcucaggaacuagacugccu

SEQ ID NO: 14813 - RNA, 23 nt, Human
uguguuuuuccuccauaaauuau

SEQ ID NO: 14814 - RNA, 21 nt, Human
ggccuggacaggggcugccag

SEQ ID NO: 14815 - RNA, 24 nt, Human
uagcugaaaaacuaaauuugcuuu

SEQ ID NO: 14816 - RNA, 28 nt, Human
ggagucagggccagggaggcauggcccc

SEQ ID NO: 14817 - RNA, 18 nt, Human
uucugccacgugcugcug

SEQ ID NO: 14818 - RNA, 31 nt, Human
uagggcacaaccuguuggauaguuuuagcuu

SEQ ID NO: 14819 - RNA, 21 nt, Human
agguuugcaaagacugagugu

SEQ ID NO: 14820 - RNA, 21 nt, Human
gccuuucucggcccuggacug

SEQ ID NO: 14821 - RNA, 27 nt, Human
gauggugguguuuucaugaacaucuuu

SEQ ID NO: 14822 - RNA, 21 nt, Human
cagcccaaggacgauggugag

SEQ ID NO: 14823 - RNA, 21 nt, Human
ucuaccaucaacaccaaccag

SEQ ID NO: 14824 - RNA, 24 nt, Human
cccacagucuuugcccucaaggag

SEQ ID NO: 14825 - RNA, 27 nt, Human
uggcugcugggcucuccaccucaggcc

SEQ ID NO: 14826 - RNA, 27 nt, Human
guguuaggccuggcacagugucugggu

SEQ ID NO: 14827 - RNA, 21 nt, Human
gcuuaggccacucgagcauca

SEQ ID NO: 14828 - RNA, 21 nt, Human
gaucauaccacggcacuccag

SEQ ID NO: 14829 - RNA, 22 nt, Human
ucgucauuaccuggcagaggca

SEQ ID NO: 14830 - RNA, 25 nt, Human
cuaacaaaauaucacagacugagua

SEQ ID NO: 14831 - RNA, 27 nt, Human
ccccucggaggacaagcgcuucucggu

SEQ ID NO: 14832 - RNA, 24 nt, Human
gcccccuggaucugcacaucugcc

SEQ ID NO: 14833 - RNA, 19 nt, Human
uuuugcucuucuguaugug

SEQ ID NO: 14834 - RNA, 27 nt, Human
cacuccucugcugggcuguucauuguc

SEQ ID NO: 14835 - RNA, 22 nt, Human
cuagcacuuacagcugugugau

SEQ ID NO: 14836 - RNA, 19 nt, Human
ugucauucugccuggcggc

SEQ ID NO: 14837 - RNA, 20 nt, Human
augaaugaggcacagccgua

SEQ ID NO: 14838 - RNA, 23 nt, Human
ugauccaguaucacaguauugug

SEQ ID NO: 14839 - RNA, 19 nt, Human
caggagacucuugcaguga

SEQ ID NO: 14840 - RNA, 21 nt, Human
ggcccuuccccuuccccccaa

SEQ ID NO: 14841 - RNA, 21 nt, Human
ccaggaguucgaagcugcagg

SEQ ID NO: 14842 - RNA, 22 nt, Human
gcgaacauaguacacugcagcc

SEQ ID NO: 14843 - RNA, 21 nt, Human
ucagccgccgggagcacccag

SEQ ID NO: 14844 - RNA, 22 nt, Human
cuaggggaggugguaggcugca

SEQ ID NO: 14845 - RNA, 20 nt, Human
cagcugccuggguccauugu

SEQ ID NO: 14846 - RNA, 25 nt, Human
aggcagcagggcugaggcaagguag

SEQ ID NO: 14847 - RNA, 22 nt, Human
guugcccaagcuggacuugaac

SEQ ID NO: 14848 - RNA, 29 nt, Human
ccacggccuuugaccaucuguaguugcca

SEQ ID NO: 14849 - RNA, 21 nt, Human
ugcccaggcuagggggcuaua

SEQ ID NO: 14850 - RNA, 16 nt, Human
cuccccucucccugcc

SEQ ID NO: 14851 - RNA, 21 nt, Human
gcgcagacuggcggagaagga

SEQ ID NO: 14852 - RNA, 23 nt, Human
uggcauagaguugcaugauaugu

SEQ ID NO: 14853 - RNA, 21 nt, Human
guuuucuccucuaccccucuc

SEQ ID NO: 14854 - RNA, 21 nt, Human
uaguauaauuuagucuuuuca

SEQ ID NO: 14855 - RNA, 27 nt, Human
augacugccgccauaagaagacagaga

SEQ ID NO: 14856 - RNA, 23 nt, Human
cccagaguagcuggaauuacagg

SEQ ID NO: 14857 - RNA, 22 nt, Human
uuuccaucuguccacaucccca

SEQ ID NO: 14858 - RNA, 23 nt, Human
uucaagccauucugccucagccu

SEQ ID NO: 14859 - RNA, 26 nt, Human
agauauuucaaauuguuuucagugaa

SEQ ID NO: 14860 - RNA, 19 nt, Human
uuggagcagucccucuuug

SEQ ID NO: 14861 - RNA, 26 nt, Human
gggcugcccugucacuccucuaacac

SEQ ID NO: 14862 - RNA, 27 nt, Human
caggcuggagugcaguggcgugaucuu

SEQ ID NO: 14863 - RNA, 27 nt, Human
caggcuggaguacaguggcaugaucuu

SEQ ID NO: 14864 - RNA, 26 nt, Human
gcuccccaaggugugaaugaggcagg

SEQ ID NO: 14865 - RNA, 21 nt, Human
uguuuuuauuaauccgucuua

SEQ ID NO: 14866 - RNA, 27 nt, Human
caggcuggagugcaguggugugaucuc

SEQ ID NO: 14867 - RNA, 19 nt, Human
ccaucugaucaaaugcaaa

SEQ ID NO: 14868 - RNA, 21 nt, Human
agagcacgucuucucugccgc

SEQ ID NO: 14869 - RNA, 24 nt, Human
augcaaagccugaagacacuggua

SEQ ID NO: 14870 - RNA, 28 nt, Human
cuggcccaaagcaguguugguugcuuac

SEQ ID NO: 14871 - RNA, 24 nt, Human
ggaaaacauaguuggaaauguaau

SEQ ID NO: 14872 - RNA, 24 nt, Human
ucuggcugccuuugcuuaagccau

SEQ ID NO: 14873 - RNA, 24 nt, Human
ggcucagagcuugaagauuaggag

SEQ ID NO: 14874 - RNA, 27 nt, Human
gggaggcugagguugcaggaucgcuug

SEQ ID NO: 14875 - RNA, 22 nt, Human
uuuaacagcaaaaggaaagaga

SEQ ID NO: 14876 - RNA, 23 nt, Human
aacacagccuguguacuccucug

SEQ ID NO: 14877 - RNA, 24 nt, Human
cucuuucucuuacccuuguguauu

SEQ ID NO: 14878 - RNA, 19 nt, Human
ggcacacaccugucuguaa

SEQ ID NO: 14879 - RNA, 25 nt, Human
ccccagaggaagcccucagccucug

SEQ ID NO: 14880 - RNA, 21 nt, Human
ccugcaguuuuguuuguacuu

SEQ ID NO: 14881 - RNA, 19 nt, Human
uuccacaaaucucuugccu

SEQ ID NO: 14882 - RNA, 28 nt, Human
cuucaaggcccugucaccaccuauuuuc

SEQ ID NO: 14883 - RNA, 27 nt, Human
ccaggagaaucacuugaacccaggagg

SEQ ID NO: 14884 - RNA, 22 nt, Human
auuuucucccuuugccaagguu

SEQ ID NO: 14885 - RNA, 20 nt, Human
aagccccuguggccgugugg

SEQ ID NO: 14886 - RNA, 23 nt, Human
uuuguuccuuugucuucuggcuu

SEQ ID NO: 14887 - RNA, 27 nt, Human
gagaaucgcuugagccugggaggcaga

SEQ ID NO: 14888 - RNA, 20 nt, Human
cuugggaggagagggccagg

SEQ ID NO: 14889 - RNA, 22 nt, Human
ucgcucaggcuggagugccaug

SEQ ID NO: 14890 - RNA, 17 nt, Human
acugagacaaugccuug

SEQ ID NO: 14891 - RNA, 32 nt, Human
gcccuuuguaguuugcaaagcacuuuuccaua

SEQ ID NO: 14892 - RNA, 25 nt, Human
cuggaacugugccuuuucucuuguc

SEQ ID NO: 14893 - RNA, 23 nt, Human
caaucuauuuaaaaaacuguaua

SEQ ID NO: 14894 - RNA, 20 nt, Human
uuggccuacagucaucugcc

SEQ ID NO: 14895 - RNA, 22 nt, Human
cuggauuuaaaaauuuuaaaca

SEQ ID NO: 14896 - RNA, 22 nt, Human
gaggcucucaguagauaucugu

SEQ ID NO: 14897 - RNA, 24 nt, Human
ucuuuuagcuuuggaggcacuugc

SEQ ID NO: 14898 - RNA, 21 nt, Human
caguaauucccaucugccuuu

SEQ ID NO: 14899 - RNA, 22 nt, Human
gauuacaggcgugagccaccaa

SEQ ID NO: 14900 - RNA, 21 nt, Human
uuccucucacauacaugcucu

SEQ ID NO: 14901 - RNA, 19 nt, Human
gcacaggaacaauacguca

SEQ ID NO: 14902 - RNA, 23 nt, Human
aaccaguaucaauuugaaaugcu

SEQ ID NO: 14903 - RNA, 21 nt, Human
acuccuuccuuccuccccacc

SEQ ID NO: 14904 - RNA, 19 nt, Human
guaggagcaggagaacuuu

SEQ ID NO: 14905 - RNA, 24 nt, Human
gccuccgcucacugcgugcaccug

SEQ ID NO: 14906 - RNA, 22 nt, Human
guaaaacugaugacauaaagaa

SEQ ID NO: 14907 - RNA, 18 nt, Human
agaaugcaaacugccuuu

SEQ ID NO: 14908 - RNA, 23 nt, Human
ccccucuggugcuugguugaaca

SEQ ID NO: 14909 - RNA, 25 nt, Human
ccuggagaacagccaacaagaggcc

SEQ ID NO: 14910 - RNA, 24 nt, Human
cccaaggaggcuacuggaucgggg

SEQ ID NO: 14911 - RNA, 21 nt, Human
agcaucagggagacuccaacu

SEQ ID NO: 14912 - RNA, 23 nt, Human
cauucuuagcugagacaccaaga

SEQ ID NO: 14913 - RNA, 22 nt, Human
uucagaguuugaagguaacuga

SEQ ID NO: 14914 - RNA, 22 nt, Human
gaggggaaagggagaagggugg

SEQ ID NO: 14915 - RNA, 25 nt, Human
ggagaagaaguacauggaggccagg

SEQ ID NO: 14916 - RNA, 27 nt, Human
ccacugcacuccagccuuggcaacaca

SEQ ID NO: 14917 - RNA, 27 nt, Human
ccauugcacccuagccugggcaacaga

SEQ ID NO: 14918 - RNA, 26 nt, Human
gcaagcuuuucaaucucaggaauacu

SEQ ID NO: 14919 - RNA, 21 nt, Human
ggaggcugaugguccuccuca

SEQ ID NO: 14920 - RNA, 22 nt, Human
gcagugucuaaagguagaugca

SEQ ID NO: 14921 - RNA, 18 nt, Human
ugucugucuguccggucu

SEQ ID NO: 14922 - RNA, 27 nt, Human
aagagccuuuagagaaagcauuugagc

SEQ ID NO: 14923 - RNA, 26 nt, Human
cugacccugguauaagaaguacucug

SEQ ID NO: 14924 - RNA, 20 nt, Human
guucucccuccuugggguga

SEQ ID NO: 14925 - RNA, 19 nt, Human
gggaagaugagcuuccaug

SEQ ID NO: 14926 - RNA, 30 nt, Human
ccugugugcuggcccugugcuagacagugc

SEQ ID NO: 14927 - RNA, 21 nt, Human
ucuccaggaauacugaacaug

SEQ ID NO: 14928 - RNA, 18 nt, Human
ugagacuucuagcaaaga

SEQ ID NO: 14929 - RNA, 22 nt, Human
ccagguuauuuuaaaaagauuu

SEQ ID NO: 14930 - RNA, 22 nt, Human
cacaugugccauaauauacaaa

SEQ ID NO: 14931 - RNA, 21 nt, Human
ggcuuacugcaaccuuugccu

SEQ ID NO: 14932 - RNA, 23 nt, Human
ggacagugagagcagggcugggc

SEQ ID NO: 14933 - RNA, 21 nt, Human
ccagaaucuuggaacaccugg

SEQ ID NO: 14934 - RNA, 22 nt, Human
ucugcgcgcacaaccuaggcag

SEQ ID NO: 14935 - RNA, 21 nt, Human
auugcaaaugcauuuaacaaa

SEQ ID NO: 14936 - RNA, 26 nt, Human
ccagcaccugggucuuuaugcaugaa

SEQ ID NO: 14937 - RNA, 22 nt, Human
ccaacccacucccuguagugaa

SEQ ID NO: 14938 - RNA, 20 nt, Human
uuccaguuuugguauacuaa

SEQ ID NO: 14939 - RNA, 24 nt, Human
gcaggcugccaccccuucuaccuc

SEQ ID NO: 14940 - RNA, 22 nt, Human
ugaccuuucagggccacagaga

SEQ ID NO: 14941 - RNA, 21 nt, Human
ccuguuucugucuguuuugug

SEQ ID NO: 14942 - RNA, 20 nt, Human
ugcauaaccuuuacacuccu

SEQ ID NO: 14943 - RNA, 20 nt, Human
aggaagaggcaggccacgca

SEQ ID NO: 14944 - RNA, 20 nt, Human
cugccacccacggucaccac

SEQ ID NO: 14945 - RNA, 20 nt, Human
acgcugggcuugcuuggggg

SEQ ID NO: 14946 - RNA, 21 nt, Human
ggcaaagggaaggagccccug

SEQ ID NO: 14947 - RNA, 22 nt, Human
ccaggaggcagagcuugcagug

SEQ ID NO: 14948 - RNA, 17 nt, Human
cuccccucuccuccgcc

SEQ ID NO: 14949 - RNA, 20 nt, Human
aaacuccugggcucaggcga

SEQ ID NO: 14950 - RNA, 22 nt, Human
ucucucucuuuuuguuuuguuu

SEQ ID NO: 14951 - RNA, 22 nt, Human
cugcugcuccuccuccuuuccc

SEQ ID NO: 14952 - RNA, 25 nt, Human
auccugagacuguuuauagcuuaaa

SEQ ID NO: 14953 - RNA, 27 nt, Human
cuccucggggugcucggcucccuccca

SEQ ID NO: 14954 - RNA, 22 nt, Human
uccucauaaaagcucagaugau

SEQ ID NO: 14955 - RNA, 22 nt, Human
ggucccucuucaccuucugagg

SEQ ID NO: 14956 - RNA, 20 nt, Human
aggaagaguggcucuuagca

SEQ ID NO: 14957 - RNA, 24 nt, Human
gguaugaacaguugacuucauggu

SEQ ID NO: 14958 - RNA, 24 nt, Human
gcauagagaccgaggcacagccca

SEQ ID NO: 14959 - RNA, 25 nt, Human
agcagagaccucaucagcagaccaa

SEQ ID NO: 14960 - RNA, 20 nt, Human
auggcucggccucugccuuu

SEQ ID NO: 14961 - RNA, 23 nt, Human
uguguucuuccuuuagucaucau

SEQ ID NO: 14962 - RNA, 22 nt, Human
gagcuccauacacacgcugccu

SEQ ID NO: 14963 - RNA, 22 nt, Human
cggucugacagccacuccagag

SEQ ID NO: 14964 - RNA, 24 nt, Human
ugaaauccugaguguugccugcca

SEQ ID NO: 14965 - RNA, 21 nt, Human
guugaccagguuggucucgaa

SEQ ID NO: 14966 - RNA, 20 nt, Human
ugggagccgacgggugggua

SEQ ID NO: 14967 - RNA, 20 nt, Human
ugcacgaacuggacugugug

SEQ ID NO: 14968 - RNA, 23 nt, Human
ccccucgagcgagcgagcuagcc

SEQ ID NO: 14969 - RNA, 25 nt, Human
gucgccccuguggcuggacugugac

SEQ ID NO: 14970 - RNA, 20 nt, Human
ggaagguaguccugcuuuau

SEQ ID NO: 14971 - RNA, 22 nt, Human
agcugcuuugacaaaaugacug

SEQ ID NO: 14972 - RNA, 23 nt, Human
ugcuuacauuuuaauagagauga

SEQ ID NO: 14973 - RNA, 27 nt, Human
augcauacuuauauuaucuuaagcaug

SEQ ID NO: 14974 - RNA, 27 nt, Human
cuccugcagccuggaaagaggagggag

SEQ ID NO: 14975 - RNA, 21 nt, Human
gucacuuuuucucucuacucc

SEQ ID NO: 14976 - RNA, 24 nt, Human
cccagcuguaugaggagagcuuca

SEQ ID NO: 14977 - RNA, 20 nt, Human
acugaccacagccuggcugg

SEQ ID NO: 14978 - RNA, 28 nt, Human
cugcuugguggcgggggugauguaugug

SEQ ID NO: 14979 - RNA, 26 nt, Human
uuguagacuuucuaaauaaagucaaa

SEQ ID NO: 14980 - RNA, 21 nt, Human
aagaggaggggauaugacagc

SEQ ID NO: 14981 - RNA, 26 nt, Human
cuucacugcauuaugaaaauauuuca

SEQ ID NO: 14982 - RNA, 21 nt, Human
gaguagcuggauuacaggcau

SEQ ID NO: 14983 - RNA, 21 nt, Human
uacauaacuucagugcaagag

SEQ ID NO: 14984 - RNA, 24 nt, Human
uucagccaaucuggacacuucuuu

SEQ ID NO: 14985 - RNA, 19 nt, Human
ucagcucugccucuguccu

SEQ ID NO: 14986 - RNA, 27 nt, Human
aguaugggaagaaggaggaauggaggg

SEQ ID NO: 14987 - RNA, 19 nt, Human
accauaaaaggaauacuua

SEQ ID NO: 14988 - RNA, 25 nt, Human
ggagguugaggggcguccgaggcgc

SEQ ID NO: 14989 - RNA, 18 nt, Human
augauguuaaaugccuug

SEQ ID NO: 14990 - RNA, 20 nt, Human
cucagcuuuaaugggugugg

SEQ ID NO: 14991 - RNA, 20 nt, Human
uacugccagagacagaaaau

SEQ ID NO: 14992 - RNA, 19 nt, Human
ggagucucuucucagugag

SEQ ID NO: 14993 - RNA, 22 nt, Human
uucccuggaauuuaauucaaag

SEQ ID NO: 14994 - RNA, 21 nt, Human
ucauucaguuucacuuccaca

SEQ ID NO: 14995 - RNA, 25 nt, Human
uuacucuguugccaggcuggagugc

SEQ ID NO: 14996 - RNA, 25 nt, Human
gugccuccccucugccucccauuuc

SEQ ID NO: 14997 - RNA, 20 nt, Human
cucuaauccagcaaagugau

SEQ ID NO: 14998 - RNA, 29 nt, Human
cacauuuugcauuagacagaugacggcug

SEQ ID NO: 14999 - RNA, 27 nt, Human
ccaugagguucggcacccaggucuccg

SEQ ID NO: 15000 - RNA, 26 nt, Human
gcaaccccugaagagaacacuuccug

SEQ ID NO: 15001 - RNA, 26 nt, Human
cccacccgguucaguguuucugggga

SEQ ID NO: 15002 - RNA, 23 nt, Human
ucugggagccuuucggcaaaucu

SEQ ID NO: 15003 - RNA, 19 nt, Human
ggccaauaucccaccauca

SEQ ID NO: 15004 - RNA, 27 nt, Human
cuaccugcagcuuugagucuugcccua

SEQ ID NO: 15005 - RNA, 22 nt, Human
cugaguagcugggacugcaggc

SEQ ID NO: 15006 - RNA, 20 nt, Human
cuacucagcucuccugcugc

SEQ ID NO: 15007 - RNA, 21 nt, Human
cuccacccucacccuccaccc

SEQ ID NO: 15008 - RNA, 24 nt, Human
augcacuugcugcugccuccuggg

SEQ ID NO: 15009 - RNA, 23 nt, Human
ucucgcccaggcuggagugcagu

SEQ ID NO: 15010 - RNA, 22 nt, Human
ugaacuccuaaccucaggugau

SEQ ID NO: 15011 - RNA, 19 nt, Human
ucaacagcaauuuaauugu

SEQ ID NO: 15012 - RNA, 22 nt, Human
ucaauccuuuguuucuaugccu

SEQ ID NO: 15013 - RNA, 26 nt, Human
aggcuccaucccccgcccccucucuc

SEQ ID NO: 15014 - RNA, 25 nt, Human
aucucaaaaugccaauguaaaauuu

SEQ ID NO: 15015 - RNA, 20 nt, Human
gguaccacauauauucauuu

SEQ ID NO: 15016 - RNA, 19 nt, Human
gaaagagaaguuuucuuga

SEQ ID NO: 15017 - RNA, 22 nt, Human
ccuuucuccuaaagccuggucc

SEQ ID NO: 15018 - RNA, 22 nt, Human
uugcauuguuguaauuguucag

SEQ ID NO: 15019 - RNA, 21 nt, Human
caccuuuaggccaucucagcu

SEQ ID NO: 15020 - RNA, 19 nt, Human
gccauucccugcagaguca

SEQ ID NO: 15021 - RNA, 19 nt, Human
agaucaaacucagcaguac

SEQ ID NO: 15022 - RNA, 25 nt, Human
cuguguucugggccugcugaggaug

SEQ ID NO: 15023 - RNA, 26 nt, Human
cuuaccucggugccuuccucuuuuua

SEQ ID NO: 15024 - RNA, 27 nt, Human
gaugucaggaaaggccuucugcagaga

SEQ ID NO: 15025 - RNA, 23 nt, Human
caccccucauccaucucagcauc

SEQ ID NO: 15026 - RNA, 25 nt, Human
gugggucuugcauuacaucaaacag

SEQ ID NO: 15027 - RNA, 23 nt, Human
ucuuccuccccaggacuuggucu

SEQ ID NO: 15028 - RNA, 26 nt, Human
gaguccagcacccccagccugccuuu

SEQ ID NO: 15029 - RNA, 22 nt, Human
ucaaccgggcuggagugcagug

SEQ ID NO: 15030 - RNA, 23 nt, Human
cuggucccagcuugaguuccugc

SEQ ID NO: 15031 - RNA, 20 nt, Human
agagggaagagaagaaacag

SEQ ID NO: 15032 - RNA, 23 nt, Human
uucauuuuuaacauuccuccucc

SEQ ID NO: 15033 - RNA, 18 nt, Human
uguuccuagaaugcagcu

SEQ ID NO: 15034 - RNA, 28 nt, Human
acuuaaauccucaucuguccuccuuucc

SEQ ID NO: 15035 - RNA, 19 nt, Human
ucuucugcucucauccugc

SEQ ID NO: 15036 - RNA, 21 nt, Human
cuccccacuggccuaaaugga

SEQ ID NO: 15037 - RNA, 20 nt, Human
cagccaggcugcggcgaggg

SEQ ID NO: 15038 - RNA, 19 nt, Human
aaacucauucguuuaauga

SEQ ID NO: 15039 - RNA, 18 nt, Human
gggaccccugcucccagc

SEQ ID NO: 15040 - RNA, 25 nt, Human
ccagcaauaauugacaaacuuuucc

SEQ ID NO: 15041 - RNA, 21 nt, Human
ugaaaucaaggugcgcugugg

SEQ ID NO: 15042 - RNA, 22 nt, Human
ucaggaagagaaaaugggcuag

SEQ ID NO: 15043 - RNA, 21 nt, Human
augugggagggacccagcugg

SEQ ID NO: 15044 - RNA, 21 nt, Human
gaccuguuucucugccgcuac

SEQ ID NO: 15045 - RNA, 20 nt, Human
ucauuauuuucagcaaccag

SEQ ID NO: 15046 - RNA, 22 nt, Human
ugaacuccugaccucagguaau

SEQ ID NO: 15047 - RNA, 20 nt, Human
uucugugccuuuaaugagga

SEQ ID NO: 15048 - RNA, 22 nt, Human
cgugaccuucucuuuuagauaa

SEQ ID NO: 15049 - RNA, 26 nt, Human
ggcgccuguaaucccagcuacucggg

SEQ ID NO: 15050 - RNA, 19 nt, Human
gacccuuguuugcacagca

SEQ ID NO: 15051 - RNA, 27 nt, Human
ucuguucugcuguggccugagcucccc

SEQ ID NO: 15052 - RNA, 18 nt, Human
cuccagcccucuccagcc

SEQ ID NO: 15053 - RNA, 23 nt, Human
aauaggagaagaguuuaagccug

SEQ ID NO: 15054 - RNA, 23 nt, Human
aaugacuugagcccaggaggagg

SEQ ID NO: 15055 - RNA, 27 nt, Human
caggcagcgggaggaggggcggcgcga

SEQ ID NO: 15056 - RNA, 29 nt, Human
uucggguaggauucucucuaaauuauuua

SEQ ID NO: 15057 - RNA, 23 nt, Human
gugaguuagggggagacccggcc

SEQ ID NO: 15058 - RNA, 19 nt, Human
caacuccaaggggaccugg

SEQ ID NO: 15059 - RNA, 22 nt, Human
aaaguguugagacuacaggcau

SEQ ID NO: 15060 - RNA, 20 nt, Human
cuggggcaagcaaaauugag

SEQ ID NO: 15061 - RNA, 19 nt, Human
agccaaggcuggucaaggc

SEQ ID NO: 15062 - RNA, 30 nt, Human
gccuggcugcccuuuccccccugcugcugc

SEQ ID NO: 15063 - RNA, 16 nt, Human
gagaaagauagacaga

SEQ ID NO: 15064 - RNA, 22 nt, Human
gguguacaccuagccugugcag

SEQ ID NO: 15065 - RNA, 20 nt, Human
uaguaucuuuaccuaccuca

SEQ ID NO: 15066 - RNA, 22 nt, Human
gccuucauccccauccugggcc

SEQ ID NO: 15067 - RNA, 22 nt, Human
gugacaccuccugcagccccca

SEQ ID NO: 15068 - RNA, 22 nt, Human
aaaaugcaaaaaauuagccggg

SEQ ID NO: 15069 - RNA, 22 nt, Human
aguuccaggccugaucuugccu

SEQ ID NO: 15070 - RNA, 21 nt, Human
agcacacccaaagaauuuuca

SEQ ID NO: 15071 - RNA, 19 nt, Human
ggcauacuuuuccacacau

SEQ ID NO: 15072 - RNA, 24 nt, Human
aagaacauuuuuagguuugcaagc

SEQ ID NO: 15073 - RNA, 21 nt, Human
aaaguugaaaaaccacccaag

SEQ ID NO: 15074 - RNA, 23 nt, Human
caggagccuggcuccguccagga

SEQ ID NO: 15075 - RNA, 21 nt, Human
acguaaacacacuugcccuca

SEQ ID NO: 15076 - RNA, 20 nt, Human
gugaagucuugcccucucug

SEQ ID NO: 15077 - RNA, 21 nt, Human
gcuguaauguuuucacaauau

SEQ ID NO: 15078 - RNA, 20 nt, Human
gagcagggagccaccuucac

SEQ ID NO: 15079 - RNA, 22 nt, Human
aaguagcugggauuacaagcac

SEQ ID NO: 15080 - RNA, 24 nt, Human
ucaugcugucuuuacaugggguuu

SEQ ID NO: 15081 - RNA, 22 nt, Human
agcacuccucaucaucacucau

SEQ ID NO: 15082 - RNA, 22 nt, Human
ucugucucucuuuugcucucuc

SEQ ID NO: 15083 - RNA, 22 nt, Human
gugugagccaccacgcccggcc

SEQ ID NO: 15084 - RNA, 25 nt, Human
gggcuaggggggaguggggagccaa

SEQ ID NO: 15085 - RNA, 27 nt, Human
uagguuggcagagauuucaguuuccca

SEQ ID NO: 15086 - RNA, 19 nt, Human
ucuucagcucccuuagcuu

SEQ ID NO: 15087 - RNA, 21 nt, Human
gcaaagcgcuggauuacaggc

SEQ ID NO: 15088 - RNA, 24 nt, Human
ccugcuagggaccucgccugcugg

SEQ ID NO: 15089 - RNA, 19 nt, Human
cauggggguacacauacac

SEQ ID NO: 15090 - RNA, 24 nt, Human
uuaaaauguuaacuggcaguaagu

SEQ ID NO: 15091 - RNA, 23 nt, Human
ggaccuggcgugcucagacccaa

SEQ ID NO: 15092 - RNA, 21 nt, Human
agcuaaauuagaacggcuuca

SEQ ID NO: 15093 - RNA, 24 nt, Human
ucucaauaaaagccaggaacagag

SEQ ID NO: 15094 - RNA, 27 nt, Human
cuucaaagugccugggcucagccuggu

SEQ ID NO: 15095 - RNA, 26 nt, Human
ccagacuggagagcaagcccagccca

SEQ ID NO: 15096 - RNA, 20 nt, Human
uauucccucuauuuuccucu

SEQ ID NO: 15097 - RNA, 22 nt, Human
gagacagagucuugcucuguca

SEQ ID NO: 15098 - RNA, 18 nt, Human
acuacuuauaaugccuua

SEQ ID NO: 15099 - RNA, 23 nt, Human
gucgcucaggcuggagugcagug

SEQ ID NO: 15100 - RNA, 26 nt, Human
cuuuucuuuuccucuggauuuuuguu

SEQ ID NO: 15101 - RNA, 19 nt, Human
uaauuucacagaugcugug

SEQ ID NO: 15102 - RNA, 22 nt, Human
ucugccugaccuaugaggccuc

SEQ ID NO: 15103 - RNA, 22 nt, Human
gcuugagccaccgcgcccggcu

SEQ ID NO: 15104 - RNA, 22 nt, Human
uugaguggcugggauugcgggc

SEQ ID NO: 15105 - RNA, 25 nt, Human
cccagugcugcuguaaauacaggaa

SEQ ID NO: 15106 - RNA, 26 nt, Human
cgugaagcauuuacacucuuuaagac

SEQ ID NO: 15107 - RNA, 21 nt, Human
gaugagccaccgcgcccagcc

SEQ ID NO: 15108 - RNA, 20 nt, Human
ugugcucucugggguuguuc

SEQ ID NO: 15109 - RNA, 25 nt, Human
ucugcaguuuguuacacaccuagga

SEQ ID NO: 15110 - RNA, 23 nt, Human
ccugccugagggcucccugcugc

SEQ ID NO: 15111 - RNA, 21 nt, Human
agccuccucggucuccugucu

SEQ ID NO: 15112 - RNA, 24 nt, Human
gaagaauuugauuagucuaugaaa

SEQ ID NO: 15113 - RNA, 23 nt, Human
uaccuacaggccauauugcucag

SEQ ID NO: 15114 - RNA, 21 nt, Human
cgccuaagcuggaguguggug

SEQ ID NO: 15115 - RNA, 21 nt, Human
gucccaggcucugggcucggg

SEQ ID NO: 15116 - RNA, 21 nt, Human
agccccagcaggaucugcauc

SEQ ID NO: 15117 - RNA, 21 nt, Human
caggcaccaccuuccuccuug

SEQ ID NO: 15118 - RNA, 21 nt, Human
cucuccucuccugcagguguc

SEQ ID NO: 15119 - RNA, 19 nt, Human
gccagugcagccccagguu

SEQ ID NO: 15120 - RNA, 21 nt, Human
cucccagauucugacuagaau

SEQ ID NO: 15121 - RNA, 22 nt, Human
uuccauucaggagcaaagagca

SEQ ID NO: 15122 - RNA, 20 nt, Human
ccaacugcuccaaucugccu

SEQ ID NO: 15123 - RNA, 22 nt, Human
aaagugcugagauuauaggcau

SEQ ID NO: 15124 - RNA, 22 nt, Human
gcggcauucaggacucuucuca

SEQ ID NO: 15125 - RNA, 21 nt, Human
cuucaaucaaaacaucauguc

SEQ ID NO: 15126 - RNA, 27 nt, Human
ccugggcaacagagcaagaccuugucu

SEQ ID NO: 15127 - RNA, 18 nt, Human
uccaaauugcuacccaac

SEQ ID NO: 15128 - RNA, 24 nt, Human
ggcgcaacguucgauuucuaccuc

SEQ ID NO: 15129 - RNA, 19 nt, Human
aaccuauagcaucuucuca

SEQ ID NO: 15130 - RNA, 19 nt, Human
guaauaaguaaaugccuua

SEQ ID NO: 15131 - RNA, 22 nt, Human
ccgcccacccacccaucagccu

SEQ ID NO: 15132 - RNA, 27 nt, Human
gggcuucaagagaggggcaggggagau

SEQ ID NO: 15133 - RNA, 28 nt, Human
acaggcacaaagggagaccauaaggaga

SEQ ID NO: 15134 - RNA, 21 nt, Human
ugcugcacuuuauuaccaagc

SEQ ID NO: 15135 - RNA, 21 nt, Human
ccuggugugacucuagugauc

SEQ ID NO: 15136 - RNA, 26 nt, Human
cagcauuggugaaggcacacucagau

SEQ ID NO: 15137 - RNA, 26 nt, Human
cuaucaaucaaaauguuuguaacuua

SEQ ID NO: 15138 - RNA, 25 nt, Human
aaaaagaguuuagucgucuaaacau

SEQ ID NO: 15139 - RNA, 23 nt, Human
aacacaaaagcuaugucuauucc

SEQ ID NO: 15140 - RNA, 21 nt, Human
caaagggagagaggggcaagc

SEQ ID NO: 15141 - RNA, 20 nt, Human
ccucugugccaccucucaca

SEQ ID NO: 15142 - RNA, 20 nt, Human
ucaaugcugaaaccucucaa

SEQ ID NO: 15143 - RNA, 22 nt, Human
ccacacacaggugguguuacug

SEQ ID NO: 15144 - RNA, 21 nt, Human
gagcaccagucacuuacucca

SEQ ID NO: 15145 - RNA, 27 nt, Human
cccucuuuaaugcugucuuuguggacu

SEQ ID NO: 15146 - RNA, 23 nt, Human
cuagcaauauuugcaacauccca

SEQ ID NO: 15147 - RNA, 22 nt, Human
caggaggcagaggguugcagug

SEQ ID NO: 15148 - RNA, 21 nt, Human
ucuucagccucuccaggcacc

SEQ ID NO: 15149 - RNA, 27 nt, Human
ugccucaguuuccccacaugugcaaug

SEQ ID NO: 15150 - RNA, 22 nt, Human
cagcccagaucucgcaccugca

SEQ ID NO: 15151 - RNA, 27 nt, Human
gcugcuggaugaugagggagaucaaga

SEQ ID NO: 15152 - RNA, 22 nt, Human
gggagugagagagagggcacga

SEQ ID NO: 15153 - RNA, 24 nt, Human
gaagacaaagaaagguuguggaaa

SEQ ID NO: 15154 - RNA, 26 nt, Human
ugcgaggucagucaaggcuuuggggg

SEQ ID NO: 15155 - RNA, 32 nt, Human
gcucacgucugcugcaaccugaagcuugcauc

SEQ ID NO: 15156 - RNA, 27 nt, Human
cacugcacccagccuagaaucuuguau

SEQ ID NO: 15157 - RNA, 22 nt, Human
ucaugccacugcacuccaaccu

SEQ ID NO: 15158 - RNA, 22 nt, Human
ucaugccacuacacuccagccu

SEQ ID NO: 15159 - RNA, 27 nt, Human
ggcgucugaggcucauagucugcuccc

SEQ ID NO: 15160 - RNA, 18 nt, Human
acucugucuucuuugcua

SEQ ID NO: 15161 - RNA, 20 nt, Human
cuugagauccaggcaaguga

SEQ ID NO: 15162 - RNA, 20 nt, Human
uaguuuaagagucccugacc

SEQ ID NO: 15163 - RNA, 22 nt, Human
augaucacagcucacugcagcu

SEQ ID NO: 15164 - RNA, 22 nt, Human
cagccccuucucugggaugugg

SEQ ID NO: 15165 - RNA, 21 nt, Human
gaccguauuaccaauguaaua

SEQ ID NO: 15166 - RNA, 19 nt, Human
agcauaucuguagcuuaag

SEQ ID NO: 15167 - RNA, 25 nt, Human
cagcucuggcuuccagaaaacccca

SEQ ID NO: 15168 - RNA, 27 nt, Human
uuguacuuucaacuguccauuucuccc

SEQ ID NO: 15169 - RNA, 26 nt, Human
aggggcucaggacagggaggaguuga

SEQ ID NO: 15170 - RNA, 22 nt, Human
agcgcugugcuaugcucugggg

SEQ ID NO: 15171 - RNA, 22 nt, Human
uggcugccugaugaguguuucc

SEQ ID NO: 15172 - RNA, 23 nt, Human
aguggguggggaguggggguggg

SEQ ID NO: 15173 - RNA, 24 nt, Human
cucuucacagcugaacucagucua

SEQ ID NO: 15174 - RNA, 23 nt, Human
auacagugucuggaacuauuggu

SEQ ID NO: 15175 - RNA, 25 nt, Human
uucucuucucucuggacuucggugu

SEQ ID NO: 15176 - RNA, 22 nt, Human
cucugauucuccugugccacag

SEQ ID NO: 15177 - RNA, 27 nt, Human
ugccuguaguccuagcuacuugggagg

SEQ ID NO: 15178 - RNA, 23 nt, Human
ggugugaugucaacagcauguua

SEQ ID NO: 15179 - RNA, 26 nt, Human
cccacccuccggaccgcggcagcugc

SEQ ID NO: 15180 - RNA, 26 nt, Human
cuuggcuucuggucuugauguauuug

SEQ ID NO: 15181 - RNA, 19 nt, Human
ccugcccccuguccccugc

SEQ ID NO: 15182 - RNA, 20 nt, Human
uauuaccuagagugaacuuu

SEQ ID NO: 15183 - RNA, 26 nt, Human
ccugcaggaggccuggggccggcgag

SEQ ID NO: 15184 - RNA, 19 nt, Human
gugccugcucaccagugcc

SEQ ID NO: 15185 - RNA, 25 nt, Human
ucaguucuuauuugcaccuacuuca

SEQ ID NO: 15186 - RNA, 21 nt, Human
cuccuugaguuuuccugcugc

SEQ ID NO: 15187 - RNA, 26 nt, Human
cccacuggccacugccauccugcugc

SEQ ID NO: 15188 - RNA, 18 nt, Human
guccacugcuguaacccc

SEQ ID NO: 15189 - RNA, 22 nt, Human
ccucaugcuguuccaccucccc

SEQ ID NO: 15190 - RNA, 23 nt, Human
ugaggucaggcuucaguaacugu

SEQ ID NO: 15191 - RNA, 27 nt, Human
ucagagcagacauaaagcuagaaaaau

SEQ ID NO: 15192 - RNA, 21 nt, Human
uugacaucuggaaaccucuac

SEQ ID NO: 15193 - RNA, 26 nt, Human
caggaaggaaagcccagcccuuucug

SEQ ID NO: 15194 - RNA, 22 nt, Human
aacuaaaacaaauugugcauuc

SEQ ID NO: 15195 - RNA, 22 nt, Human
ucuuuuuuccucuucagucucc

SEQ ID NO: 15196 - RNA, 22 nt, Human
cggagucucgcucugucgccca

SEQ ID NO: 15197 - RNA, 22 nt, Human
uggagucuugcucugucgccca

SEQ ID NO: 15198 - RNA, 22 nt, Human
cagagucucgcucugucaccca

SEQ ID NO: 15199 - RNA, 21 nt, Human
ucugcccuugaggaccugcga

SEQ ID NO: 15200 - RNA, 22 nt, Human
cggagucucacucugucaccca

SEQ ID NO: 15201 - RNA, 22 nt, Human
cggagucuugcucuguugccca

SEQ ID NO: 15202 - RNA, 20 nt, Human
ucuccaccucccaaagugcu

SEQ ID NO: 15203 - RNA, 27 nt, Human
uuuggccucuuuguccaaagugaccuu

SEQ ID NO: 15204 - RNA, 22 nt, Human
ucucugaugugucucaguaucu

SEQ ID NO: 15205 - RNA, 21 nt, Human
cugagauugcaggcacaugcc

SEQ ID NO: 15206 - RNA, 27 nt, Human
uugcccagguggauaaauguguacaug

SEQ ID NO: 15207 - RNA, 23 nt, Human
gagcccccggaagaauuuuauga

SEQ ID NO: 15208 - RNA, 25 nt, Human
ccucauuccuccuguucucccaguu

SEQ ID NO: 15209 - RNA, 23 nt, Human
aucacaacaacuuuugcugccag

SEQ ID NO: 15210 - RNA, 23 nt, Human
aggcucugccucaccuuggggcu

SEQ ID NO: 15211 - RNA, 30 nt, Human
aucuuagaagcacuacaccuugccuugcug

SEQ ID NO: 15212 - RNA, 21 nt, Human
accuuaggcuggaccuaaaua

SEQ ID NO: 15213 - RNA, 18 nt, Human
uaucuagcuauuuuaaua

SEQ ID NO: 15214 - RNA, 27 nt, Human
uagucucuccccuggccacaguaauug

SEQ ID NO: 15215 - RNA, 22 nt, Human
ggagcucagcaacaaggcugca

SEQ ID NO: 15216 - RNA, 24 nt, Human
agagcgcccauucaccccccucac

SEQ ID NO: 15217 - RNA, 24 nt, Human
gcgccuggagcggcuggagcagug

SEQ ID NO: 15218 - RNA, 26 nt, Human
uggcccuucccuuuaccaacagaaaa

SEQ ID NO: 15219 - RNA, 22 nt, Human
cuggcagcugccggcgcuuggc

SEQ ID NO: 15220 - RNA, 24 nt, Human
guugccggccccugaaguggagcg

SEQ ID NO: 15221 - RNA, 21 nt, Human
caugggcugagguguagcuga

SEQ ID NO: 15222 - RNA, 22 nt, Human
ccuccaaaugcugucucugccu

SEQ ID NO: 15223 - RNA, 20 nt, Human
gggcucuuugaggugggugg

SEQ ID NO: 15224 - RNA, 22 nt, Human
ccaaaaugccauuuagcaauaa

SEQ ID NO: 15225 - RNA, 25 nt, Human
gauuuauuucaaacuaggccagcug

SEQ ID NO: 15226 - RNA, 24 nt, Human
auugugcuuuuguaacaauguugu

SEQ ID NO: 15227 - RNA, 18 nt, Human
ccuuucucccccucgguu

SEQ ID NO: 15228 - RNA, 18 nt, Human
cuggcugcgucuuccucu

SEQ ID NO: 15229 - RNA, 21 nt, Human
gaacuuuuaaugaacugugaa

SEQ ID NO: 15230 - RNA, 22 nt, Human
ugccuguagucucagcuaguug

SEQ ID NO: 15231 - RNA, 20 nt, Human
aagaagccuucuuuucuuuc

SEQ ID NO: 15232 - RNA, 25 nt, Human
cggccucuucccagcagcggcucua

SEQ ID NO: 15233 - RNA, 27 nt, Human
gcaagcucucagcaagugcccagugga

SEQ ID NO: 15234 - RNA, 26 nt, Human
ucagcauuugucuccuccuuuaacug

SEQ ID NO: 15235 - RNA, 27 nt, Human
cuccuugugccuccacugaugcaggag

SEQ ID NO: 15236 - RNA, 26 nt, Human
uccagcaaauaggaacaguuuugccc

SEQ ID NO: 15237 - RNA, 26 nt, Human
gucuuuccuuauguugcuuuuucaac

SEQ ID NO: 15238 - RNA, 22 nt, Human
gcacaagaaucuccaaacaccu

SEQ ID NO: 15239 - RNA, 21 nt, Human
gacccuguaguuuccaguuaa

SEQ ID NO: 15240 - RNA, 27 nt, Human
gcacugggaucaucuguuuacaggcau

SEQ ID NO: 15241 - RNA, 27 nt, Human
gcuggguagagcaaucugggcacuuug

SEQ ID NO: 15242 - RNA, 18 nt, Human
ucccuggcacaccuucca

SEQ ID NO: 15243 - RNA, 21 nt, Human
cugugccucaguccuucaccu

SEQ ID NO: 15244 - RNA, 26 nt, Human
aguccccaguuggggcugcgaccucc

SEQ ID NO: 15245 - RNA, 27 nt, Human
acaauuguauucccagccuguguccca

SEQ ID NO: 15246 - RNA, 20 nt, Human
ggugagcuguggaggugggg

SEQ ID NO: 15247 - RNA, 22 nt, Human
agaccuacagaaucagaaacuc

SEQ ID NO: 15248 - RNA, 23 nt, Human
ugcccccaauuucccagacuaga

SEQ ID NO: 15249 - RNA, 25 nt, Human
gugggccauggagucaggccaccuc

SEQ ID NO: 15250 - RNA, 22 nt, Human
cugggucagagagcagggagug

SEQ ID NO: 15251 - RNA, 19 nt, Human
ggggcagcccucacccaac

SEQ ID NO: 15252 - RNA, 21 nt, Human
cagacagagcaggugcgggga

SEQ ID NO: 15253 - RNA, 23 nt, Human
ccuuuggcugccccacucuccuu

SEQ ID NO: 15254 - RNA, 24 nt, Human
cugccuggaucucaccagcacuuu

SEQ ID NO: 15255 - RNA, 21 nt, Human
uguccacccucccaggccgac

SEQ ID NO: 15256 - RNA, 24 nt, Human
guagaugguuagcauguuuagcaa

SEQ ID NO: 15257 - RNA, 26 nt, Human
ucucagccuaacuccauccccaccgc

SEQ ID NO: 15258 - RNA, 23 nt, Human
agucuaagaaaagcacagauggu

SEQ ID NO: 15259 - RNA, 21 nt, Human
ugguggagcaggaagugcagg

SEQ ID NO: 15260 - RNA, 20 nt, Human
ccccgcaccugguggccuug

SEQ ID NO: 15261 - RNA, 22 nt, Human
gugggcucccugccccucucug

SEQ ID NO: 15262 - RNA, 20 nt, Human
augucugccacaccucucca

SEQ ID NO: 15263 - RNA, 24 nt, Human
ccuaucaggaugaggagcagcagc

SEQ ID NO: 15264 - RNA, 20 nt, Human
uuucucucuaccuauaaaca

SEQ ID NO: 15265 - RNA, 27 nt, Human
cagacccaagcuguccauuucugugau

SEQ ID NO: 15266 - RNA, 19 nt, Human
ggaacaacauuuacaacuc

SEQ ID NO: 15267 - RNA, 25 nt, Human
ugcuucuagaugccuucucucucca

SEQ ID NO: 15268 - RNA, 24 nt, Human
ucugauaguccucugcuaaaacaa

SEQ ID NO: 15269 - RNA, 21 nt, Human
cacaagguacaaaaucuugca

SEQ ID NO: 15270 - RNA, 27 nt, Human
aaguagcugggauuacaggugcaggcc

SEQ ID NO: 15271 - RNA, 25 nt, Human
uuggguaagaaugcuucuguuccug

SEQ ID NO: 15272 - RNA, 22 nt, Human
uguggucaccaagaucuaaguu

SEQ ID NO: 15273 - RNA, 22 nt, Human
aaaugucccuuucuucuccccc

SEQ ID NO: 15274 - RNA, 24 nt, Human
guugcccugccaucgccuccauca

SEQ ID NO: 15275 - RNA, 26 nt, Human
guauggucagaauauaauacuuccau

SEQ ID NO: 15276 - RNA, 21 nt, Human
ggcugcaggagguugcggcgg

SEQ ID NO: 15277 - RNA, 21 nt, Human
caggaauauccaagaagcugu

SEQ ID NO: 15278 - RNA, 27 nt, Human
ucuccaccucccauaguucucccgcgu

SEQ ID NO: 15279 - RNA, 26 nt, Human
gcuguggccacaagagugcgcugugc

SEQ ID NO: 15280 - RNA, 21 nt, Human
gacucccugguucaagcgauu

SEQ ID NO: 15281 - RNA, 22 nt, Human
guguguaggccuggccgcaguc

SEQ ID NO: 15282 - RNA, 19 nt, Human
agauaaaauauuuacuauu

SEQ ID NO: 15283 - RNA, 19 nt, Human
cucauucucauuccugggc

SEQ ID NO: 15284 - RNA, 27 nt, Human
gcacagcccugagugucccaagccggg

SEQ ID NO: 15285 - RNA, 22 nt, Human
ggaggccgaggagagaggauca

SEQ ID NO: 15286 - RNA, 27 nt, Human
cacagccagugucaggccucugccucu

SEQ ID NO: 15287 - RNA, 28 nt, Human
gcugcaccugccagccuggcuucuggag

SEQ ID NO: 15288 - RNA, 23 nt, Human
uccucaggaagcgucucacucug

SEQ ID NO: 15289 - RNA, 24 nt, Human
agccuccucaccucuucccaaccc

SEQ ID NO: 15290 - RNA, 24 nt, Human
ggggcucaguucuggacugugggu

SEQ ID NO: 15291 - RNA, 23 nt, Human
ugcacauucuacacacagugccu

SEQ ID NO: 15292 - RNA, 20 nt, Human
uugcacagggcugugccagu

SEQ ID NO: 15293 - RNA, 27 nt, Human
uguggguggaagggcugggugucgaaa

SEQ ID NO: 15294 - RNA, 20 nt, Human
accacaacuuugaaaaucuu

SEQ ID NO: 15295 - RNA, 21 nt, Human
cuggguaccccaaacucuuag

SEQ ID NO: 15296 - RNA, 28 nt, Human
caucaggucugcagagcugcaggagaag

SEQ ID NO: 15297 - RNA, 21 nt, Human
gcccaguccccgauggcugcg

SEQ ID NO: 15298 - RNA, 21 nt, Human
gaggaagaggaggaggcggcg

SEQ ID NO: 15299 - RNA, 25 nt, Human
agcaaauuuaaaucucuccucgauc

SEQ ID NO: 15300 - RNA, 26 nt, Human
agccaggcuuucuuagccauucuuug

SEQ ID NO: 15301 - RNA, 27 nt, Human
uucucgugcacugcuuucuccuucaca

SEQ ID NO: 15302 - RNA, 22 nt, Human
ucuaucgcccaggcuggagugc

SEQ ID NO: 15303 - RNA, 21 nt, Human
ucccaggccugcugugguucu

SEQ ID NO: 15304 - RNA, 24 nt, Human
uuuggugacucugugcccuugcuc

SEQ ID NO: 15305 - RNA, 23 nt, Human
acagcuuuccugcacugcagcuu

SEQ ID NO: 15306 - RNA, 22 nt, Human
gccaggaccagccuguaccuug

SEQ ID NO: 15307 - RNA, 20 nt, Human
acuguacugagugcuuauuc

SEQ ID NO: 15308 - RNA, 24 nt, Human
aggcaaaucaccgggcagagggag

SEQ ID NO: 15309 - RNA, 22 nt, Human
gucccagaugccugggcugaga

SEQ ID NO: 15310 - RNA, 20 nt, Human
uggcuacacuagauauuuug

SEQ ID NO: 15311 - RNA, 25 nt, Human
gggaagaaaacgucaccuugccaua

SEQ ID NO: 15312 - RNA, 23 nt, Human
ugcucucagcuggcagugcaaug

SEQ ID NO: 15313 - RNA, 27 nt, Human
ucacccaggaagugcaagggguuuggg

SEQ ID NO: 15314 - RNA, 23 nt, Human
guucgggaagaaaauaaccccau

SEQ ID NO: 15315 - RNA, 25 nt, Human
ucuucaacuaccaucucuggacuca

SEQ ID NO: 15316 - RNA, 20 nt, Human
uugccccagggaaggucaca

SEQ ID NO: 15317 - RNA, 21 nt, Human
cagugcugggauuacaggcau

SEQ ID NO: 15318 - RNA, 22 nt, Human
gcaguaggugcuccuucaccuc

SEQ ID NO: 15319 - RNA, 22 nt, Human
ucuuuucucacauucagacuua

SEQ ID NO: 15320 - RNA, 25 nt, Human
ccccaggcuggagugcaguggcucg

SEQ ID NO: 15321 - RNA, 26 nt, Human
cccagcucucccuucgaguagcaacc

SEQ ID NO: 15322 - RNA, 27 nt, Human
cagucucucucuuccucacagucccac

SEQ ID NO: 15323 - RNA, 25 nt, Human
agaggaucuacccgggucccugccu

SEQ ID NO: 15324 - RNA, 28 nt, Human
ggcaggcugaagacacuagaauccugac

SEQ ID NO: 15325 - RNA, 27 nt, Human
gcacagcccagggccugcaugggggca

SEQ ID NO: 15326 - RNA, 22 nt, Human
gcaaagcauacaacaauauuac

SEQ ID NO: 15327 - RNA, 27 nt, Human
ugcuuguaauccuagcacuuuuugagg

SEQ ID NO: 15328 - RNA, 27 nt, Human
cuguggacuaaaucugccacgauuggu

SEQ ID NO: 15329 - RNA, 18 nt, Human
uuccaauauacuaucuga

SEQ ID NO: 15330 - RNA, 22 nt, Human
gaggccuggagcguccugcugc

SEQ ID NO: 15331 - RNA, 25 nt, Human
uauuuaccaguuuuuaacuuaagcc

SEQ ID NO: 15332 - RNA, 19 nt, Human
gcuucugccucauccugcc

SEQ ID NO: 15333 - RNA, 24 nt, Human
ggcgcggcggcucugcccaccucu

SEQ ID NO: 15334 - RNA, 28 nt, Human
aguauucuccccugauuggaaugguuga

SEQ ID NO: 15335 - RNA, 22 nt, Human
gcaugagccaccgcaccgggcc

SEQ ID NO: 15336 - RNA, 21 nt, Human
gagaaggcugcagaugccgag

SEQ ID NO: 15337 - RNA, 20 nt, Human
uguguggaaagucagaggaa

SEQ ID NO: 15338 - RNA, 19 nt, Human
cgugcagcggacagcagau

SEQ ID NO: 15339 - RNA, 19 nt, Human
aggcccagcagacccugcu

SEQ ID NO: 15340 - RNA, 18 nt, Human
uuaucuccucuucauggc

SEQ ID NO: 15341 - RNA, 21 nt, Human
ucgguggaaaauuagagugaa

SEQ ID NO: 15342 - RNA, 25 nt, Human
cauucucuggcagcaccuccaggau

SEQ ID NO: 15343 - RNA, 25 nt, Human
aucauuaaggagcggaggcuuuugg

SEQ ID NO: 15344 - RNA, 24 nt, Human
ggcugacugcaaccacugccucca

SEQ ID NO: 15345 - RNA, 23 nt, Human
uguugcccaggcugcagugcagu

SEQ ID NO: 15346 - RNA, 28 nt, Human
gcuccauccucggcuccugggcaccguc

SEQ ID NO: 15347 - RNA, 23 nt, Human
ggagagggaagaaaucuggaaua

SEQ ID NO: 15348 - RNA, 23 nt, Human
cccccuuccauggccccagcucu

SEQ ID NO: 15349 - RNA, 21 nt, Human
aggaaagagaauacuugcaga

SEQ ID NO: 15350 - RNA, 26 nt, Human
guauuuguuucauaagcaucuuccug

SEQ ID NO: 15351 - RNA, 21 nt, Human
auaaaugcaaacugacaaccu

SEQ ID NO: 15352 - RNA, 21 nt, Human
augaagagaacgcuggaaggc

SEQ ID NO: 15353 - RNA, 20 nt, Human
ggcuguaguagaggcaguuu

SEQ ID NO: 15354 - RNA, 20 nt, Human
ggcgggcggagguuccagga

SEQ ID NO: 15355 - RNA, 25 nt, Human
ucagcuugggcaagugugugccugu

SEQ ID NO: 15356 - RNA, 21 nt, Human
uacucagcuaacaaaccugcc

SEQ ID NO: 15357 - RNA, 19 nt, Human
cucucagcugcugaaagcu

SEQ ID NO: 15358 - RNA, 22 nt, Human
caucacugcacuccaaccuggg

SEQ ID NO: 15359 - RNA, 23 nt, Human
gccaagcagggggccacagggug

SEQ ID NO: 15360 - RNA, 21 nt, Human
auucauaacacuuggcacuug

SEQ ID NO: 15361 - RNA, 19 nt, Human
ugcuuucuuuagcuguaau

SEQ ID NO: 15362 - RNA, 22 nt, Human
uggagaaaggggaaguggucca

SEQ ID NO: 15363 - RNA, 22 nt, Human
aggcagcacaaggaggauguga

SEQ ID NO: 15364 - RNA, 27 nt, Human
agguacccagcugcugcccacauuucu

SEQ ID NO: 15365 - RNA, 27 nt, Human
acucagggcagaguucugaaucucaaa

SEQ ID NO: 15366 - RNA, 20 nt, Human
cacaaaugaagaagaacaaa

SEQ ID NO: 15367 - RNA, 22 nt, Human
agugugcccucaaccagcacag

SEQ ID NO: 15368 - RNA, 21 nt, Human
gggcccccggcccuggcuuug

SEQ ID NO: 15369 - RNA, 26 nt, Human
ggcuguagguggcggcugagaagugc

SEQ ID NO: 15370 - RNA, 21 nt, Human
guacauacauuguaucuuugu

SEQ ID NO: 15371 - RNA, 23 nt, Human
gguagauggagugaugauucuuc

SEQ ID NO: 15372 - RNA, 23 nt, Human
guacagucuugcagcaggaucua

SEQ ID NO: 15373 - RNA, 19 nt, Human
ucgccagcaaaagaagaga

SEQ ID NO: 15374 - RNA, 27 nt, Human
agggucugaggcugcagccccaguucg

SEQ ID NO: 15375 - RNA, 25 nt, Human
gccuacuugccccuccuuccaggcc

SEQ ID NO: 15376 - RNA, 25 nt, Human
gacucacugcagcuaucucucgccu

SEQ ID NO: 15377 - RNA, 25 nt, Human
caggcaccuguaaucccagcuacuc

SEQ ID NO: 15378 - RNA, 26 nt, Human
gccggugcugaaggagguggcugugg

SEQ ID NO: 15379 - RNA, 25 nt, Human
cuaauuccuguguagcuuuguucau

SEQ ID NO: 15380 - RNA, 23 nt, Human
ugcguuggacaccauaagccaca

SEQ ID NO: 15381 - RNA, 24 nt, Human
ugcacuccaggcugggugacagag

SEQ ID NO: 15382 - RNA, 21 nt, Human
aaugauaguuaugugcuuacc

SEQ ID NO: 15383 - RNA, 20 nt, Human
ccugcagggcugccuguuua

SEQ ID NO: 15384 - RNA, 21 nt, Human
cugcagucccauccucuuguc

SEQ ID NO: 15385 - RNA, 22 nt, Human
gggccuucagcuggagcugugg

SEQ ID NO: 15386 - RNA, 23 nt, Human
ucugccgggggcccaggcugugc

SEQ ID NO: 15387 - RNA, 22 nt, Human
agcuaauuucuguauuuuuagu

SEQ ID NO: 15388 - RNA, 21 nt, Human
auuguuuguaaucaccaauaa

SEQ ID NO: 15389 - RNA, 27 nt, Human
uugccuaaauuuaaacuuucucauuug

SEQ ID NO: 15390 - RNA, 27 nt, Human
cccugcaggagccccaucuugucgcua

SEQ ID NO: 15391 - RNA, 26 nt, Human
aggaaaauacagcggaaaaaugcaga

SEQ ID NO: 15392 - RNA, 26 nt, Human
uaggucagcagagauuucaguuuccc

SEQ ID NO: 15393 - RNA, 25 nt, Human
cuuccagaccccugcccucuuggga

SEQ ID NO: 15394 - RNA, 19 nt, Human
uauuaaaauacguugucug

SEQ ID NO: 15395 - RNA, 20 nt, Human
acauguguguauauaugugu

SEQ ID NO: 15396 - RNA, 27 nt, Human
cguuacugcuaaggauuaguccuggcu

SEQ ID NO: 15397 - RNA, 24 nt, Human
acugccacucuccccauuggcacc

SEQ ID NO: 15398 - RNA, 27 nt, Human
gguaauauauuauuuuagguaauauuu

SEQ ID NO: 15399 - RNA, 19 nt, Human
uucacacacaauugauuca

SEQ ID NO: 15400 - RNA, 26 nt, Human
guagcccagacuuugaaggugcuuug

SEQ ID NO: 15401 - RNA, 26 nt, Human
cuucacuggggcccugucugugugcu

SEQ ID NO: 15402 - RNA, 25 nt, Human
uuacuaagccacaagaaauuugauu

SEQ ID NO: 15403 - RNA, 19 nt, Human
gccccucucccacccgcag

SEQ ID NO: 15404 - RNA, 22 nt, Human
agggaaggcaaaggcagaggaa

SEQ ID NO: 15405 - RNA, 21 nt, Human
uuuuugucgucauugcuggug

SEQ ID NO: 15406 - RNA, 21 nt, Human
aaaaguacaaaaauuagccag

SEQ ID NO: 15407 - RNA, 19 nt, Human
uaaaaaauaggggccaggc

SEQ ID NO: 15408 - RNA, 21 nt, Human
caccagcccugggaaugaugg

SEQ ID NO: 15409 - RNA, 22 nt, Human
acuucuauauagagauagacuu

SEQ ID NO: 15410 - RNA, 27 nt, Human
agcaacuccccuacaucaaaugcucaa

SEQ ID NO: 15411 - RNA, 22 nt, Human
ggcccugcaagugccuggagga

SEQ ID NO: 15412 - RNA, 22 nt, Human
cucugccaccaccaagucauug

SEQ ID NO: 15413 - RNA, 32 nt, Human
gucuuagcauucugcaaaauggagaucuguug

SEQ ID NO: 15414 - RNA, 20 nt, Human
acagugcuucuguucagguu

SEQ ID NO: 15415 - RNA, 21 nt, Human
gauagccacuggcagcuuuga

SEQ ID NO: 15416 - RNA, 20 nt, Human
aggcugaggggaggaucacu

SEQ ID NO: 15417 - RNA, 23 nt, Human
uugcugagagagugcagcuuuug

SEQ ID NO: 15418 - RNA, 23 nt, Human
cgaguugcugggaccacagguca

SEQ ID NO: 15419 - RNA, 19 nt, Human
uccuccuaggaugaccuca

SEQ ID NO: 15420 - RNA, 27 nt, Human
ucucaacaaagcacaguguuaaaugaa

SEQ ID NO: 15421 - RNA, 22 nt, Human
gggaccuucuugccucaguguu

SEQ ID NO: 15422 - RNA, 22 nt, Human
ccgagcaacucuguccaaaaag

SEQ ID NO: 15423 - RNA, 20 nt, Human
cugaguauuaauaucugagg

SEQ ID NO: 15424 - RNA, 23 nt, Human
augguaggauucaaauguguguc

SEQ ID NO: 15425 - RNA, 22 nt, Human
ucuccccugugccugaucugug

SEQ ID NO: 15426 - RNA, 24 nt, Human
ggucccucugggcaugcugugcuc

SEQ ID NO: 15427 - RNA, 22 nt, Human
gccccuggcauuugcuggggaa

SEQ ID NO: 15428 - RNA, 20 nt, Human
ugcaaauucuggcagcuggc

SEQ ID NO: 15429 - RNA, 23 nt, Human
gcauggauaaaggagacagcccu

SEQ ID NO: 15430 - RNA, 21 nt, Human
agacucccucagccaugagaa

SEQ ID NO: 15431 - RNA, 18 nt, Human
cucuugcuccaccaggaa

SEQ ID NO: 15432 - RNA, 19 nt, Human
ccugugcccucaccaccac

SEQ ID NO: 15433 - RNA, 27 nt, Human
ggggugagacuugagcagaacaggggc

SEQ ID NO: 15434 - RNA, 19 nt, Human
aauguucucaaucguggcu

SEQ ID NO: 15435 - RNA, 25 nt, Human
guugcccaggcuggucucgaacucc

SEQ ID NO: 15436 - RNA, 21 nt, Human
cuccuauuuuacagcuacaag

SEQ ID NO: 15437 - RNA, 22 nt, Human
ccaaccuauuaccaccccaccu

SEQ ID NO: 15438 - RNA, 20 nt, Human
guuggcagaugcagcucuuc

SEQ ID NO: 15439 - RNA, 25 nt, Human
aguucucaugacuccuacuuuucau

SEQ ID NO: 15440 - RNA, 21 nt, Human
agguagggaaaaauucaugug

SEQ ID NO: 15441 - RNA, 30 nt, Human
uguggacuugugugggaugggugcaggucu

SEQ ID NO: 15442 - RNA, 21 nt, Human
accuugaggguccaaugggac

SEQ ID NO: 15443 - RNA, 20 nt, Human
ccagccccucacacucccag

SEQ ID NO: 15444 - RNA, 20 nt, Human
caggcuggagugcgguggca

SEQ ID NO: 15445 - RNA, 27 nt, Human
guuggauguucaaccucuaauuugccu

SEQ ID NO: 15446 - RNA, 26 nt, Human
ucuuucuuggacgugagcuaauuaua

SEQ ID NO: 15447 - RNA, 25 nt, Human
uucuagcuccuccaaucccauuuua

SEQ ID NO: 15448 - RNA, 23 nt, Human
agugccaugauugauuagcaaug

SEQ ID NO: 15449 - RNA, 27 nt, Human
gucacccaggaggauggcaaagagagu

SEQ ID NO: 15450 - RNA, 19 nt, Human
gcuggaguacaguggugcg

SEQ ID NO: 15451 - RNA, 20 nt, Human
ccugccacaguucacaugcc

SEQ ID NO: 15452 - RNA, 22 nt, Human
uucuacccuggggcgaacagaa

SEQ ID NO: 15453 - RNA, 22 nt, Human
gcccaggcuguguggaaacagc

SEQ ID NO: 15454 - RNA, 22 nt, Human
acacaggaggcugaggcaggag

SEQ ID NO: 15455 - RNA, 21 nt, Human
cccgacugagccagggccacu

SEQ ID NO: 15456 - RNA, 19 nt, Human
agcacuccucaagacuuug

SEQ ID NO: 15457 - RNA, 27 nt, Human
gaaaacaaugcuugagagaaauggguu

SEQ ID NO: 15458 - RNA, 20 nt, Human
aagaaucaagaucuucccuc

SEQ ID NO: 15459 - RNA, 30 nt, Human
ccacuucuccuucgcuuuccugagcccuaa

SEQ ID NO: 15460 - RNA, 22 nt, Human
uauguaaacaaaaaagcuuuug

SEQ ID NO: 15461 - RNA, 21 nt, Human
cgggcggcggagauugcagug

SEQ ID NO: 15462 - RNA, 21 nt, Human
cgggaggcggagcuugcagug

SEQ ID NO: 15463 - RNA, 21 nt, Human
cuaacgcaaccaagugugcua

SEQ ID NO: 15464 - RNA, 19 nt, Human
uccucuuuuuauuuuuucc

SEQ ID NO: 15465 - RNA, 21 nt, Human
ccgcaccccacauuccguccu

SEQ ID NO: 15466 - RNA, 27 nt, Human
ugcgugcuaccacgcccagcuacuucu

SEQ ID NO: 15467 - RNA, 28 nt, Human
uuugcuccacacacauaauggcagcuca

SEQ ID NO: 15468 - RNA, 28 nt, Human
gcugggccagaccccaggaagguggggu

SEQ ID NO: 15469 - RNA, 23 nt, Human
gaauguaaccgcuuuaagaaagg

SEQ ID NO: 15470 - RNA, 24 nt, Human
uugaacauucaaaaaccccuggaa

SEQ ID NO: 15471 - RNA, 22 nt, Human
cacuugaacccgggacgcagag

SEQ ID NO: 15472 - RNA, 22 nt, Human
gguaauuugaugggauggggaa

SEQ ID NO: 15473 - RNA, 23 nt, Human
gucgcccaggcuggaaugcagug

SEQ ID NO: 15474 - RNA, 22 nt, Human
ggggccccccuccuugcucugc

SEQ ID NO: 15475 - RNA, 24 nt, Human
gaagaauucugcaaggcuuggagg

SEQ ID NO: 15476 - RNA, 22 nt, Human
uucaugagauuucauccauuua

SEQ ID NO: 15477 - RNA, 19 nt, Human
gacugguccaguacccuuc

SEQ ID NO: 15478 - RNA, 24 nt, Human
cuggcugcgaguguuccugagagu

SEQ ID NO: 15479 - RNA, 21 nt, Human
ugcacugcuuccaagugccug

SEQ ID NO: 15480 - RNA, 19 nt, Human
uggcaucacgucagugcuc

SEQ ID NO: 15481 - RNA, 24 nt, Human
ucuugucugcuaucaaaccacuuc

SEQ ID NO: 15482 - RNA, 20 nt, Human
gugccucccaggccugcugu

SEQ ID NO: 15483 - RNA, 22 nt, Human
caggcuggagugcaguggccug

SEQ ID NO: 15484 - RNA, 23 nt, Human
cagccucucuuugcuuugccugc

SEQ ID NO: 15485 - RNA, 27 nt, Human
ucacccaggcugcagugccaugcagac

SEQ ID NO: 15486 - RNA, 26 nt, Human
cccaccccacucccugcucaguaccu

SEQ ID NO: 15487 - RNA, 20 nt, Human
ggccucggcccgggacgucu

SEQ ID NO: 15488 - RNA, 22 nt, Human
gggcccaugggagggagcugag

SEQ ID NO: 15489 - RNA, 18 nt, Human
ccaaccaaccaaacucca

SEQ ID NO: 15490 - RNA, 25 nt, Human
gccugugaaacugugaggggauuca

SEQ ID NO: 15491 - RNA, 25 nt, Human
uucaaagcucuauuaagauuuccaa

SEQ ID NO: 15492 - RNA, 23 nt, Human
ccucucugccagcaccaagagau

SEQ ID NO: 15493 - RNA, 25 nt, Human
uuccccaauccccaggucucuagau

SEQ ID NO: 15494 - RNA, 26 nt, Human
gaagaggagcauugauguuggguggc

SEQ ID NO: 15495 - RNA, 24 nt, Human
agcagcagcagcagguaccagcac

SEQ ID NO: 15496 - RNA, 27 nt, Human
ggucacuguugaaacucauccuguuca

SEQ ID NO: 15497 - RNA, 20 nt, Human
ccuaccaucuccugccuccc

SEQ ID NO: 15498 - RNA, 22 nt, Human
gccuguaauccuagcaguuugg

SEQ ID NO: 15499 - RNA, 27 nt, Human
uugcccaggcuggagugcaguggcgug

SEQ ID NO: 15500 - RNA, 27 nt, Human
uugcccaggcuggaguguaguggcgcg

SEQ ID NO: 15501 - RNA, 22 nt, Human
ccugaaaagugauuguuuucca

SEQ ID NO: 15502 - RNA, 27 nt, Human
ccuaaaauguuucagcaggcugucacc

SEQ ID NO: 15503 - RNA, 22 nt, Human
uccuccugguccuuuccugcuu

SEQ ID NO: 15504 - RNA, 27 nt, Human
ccccugccuuaguuaacaaguguguau

SEQ ID NO: 15505 - RNA, 27 nt, Human
cuguauaccuaaucugccucugccucu

SEQ ID NO: 15506 - RNA, 20 nt, Human
cucuuccaaucuccaucacc

SEQ ID NO: 15507 - RNA, 20 nt, Human
ugucuagcacuuccuugcca

SEQ ID NO: 15508 - RNA, 21 nt, Human
gaccgagguccugcaggugga

SEQ ID NO: 15509 - RNA, 21 nt, Human
aaguuagggucuauguauuua

SEQ ID NO: 15510 - RNA, 21 nt, Human
ccugccauuuguucccgccuu

SEQ ID NO: 15511 - RNA, 26 nt, Human
accugccucuggcccugguccugggc

SEQ ID NO: 15512 - RNA, 26 nt, Human
cccucccgccacucagcucaggcuga

SEQ ID NO: 15513 - RNA, 22 nt, Human
acucuucugucauagcauugug

SEQ ID NO: 15514 - RNA, 25 nt, Human
ggacuggacuuggcuuauuucuucc

SEQ ID NO: 15515 - RNA, 25 nt, Human
agugguucuccaagugugguccugg

SEQ ID NO: 15516 - RNA, 22 nt, Human
acugcaaccuccgccucccggg

SEQ ID NO: 15517 - RNA, 30 nt, Human
cccucccucugguccacugccuuuucauau

SEQ ID NO: 15518 - RNA, 23 nt, Human
uaguuucuguucuguaaagugau

SEQ ID NO: 15519 - RNA, 20 nt, Human
guuuucuuuucuugcacuga

SEQ ID NO: 15520 - RNA, 24 nt, Human
agaaugaggcaguuggcaaacuuc

SEQ ID NO: 15521 - RNA, 17 nt, Human
accacacuccagcuggg

SEQ ID NO: 15522 - RNA, 29 nt, Human
acauucccuggcuucugugcucucuuccc

SEQ ID NO: 15523 - RNA, 28 nt, Human
uucagaacauagggaugaaguaaggugc

SEQ ID NO: 15524 - RNA, 26 nt, Human
augccugguucauuuuuguguuuuua

SEQ ID NO: 15525 - RNA, 27 nt, Human
cacacuuguaucuggacuugccagcug

SEQ ID NO: 15526 - RNA, 26 nt, Human
ugcgccccagagagucccggacgccg

SEQ ID NO: 15527 - RNA, 22 nt, Human
cccacagccacuacugacugca

SEQ ID NO: 15528 - RNA, 17 nt, Human
gcacagccagccaaccu

SEQ ID NO: 15529 - RNA, 22 nt, Human
aagugcuuugcuggaguccugu

SEQ ID NO: 15530 - RNA, 22 nt, Human
ugcagugaaccgagaucaugcc

SEQ ID NO: 15531 - RNA, 30 nt, Human
gcagaguguuuaccuggugcucucaacagg

SEQ ID NO: 15532 - RNA, 22 nt, Human
ggagccgccuccuccuggccag

SEQ ID NO: 15533 - RNA, 20 nt, Human
ugcucuguggcuccaggguu

SEQ ID NO: 15534 - RNA, 22 nt, Human
ggaagcugcaggaagggagggu

SEQ ID NO: 15535 - RNA, 21 nt, Human
guugccaggcuagagugcagu

SEQ ID NO: 15536 - RNA, 23 nt, Human
acugucucccugccugucaauca

SEQ ID NO: 15537 - RNA, 22 nt, Human
ucaggccagggcagugcugcug

SEQ ID NO: 15538 - RNA, 24 nt, Human
cgugguggagaacaagugccuuca

SEQ ID NO: 15539 - RNA, 23 nt, Human
ccagcacuccucugucucugcuc

SEQ ID NO: 15540 - RNA, 27 nt, Human
gagacuugccagagccgggcacauuga

SEQ ID NO: 15541 - RNA, 21 nt, Human
guucaucugcugacuucuguc

SEQ ID NO: 15542 - RNA, 22 nt, Human
cucuguacagacagcugaguca

SEQ ID NO: 15543 - RNA, 20 nt, Human
cugcucucucuccuccagcg

SEQ ID NO: 15544 - RNA, 21 nt, Human
gacauggguaccucucagugu

SEQ ID NO: 15545 - RNA, 26 nt, Human
ugccaccaaaacccaaagaucaaagg

SEQ ID NO: 15546 - RNA, 22 nt, Human
agggcagcagccguugcucaga

SEQ ID NO: 15547 - RNA, 24 nt, Human
uggagccugggagccuccugaagu

SEQ ID NO: 15548 - RNA, 25 nt, Human
uguagggaagguggggcaugguuua

SEQ ID NO: 15549 - RNA, 21 nt, Human
ggagagaaggggcccucccag

SEQ ID NO: 15550 - RNA, 18 nt, Human
uucgucuccccuagcucc

SEQ ID NO: 15551 - RNA, 19 nt, Human
uucaguaagcacuucugaa

SEQ ID NO: 15552 - RNA, 25 nt, Human
cagggcuguaacugccaggcucucu

SEQ ID NO: 15553 - RNA, 24 nt, Human
cccuccuccucugggcacagggug

SEQ ID NO: 15554 - RNA, 23 nt, Human
agcaaagugcacugaugugugag

SEQ ID NO: 15555 - RNA, 20 nt, Human
ugcuucuugaaccaagucac

SEQ ID NO: 15556 - RNA, 21 nt, Human
guuugggggucuaucucucca

SEQ ID NO: 15557 - RNA, 25 nt, Human
cuggcguccccucccucugucuuca

SEQ ID NO: 15558 - RNA, 21 nt, Human
guagguuuagacucuuguaca

SEQ ID NO: 15559 - RNA, 20 nt, Human
uuguaaaauauaaccucaca

SEQ ID NO: 15560 - RNA, 22 nt, Human
ugcccaggcugcagugcagugg

SEQ ID NO: 15561 - RNA, 20 nt, Human
ugguccaaguagacagcugc

SEQ ID NO: 15562 - RNA, 23 nt, Human
agcugacggcuuuuacugccuag

SEQ ID NO: 15563 - RNA, 26 nt, Human
cuguaacccuugagauuaaguucagc

SEQ ID NO: 15564 - RNA, 21 nt, Human
uuaagugacuaauuuaauuuc

SEQ ID NO: 15565 - RNA, 19 nt, Human
auguaacacuguugagugc

SEQ ID NO: 15566 - RNA, 24 nt, Human
ccgcugucccagcuccuugagacu

SEQ ID NO: 15567 - RNA, 27 nt, Human
aacuuagagucuaaaagauuucuacug

SEQ ID NO: 15568 - RNA, 27 nt, Human
cacacuucuagucgcgggagcugcagg

SEQ ID NO: 15569 - RNA, 20 nt, Human
cagacuuccuguccugcugg

SEQ ID NO: 15570 - RNA, 22 nt, Human
uuuuagugaaucugcucuccca

SEQ ID NO: 15571 - RNA, 22 nt, Human
ggcucacugcagccucagcguc

SEQ ID NO: 15572 - RNA, 25 nt, Human
acuaagcuugacaucugugagugac

SEQ ID NO: 15573 - RNA, 21 nt, Human
guauauuuuuguaccaaacca

SEQ ID NO: 15574 - RNA, 21 nt, Human
cacacacaggccagcugcuca

SEQ ID NO: 15575 - RNA, 23 nt, Human
ccugcucuuccgcugcucgcucc

SEQ ID NO: 15576 - RNA, 27 nt, Human
cugccugcacucccuggccuugcccgu

SEQ ID NO: 15577 - RNA, 21 nt, Human
uauauucuucuuuguaguccu

SEQ ID NO: 15578 - RNA, 26 nt, Human
gccgccucccuccagcccuggagagg

SEQ ID NO: 15579 - RNA, 27 nt, Human
ucauggacugaggccagagcccccugu

SEQ ID NO: 15580 - RNA, 23 nt, Human
gucauuuuacaaauuaugugauu

SEQ ID NO: 15581 - RNA, 30 nt, Human
aaucaaugcuuaauaaaauauuuuuaaagg

SEQ ID NO: 15582 - RNA, 23 nt, Human
agcacuuuguuucagaacuggaa

SEQ ID NO: 15583 - RNA, 23 nt, Human
cugugcgagcuguggagugcagg

SEQ ID NO: 15584 - RNA, 20 nt, Human
ccaggucugggauucuaagu

SEQ ID NO: 15585 - RNA, 21 nt, Human
ugcuugguaacgggcugccag

SEQ ID NO: 15586 - RNA, 26 nt, Human
uuucuuuuguaaagagaccaucuucu

SEQ ID NO: 15587 - RNA, 22 nt, Human
ccccugcccugaagcuggcagu

SEQ ID NO: 15588 - RNA, 27 nt, Human
ggcugauuucaaaauauagagcccuuu

SEQ ID NO: 15589 - RNA, 27 nt, Human
aggagacacuggcaggagaugugcugu

SEQ ID NO: 15590 - RNA, 20 nt, Human
gguucgcuuaucaacuaaug

SEQ ID NO: 15591 - RNA, 24 nt, Human
ugcccccaacaacuccaggcccug

SEQ ID NO: 15592 - RNA, 18 nt, Human
uucagcuuccugcugcua

SEQ ID NO: 15593 - RNA, 22 nt, Human
uccuccaaaagcagcucucacu

SEQ ID NO: 15594 - RNA, 25 nt, Human
cucauuucuuaugaaucuuuccagg

SEQ ID NO: 15595 - RNA, 29 nt, Human
acccgacugcccuaccagccugcacaugg

SEQ ID NO: 15596 - RNA, 20 nt, Human
uacuuuucgagagaagggaa

SEQ ID NO: 15597 - RNA, 27 nt, Human
auugucaucagcccugccuguuuugca

SEQ ID NO: 15598 - RNA, 20 nt, Human
uucugcuauuugcuguugug

SEQ ID NO: 15599 - RNA, 20 nt, Human
cuugagggaaaggaacauga

SEQ ID NO: 15600 - RNA, 22 nt, Human
gaccagccuggacaauauagug

SEQ ID NO: 15601 - RNA, 19 nt, Human
guucuugcugggcaauggc

SEQ ID NO: 15602 - RNA, 22 nt, Human
ugugccaggcugaauuacagug

SEQ ID NO: 15603 - RNA, 22 nt, Human
ccgagcccucuuugcgcccugg

SEQ ID NO: 15604 - RNA, 19 nt, Human
uuuccucaucugcugccuc

SEQ ID NO: 15605 - RNA, 20 nt, Human
uuuguuugcagucucucucu

SEQ ID NO: 15606 - RNA, 21 nt, Human
uuugcuuaaacuaaugaacaa

SEQ ID NO: 15607 - RNA, 20 nt, Human
uucuggggccagcuucccuu

SEQ ID NO: 15608 - RNA, 21 nt, Human
gccauugcauuccagccuggg

SEQ ID NO: 15609 - RNA, 21 nt, Human
gaccucuuuuucaauacugua

SEQ ID NO: 15610 - RNA, 27 nt, Human
uuuuccucucugcaaauggcuuagcua

SEQ ID NO: 15611 - RNA, 26 nt, Human
gggcaacagagacccugucucaacca

SEQ ID NO: 15612 - RNA, 26 nt, Human
acaucaucugcuguaacaacugcucu

SEQ ID NO: 15613 - RNA, 27 nt, Human
ucaggaggcugaggcaggaggauugcu

SEQ ID NO: 15614 - RNA, 19 nt, Human
uuuaaaguuucugcagucc

SEQ ID NO: 15615 - RNA, 21 nt, Human
uccgcagucuggccugggcga

SEQ ID NO: 15616 - RNA, 21 nt, Human
aaccccuaggcucaagcaauc

SEQ ID NO: 15617 - RNA, 23 nt, Human
ugcccugcucuacucugcgcucu

SEQ ID NO: 15618 - RNA, 26 nt, Human
caaaaucacugcucguuuucauuugg

SEQ ID NO: 15619 - RNA, 27 nt, Human
ugcuguuguucagaaguuguuagugau

SEQ ID NO: 15620 - RNA, 22 nt, Human
ggucucgaacucuggaccucag

SEQ ID NO: 15621 - RNA, 26 nt, Human
ugggaagagagugagggacagaggaa

SEQ ID NO: 15622 - RNA, 27 nt, Human
uuagaaaacaaacugcuugacccagga

SEQ ID NO: 15623 - RNA, 22 nt, Human
gaagccaagauugaucucauuu

SEQ ID NO: 15624 - RNA, 20 nt, Human
caggggccacauccaaaaag

SEQ ID NO: 15625 - RNA, 22 nt, Human
ugggagacuguuucucuggccu

SEQ ID NO: 15626 - RNA, 20 nt, Human
gaucauaccacuucauucca

SEQ ID NO: 15627 - RNA, 20 nt, Human
gcucuuguugcccaggcugg

SEQ ID NO: 15628 - RNA, 24 nt, Human
aggaagccaccauggaugcaguga

SEQ ID NO: 15629 - RNA, 22 nt, Human
uauguaaacauauggguauuuu

SEQ ID NO: 15630 - RNA, 26 nt, Human
auugauuucaacaaagauggccacau

SEQ ID NO: 15631 - RNA, 27 nt, Human
uggucucaagcuaaaacaaaaauaaau

SEQ ID NO: 15632 - RNA, 22 nt, Human
caacagagcgagauuccaucuc

SEQ ID NO: 15633 - RNA, 22 nt, Human
ccuaaaaucuguuuuucucauc

SEQ ID NO: 15634 - RNA, 21 nt, Human
ccaagaccccaaaucaccaca

SEQ ID NO: 15635 - RNA, 19 nt, Human
ucuuucaaaagaacucaga

SEQ ID NO: 15636 - RNA, 16 nt, Human
gcauccugcugccuuc

SEQ ID NO: 15637 - RNA, 26 nt, Human
ggccuggagcacaugcuuacuggugg

SEQ ID NO: 15638 - RNA, 24 nt, Human
gggcucgggggcaggaaggucaga

SEQ ID NO: 15639 - RNA, 22 nt, Human
gcugggguuuuaguaaagcucc

SEQ ID NO: 15640 - RNA, 25 nt, Human
cugcccauguccugccugaaauacc

SEQ ID NO: 15641 - RNA, 22 nt, Human
ccugacacgugugugcagcagc

SEQ ID NO: 15642 - RNA, 25 nt, Human
ggaagcaagcggagguugcagugag

SEQ ID NO: 15643 - RNA, 21 nt, Human
aacacagcuuuacaacuucca

SEQ ID NO: 15644 - RNA, 17 nt, Human
gugacugcaagcauuuu

SEQ ID NO: 15645 - RNA, 23 nt, Human
agcaggaauucaaagcugcuugc

SEQ ID NO: 15646 - RNA, 24 nt, Human
ccugcagcccauccacaaccugcu

SEQ ID NO: 15647 - RNA, 27 nt, Human
caggcuggagugcaguggcucaaugca

SEQ ID NO: 15648 - RNA, 26 nt, Human
guccuggccuuucuucaugugugcgu

SEQ ID NO: 15649 - RNA, 26 nt, Human
aauccuuccauuccacacagaaugca

SEQ ID NO: 15650 - RNA, 22 nt, Human
cuugcaaauguuguauuucaaa

SEQ ID NO: 15651 - RNA, 21 nt, Human
aucuuuuuuggaacuaaagca

SEQ ID NO: 15652 - RNA, 24 nt, Human
ugagggcuggagaccagaacagca

SEQ ID NO: 15653 - RNA, 23 nt, Human
ucaccccagagcagcugcagccu

SEQ ID NO: 15654 - RNA, 18 nt, Human
caagucacuggucuguuu

SEQ ID NO: 15655 - RNA, 26 nt, Human
gcgcugccagcccgaguuugcagaga

SEQ ID NO: 15656 - RNA, 26 nt, Human
ucugucguccaggcuggagugcagug

SEQ ID NO: 15657 - RNA, 24 nt, Human
ugucacccaggcugaagugcagug

SEQ ID NO: 15658 - RNA, 24 nt, Human
caaguaugaugauuugcuaucaaa

SEQ ID NO: 15659 - RNA, 21 nt, Human
gaaagugcugggauuacaggc

SEQ ID NO: 15660 - RNA, 20 nt, Human
ccuaggcuggagugcaguga

SEQ ID NO: 15661 - RNA, 21 nt, Human
gcaaacaaacuuauucuacug

SEQ ID NO: 15662 - RNA, 22 nt, Human
gugugagccaccgcacccaauc

SEQ ID NO: 15663 - RNA, 24 nt, Human
ugcuugguucugacauucuggacu

SEQ ID NO: 15664 - RNA, 27 nt, Human
cagucagaguucaaguuaaaacagaaa

SEQ ID NO: 15665 - RNA, 27 nt, Human
ucuccugccucagcuccucgaguagcu

SEQ ID NO: 15666 - RNA, 23 nt, Human
agucuguaaauguuuauugagaa

SEQ ID NO: 15667 - RNA, 24 nt, Human
auccuguaauuucaugcagcuuug

SEQ ID NO: 15668 - RNA, 20 nt, Human
ggucccauuucucugcagca

SEQ ID NO: 15669 - RNA, 22 nt, Human
gcagguucugcugagggugggg

SEQ ID NO: 15670 - RNA, 22 nt, Human
cccaccccagcucaugcccccu

SEQ ID NO: 15671 - RNA, 27 nt, Human
ugagagagacagcagggaggagguaga

SEQ ID NO: 15672 - RNA, 19 nt, Human
agucccuuacagaggacca

SEQ ID NO: 15673 - RNA, 23 nt, Human
ucucugagcuggggaggugggag

SEQ ID NO: 15674 - RNA, 25 nt, Human
ggcugcaccugaagcauuugguggg

SEQ ID NO: 15675 - RNA, 27 nt, Human
uuuguuuuccuuccucuaaagaugucu

SEQ ID NO: 15676 - RNA, 19 nt, Human
ugcccgguuuuacucucau

SEQ ID NO: 15677 - RNA, 27 nt, Human
ugauacaacaggauuuucaaguuauuc

SEQ ID NO: 15678 - RNA, 22 nt, Human
gcuuccuucauuuccuccguca

SEQ ID NO: 15679 - RNA, 30 nt, Human
cuugccucucccuauggccugcuggcccac

SEQ ID NO: 15680 - RNA, 22 nt, Human
gggcacaccuuccccgggguuc

SEQ ID NO: 15681 - RNA, 22 nt, Human
cacaggcagaugaaugucuuga

SEQ ID NO: 15682 - RNA, 20 nt, Human
acagagcaguggcacuggac

SEQ ID NO: 15683 - RNA, 26 nt, Human
ggugguggggagacagauggagaagc

SEQ ID NO: 15684 - RNA, 22 nt, Human
aaaucacugccggcuaguccca

SEQ ID NO: 15685 - RNA, 22 nt, Human
aggaggaaccccuucucugguu

SEQ ID NO: 15686 - RNA, 21 nt, Human
cuugaccuucugucgucccca

SEQ ID NO: 15687 - RNA, 21 nt, Human
ccuuccuaugcucacccagag

SEQ ID NO: 15688 - RNA, 27 nt, Human
uuuacagucuuucuuucugaauuuuga

SEQ ID NO: 15689 - RNA, 29 nt, Human
gaggcuuggucccacaggccagggaccaa

SEQ ID NO: 15690 - RNA, 22 nt, Human
gcugguggcgucgccugcgcgu

SEQ ID NO: 15691 - RNA, 22 nt, Human
gguauuuuucuauuucucuccu

SEQ ID NO: 15692 - RNA, 22 nt, Human
cagcagggagcugggagcuggg

SEQ ID NO: 15693 - RNA, 23 nt, Human
aggcugaggcaggagaauuugcu

SEQ ID NO: 15694 - RNA, 29 nt, Human
cggcccggccggcaguugcaguguagaca

SEQ ID NO: 15695 - RNA, 23 nt, Human
cagauguuguuuauugaaucuac

SEQ ID NO: 15696 - RNA, 20 nt, Human
gguauagcuugaacuccuag

SEQ ID NO: 15697 - RNA, 21 nt, Human
aggccugauuucagcuccacc

SEQ ID NO: 15698 - RNA, 22 nt, Human
uggugaugauaaaaaugaugga

SEQ ID NO: 15699 - RNA, 22 nt, Human
agagcacagagagccauccgcc

SEQ ID NO: 15700 - RNA, 26 nt, Human
cccaaauuggagauaggcacuccucu

SEQ ID NO: 15701 - RNA, 24 nt, Human
cuggaggaaugcaugucacaggcg

SEQ ID NO: 15702 - RNA, 23 nt, Human
agaacagaucuuuuacuuuggcc

SEQ ID NO: 15703 - RNA, 22 nt, Human
acuuauaccuaaacccaaagga

SEQ ID NO: 15704 - RNA, 26 nt, Human
uaugaauauuuugaaauaacucugaa

SEQ ID NO: 15705 - RNA, 18 nt, Human
auuauugccaucaugcuu

SEQ ID NO: 15706 - RNA, 23 nt, Human
ccagcauguucccaaaucugugc

SEQ ID NO: 15707 - RNA, 21 nt, Human
cuccugagccugcggguccag

SEQ ID NO: 15708 - RNA, 21 nt, Human
gggauuacaggugugagcaua

SEQ ID NO: 15709 - RNA, 31 nt, Human
cgcuggucccccaccaggcuugggagcccug

SEQ ID NO: 15710 - RNA, 22 nt, Human
cacaagaagucauacuuuggug

SEQ ID NO: 15711 - RNA, 26 nt, Human
uacagcguccucgaaaccacgagcaa

SEQ ID NO: 15712 - RNA, 29 nt, Human
ccaggucuuaaggaccccaaagucaggau

SEQ ID NO: 15713 - RNA, 23 nt, Human
augguaggaggcaguaguucccc

SEQ ID NO: 15714 - RNA, 26 nt, Human
gccugugggugaucccagcucuuacu

SEQ ID NO: 15715 - RNA, 28 nt, Human
agcuauuuaaacaacuuaaacaucuuuu

SEQ ID NO: 15716 - RNA, 21 nt, Human
gccugcuccccucuggucacc

SEQ ID NO: 15717 - RNA, 23 nt, Human
uuccaacaaggacagcccuccuu

SEQ ID NO: 15718 - RNA, 19 nt, Human
ucagcagaugagugccagu

SEQ ID NO: 15719 - RNA, 20 nt, Human
gccaccucagaccccggggu

SEQ ID NO: 15720 - RNA, 21 nt, Human
aaucuccugugaucugugcua

SEQ ID NO: 15721 - RNA, 26 nt, Human
ucauagaaaacauuaguuuucuucug

SEQ ID NO: 15722 - RNA, 20 nt, Human
ggucacguaauuacucucau

SEQ ID NO: 15723 - RNA, 22 nt, Human
uucuccuugggccucaggcaaa

SEQ ID NO: 15724 - RNA, 23 nt, Human
caugccuguaaucccagcuacuu

SEQ ID NO: 15725 - RNA, 23 nt, Human
cgugccugugaucccagcuacuu

SEQ ID NO: 15726 - RNA, 23 nt, Human
caugccuguaauccuagcuacuc

SEQ ID NO: 15727 - RNA, 22 nt, Human
gcagaugaggugaaaaggccaa

SEQ ID NO: 15728 - RNA, 21 nt, Human
ugcuccacccacaccuccaug

SEQ ID NO: 15729 - RNA, 19 nt, Human
gguuuucugaaucuugccu

SEQ ID NO: 15730 - RNA, 19 nt, Human
gaggaagaaaaccagcgca

SEQ ID NO: 15731 - RNA, 28 nt, Human
ccucacuccucccuaucauguaccguga

SEQ ID NO: 15732 - RNA, 22 nt, Human
cacugcacuucagcuugggcaa

SEQ ID NO: 15733 - RNA, 25 nt, Human
gucacccaggcuggagugcuauggc

SEQ ID NO: 15734 - RNA, 23 nt, Human
cccggcacucgcucuccuccucu

SEQ ID NO: 15735 - RNA, 25 nt, Human
cagcggagagcccaggagaacgagc

SEQ ID NO: 15736 - RNA, 28 nt, Human
agaccagucccacccaccuuucuggccu

SEQ ID NO: 15737 - RNA, 26 nt, Human
ucaaaccaccaagauuccugcugcaa

SEQ ID NO: 15738 - RNA, 21 nt, Human
gcaaaguuuaaauguauuuua

SEQ ID NO: 15739 - RNA, 27 nt, Human
cccuccagggagcccacccugacccac

SEQ ID NO: 15740 - RNA, 21 nt, Human
acuagauuuauaaaugcacug

SEQ ID NO: 15741 - RNA, 24 nt, Human
uucuugggcccuccugaaacuuac

SEQ ID NO: 15742 - RNA, 22 nt, Human
gauugcuuuuuccucucauugu

SEQ ID NO: 15743 - RNA, 24 nt, Human
acaguuucuuuugcaauuuugugg

SEQ ID NO: 15744 - RNA, 22 nt, Human
cccugcaggaggccugggaggg

SEQ ID NO: 15745 - RNA, 24 nt, Human
cccaggacuccccuucuguggucu

SEQ ID NO: 15746 - RNA, 22 nt, Human
ucuuccauuguucaguauuuuu

SEQ ID NO: 15747 - RNA, 22 nt, Human
uagauuaaaauauuugccucca

SEQ ID NO: 15748 - RNA, 26 nt, Human
acuaguaccuguggauuacagucagu

SEQ ID NO: 15749 - RNA, 21 nt, Human
acagaguugcuuuugcaccua

SEQ ID NO: 15750 - RNA, 26 nt, Human
aaguucucagcaccuacuuuugucaa

SEQ ID NO: 15751 - RNA, 23 nt, Human
agcuccugaagaucugugcuuuc

SEQ ID NO: 15752 - RNA, 25 nt, Human
gcccacacuagccugggugcaucug

SEQ ID NO: 15753 - RNA, 24 nt, Human
ccauuugaaauagcaccuuccuua

SEQ ID NO: 15754 - RNA, 20 nt, Human
cauguaaaucacaaaaacug

SEQ ID NO: 15755 - RNA, 23 nt, Human
acuugacuuugcaauggugcuaa

SEQ ID NO: 15756 - RNA, 22 nt, Human
ccggggagggggaaagagcagc

SEQ ID NO: 15757 - RNA, 24 nt, Human
ucaucauggcuaaugaggacuguc

SEQ ID NO: 15758 - RNA, 21 nt, Human
ggccaacauggugaaacccca

SEQ ID NO: 15759 - RNA, 19 nt, Human
ucagaaauuggagagcaaa

SEQ ID NO: 15760 - RNA, 20 nt, Human
cuccuucccgccugccugua

SEQ ID NO: 15761 - RNA, 22 nt, Human
cgcagcccugcagagggcacag

SEQ ID NO: 15762 - RNA, 20 nt, Human
uguaguuuuuauauguugua

SEQ ID NO: 15763 - RNA, 27 nt, Human
ccuggaucucccugagaugggcuuccc

SEQ ID NO: 15764 - RNA, 27 nt, Human
cccugugccggacuccagccggggcga

SEQ ID NO: 15765 - RNA, 25 nt, Human
cccuuccucagacgccuugugggcu

SEQ ID NO: 15766 - RNA, 22 nt, Human
ccuuuugaauacauuuguauuu

SEQ ID NO: 15767 - RNA, 28 nt, Human
cucauggggcaggaaauggggggaucac

SEQ ID NO: 15768 - RNA, 22 nt, Human
uccucuggcccugcucuccugc

SEQ ID NO: 15769 - RNA, 22 nt, Human
gccccgaauggagugcccaggc

SEQ ID NO: 15770 - RNA, 24 nt, Human
accacaccacugccccaaggaccu

SEQ ID NO: 15771 - RNA, 27 nt, Human
cacugcacuccaaccugggcaacagag

SEQ ID NO: 15772 - RNA, 27 nt, Human
ggagagagaagacguggagggagggac

SEQ ID NO: 15773 - RNA, 22 nt, Human
gagauggaggagggaggccggg

SEQ ID NO: 15774 - RNA, 22 nt, Human
auuuuucuuaguagggggccuu

SEQ ID NO: 15775 - RNA, 21 nt, Human
ggcucugugcuguaacuggag

SEQ ID NO: 15776 - RNA, 22 nt, Human
cccccuucccgggcugcacuuu

SEQ ID NO: 15777 - RNA, 25 nt, Human
cuucuacuuuuccuuuugaaagcuc

SEQ ID NO: 15778 - RNA, 21 nt, Human
aaggcagccaacaugaaggaa

SEQ ID NO: 15779 - RNA, 22 nt, Human
ccaacucuugggcucaagcauc

SEQ ID NO: 15780 - RNA, 23 nt, Human
cugauuuugccacaccuccaucc

SEQ ID NO: 15781 - RNA, 21 nt, Human
cugcugccucucuuucacaca

SEQ ID NO: 15782 - RNA, 29 nt, Human
uugcaucuaggcugggcguggcggcucac

SEQ ID NO: 15783 - RNA, 23 nt, Human
cccaucauccugccccuguggca

SEQ ID NO: 15784 - RNA, 26 nt, Human
cuccugagcuccagucccugcuggau

SEQ ID NO: 15785 - RNA, 27 nt, Human
ccccugccuuaucucugccugcacgcc

SEQ ID NO: 15786 - RNA, 26 nt, Human
uuuuauuuggcuuguuuuauuuugga

SEQ ID NO: 15787 - RNA, 21 nt, Human
gaaagagaagacccagaguga

SEQ ID NO: 15788 - RNA, 25 nt, Human
uuuccacugcuauuagucaugguca

SEQ ID NO: 15789 - RNA, 22 nt, Human
ggcuggcugcccuugcaaagca

SEQ ID NO: 15790 - RNA, 25 nt, Human
agaacuaggagucuucacugcucug

SEQ ID NO: 15791 - RNA, 22 nt, Human
ccauaaacucuguuugcuuauu

SEQ ID NO: 15792 - RNA, 22 nt, Human
uguggugagccaacaucacacc

SEQ ID NO: 15793 - RNA, 29 nt, Human
uugggcugagagcaggaacaacgcgguag

SEQ ID NO: 15794 - RNA, 27 nt, Human
agacccuaaauccagccacgucaugcc

SEQ ID NO: 15795 - RNA, 21 nt, Human
ccuuccuguucugugucugcu

SEQ ID NO: 15796 - RNA, 20 nt, Human
aucuguaccuuaucaaacau

SEQ ID NO: 15797 - RNA, 19 nt, Human
uuauuuucaccuguuuuua

SEQ ID NO: 15798 - RNA, 20 nt, Human
ugagauucaaaucugccuuu

SEQ ID NO: 15799 - RNA, 22 nt, Human
guucacuccccucucaucgucc

SEQ ID NO: 15800 - RNA, 30 nt, Human
uccaggucugucaaguggccuuugucccug

SEQ ID NO: 15801 - RNA, 25 nt, Human
ucugccuggcggccaggccuccagc

SEQ ID NO: 15802 - RNA, 21 nt, Human
ucaccugcagccuaauuacuc

SEQ ID NO: 15803 - RNA, 19 nt, Human
uguucugaccucaugagug

SEQ ID NO: 15804 - RNA, 27 nt, Human
auacuauauugcuguaugguauaugca

SEQ ID NO: 15805 - RNA, 27 nt, Human
ugaaaccccaucucuacuggaaaugca

SEQ ID NO: 15806 - RNA, 25 nt, Human
cacagcugagagccaagcccaguuc

SEQ ID NO: 15807 - RNA, 22 nt, Human
uucugcugcuacugcugcugcc

SEQ ID NO: 15808 - RNA, 25 nt, Human
ccugccucccugccucccacccuca

SEQ ID NO: 15809 - RNA, 19 nt, Human
aaaauucuugcaaugagua

SEQ ID NO: 15810 - RNA, 22 nt, Human
uggugccaccaaacuccugcac

SEQ ID NO: 15811 - RNA, 23 nt, Human
accgaguuuauuuuucacuuacu

SEQ ID NO: 15812 - RNA, 24 nt, Human
ugaccacaggcugguguguaggug

SEQ ID NO: 15813 - RNA, 27 nt, Human
cucaauaaauacauuacuguacucugg

SEQ ID NO: 15814 - RNA, 23 nt, Human
ucuggcuuccuuucauugucuua

SEQ ID NO: 15815 - RNA, 27 nt, Human
gaggggcccgguggcggcagggccagg

SEQ ID NO: 15816 - RNA, 21 nt, Human
auucacgucccaucuuuuugg

SEQ ID NO: 15817 - RNA, 21 nt, Human
gccaccccauuaaagugcagu

SEQ ID NO: 15818 - RNA, 20 nt, Human
ucucccacccucgcucgcgu

SEQ ID NO: 15819 - RNA, 20 nt, Human
aguuauuuuuaggcacagca

SEQ ID NO: 15820 - RNA, 23 nt, Human
ucuaugacacaaaugaauugagg

SEQ ID NO: 15821 - RNA, 21 nt, Human
uuaaucuuuuucuuuaccucc

SEQ ID NO: 15822 - RNA, 32 nt, Human
gucacgaugcccagacuuggagcaaggcaacc

SEQ ID NO: 15823 - RNA, 22 nt, Human
ccgaucuccuccugccugggcc

SEQ ID NO: 15824 - RNA, 17 nt, Human
uaucucaaauguuaaua

SEQ ID NO: 15825 - RNA, 23 nt, Human
cucucuuccuccucagcgaacca

SEQ ID NO: 15826 - RNA, 26 nt, Human
gcaaaacugguugaacagcggaugaa

SEQ ID NO: 15827 - RNA, 20 nt, Human
aggccaucagauuagcaggg

SEQ ID NO: 15828 - RNA, 20 nt, Human
uuuucauuuucaagguuuac

SEQ ID NO: 15829 - RNA, 24 nt, Human
ugcuuuaugaauuaacagucuguu

SEQ ID NO: 15830 - RNA, 23 nt, Human
uugggaaagauaaaacucuagca

SEQ ID NO: 15831 - RNA, 23 nt, Human
cagaaccuggcuccagccagggg

SEQ ID NO: 15832 - RNA, 24 nt, Human
cuccaaugaccugaucauuuaguu

SEQ ID NO: 15833 - RNA, 22 nt, Human
caugcaugcuguugauuuuccu

SEQ ID NO: 15834 - RNA, 27 nt, Human
ugcuuucagaagugcccuuccugcugc

SEQ ID NO: 15835 - RNA, 23 nt, Human
cccggggcuguggcuggcagcuu

SEQ ID NO: 15836 - RNA, 27 nt, Human
cacaaagcucauacccagcccuaccaa

SEQ ID NO: 15837 - RNA, 24 nt, Human
ggcucacagcaaccucucugccuc

SEQ ID NO: 15838 - RNA, 28 nt, Human
ugggcagaguucaucuucuugaccuuug

SEQ ID NO: 15839 - RNA, 20 nt, Human
cgcccggccgggaggcagag

SEQ ID NO: 15840 - RNA, 18 nt, Human
cauguaaaucaaagccaa

SEQ ID NO: 15841 - RNA, 25 nt, Human
aguccacaaagcccauggccgaguc

SEQ ID NO: 15842 - RNA, 20 nt, Human
ucaggguuuguucccaccau

SEQ ID NO: 15843 - RNA, 22 nt, Human
cagcuuuguccccacugugcau

SEQ ID NO: 15844 - RNA, 27 nt, Human
ugucauugucuguccccacccggucgu

SEQ ID NO: 15845 - RNA, 21 nt, Human
agcugcugggcucaagcaauc

SEQ ID NO: 15846 - RNA, 21 nt, Human
uaaucgaacucaaauauuuua

SEQ ID NO: 15847 - RNA, 22 nt, Human
auaaucuaccucugccucucuc

SEQ ID NO: 15848 - RNA, 27 nt, Human
ucaggaggccgaggcagaagaauugcu

SEQ ID NO: 15849 - RNA, 22 nt, Human
gccucaguccuucaccuugcca

SEQ ID NO: 15850 - RNA, 27 nt, Human
ccuggucaccuaggaagccucagauuc

SEQ ID NO: 15851 - RNA, 23 nt, Human
gccagcuggccagccuccacucc

SEQ ID NO: 15852 - RNA, 22 nt, Human
uggcucaugucugcaaucccag

SEQ ID NO: 15853 - RNA, 24 nt, Human
uucuaaacugcauuccugugccca

SEQ ID NO: 15854 - RNA, 22 nt, Human
ccccaaaucuuccucuggagcu

SEQ ID NO: 15855 - RNA, 24 nt, Human
ucagcauuuguccuggguucccuu

SEQ ID NO: 15856 - RNA, 23 nt, Human
uuucauguaccccaggaaauacu

SEQ ID NO: 15857 - RNA, 26 nt, Human
gggaagagauuaccuagccuuacuaa

SEQ ID NO: 15858 - RNA, 21 nt, Human
ucuaauucauuuucucuuuag

SEQ ID NO: 15859 - RNA, 27 nt, Human
uuguccaagacauguacucucaguuug

SEQ ID NO: 15860 - RNA, 26 nt, Human
guggguggggguggggacggggguaa

SEQ ID NO: 15861 - RNA, 22 nt, Human
cagcucuucacaguccuggacu

SEQ ID NO: 15862 - RNA, 20 nt, Human
acacaauucacacauaacac

SEQ ID NO: 15863 - RNA, 26 nt, Human
uuugcugcugaccucggcugcuccuc

SEQ ID NO: 15864 - RNA, 23 nt, Human
ucccagccacccacacagcaccu

SEQ ID NO: 15865 - RNA, 21 nt, Human
caccagccugugauuugaugg

SEQ ID NO: 15866 - RNA, 22 nt, Human
uccucuugaaugauagugcaag

SEQ ID NO: 15867 - RNA, 23 nt, Human
ucucacuguguugcccaggcugg

SEQ ID NO: 15868 - RNA, 23 nt, Human
gcucuccucuugccacugccucu

SEQ ID NO: 15869 - RNA, 22 nt, Human
gauuucaugucuuccuccagca

SEQ ID NO: 15870 - RNA, 24 nt, Human
ucaggagacucagaguccucugug

SEQ ID NO: 15871 - RNA, 27 nt, Human
aaaaaugcucaugccaguuaaugccag

SEQ ID NO: 15872 - RNA, 22 nt, Human
ugaaacuauucauuuugcuucu

SEQ ID NO: 15873 - RNA, 22 nt, Human
ucaaagaacagccagugaggcc

SEQ ID NO: 15874 - RNA, 25 nt, Human
uccuuucuccacaccccccuuggcc

SEQ ID NO: 15875 - RNA, 21 nt, Human
aagacuucuggcuucauuuua

SEQ ID NO: 15876 - RNA, 22 nt, Human
agcaaauuuaccuuucucucca

SEQ ID NO: 15877 - RNA, 22 nt, Human
gaggaugaauaaaugugaucac

SEQ ID NO: 15878 - RNA, 22 nt, Human
uccaggcccagaguacugugag

SEQ ID NO: 15879 - RNA, 23 nt, Human
uccucuugugguuaaagacugaa

SEQ ID NO: 15880 - RNA, 27 nt, Human
ccccaccccccuuugggggucaggaac

SEQ ID NO: 15881 - RNA, 26 nt, Human
ggggguggggaggggggugagaagac

SEQ ID NO: 15882 - RNA, 24 nt, Human
gguagagggaggacacagagccgc

SEQ ID NO: 15883 - RNA, 20 nt, Human
ugugcuucuaguaggcacag

SEQ ID NO: 15884 - RNA, 22 nt, Human
caacauuucaaaugucucucca

SEQ ID NO: 15885 - RNA, 18 nt, Human
gcaaaacuuagaugugag

SEQ ID NO: 15886 - RNA, 27 nt, Human
acagauggcggaacgagagguucccug

SEQ ID NO: 15887 - RNA, 22 nt, Human
ccuauagaucauccuauucuua

SEQ ID NO: 15888 - RNA, 32 nt, Human
gccuggaaacuacaaaggauuguguuaauuuu

SEQ ID NO: 15889 - RNA, 20 nt, Human
ucuggaggacaagcaguuag

SEQ ID NO: 15890 - RNA, 22 nt, Human
ucccccagccauuccuucuuuc

SEQ ID NO: 15891 - RNA, 25 nt, Human
guccucacuuuuccuuccucucacg

SEQ ID NO: 15892 - RNA, 21 nt, Human
aagugguaucugacacacucu

SEQ ID NO: 15893 - RNA, 26 nt, Human
uuagccagaagcaggcuuguuuuccu

SEQ ID NO: 15894 - RNA, 19 nt, Human
ccuguucugucacuuguca

SEQ ID NO: 15895 - RNA, 21 nt, Human
aacaaaaccaguugcaccuua

SEQ ID NO: 15896 - RNA, 21 nt, Human
ccuguuauaccagcacuuugg

SEQ ID NO: 15897 - RNA, 25 nt, Human
ggcccagacccgggcuggggcgcgg

SEQ ID NO: 15898 - RNA, 28 nt, Human
gacacacaaaagcucuuuauguuauaaa

SEQ ID NO: 15899 - RNA, 23 nt, Human
gcuacacucgucccccuccugcc

SEQ ID NO: 15900 - RNA, 25 nt, Human
ccuucucagccucuggacucuccua

SEQ ID NO: 15901 - RNA, 23 nt, Human
aggcugagcaaacucauauucca

SEQ ID NO: 15902 - RNA, 27 nt, Human
uggaaacaccuguaggcagaggcugcc

SEQ ID NO: 15903 - RNA, 25 nt, Human
ggagacggccaagugaaggagccag

SEQ ID NO: 15904 - RNA, 19 nt, Human
accagccuguugcuguacu

SEQ ID NO: 15905 - RNA, 22 nt, Human
aaagguggggagaguggagcac

SEQ ID NO: 15906 - RNA, 27 nt, Human
ucaucccuguuccucaaggccaccugg

SEQ ID NO: 15907 - RNA, 27 nt, Human
aacugauuccaggagauuggauuugcu

SEQ ID NO: 15908 - RNA, 30 nt, Human; identical to SEQ ID NO: 7335

SEQ ID NO: 15909 - RNA, 25 nt, Human
agagaagauacuuucuagauaccgc

SEQ ID NO: 15910 - RNA, 22 nt, Human
ucugggaguuauaggucauggg

SEQ ID NO: 15911 - RNA, 22 nt, Human
acacgaaagaacccggucucca

SEQ ID NO: 15912 - RNA, 24 nt, Human
guaacaucaauauuuaaacauuuu

SEQ ID NO: 15913 - RNA, 26 nt, Human
cccuacaaagccuccucugcaugcca

SEQ ID NO: 15914 - RNA, 21 nt, Human
ucuguucuguuguuugugguu

SEQ ID NO: 15915 - RNA, 22 nt, Human
guuuuuccccccuccuucugcu

SEQ ID NO: 15916 - RNA, 28 nt, Human
cuauuuguaaauucuuaagcaaauagaa

SEQ ID NO: 15917 - RNA, 30 nt, Human
ccuauacuccucaggcuccuggguggccug

SEQ ID NO: 15918 - RNA, 27 nt, Human
cuaucuccccuuccucugucccccaac

SEQ ID NO: 15919 - RNA, 22 nt, Human
ugacaggaaugaaucucaccag

SEQ ID NO: 15920 - RNA, 28 nt, Human
cauucccuuucaucugugcucauacuuu

SEQ ID NO: 15921 - RNA, 21 nt, Human
guccugcuggggugggugggu

SEQ ID NO: 15922 - RNA, 24 nt, Human
ucccaggcuggagugcaauggugc

SEQ ID NO: 15923 - RNA, 20 nt, Human
aagagguccaaggcugcagu

SEQ ID NO: 15924 - RNA, 20 nt, Human
ugugaugccuuaggacaugu

SEQ ID NO: 15925 - RNA, 27 nt, Human
uugacacucucuaccaagagggucuuc

SEQ ID NO: 15926 - RNA, 22 nt, Human
acgggguuacaaaaagacauga

SEQ ID NO: 15927 - RNA, 21 nt, Human
guugcucaggcugaucucaaa

SEQ ID NO: 15928 - RNA, 19 nt, Human
aagaagcagcugcagcuga

SEQ ID NO: 15929 - RNA, 18 nt, Human
ugugaccuugaacaaguc

SEQ ID NO: 15930 - RNA, 21 nt, Human
ugucaguggcaggugccugaa

SEQ ID NO: 15931 - RNA, 21 nt, Human
gggcugggugcaguggcucau

SEQ ID NO: 15932 - RNA, 25 nt, Human
ugccaggcugggguguuuucgguau

SEQ ID NO: 15933 - RNA, 21 nt, Human
gggaaacacauuuacuugaau

SEQ ID NO: 15934 - RNA, 27 nt, Human
uuuguggacugguggccagucguauac

SEQ ID NO: 15935 - RNA, 21 nt, Human
gacaggcaccuguaaucccag

SEQ ID NO: 15936 - RNA, 21 nt, Human
cccaucucaucugucagccac

SEQ ID NO: 15937 - RNA, 19 nt, Human
caguucugcagggcugcuc

SEQ ID NO: 15938 - RNA, 27 nt, Human
uuaguaaugucugcaacaaugacauuu

SEQ ID NO: 15939 - RNA, 27 nt, Human
cccucauucccucgggacccucccagu

SEQ ID NO: 15940 - RNA, 22 nt, Human
aucucagcccacaucucagccc

SEQ ID NO: 15941 - RNA, 23 nt, Human
ugagcucacagagauguguauua

SEQ ID NO: 15942 - RNA, 23 nt, Human
cuugaaacuaauaaaaugaguua

SEQ ID NO: 15943 - RNA, 23 nt, Human
gcgccugccuccccacugcucug

SEQ ID NO: 15944 - RNA, 20 nt, Human
uggugaggggcucagaggaa

SEQ ID NO: 15945 - RNA, 27 nt, Human
gucgcaucuucuccagcgcugggcccu

SEQ ID NO: 15946 - RNA, 20 nt, Human
aggcugaggacuuaaaauau

SEQ ID NO: 15947 - RNA, 20 nt, Human
cucaauaaggcagugcagug

SEQ ID NO: 15948 - RNA, 22 nt, Human
uggugcaugccuguaaucccag

SEQ ID NO: 15949 - RNA, 22 nt, Human
uggcgcaugccuguaauccuag

SEQ ID NO: 15950 - RNA, 27 nt, Human
ggcaaagcagcaguucuaccaagccca

SEQ ID NO: 15951 - RNA, 23 nt, Human
uuuuagaaucuggacacuuucua

SEQ ID NO: 15952 - RNA, 24 nt, Human
uuuguuuuagaggcaaguuuagca

SEQ ID NO: 15953 - RNA, 17 nt, Human
ucccugcuuugcuguga

SEQ ID NO: 15954 - RNA, 21 nt, Human
ccuuccugaauucuuuaaaua

SEQ ID NO: 15955 - RNA, 22 nt, Human
acaucccgcuucgccucccucc

SEQ ID NO: 15956 - RNA, 20 nt, Human
cuggcagcagaaauccauga

SEQ ID NO: 15957 - RNA, 22 nt, Human
acuagugccaaugaugugaccc

SEQ ID NO: 15958 - RNA, 21 nt, Human
aguuauuaauagccagagcca

SEQ ID NO: 15959 - RNA, 22 nt, Human
cauuuugguaaaauacuucuug

SEQ ID NO: 15960 - RNA, 18 nt, Human
aaauguucacuggcauuu

SEQ ID NO: 15961 - RNA, 22 nt, Human
ggcuuugcuggucuuucuugga

SEQ ID NO: 15962 - RNA, 26 nt, Human
gacucaugggaccugaagggugacau

SEQ ID NO: 15963 - RNA, 21 nt, Human
aaaugcccaaauuugagaugc

SEQ ID NO: 15964 - RNA, 20 nt, Human
ccauccacugcccaugaccc

SEQ ID NO: 15965 - RNA, 19 nt, Human
agaaaaauuugaagucuga

SEQ ID NO: 15966 - RNA, 20 nt, Human
uucaagguuaagccauucug

SEQ ID NO: 15967 - RNA, 28 nt, Human
gggcaagaaagacgcaagcccagaggcc

SEQ ID NO: 15968 - RNA, 22 nt, Human
uuagcucuacuggaauuuucau

SEQ ID NO: 15969 - RNA, 22 nt, Human
ucauggaauuucgggaucaugu

SEQ ID NO: 15970 - RNA, 24 nt, Human
augugcaagguguccaaacugaca

SEQ ID NO: 15971 - RNA, 24 nt, Human
uuucaaagguagccaucauggauc

SEQ ID NO: 15972 - RNA, 24 nt, Human
cggccgccccucuucccuucccac

SEQ ID NO: 15973 - RNA, 21 nt, Human
guggcuuuaaucccagcacuu

SEQ ID NO: 15974 - RNA, 21 nt, Human
ucaagauuccauuucuuaaca

SEQ ID NO: 15975 - RNA, 22 nt, Human
caccauggucaaaacggauuag

SEQ ID NO: 15976 - RNA, 23 nt, Human
caccugaggucaggauucaaaac

SEQ ID NO: 15977 - RNA, 24 nt, Human
uauccagaguggaacccaggcugg

SEQ ID NO: 15978 - RNA, 22 nt, Human
ggcuuuucuguaauaagcuucc

SEQ ID NO: 15979 - RNA, 26 nt, Human
cgucuuuagagacaggcacaugggca

SEQ ID NO: 15980 - RNA, 22 nt, Human
guaacuugcccauuucuccaca

SEQ ID NO: 15981 - RNA, 23 nt, Human
ucuccaguuugcaccugucccca

SEQ ID NO: 15982 - RNA, 28 nt, Human
acuuucugcucauaucauaaccaggucc

SEQ ID NO: 15983 - RNA, 23 nt, Human
agcagagaaaacuggaagaagau

SEQ ID NO: 15984 - RNA, 22 nt, Human
ccaaaaugcugggauuacaggc

SEQ ID NO: 15985 - RNA, 22 nt, Human
auugcuugagcccagaaguucg

SEQ ID NO: 15986 - RNA, 26 nt, Human
gcaguguaggaauucuauugaguggc

SEQ ID NO: 15987 - RNA, 27 nt, Human
agugucaggaucgcgggcuugcuuucc

SEQ ID NO: 15988 - RNA, 22 nt, Human
acacagaaagagucaucugaug

SEQ ID NO: 15989 - RNA, 26 nt, Human
aucucaguuuaaauuaccuagcuaaa

SEQ ID NO: 15990 - RNA, 22 nt, Human
uguugccaaggcuggagugcag

SEQ ID NO: 15991 - RNA, 22 nt, Human
uguugcccaggcuggcgugcag

SEQ ID NO: 15992 - RNA, 25 nt, Human
uggcugaccacaugguuaaaugcau

SEQ ID NO: 15993 - RNA, 23 nt, Human
uugaagccccaggugccacuuug

SEQ ID NO: 15994 - RNA, 19 nt, Human
ccagcacuuuggaaggccg

SEQ ID NO: 15995 - RNA, 22 nt, Human
ccgggaggugggaguuguagug

SEQ ID NO: 15996 - RNA, 23 nt, Human
acucuggguucuacugcuaggca

SEQ ID NO: 15997 - RNA, 21 nt, Human
cugacccccauagcagcagug

SEQ ID NO: 15998 - RNA, 20 nt, Human
agcaaacuaacagaaauaca

SEQ ID NO: 15999 - RNA, 23 nt, Human
augcauuguaacuacaaauuuua

SEQ ID NO: 16000 - RNA, 17 nt, Human
gccugcgccugcaccug

SEQ ID NO: 16001 - RNA, 22 nt, Human
gucccauucacuucugugaucc

SEQ ID NO: 16002 - RNA, 24 nt, Human
agcauacaacaugagcaaagcuuu

SEQ ID NO: 16003 - RNA, 22 nt, Human
ugggguggugggcaguggggaa

SEQ ID NO: 16004 - RNA, 23 nt, Human
ggauaggggcggcccggagccag

SEQ ID NO: 16005 - RNA, 21 nt, Human
agcaucagucccccacuuggg

SEQ ID NO: 16006 - RNA, 26 nt, Human
gcugagaucuuuccuccugguuacug

SEQ ID NO: 16007 - RNA, 22 nt, Human
aggcucaggucccuggggcuag

SEQ ID NO: 16008 - RNA, 22 nt, Human
gcugcuugcccugccaaugcaa

SEQ ID NO: 16009 - RNA, 20 nt, Human
uaaagacugacuacugugug

SEQ ID NO: 16010 - RNA, 26 nt, Human
acugucagacaaauagaaacacugcc

SEQ ID NO: 16011 - RNA, 23 nt, Human
ggauauuuauggcuguaaaauag

SEQ ID NO: 16012 - RNA, 20 nt, Human
uaauguucauugacuggcuu

SEQ ID NO: 16013 - RNA, 20 nt, Human
uaacuugccaggcucuagca

SEQ ID NO: 16014 - RNA, 22 nt, Human
uguucauaaaaaauaacaacug

SEQ ID NO: 16015 - RNA, 27 nt, Human
gcaggcucggauggacuauagcuuuga

SEQ ID NO: 16016 - RNA, 21 nt, Human
gucaccaaggcuuagugcagu

SEQ ID NO: 16017 - RNA, 29 nt, Human
ucuccuagccccucucucacacaucacau

SEQ ID NO: 16018 - RNA, 21 nt, Human
gcuucauacggaaaguguuug

SEQ ID NO: 16019 - RNA, 27 nt, Human
agaagcagugugagcagggcugacucc

SEQ ID NO: 16020 - RNA, 22 nt, Human
ggaaauuuaucauguuuaaaaa

SEQ ID NO: 16021 - RNA, 25 nt, Human
aaguugugcuuuguggggacaauca

SEQ ID NO: 16022 - RNA, 29 nt, Human
cauacacacacaaauacacaaucucuagg

SEQ ID NO: 16023 - RNA, 22 nt, Human
uucauucuuugaaggauuuacu

SEQ ID NO: 16024 - RNA, 22 nt, Human
uaccuccuggguucaagugauu

SEQ ID NO: 16025 - RNA, 19 nt, Human
cugcucccugcuccguccc

SEQ ID NO: 16026 - RNA, 20 nt, Human
ccuugcuugugcccugggcc

SEQ ID NO: 16027 - RNA, 26 nt, Human
uucaaugccuuagccaaggaguccag

SEQ ID NO: 16028 - RNA, 22 nt, Human
cacuucucuguguucugccucc

SEQ ID NO: 16029 - RNA, 22 nt, Human
ccugccugcuuacgcgcgcugc

SEQ ID NO: 16030 - RNA, 23 nt, Human
acagcacuuuuccucuucuagau

SEQ ID NO: 16031 - RNA, 21 nt, Human
cugaguguugagcagugucau

SEQ ID NO: 16032 - RNA, 26 nt, Human
ggacucugccuuuuuguugguaggga

SEQ ID NO: 16033 - RNA, 20 nt, Human
gugccagcagcugcugccuu

SEQ ID NO: 16034 - RNA, 23 nt, Human
uaaagacuccguguaacugugug

SEQ ID NO: 16035 - RNA, 26 nt, Human
aggcggcauuagaggaaguccuggcu

SEQ ID NO: 16036 - RNA, 22 nt, Human
uguucuuccuccagcugcacca

SEQ ID NO: 16037 - RNA, 23 nt, Human
ucagcaaugccuuccuggaccac

SEQ ID NO: 16038 - RNA, 19 nt, Human
agagacacuaacgacuuca

SEQ ID NO: 16039 - RNA, 17 nt, Human
ccaaagugccuucugag

SEQ ID NO: 16040 - RNA, 20 nt, Human
aaaaguagcuggaguuaggu

SEQ ID NO: 16041 - RNA, 20 nt, Human
ucaccucccuacuccuguca

SEQ ID NO: 16042 - RNA, 17 nt, Human
acuguaaccucagucua

SEQ ID NO: 16043 - RNA, 19 nt, Human
uuuccaaaacugguacuua

SEQ ID NO: 16044 - RNA, 26 nt, Human
gcucuuuguggcaguggccaggcagg

SEQ ID NO: 16045 - RNA, 26 nt, Human
cuguggcuuggggucgggagugcagg

SEQ ID NO: 16046 - RNA, 16 nt, Human
cgcuuccuccaccuca

SEQ ID NO: 16047 - RNA, 21 nt, Human
gugggguggaagcuuggggaa

SEQ ID NO: 16048 - RNA, 26 nt, Human
gcauggucucuucaccgcugcccucg

SEQ ID NO: 16049 - RNA, 21 nt, Human
aagcagccagcucaucccagu

SEQ ID NO: 16050 - RNA, 22 nt, Human
uuccauucaaaauauguauuca

SEQ ID NO: 16051 - RNA, 20 nt, Human
uaucuaugcugaguauuuuc

SEQ ID NO: 16052 - RNA, 22 nt, Human
uacacggaugccuuccccuggg

SEQ ID NO: 16053 - RNA, 19 nt, Human
ugcauauauucacauucac

SEQ ID NO: 16054 - RNA, 19 nt, Human
agccggguaugguggugca

SEQ ID NO: 16055 - RNA, 25 nt, Human
guguagcuaugugcugcugcugcuc

SEQ ID NO: 16056 - RNA, 27 nt, Human
ucuguuccccuugaaccuguguggacc

SEQ ID NO: 16057 - RNA, 24 nt, Human
ggagaggcccucuggaguggccac

SEQ ID NO: 16058 - RNA, 21 nt, Human
accaaaaccacagugccgaca

SEQ ID NO: 16059 - RNA, 26 nt, Human
ggcccuccagcuccccuccaguuacc

SEQ ID NO: 16060 - RNA, 19 nt, Human
gggaggaagcagaggcaga

SEQ ID NO: 16061 - RNA, 21 nt, Human
gucuagccgccgcccccagcc

SEQ ID NO: 16062 - RNA, 21 nt, Human
ggccucugcuggucucuggcu

SEQ ID NO: 16063 - RNA, 21 nt, Human
cuucuuucucagaccucaguc

SEQ ID NO: 16064 - RNA, 23 nt, Human
ugcauuuuccuaauaugccuuua

SEQ ID NO: 16065 - RNA, 30 nt, Human
cuucugucuguuuaaaccucaggauggcuc

SEQ ID NO: 16066 - RNA, 20 nt, Human
cccauacucccucguugaca

SEQ ID NO: 16067 - RNA, 22 nt, Human
gagcacccuucucuucuugccg

SEQ ID NO: 16068 - RNA, 22 nt, Human
guccucuggcugcugagcuggg

SEQ ID NO: 16069 - RNA, 23 nt, Human
cuuguauuggccaucuggaauau

SEQ ID NO: 16070 - RNA, 23 nt, Human
cuucauuuacucauuguaaauac

SEQ ID NO: 16071 - RNA, 20 nt, Human
guuuggguuuuaauuacaca

SEQ ID NO: 16072 - RNA, 22 nt, Human
gugguaucuggagcauugugua

SEQ ID NO: 16073 - RNA, 20 nt, Human
aagcaguuauucucucucca

SEQ ID NO: 16074 - RNA, 27 nt, Human
acugccucugcucucuugucuucagac

SEQ ID NO: 16075 - RNA, 23 nt, Human
ugcgcggagcuggaguccggcug

SEQ ID NO: 16076 - RNA, 23 nt, Human
acuguucuuugucagauucuucc

SEQ ID NO: 16077 - RNA, 23 nt, Human
aucucgggguccaucugugauau

SEQ ID NO: 16078 - RNA, 20 nt, Human
ggauaggauaaggaaccuga

SEQ ID NO: 16079 - RNA, 22 nt, Human
cgggcuuguguucucccucuca

SEQ ID NO: 16080 - RNA, 27 nt, Human
agguauucucuccaucuguuaaacaca

SEQ ID NO: 16081 - RNA, 27 nt, Human
auugcuugagcccaggaguucgaggcu

SEQ ID NO: 16082 - RNA, 21 nt, Human
cugcaccccuuccugggacac

SEQ ID NO: 16083 - RNA, 22 nt, Human
agauguuaauaaaauuuaagga

SEQ ID NO: 16084 - RNA, 22 nt, Human
agaacuccagccccgcuacuua

SEQ ID NO: 16085 - RNA, 21 nt, Human
gcuugugaucccagcacuuug

SEQ ID NO: 16086 - RNA, 19 nt, Human
ccccuggccucucuuccca

SEQ ID NO: 16087 - RNA, 21 nt, Human
ccaccuccccaccccaaaaag

SEQ ID NO: 16088 - RNA, 22 nt, Human
cucagucccucccagcugcagu

SEQ ID NO: 16089 - RNA, 24 nt, Human
acucuacgaguugugcagaaagau

SEQ ID NO: 16090 - RNA, 20 nt, Human
cuagcuguuuuuaccuaguu

SEQ ID NO: 16091 - RNA, 24 nt, Human
gauuuuaaaguaaagauguauuua

SEQ ID NO: 16092 - RNA, 21 nt, Human
ugcugaaucacuaaaugacca

SEQ ID NO: 16093 - RNA, 24 nt, Human
gugucccagggcccaaaagucaga

SEQ ID NO: 16094 - RNA, 26 nt, Human
gagaauuggccauccugaggacacag

SEQ ID NO: 16095 - RNA, 24 nt, Human
ucaugccacugggccugcuagucu

SEQ ID NO: 16096 - RNA, 25 nt, Human
uggggugcaggaccuguccaccuca

SEQ ID NO: 16097 - RNA, 22 nt, Human
guggcccaggcuggagugcagu

SEQ ID NO: 16098 - RNA, 26 nt, Human
aagaucacuuugucaccagcccuggg

SEQ ID NO: 16099 - RNA, 22 nt, Human
auugcuugaagcuaggaguuug

SEQ ID NO: 16100 - RNA, 23 nt, Human
accugaaaacaaauuauucauuu

SEQ ID NO: 16101 - RNA, 20 nt, Human
aguccugcuggaucuugccu

SEQ ID NO: 16102 - RNA, 27 nt, Human
aacuguuuuucaaaacgccauguccua

SEQ ID NO: 16103 - RNA, 23 nt, Human
augccugggaucagaagcauuuu

SEQ ID NO: 16104 - RNA, 24 nt, Human
uuauaacuuuguuauuacauugug

SEQ ID NO: 16105 - RNA, 28 nt, Human
aagagcccucuuuccacgagacugaagu

SEQ ID NO: 16106 - RNA, 22 nt, Human
cagucguauccuggugaauguc

SEQ ID NO: 16107 - RNA, 20 nt, Human
gcaacagcaaacaggugcua

SEQ ID NO: 16108 - RNA, 25 nt, Human
ggguuggcaccugcacacuccaucu

SEQ ID NO: 16109 - RNA, 24 nt, Human
gcugcugcugcgcccuuaccuucc

SEQ ID NO: 16110 - RNA, 27 nt, Human
cgcuguuacccaggcuggagugcaaug

SEQ ID NO: 16111 - RNA, 23 nt, Human
aacacuguuucugguaaugaagc

SEQ ID NO: 16112 - RNA, 27 nt, Human
aaggcauucucccagcucuagccucug

SEQ ID NO: 16113 - RNA, 23 nt, Human
ugucgcucaggcuggagugcagu

SEQ ID NO: 16114 - RNA, 25 nt, Human
gccacagccacucgccuuccuaccc

SEQ ID NO: 16115 - RNA, 21 nt, Human
cauugauuggugcccacccag

SEQ ID NO: 16116 - RNA, 21 nt, Human
guuagcugauuaacccaugua

SEQ ID NO: 16117 - RNA, 22 nt, Human
agcucacugcagccuuguccuc

SEQ ID NO: 16118 - RNA, 24 nt, Human
gcucggcaugugaauucuuagcuc

SEQ ID NO: 16119 - RNA, 23 nt, Human
cgaguagcugggauuagaggcgc

SEQ ID NO: 16120 - RNA, 26 nt, Human
cccuuccaguuuuccccuugcuuccc

SEQ ID NO: 16121 - RNA, 21 nt, Human
gccuuucuuucccgcuaggcu

SEQ ID NO: 16122 - RNA, 21 nt, Human
uuaucuuacugggacauuuuc

SEQ ID NO: 16123 - RNA, 26 nt, Human
aggcugaggacuuugcccaggaugac

SEQ ID NO: 16124 - RNA, 20 nt, Human
uuauuucucauaaguaccca

SEQ ID NO: 16125 - RNA, 27 nt, Human
ccugccuuccagugccccaccacccuu

SEQ ID NO: 16126 - RNA, 23 nt, Human
augucacugcagauugagaccua

SEQ ID NO: 16127 - RNA, 21 nt, Human
agccucugaguagcugggauu

SEQ ID NO: 16128 - RNA, 27 nt, Human
accuuugcugaguuccggggugcaaug

SEQ ID NO: 16129 - RNA, 22 nt, Human
ggccucccaaagugcugggauu

SEQ ID NO: 16130 - RNA, 22 nt, Human
agccucccaaagugcuaggauu

SEQ ID NO: 16131 - RNA, 25 nt, Human
gaggcuucuuagaagcuuaaacccc

SEQ ID NO: 16132 - RNA, 22 nt, Human
aggcugagaaacucagccucua

SEQ ID NO: 16133 - RNA, 27 nt, Human
ugcucuucuccuucugcugcugccauc

SEQ ID NO: 16134 - RNA, 21 nt, Human
cucuguagacuggaucuguuu

SEQ ID NO: 16135 - RNA, 24 nt, Human
cugucacuuguuuccuuuucuccc

SEQ ID NO: 16136 - RNA, 22 nt, Human
gccauggucccaggcuucccaa

SEQ ID NO: 16137 - RNA, 22 nt, Human
cuucgcuuuauuuuuguaagua

SEQ ID NO: 16138 - RNA, 20 nt, Human
cugagucugacucaucucug

SEQ ID NO: 16139 - RNA, 21 nt, Human
uugccaggcuagagugcagug

SEQ ID NO: 16140 - RNA, 25 nt, Human
ucuuuauuccucccucaugagcaca

SEQ ID NO: 16141 - RNA, 23 nt, Human
cauagagaauaagcuggucucca

SEQ ID NO: 16142 - RNA, 27 nt, Human
cccugcucccucugccacuguggacac

SEQ ID NO: 16143 - RNA, 26 nt, Human
ccugcacuccgccuuaguccuggggc

SEQ ID NO: 16144 - RNA, 26 nt, Human
gaagcuguucucccacuguuccccua

SEQ ID NO: 16145 - RNA, 23 nt, Human
gcuccucugugccuaggccuuac

SEQ ID NO: 16146 - RNA, 22 nt, Human
ugcccuuucugacuguguucuc

SEQ ID NO: 16147 - RNA, 23 nt, Human
gggagagaggagcgaagauccgg

SEQ ID NO: 16148 - RNA, 28 nt, Human
ucaacugcugcuucaccagacuuuucuc

SEQ ID NO: 16149 - RNA, 16 nt, Human
uugaaucuugcugcua

SEQ ID NO: 16150 - RNA, 26 nt, Human
uccagccugggugacauagcaagacc

SEQ ID NO: 16151 - RNA, 19 nt, Human
ccucuacugacuucucucc

SEQ ID NO: 16152 - RNA, 25 nt, Human
ucacaugccccucuuagaagaaaua

SEQ ID NO: 16153 - RNA, 27 nt, Human
uaccaugguugugcacaugcuucagaa

SEQ ID NO: 16154 - RNA, 23 nt, Human
ugccuucaugaccuacacaaugu

SEQ ID NO: 16155 - RNA, 24 nt, Human
gccccuuccccaggcccaccauca

SEQ ID NO: 16156 - RNA, 21 nt, Human
cuguguagcaccagcccuggg

SEQ ID NO: 16157 - RNA, 27 nt, Human
auuuucuguuacugcuauaucuacgug

SEQ ID NO: 16158 - RNA, 21 nt, Human
gggcuggagggagccggggca

SEQ ID NO: 16159 - RNA, 21 nt, Human
gcugcacuccagccugcggga

SEQ ID NO: 16160 - RNA, 23 nt, Human
ucagccggcccuggagugcgggc

SEQ ID NO: 16161 - RNA, 21 nt, Human
agcuccugaguagcugggauu

SEQ ID NO: 16162 - RNA, 25 nt, Human
cccuccuccuguguagcugccaccu

SEQ ID NO: 16163 - RNA, 23 nt, Human
ugucugggaaaaggucacuggac

SEQ ID NO: 16164 - RNA, 22 nt, Human
cuggguggaccuaagguuccuu

SEQ ID NO: 16165 - RNA, 20 nt, Human
uuaacuggugaaauuuaaag

SEQ ID NO: 16166 - RNA, 19 nt, Human
gaaguuacagaugaggcac

SEQ ID NO: 16167 - RNA, 24 nt, Human
acguuucugaacaauggggacuuu

SEQ ID NO: 16168 - RNA, 23 nt, Human
gucuuguucuuccaauugguaua

SEQ ID NO: 16169 - RNA, 23 nt, Human
cagaauuauaauuaguuccucau

SEQ ID NO: 16170 - RNA, 27 nt, Human
uggaugucauauuggcaguuggaggac

SEQ ID NO: 16171 - RNA, 25 nt, Human
gcuuggaaagggaagaucuuaugcc

SEQ ID NO: 16172 - RNA, 22 nt, Human
ccauccuaacauuaccaaaagu

SEQ ID NO: 16173 - RNA, 26 nt, Human
cagacugcuacagcugcuccccuccc

SEQ ID NO: 16174 - RNA, 23 nt, Human
cuauuccucucuaccuuuaagga

SEQ ID NO: 16175 - RNA, 18 nt, Human
cagguuagggugugugcc

SEQ ID NO: 16176 - RNA, 23 nt, Human
cagcuguuuuuaggcuguuccuu

SEQ ID NO: 16177 - RNA, 27 nt, Human
uaggcuuuugcuugcuaucuaaguguu

SEQ ID NO: 16178 - RNA, 26 nt, Human
ugcccagguggaguuagaaagucaaa

SEQ ID NO: 16179 - RNA, 27 nt, Human
acuaagcucgcagcaagcggcuacccc

SEQ ID NO: 16180 - RNA, 25 nt, Human
ggggucgcggaagggaauggauaga

SEQ ID NO: 16181 - RNA, 26 nt, Human
ggcucuugaucagugugcuaaccuca

SEQ ID NO: 16182 - RNA, 23 nt, Human
uucagcuuucccagcugaucuga

SEQ ID NO: 16183 - RNA, 23 nt, Human
gccagugccauggggaaggggcu

SEQ ID NO: 16184 - RNA, 20 nt, Human
gucagaguuccguacucggg

SEQ ID NO: 16185 - RNA, 29 nt, Human
gccauuuccauccugcagaagaagccccg

SEQ ID NO: 16186 - RNA, 23 nt, Human
gaagcugcugcagcucccuccuc

SEQ ID NO: 16187 - RNA, 22 nt, Human
aucgcuugaacccgggcggcgg

SEQ ID NO: 16188 - RNA, 28 nt, Human
cucgugcaggaaguacucaucgacugau

SEQ ID NO: 16189 - RNA, 25 nt, Human
cuuacaggaaccaccuacucuuuca

SEQ ID NO: 16190 - RNA, 21 nt, Human
gcccagcuggaguaggagcgc

SEQ ID NO: 16191 - RNA, 25 nt, Human
gccuccugaauuuauuauuguucuu

SEQ ID NO: 16192 - RNA, 21 nt, Human
ccacugaggagcuuuguuuca

SEQ ID NO: 16193 - RNA, 27 nt, Human
aaagugcugggauuacaggcuugaaag

SEQ ID NO: 16194 - RNA, 25 nt, Human
gaccucgggugauccacccaccuca

SEQ ID NO: 16195 - RNA, 22 nt, Human
ccuuucugugguaauacuacug

SEQ ID NO: 16196 - RNA, 21 nt, Human
uauuuucccuuccuuauuuua

SEQ ID NO: 16197 - RNA, 25 nt, Human
uuggggccugggcucccccucucug

SEQ ID NO: 16198 - RNA, 25 nt, Human
gucgguuaugggguuggagugccga

SEQ ID NO: 16199 - RNA, 24 nt, Human
uuuacuuccucuuuucuaaucuga

SEQ ID NO: 16200 - RNA, 26 nt, Human
ggagagagcuggaaggaaggagccag

SEQ ID NO: 16201 - RNA, 28 nt, Human
agcacuguuccagccugcccucuucauu

SEQ ID NO: 16202 - RNA, 22 nt, Human
accagggcagagaggucagggc

SEQ ID NO: 16203 - RNA, 21 nt, Human
gggaagggaggcgaaggccug

SEQ ID NO: 16204 - RNA, 27 nt, Human
aucuuuacaagcauagcugccugcacu

SEQ ID NO: 16205 - RNA, 20 nt, Human
cagauuauucaucuuguuag

SEQ ID NO: 16206 - RNA, 24 nt, Human
uucaguuuugaaucaguauuguua

SEQ ID NO: 16207 - RNA, 20 nt, Human
ccugcccgcccgccugcugc

SEQ ID NO: 16208 - RNA, 24 nt, Human
cucccugcucccggcucugaggcu

SEQ ID NO: 16209 - RNA, 27 nt, Human
ccaagcccuuagggaccgcagaggacu

SEQ ID NO: 16210 - RNA, 27 nt, Human
acugccuucuccucucugggccuuugu

SEQ ID NO: 16211 - RNA, 19 nt, Human
aagcucucgcagugcagug

SEQ ID NO: 16212 - RNA, 24 nt, Human
guuagaugaaucagugcccaagac

SEQ ID NO: 16213 - RNA, 18 nt, Human
aaguguccucagguuuca

SEQ ID NO: 16214 - RNA, 22 nt, Human
agaccuuuuuuccacugcccag

SEQ ID NO: 16215 - RNA, 22 nt, Human
uacugcacuccagccuggguga

SEQ ID NO: 16216 - RNA, 22 nt, Human
aguggugcuucaacugguaucu

SEQ ID NO: 16217 - RNA, 27 nt, Human
uuagaaaacaguuuguagacaaugauu

SEQ ID NO: 16218 - RNA, 27 nt, Human
ccugccugaggacucaccugccuggga

SEQ ID NO: 16219 - RNA, 21 nt, Human
auggggauggaggaggaaggc

SEQ ID NO: 16220 - RNA, 22 nt, Human
aaucagugccugguguucugaa

SEQ ID NO: 16221 - RNA, 23 nt, Human
uccaaaguagcugggauuacagg

SEQ ID NO: 16222 - RNA, 22 nt, Human
ucuucacuuccuucuaaagaga

SEQ ID NO: 16223 - RNA, 22 nt, Human
caaaugcauggcaaaucugucg

SEQ ID NO: 16224 - RNA, 27 nt, Human
uucugacccuucugaaaaauaacuaca

SEQ ID NO: 16225 - RNA, 22 nt, Human
gcuuaagauccugucauaguuu

SEQ ID NO: 16226 - RNA, 23 nt, Human
ggccuuuaguaaugaauguaaug

SEQ ID NO: 16227 - RNA, 24 nt, Human
ggaggggcuccguguagcaaccca

SEQ ID NO: 16228 - RNA, 25 nt, Human
uuuggagcuuggugaggaggguggg

SEQ ID NO: 16229 - RNA, 27 nt, Human
ggcucacaccuguaaucccagcacuuu

SEQ ID NO: 16230 - RNA, 25 nt, Human
uucagugcuggagguccuggcaggg

SEQ ID NO: 16231 - RNA, 21 nt, Human
uucuuuaccaguuucugauuu

SEQ ID NO: 16232 - RNA, 21 nt, Human
ggguuccaguucugguucugc

SEQ ID NO: 16233 - RNA, 22 nt, Human
ugcagugagcugagaucgcgcc

SEQ ID NO: 16234 - RNA, 22 nt, Human
uacagugagccgagaucaugcc

SEQ ID NO: 16235 - RNA, 22 nt, Human
ugcagugagccgagaucgugcc

SEQ ID NO: 16236 - RNA, 20 nt, Human
aaacccagcucacaggagcu

SEQ ID NO: 16237 - RNA, 22 nt, Human
ccaaccucacugacacaggguc

SEQ ID NO: 16238 - RNA, 21 nt, Human
ugagcuaagaucacaccacua

SEQ ID NO: 16239 - RNA, 26 nt, Human
ggagguggagcagcgggcguccccga

SEQ ID NO: 16240 - RNA, 22 nt, Human
auugggcaccuacuaugugcca

SEQ ID NO: 16241 - RNA, 27 nt, Human
uuaaucaaagaucaucucacgcugauc

SEQ ID NO: 16242 - RNA, 29 nt, Human
guggaaauagaagcaaaugacaaaaagcc

SEQ ID NO: 16243 - RNA, 27 nt, Human
ccuaggugucugcugugaaccuccagu

SEQ ID NO: 16244 - RNA, 19 nt, Human
ucagaaguacaugaggggc

SEQ ID NO: 16245 - RNA, 25 nt, Human
uguauucuuaaaaucugcauuuguu

SEQ ID NO: 16246 - RNA, 21 nt, Human
ccugcccugccuccuccauca

SEQ ID NO: 16247 - RNA, 23 nt, Human
auugauuucugccuuccuugcua

SEQ ID NO: 16248 - RNA, 22 nt, Human
aggccuccuguccacaccagcg

SEQ ID NO: 16249 - RNA, 21 nt, Human
agaccagccugccaacauggu

SEQ ID NO: 16250 - RNA, 24 nt, Human
gcacuaugcugagcuuacacuaau

SEQ ID NO: 16251 - RNA, 21 nt, Human
auucauugucccuuucuugaa

SEQ ID NO: 16252 - RNA, 22 nt, Human
gcagugcccugcccugcccugc

SEQ ID NO: 16253 - RNA, 26 nt, Human
cugccucuggcugccugcguccucuc

SEQ ID NO: 16254 - RNA, 25 nt, Human
agcuuucagacagagcccacuuagc

SEQ ID NO: 16255 - RNA, 31 nt, Human
cgcaggaagaggucaucaucaugucggacga

SEQ ID NO: 16256 - RNA, 27 nt, Human
uuaguaaucuacaaaggaaauaucaaa

SEQ ID NO: 16257 - RNA, 25 nt, Human
aguauacuagaaucauggauugcug

SEQ ID NO: 16258 - RNA, 26 nt, Human
ccugccugccccuacccuggacuugc

SEQ ID NO: 16259 - RNA, 24 nt, Human
cuggaaggcccuggaaggagaagc

SEQ ID NO: 16260 - RNA, 24 nt, Human
ccccguaacccccuccugccucca

SEQ ID NO: 16261 - RNA, 20 nt, Human
ccagaucuaccauuaauaga

SEQ ID NO: 16262 - RNA, 24 nt, Human
gcuggccacagccagguuuucccu

SEQ ID NO: 16263 - RNA, 22 nt, Human
accgagcacauaccaugugcca

SEQ ID NO: 16264 - RNA, 22 nt, Human
aucucugagcaguggggagugg

SEQ ID NO: 16265 - RNA, 27 nt, Human
ucucaguucguguuugauuccauucca

SEQ ID NO: 16266 - RNA, 23 nt, Human
uguccuggccucagucuugcuag

SEQ ID NO: 16267 - RNA, 23 nt, Human
gacgggguuucuccguguugguc

SEQ ID NO: 16268 - RNA, 19 nt, Human
cuccacccccgccacggcc

SEQ ID NO: 16269 - RNA, 21 nt, Human
auuuuguuugcuucauguguc

SEQ ID NO: 16270 - RNA, 20 nt, Human
caccgaggcuggagugcagu

SEQ ID NO: 16271 - RNA, 25 nt, Human
caguuucaaaugcuugcuugcuuuc

SEQ ID NO: 16272 - RNA, 28 nt, Human
cgcaccguggcuggaguccugagcagca

SEQ ID NO: 16273 - RNA, 21 nt, Human
cuggaaguuuaaaaauguaca

SEQ ID NO: 16274 - RNA, 22 nt, Human
uucucuauuuuacuuuucugcc

SEQ ID NO: 16275 - RNA, 22 nt, Human
acucacugcagagcugcugccu

SEQ ID NO: 16276 - RNA, 21 nt, Human
aaguuccugggcucaaagaug

SEQ ID NO: 16277 - RNA, 25 nt, Human
ggugcuauugguauuuccucuguua

SEQ ID NO: 16278 - RNA, 21 nt, Human
aacaauuacacacaacagggu

SEQ ID NO: 16279 - RNA, 22 nt, Human
aggcggguggaucacgacguca

SEQ ID NO: 16280 - RNA, 24 nt, Human
uagggaggaugaauuacccaggau

SEQ ID NO: 16281 - RNA, 18 nt, Human
ucugccuuggacauggca

SEQ ID NO: 16282 - RNA, 24 nt, Human
uucugcauuuucaaaaugauaauu

SEQ ID NO: 16283 - RNA, 22 nt, Human
ccgggagguggaggcugcaaug

SEQ ID NO: 16284 - RNA, 21 nt, Human
uaacugcacuuucggcccuuu

SEQ ID NO: 16285 - RNA, 27 nt, Human
uugcccaggucuucugcgaucaguuaa

SEQ ID NO: 16286 - RNA, 23 nt, Human
ccaccucggggaacuccagacca

SEQ ID NO: 16287 - RNA, 25 nt, Human
guggcucuuggaaccugggaggcag

SEQ ID NO: 16288 - RNA, 26 nt, Human
cuugcuccuguucucagccuguuauc

SEQ ID NO: 16289 - RNA, 25 nt, Human
caggcaccuguaaucccagcuacuu

SEQ ID NO: 16290 - RNA, 23 nt, Human
ccagagccacagccaccucuacc

SEQ ID NO: 16291 - RNA, 22 nt, Human
cuacccucugggaaagcccuug

SEQ ID NO: 16292 - RNA, 23 nt, Human
ccucuccuggcccuggaaggugc

SEQ ID NO: 16293 - RNA, 29 nt, Human
ccagcuggcauauagguugcagucucggc

SEQ ID NO: 16294 - RNA, 20 nt, Human
uugcccagaggaucacagug

SEQ ID NO: 16295 - RNA, 26 nt, Human
cuccacccucuacuuuauuagaauug

SEQ ID NO: 16296 - RNA, 25 nt, Human
uugagauugauguguuuucacugga

SEQ ID NO: 16297 - RNA, 24 nt, Human
ggcagcaggcggugggaugcuugu

SEQ ID NO: 16298 - RNA, 24 nt, Human
acuggaagggcguuuuucagagcu

SEQ ID NO: 16299 - RNA, 22 nt, Human
uacugcauuccagccuggguga

SEQ ID NO: 16300 - RNA, 22 nt, Human
cggcagugucuggaggcauggc

SEQ ID NO: 16301 - RNA, 19 nt, Human
uuguuucucaugaaaaguu

SEQ ID NO: 16302 - RNA, 23 nt, Human
ccaagguaaaagggcccccaagg

SEQ ID NO: 16303 - RNA, 26 nt, Human
ccuucccagcagacauccucaucggg

SEQ ID NO: 16304 - RNA, 19 nt, Human
cuucccuucaccacagcgu

SEQ ID NO: 16305 - RNA, 21 nt, Human
guuccucccuccccuuucaac

SEQ ID NO: 16306 - RNA, 22 nt, Human
ggcaggagacuggcgugaaccc

SEQ ID NO: 16307 - RNA, 26 nt, Human
agcgaagaggaacccaagcugaagua

SEQ ID NO: 16308 - RNA, 22 nt, Human
aagaauugagauauaacaaugg

SEQ ID NO: 16309 - RNA, 24 nt, Human
guguugaguacaguuggugaagga

SEQ ID NO: 16310 - RNA, 23 nt, Human
agaggauggcagcagguauuggg

SEQ ID NO: 16311 - RNA, 27 nt, Human
uuucauguugcuuucuagaaaacagca

SEQ ID NO: 16312 - RNA, 25 nt, Human
gugcuucucuucugaccugcauguu

SEQ ID NO: 16313 - RNA, 20 nt, Human
ugugggugggggaggaagag

SEQ ID NO: 16314 - RNA, 18 nt, Human
cuugccaccugcugcugc

SEQ ID NO: 16315 - RNA, 27 nt, Human
guugcccaggcuggagugcaacggcau

SEQ ID NO: 16316 - RNA, 21 nt, Human
ucuacuucccugcuaaagggc

SEQ ID NO: 16317 - RNA, 28 nt, Human
acucagugagccuccugugccuggcccc

SEQ ID NO: 16318 - RNA, 27 nt, Human
cgguguugugcuguggggaagggagaa

SEQ ID NO: 16319 - RNA, 26 nt, Human
uggcucccagagcuuugaccagauug

SEQ ID NO: 16320 - RNA, 24 nt, Human
ggccucggcggcuccucacccuca

SEQ ID NO: 16321 - RNA, 22 nt, Human
ugaugggaauugugugauguuu

SEQ ID NO: 16322 - RNA, 22 nt, Human
uaucugaaggacaaaacucauu

SEQ ID NO: 16323 - RNA, 22 nt, Human
gcucugaauacuccauucugcc

SEQ ID NO: 16324 - RNA, 27 nt, Human
gagaauggcaugaaccugggaggcaga

SEQ ID NO: 16325 - RNA, 25 nt, Human
gcuguagugagcugucauugugcca

SEQ ID NO: 16326 - RNA, 23 nt, Human
gugacaacuaaacaaggcauuca

SEQ ID NO: 16327 - RNA, 20 nt, Human
uggggugacugucauuggua

SEQ ID NO: 16328 - RNA, 26 nt, Human
cuuugugucaccucagugacuuacag

SEQ ID NO: 16329 - RNA, 21 nt, Human
agacccuuauccacugcuccu

SEQ ID NO: 16330 - RNA, 26 nt, Human
cuguuuuuuaaaugaucaugaaacca

SEQ ID NO: 16331 - RNA, 20 nt, Human
agaucagaagagaucaaggg

SEQ ID NO: 16332 - RNA, 19 nt, Human
ccuuucuccuuuucuuucc

SEQ ID NO: 16333 - RNA, 22 nt, Human
ucucugguggcugggcugcucc

SEQ ID NO: 16334 - RNA, 21 nt, Human
ucuucuuccuguccaugccgg

SEQ ID NO: 16335 - RNA, 22 nt, Human
uccaguaagcacauguuuauuc

SEQ ID NO: 16336 - RNA, 20 nt, Human
gggggcagccacucucucca

SEQ ID NO: 16337 - RNA, 26 nt, Human
accaugccauggggccagaaauucag

SEQ ID NO: 16338 - RNA, 24 nt, Human
uguuaauaaaaauaagaaauagcu

SEQ ID NO: 16339 - RNA, 22 nt, Human
ccgagaucacgccacugcacua

SEQ ID NO: 16340 - RNA, 22 nt, Human
ucaucuaaaucagguaugagug

SEQ ID NO: 16341 - RNA, 21 nt, Human
gcacgggugccuccagccuga

SEQ ID NO: 16342 - RNA, 23 nt, Human
ccuucuggcugcaccugccaugu

SEQ ID NO: 16343 - RNA, 18 nt, Human
gcagagcuuaauuauccu

SEQ ID NO: 16344 - RNA, 22 nt, Human
ccgagaucgcaccagugcacuc

SEQ ID NO: 16345 - RNA, 25 nt, Human
ugggagccaggcagggccagggcag

SEQ ID NO: 16346 - RNA, 27 nt, Human
ugccuguaaucccaguuacuugggagg

SEQ ID NO: 16347 - RNA, 20 nt, Human
gacucaacuuccuacugcaa

SEQ ID NO: 16348 - RNA, 27 nt, Human
caaaaccuucuauuuuagcuuuaguga

SEQ ID NO: 16349 - RNA, 22 nt, Human
cuuggcccugcucccagauggc

SEQ ID NO: 16350 - RNA, 22 nt, Human
ccaugagcugcucauuacaguu

SEQ ID NO: 16351 - RNA, 22 nt, Human
gucacccaggcgggaguggugc

SEQ ID NO: 16352 - RNA, 24 nt, Human
aucaucuguguaguaggugugugu

SEQ ID NO: 16353 - RNA, 23 nt, Human
cccaggaggucagggcugcagug

SEQ ID NO: 16354 - RNA, 22 nt, Human
cuguccgucucugggaaugguc

SEQ ID NO: 16355 - RNA, 24 nt, Human
acucagcccggcugaugccucugc

SEQ ID NO: 16356 - RNA, 20 nt, Human
gugccgccuggccugcaugc

SEQ ID NO: 16357 - RNA, 22 nt, Human
cuccacccccaccucaagugcc

SEQ ID NO: 16358 - RNA, 23 nt, Human
ccucuagccucugcuggagugca

SEQ ID NO: 16359 - RNA, 22 nt, Human
ggcccaugugcccacugucucu

SEQ ID NO: 16360 - RNA, 21 nt, Human
ccugcagccucaugccuggcc

SEQ ID NO: 16361 - RNA, 27 nt, Human
uggacucaaacuccugaccuugugauu

SEQ ID NO: 16362 - RNA, 25 nt, Human
cauggacuggggugcaaugggacag

SEQ ID NO: 16363 - RNA, 20 nt, Human
ggcucagagcugaggcagaa

SEQ ID NO: 16364 - RNA, 27 nt, Human
ccugggcaacagaguaagaccuugucu

SEQ ID NO: 16365 - RNA, 27 nt, Human
ccugggcaacagagcaagaccucgucu

SEQ ID NO: 16366 - RNA, 23 nt, Human
ugucgcccaggcuggagugcagu

SEQ ID NO: 16367 - RNA, 23 nt, Human
uguugcccaggcuggaguguagu

SEQ ID NO: 16368 - RNA, 23 nt, Human
ugucacccaggcuggagugcggu

SEQ ID NO: 16369 - RNA, 22 nt, Human
aaagugagacccugucacuaac

SEQ ID NO: 16370 - RNA, 16 nt, Human
cucauagaaugccuuu

SEQ ID NO: 16371 - RNA, 21 nt, Human
uguuguacacagaaauacagu

SEQ ID NO: 16372 - RNA, 21 nt, Human
cugggaaauauuguguuggaa

SEQ ID NO: 16373 - RNA, 18 nt, Human
agaaggcagagaaaguga

SEQ ID NO: 16374 - RNA, 23 nt, Human
aaagagauaauuucagcucuuac

SEQ ID NO: 16375 - RNA, 24 nt, Human
gaaagggagaagacagcagagggg

SEQ ID NO: 16376 - RNA, 27 nt, Human
uccucaagggaaagcugcccacuucua

SEQ ID NO: 16377 - RNA, 27 nt, Human
ucuccuggugccugcaccugcacucua

SEQ ID NO: 16378 - RNA, 21 nt, Human
gcagggugcaguaucaugccc

SEQ ID NO: 16379 - RNA, 21 nt, Human
gccauggcccauucuucauca

SEQ ID NO: 16380 - RNA, 27 nt, Human
ccccaucugaaagggucuccucucuca

SEQ ID NO: 16381 - RNA, 22 nt, Human
uccuuucucacacuccacugcc

SEQ ID NO: 16382 - RNA, 26 nt, Human
gaauucaagaaaauuuaagcugcaaa

SEQ ID NO: 16383 - RNA, 24 nt, Human
uuaguaaaugcaaaguaaugacuu

SEQ ID NO: 16384 - RNA, 24 nt, Human
gagcgagacucagaggcuccgaac

SEQ ID NO: 16385 - RNA, 22 nt, Human
gggggcuuuucaagaggggcca

SEQ ID NO: 16386 - RNA, 19 nt, Human
uucucacaccugugcgcag

SEQ ID NO: 16387 - RNA, 20 nt, Human
uucacuucuuuagggagaca

SEQ ID NO: 16388 - RNA, 21 nt, Human
acaugcuggggaucauggcau

SEQ ID NO: 16389 - RNA, 21 nt, Human
ugaguguggcgggaagggugg

SEQ ID NO: 16390 - RNA, 23 nt, Human
uguaagcuucauagggauggaca

SEQ ID NO: 16391 - RNA, 26 nt, Human
ggauguucuugccucugacaguagcu

SEQ ID NO: 16392 - RNA, 22 nt, Human
gaauuggcagcugacugcacug

SEQ ID NO: 16393 - RNA, 20 nt, Human
ugccagggguacauuuuugc

SEQ ID NO: 16394 - RNA, 28 nt, Human
cccagcaacaacaaaagaacuaguccuc

SEQ ID NO: 16395 - RNA, 21 nt, Human
ucacccaaccugacuuccucu

SEQ ID NO: 16396 - RNA, 24 nt, Human
auaaagugcuuugggugccauucc

SEQ ID NO: 16397 - RNA, 21 nt, Human
ucgaucucaucaccauaauaa

SEQ ID NO: 16398 - RNA, 27 nt, Human
uggaacuacugguuagaaggugagugu

SEQ ID NO: 16399 - RNA, 20 nt, Human
auauagaugcacacauaucu

SEQ ID NO: 16400 - RNA, 26 nt, Human
cugccucucuaagcuggccucagguu

SEQ ID NO: 16401 - RNA, 20 nt, Human
aagccuccgcugggcuucau

SEQ ID NO: 16402 - RNA, 27 nt, Human
ggaggcugaggcagguggaucgccuga

SEQ ID NO: 16403 - RNA, 20 nt, Human
cguuuagaaucaucuauuua

SEQ ID NO: 16404 - RNA, 23 nt, Human
ccgcuaaaucauugaugacucca

SEQ ID NO: 16405 - RNA, 20 nt, Human
gaccaaaaaagucauaccuu

SEQ ID NO: 16406 - RNA, 20 nt, Human
agccaaaggugcagucggaa

SEQ ID NO: 16407 - RNA, 23 nt, Human
uaucaguaccauuugaucugcca

SEQ ID NO: 16408 - RNA, 21 nt, Human
aagaccuugggaaauggaggc

SEQ ID NO: 16409 - RNA, 21 nt, Human
guggguggaaagaucaaauua

SEQ ID NO: 16410 - RNA, 24 nt, Human
cccacugcugccccaagcucacuc

SEQ ID NO: 16411 - RNA, 20 nt, Human
cacccaggcuggagugcaau

SEQ ID NO: 16412 - RNA, 20 nt, Human
cucccaggcuggagugcuau

SEQ ID NO: 16413 - RNA, 20 nt, Human
cacccaggcuagagugcagu

SEQ ID NO: 16414 - RNA, 21 nt, Human
ucucauccuucccaacccagu

SEQ ID NO: 16415 - RNA, 23 nt, Human
guggggaagugcguguguugggc

SEQ ID NO: 16416 - RNA, 23 nt, Human
cccaaauugaagauccuuccuug

SEQ ID NO: 16417 - RNA, 21 nt, Human
ugggaacuguguuggcugcca

SEQ ID NO: 16418 - RNA, 19 nt, Human
ucuagcuaauaaaauacau

SEQ ID NO: 16419 - RNA, 18 nt, Human
ugacacccuaucuuguca

SEQ ID NO: 16420 - RNA, 22 nt, Human
gggcuucucccucuacccaggg

SEQ ID NO: 16421 - RNA, 25 nt, Human
cucucggucccacaguccucaggcc

SEQ ID NO: 16422 - RNA, 19 nt, Human
uuugcuugacuggaggaag

SEQ ID NO: 16423 - RNA, 19 nt, Human
aaacccagacuugcuucca

SEQ ID NO: 16424 - RNA, 22 nt, Human
cggguauuucaugucucaggga

SEQ ID NO: 16425 - RNA, 27 nt, Human
ggggaaagaaugguagagacagaaauu

SEQ ID NO: 16426 - RNA, 22 nt, Human
uuuguaacccaggcuggaaugc

SEQ ID NO: 16427 - RNA, 25 nt, Human
ucccaggcugcuggagugcaguggc

SEQ ID NO: 16428 - RNA, 20 nt, Human
agggguggaagggaucucug

SEQ ID NO: 16429 - RNA, 22 nt, Human
ccuccuugucaaaguguguaaa

SEQ ID NO: 16430 - RNA, 22 nt, Human
gggagagaggagcaugcgcgag

SEQ ID NO: 16431 - RNA, 19 nt, Human
uucaaguucagugccuacc

SEQ ID NO: 16432 - RNA, 32 nt, Human
ggaggcucagcagcaggacgacuugagcccaa

SEQ ID NO: 16433 - RNA, 26 nt, Human
uuuaaacuuugacaaaaaugguuuug

SEQ ID NO: 16434 - RNA, 22 nt, Human
ccguacugucuguguccuugua

SEQ ID NO: 16435 - RNA, 23 nt, Human
guuagugggaagagcuggguuuu

SEQ ID NO: 16436 - RNA, 23 nt, Human
cagacuccaugguuugacaccag

SEQ ID NO: 16437 - RNA, 25 nt, Human
ggguggaguguguguucuuucucca

SEQ ID NO: 16438 - RNA, 23 nt, Human
gaaaggagaguagaacauuuuuc

SEQ ID NO: 16439 - RNA, 22 nt, Human
cucuggcccagaaagccucucu

SEQ ID NO: 16440 - RNA, 20 nt, Human
aacucguaacccuguccuuc

SEQ ID NO: 16441 - RNA, 22 nt, Human
ccccucggaggcggcgggcgga

SEQ ID NO: 16442 - RNA, 20 nt, Human
uuucaggcuacaugcaacag

SEQ ID NO: 16443 - RNA, 25 nt, Human
uguucucagucccaaacugaaacua

SEQ ID NO: 16444 - RNA, 27 nt, Human
ccagcacuguggcagcgcccaggaggg

SEQ ID NO: 16445 - RNA, 26 nt, Human
gggguggcagaggaucugcagcccug

SEQ ID NO: 16446 - RNA, 28 nt, Human
gcuccgccugcagggacagaaagacaug

SEQ ID NO: 16447 - RNA, 23 nt, Human
uaucaguaucauuugaucugcca

SEQ ID NO: 16448 - RNA, 20 nt, Human
aggaccaccuuccucuagag

SEQ ID NO: 16449 - RNA, 26 nt, Human
cugaucuauuuuuccucaucuguaaa

SEQ ID NO: 16450 - RNA, 24 nt, Human
acccaggcuggacugcaaugacgc

SEQ ID NO: 16451 - RNA, 19 nt, Human
cgccucuccaugaacccgu

SEQ ID NO: 16452 - RNA, 27 nt, Human
cacuacccuucucucccccagcucauc

SEQ ID NO: 16453 - RNA, 20 nt, Human
ucccaauaaaaugauauauu

SEQ ID NO: 16454 - RNA, 23 nt, Human
uaagaucauuaauuuuguaaucu

SEQ ID NO: 16455 - RNA, 21 nt, Human
gacuccuggcuucauguggca

SEQ ID NO: 16456 - RNA, 23 nt, Human
aaauggccuugacauuuaaucac

SEQ ID NO: 16457 - RNA, 26 nt, Human
aaaacaauauauguaaauuauaagua

SEQ ID NO: 16458 - RNA, 23 nt, Human
uauauguguguggcguguguaua

SEQ ID NO: 16459 - RNA, 27 nt, Human
ucaggagggcuuccugggaggugucuc

SEQ ID NO: 16460 - RNA, 22 nt, Human
uaucgcccaggcuggagugcag

SEQ ID NO: 16461 - RNA, 21 nt, Human
accugaauaaaaaugaccagc

SEQ ID NO: 16462 - RNA, 25 nt, Human
ggggagaguucauggagagagcaug

SEQ ID NO: 16463 - RNA, 20 nt, Human
gcuaccacaccgugcccuca

SEQ ID NO: 16464 - RNA, 21 nt, Human
agcuucuggaucccaggcuca

SEQ ID NO: 16465 - RNA, 26 nt, Human
aggauuuagguuaggccaggagauug

SEQ ID NO: 16466 - RNA, 26 nt, Human
ggccuggaacccucuuggcuaaggug

SEQ ID NO: 16467 - RNA, 20 nt, Human
acuuccucacguugugugcg

SEQ ID NO: 16468 - RNA, 21 nt, Human
ggacaauggagguggcggugg

SEQ ID NO: 16469 - RNA, 23 nt, Human
gcauguaaucccagcuacucggg

SEQ ID NO: 16470 - RNA, 23 nt, Human
gcuggaugacccacuguccgcgg

SEQ ID NO: 16471 - RNA, 27 nt, Human
uccuccaggacggccaggccgugccgc

SEQ ID NO: 16472 - RNA, 27 nt, Human
gggagcacggagcauccccuguuccug

SEQ ID NO: 16473 - RNA, 21 nt, Human
ucccugcagccagguguaguu

SEQ ID NO: 16474 - RNA, 22 nt, Human
uauuaaccaacuggcaccaagg

SEQ ID NO: 16475 - RNA, 20 nt, Human
gaagaguucaugugccugga

SEQ ID NO: 16476 - RNA, 23 nt, Human
ccuuggaccagccacugccaccu

SEQ ID NO: 16477 - RNA, 22 nt, Human
aaaaaucaguguauuagucaua

SEQ ID NO: 16478 - RNA, 22 nt, Human
gaagggagacagaggcggcggc

SEQ ID NO: 16479 - RNA, 21 nt, Human
cccacaggcccagugccaccc

SEQ ID NO: 16480 - RNA, 22 nt, Human
auugcuugagcuugggagaucg

SEQ ID NO: 16481 - RNA, 21 nt, Human
uagacagaguccagcugccca

SEQ ID NO: 16482 - RNA, 24 nt, Human
uagcaaacauaaugcuaguccuag

SEQ ID NO: 16483 - RNA, 21 nt, Human
aaaugcagaaugcuuaaggcu

SEQ ID NO: 16484 - RNA, 28 nt, Human
uugugaaaguauucuaagccaaguuuua

SEQ ID NO: 16485 - RNA, 22 nt, Human
uagcugggcgugguagugcaag

SEQ ID NO: 16486 - RNA, 26 nt, Human
gacuccugguugccuuuucccagcca

SEQ ID NO: 16487 - RNA, 26 nt, Human
cuuagcaacuguagaugucucggaua

SEQ ID NO: 16488 - RNA, 19 nt, Human
ugccauucuugugcacuga

SEQ ID NO: 16489 - RNA, 22 nt, Human
caccuaacucaccuaacucaua

SEQ ID NO: 16490 - RNA, 20 nt, Human
cguuugauaguuaacauuuc

SEQ ID NO: 16491 - RNA, 26 nt, Human
gugacauccuucagucccucacaucu

SEQ ID NO: 16492 - RNA, 22 nt, Human
aguagaggucacagagaugaca

SEQ ID NO: 16493 - RNA, 22 nt, Human
cuuugcagacguuucacuccuu

SEQ ID NO: 16494 - RNA, 23 nt, Human
gcaccacgggacaucacagggug

SEQ ID NO: 16495 - RNA, 19 nt, Human
uucauuucuggccuuuuca

SEQ ID NO: 16496 - RNA, 16 nt, Human
cagcccggccuagcca

SEQ ID NO: 16497 - RNA, 24 nt, Human
gaaucacugguaaauguuggcuga

SEQ ID NO: 16498 - RNA, 23 nt, Human
cugcccaccuggggaucccccaa

SEQ ID NO: 16499 - RNA, 21 nt, Human
ugaacagucuucagccacagu

SEQ ID NO: 16500 - RNA, 22 nt, Human
uccgucccuccugguuuuguaa

SEQ ID NO: 16501 - RNA, 21 nt, Human
cuucccuuccucccggggccu

SEQ ID NO: 16502 - RNA, 22 nt, Human
aacuucuguucagaaauacaca

SEQ ID NO: 16503 - RNA, 22 nt, Human
gaaagagaaaaauuaaguuagg

SEQ ID NO: 16504 - RNA, 25 nt, Human
uaucugaagaaaaggucagaucuau

SEQ ID NO: 16505 - RNA, 21 nt, Human
aggcggcagagguugcaguga

SEQ ID NO: 16506 - RNA, 20 nt, Human
cuugcuggcccugauggggu

SEQ ID NO: 16507 - RNA, 22 nt, Human
cccaaauugcugggauuacagg

SEQ ID NO: 16508 - RNA, 26 nt, Human
ggaggcaccgguggcagcagcagcau

SEQ ID NO: 16509 - RNA, 21 nt, Human
ucuccaggaaggcggggcuuc

SEQ ID NO: 16510 - RNA, 27 nt, Human
ggcuggcugccggcuccaugacgcccg

SEQ ID NO: 16511 - RNA, 21 nt, Human
uucuagcuauaggaacuaucu

SEQ ID NO: 16512 - RNA, 25 nt, Human
uugagcuauuuaaacaacuuaaaca

SEQ ID NO: 16513 - RNA, 20 nt, Human
gcugcccugcccuugugacc

SEQ ID NO: 16514 - RNA, 22 nt, Human
agccucccuaguagcugggaug

SEQ ID NO: 16515 - RNA, 21 nt, Human
gcaauguuggguuggggaaga

SEQ ID NO: 16516 - RNA, 25 nt, Human
caacagaucuggaaccucagccugg

SEQ ID NO: 16517 - RNA, 27 nt, Human
ggucccgccagccccucacacucccag

SEQ ID NO: 16518 - RNA, 21 nt, Human
caggagguugagaaugcagug

SEQ ID NO: 16519 - RNA, 21 nt, Human
gggaagccuccuaaggccagg

SEQ ID NO: 16520 - RNA, 27 nt, Human
cugcccuucuugaugucacaguuuuuu

SEQ ID NO: 16521 - RNA, 25 nt, Human
uuucccaugugguuuuuauguuuaa

SEQ ID NO: 16522 - RNA, 23 nt, Human
ggcagaucaugggacuucuucac

SEQ ID NO: 16523 - RNA, 23 nt, Human
agugcucaguaaggcagugcaau

SEQ ID NO: 16524 - RNA, 22 nt, Human
accucagugauuuuauucccua

SEQ ID NO: 16525 - RNA, 21 nt, Human
ccgccuggccagaccuccugg

SEQ ID NO: 16526 - RNA, 20 nt, Human
aucaauuaaauagcucagag

SEQ ID NO: 16527 - RNA, 21 nt, Human
aggcagcuagaggcgcaggag

SEQ ID NO: 16528 - RNA, 28 nt, Human
gagagccaccaaggaggagcaggggagc

SEQ ID NO: 16529 - RNA, 22 nt, Human
ggugcuaauccaggacagcauu

SEQ ID NO: 16530 - RNA, 20 nt, Human
auguguuuuaaagcauugca

SEQ ID NO: 16531 - RNA, 27 nt, Human
uugcccaggcuagucuggaacuccuga

SEQ ID NO: 16532 - RNA, 22 nt, Human
ccccagcgcuauucauaacuuu

SEQ ID NO: 16533 - RNA, 22 nt, Human
auauaucagcaaagcaaaaaga

SEQ ID NO: 16534 - RNA, 18 nt, Human
gccguggagaugagacua

SEQ ID NO: 16535 - RNA, 22 nt, Human
uguuaagaaauguuaguggugg

SEQ ID NO: 16536 - RNA, 16 nt, Human
ccucccccugccuccc

SEQ ID NO: 16537 - RNA, 27 nt, Human
cgugggugagaaagguccugguccgcg

SEQ ID NO: 16538 - RNA, 22 nt, Human
ccuccagggcucaacacuguga

SEQ ID NO: 16539 - RNA, 21 nt, Human
ucagaaauuuuauacugccaa

SEQ ID NO: 16540 - RNA, 26 nt, Human
acagagcuggaagagaccacagcaga

SEQ ID NO: 16541 - RNA, 29 nt, Human
cgggugcgguggaggcggccuugcggugg

SEQ ID NO: 16542 - RNA, 22 nt, Human
agagacaccugggcgaacucag

SEQ ID NO: 16543 - RNA, 25 nt, Human
ucuuuuauuucuuuuucucuuugau

SEQ ID NO: 16544 - RNA, 21 nt, Human
ugaaaaaugaggaggccaggc

SEQ ID NO: 16545 - RNA, 27 nt, Human
ccagggggcagaggcaggggcgggagg

SEQ ID NO: 16546 - RNA, 21 nt, Human
auuuacucuauaaucugcagu

SEQ ID NO: 16547 - RNA, 22 nt, Human
ccaccucuacagaaucccaguu

SEQ ID NO: 16548 - RNA, 27 nt, Human
ucugggagguggaagccaggccagagg

SEQ ID NO: 16549 - RNA, 22 nt, Human
cugcuuguacaacaugguuugg

SEQ ID NO: 16550 - RNA, 21 nt, Human
ugagcacggucuugaucaaac

SEQ ID NO: 16551 - RNA, 22 nt, Human
gcaaguguccucugacagccgu

SEQ ID NO: 16552 - RNA, 23 nt, Human
uucauuucauacacacuggcuca

SEQ ID NO: 16553 - RNA, 20 nt, Human
ucuguuucucuuuucucuua

SEQ ID NO: 16554 - RNA, 25 nt, Human
gcuuccuucuugcccagcgcugggu

SEQ ID NO: 16555 - RNA, 19 nt, Human
cuaccaugccucuccaaca

SEQ ID NO: 16556 - RNA, 24 nt, Human
uauuucuugagagaagauuuuaac

SEQ ID NO: 16557 - RNA, 22 nt, Human
ugggaccacagagauguuuucu

SEQ ID NO: 16558 - RNA, 22 nt, Human
ucuucuauauugcagugucucu

SEQ ID NO: 16559 - RNA, 22 nt, Human
ucaucuucccuuuccucccuuc

SEQ ID NO: 16560 - RNA, 24 nt, Human
ccagcccaggccucccagggaagg

SEQ ID NO: 16561 - RNA, 26 nt, Human
gggaauaugcccaagcuaugccuugu

SEQ ID NO: 16562 - RNA, 19 nt, Human
guucuccacacucacaaga

SEQ ID NO: 16563 - RNA, 23 nt, Human
cccuuagcaucagcuccucccuc

SEQ ID NO: 16564 - RNA, 26 nt, Human
uguuuauucaggugggagauguucug

SEQ ID NO: 16565 - RNA, 22 nt, Human
gcuggcucccccuccccaggcu

SEQ ID NO: 16566 - RNA, 22 nt, Human
cugcugugugggugugggggug

SEQ ID NO: 16567 - RNA, 27 nt, Human
uuggcgcagcccugaagaaacuaccua

SEQ ID NO: 16568 - RNA, 23 nt, Human
uccacacacauccucaccccaca

SEQ ID NO: 16569 - RNA, 24 nt, Human
cuccuaaccaaggugcacugagaa

SEQ ID NO: 16570 - RNA, 20 nt, Human
caaguugaaagcagagugua

SEQ ID NO: 16571 - RNA, 19 nt, Human
auccaggcuggagugcggu

SEQ ID NO: 16572 - RNA, 19 nt, Human
guccaggcuggagugcagu

SEQ ID NO: 16573 - RNA, 18 nt, Human
cagggagggaggggcggc

SEQ ID NO: 16574 - RNA, 21 nt, Human
guucaccguaggcaucuuuaa

SEQ ID NO: 16575 - RNA, 24 nt, Human
uucaguuauguuuauaaguuugca

SEQ ID NO: 16576 - RNA, 22 nt, Human
cuccaccccugucauucacuuc

SEQ ID NO: 16577 - RNA, 25 nt, Human
gcagguggggaggggguuugguggc

SEQ ID NO: 16578 - RNA, 20 nt, Human
gcagaaauuuugaagucaga

SEQ ID NO: 16579 - RNA, 22 nt, Human
uccaccccaucccaucccaccu

SEQ ID NO: 16580 - RNA, 25 nt, Human
acagcauagccagcaggccacuuuu

SEQ ID NO: 16581 - RNA, 22 nt, Human
cuucugcugugagauucccuag

SEQ ID NO: 16582 - RNA, 22 nt, Human
uguggaauauuugaguucuauu

SEQ ID NO: 16583 - RNA, 22 nt, Human
ggucucgaaugucugaccucag

SEQ ID NO: 16584 - RNA, 25 nt, Human
cccgcagcgcuccaggauucugcgg

SEQ ID NO: 16585 - RNA, 23 nt, Human
cucugcaggagucugcaggucac

SEQ ID NO: 16586 - RNA, 20 nt, Human
ccuaaccuucaacaaauguu

SEQ ID NO: 16587 - RNA, 20 nt, Human
ggaaagggagagcuguaagc

SEQ ID NO: 16588 - RNA, 30 nt, Human
ugccaguuugcuuaguucucacugucuccu

SEQ ID NO: 16589 - RNA, 20 nt, Human
uuaucucggcugcggcggga

SEQ ID NO: 16590 - RNA, 22 nt, Human
agggggagaggggaaagggguc

SEQ ID NO: 16591 - RNA, 19 nt, Human
ugugcaauacauuuguuau

SEQ ID NO: 16592 - RNA, 22 nt, Human
uucccaggucuggaucgauuca

SEQ ID NO: 16593 - RNA, 22 nt, Human
cccaccccguagauucccauca

SEQ ID NO: 16594 - RNA, 23 nt, Human
ccgggggcaaaggagguggcaug

SEQ ID NO: 16595 - RNA, 27 nt, Human
cuucucgggggcccgccgcacgcccgg

SEQ ID NO: 16596 - RNA, 21 nt, Human
guucuccuuacuccaucuccu

SEQ ID NO: 16597 - RNA, 18 nt, Human
cuucagaguucugaagaa

SEQ ID NO: 16598 - RNA, 23 nt, Human
uauaccccauuuccuuccaguca

SEQ ID NO: 16599 - RNA, 21 nt, Human
acacaccccuguccuccagca

SEQ ID NO: 16600 - RNA, 25 nt, Human
gcugcaccccuuccugggcacacgc

SEQ ID NO: 16601 - RNA, 22 nt, Human
ccguugcacuccagccugggcg

SEQ ID NO: 16602 - RNA, 26 nt, Human
cagcacuugccuuuacgaccauguuc

SEQ ID NO: 16603 - RNA, 18 nt, Human
caguguaauauuucucca

SEQ ID NO: 16604 - RNA, 22 nt, Human
gcaacacggugaaaccccaucu

SEQ ID NO: 16605 - RNA, 23 nt, Human
gcacagccuucuccacuggccgg

SEQ ID NO: 16606 - RNA, 23 nt, Human
guggauaauacaacagagaaaac

SEQ ID NO: 16607 - RNA, 27 nt, Human
gaaacagcaauuaaaguuuuucuucca

SEQ ID NO: 16608 - RNA, 20 nt, Human
gcgcagcuggcugggcucag

SEQ ID NO: 16609 - RNA, 24 nt, Human
cguuccccgccuccagcccgccuc

SEQ ID NO: 16610 - RNA, 20 nt, Human
cggcauggaucucagcgagc

SEQ ID NO: 16611 - RNA, 26 nt, Human
cucuucuccccgugcuuuucugcggc

SEQ ID NO: 16612 - RNA, 25 nt, Human
uucuaggguuuuuguacauuuugga

SEQ ID NO: 16613 - RNA, 24 nt, Human
aggaagaaagggagagagggccag

SEQ ID NO: 16614 - RNA, 20 nt, Human
augccugcugcaucuuccca

SEQ ID NO: 16615 - RNA, 21 nt, Human
uguggucuccugugugcugcu

SEQ ID NO: 16616 - RNA, 23 nt, Human
cuuguaaugaaacucuucaccuu

SEQ ID NO: 16617 - RNA, 22 nt, Human
cacuugaacccgggaggcagag

SEQ ID NO: 16618 - RNA, 21 nt, Human
agccuccaaguagcugggacu

SEQ ID NO: 16619 - RNA, 23 nt, Human
guacacagaugacaaguguccaa

SEQ ID NO: 16620 - RNA, 21 nt, Human
ugcacacauuuaacgacagaa

SEQ ID NO: 16621 - RNA, 22 nt, Human
ucuucaucuucaauuuggguuu

SEQ ID NO: 16622 - RNA, 25 nt, Human
caucuggggcaggcccuccacuucc

SEQ ID NO: 16623 - RNA, 25 nt, Human
gucuuucuuugucauucaguucuag

SEQ ID NO: 16624 - RNA, 20 nt, Human
uccuuucauauuucugggag

SEQ ID NO: 16625 - RNA, 22 nt, Human
ccaaaaugcugggauuauaggc

SEQ ID NO: 16626 - RNA, 18 nt, Human
caggcauuaaaauuugua

SEQ ID NO: 16627 - RNA, 22 nt, Human
aagcaaaacaaaaacaauucag

SEQ ID NO: 16628 - RNA, 23 nt, Human
ccugggaguuagagguugcagug

SEQ ID NO: 16629 - RNA, 20 nt, Human
ucucucuugcugaggacuca

SEQ ID NO: 16630 - RNA, 22 nt, Human
ugggagguggauaggucgguga

SEQ ID NO: 16631 - RNA, 31 nt, Human
gcccucucgccuccuccuccugggaagaagc

SEQ ID NO: 16632 - RNA, 25 nt, Human
ugcagucgcucuacaaccaccugcg

SEQ ID NO: 16633 - RNA, 22 nt, Human
gaccagucuggccaacaucgug

SEQ ID NO: 16634 - RNA, 21 nt, Human
gggaggcagagguuacaguga

SEQ ID NO: 16635 - RNA, 22 nt, Human
uuuauuaucaugacaauguugg

SEQ ID NO: 16636 - RNA, 22 nt, Human
cacugcagcugccagcacuugg

SEQ ID NO: 16637 - RNA, 22 nt, Human
gcugcucuuaacuacuaugcag

SEQ ID NO: 16638 - RNA, 22 nt, Human
cuugggaaagaucugucagagg

SEQ ID NO: 16639 - RNA, 20 nt, Human
aggaaauguguuggcucacu

SEQ ID NO: 16640 - RNA, 21 nt, Human
accagccaagaugaacuccuu

SEQ ID NO: 16641 - RNA, 20 nt, Human
cagaagcuaagagccagccu

SEQ ID NO: 16642 - RNA, 27 nt, Human
aguuacaccuccacucagcacucugga

SEQ ID NO: 16643 - RNA, 26 nt, Human
aaccgaauaaauagcuccuauuuggu

SEQ ID NO: 16644 - RNA, 23 nt, Human
agcaguuuggucaacuuaccaac

SEQ ID NO: 16645 - RNA, 24 nt, Human
aaagcaacuguauaaaugaaugua

SEQ ID NO: 16646 - RNA, 23 nt, Human
ggcaaagcagcaguucuaccaag

SEQ ID NO: 16647 - RNA, 21 nt, Human
cccaucucaggcagcaagaca

SEQ ID NO: 16648 - RNA, 27 nt, Human
cccugcuccuugugggcgcucacacug

SEQ ID NO: 16649 - RNA, 18 nt, Human
ucucucccucucccuguc

SEQ ID NO: 16650 - RNA, 21 nt, Human
gaagcucgugacaagugccuu

SEQ ID NO: 16651 - RNA, 22 nt, Human
uggcccaugccuauaaucccag

SEQ ID NO: 16652 - RNA, 28 nt, Human
aaauguguccguauauuucuguaccugc

SEQ ID NO: 16653 - RNA, 27 nt, Human
ccagaaggcagagaggcaguucugaau

SEQ ID NO: 16654 - RNA, 26 nt, Human
uugccuggccuuccugucuagucucu

SEQ ID NO: 16655 - RNA, 20 nt, Human
gaccacagcagagcucacag

SEQ ID NO: 16656 - RNA, 23 nt, Human
uucucuuucgcaccugccucuca

SEQ ID NO: 16657 - RNA, 23 nt, Human
gcugcaacucugauauacagaga

SEQ ID NO: 16658 - RNA, 28 nt, Human
ucccuggccucugcccacuagacaucag

SEQ ID NO: 16659 - RNA, 21 nt, Human
cugcaaccuccgccuccuggg

SEQ ID NO: 16660 - RNA, 16 nt, Human
ccaccucagccaucca

SEQ ID NO: 16661 - RNA, 26 nt, Human
uauaguagugcaaaauggaagacuga

SEQ ID NO: 16662 - RNA, 22 nt, Human
aacuugaaaagagagugaaggg

SEQ ID NO: 16663 - RNA, 24 nt, Human
ucucuuagcuuguguguguuucuu

SEQ ID NO: 16664 - RNA, 20 nt, Human
agcauggggauucuuuucua

SEQ ID NO: 16665 - RNA, 22 nt, Human
aauugggcaaauaaauuacaua

SEQ ID NO: 16666 - RNA, 21 nt, Human
cucuuuuuguuuuuuguguuu

SEQ ID NO: 16667 - RNA, 26 nt, Human
guuuugaaaaccuaaaagacaggcuc

SEQ ID NO: 16668 - RNA, 20 nt, Human
caaauugaguuuaacaauaa

SEQ ID NO: 16669 - RNA, 20 nt, Human
acaagccagagaucucccac

SEQ ID NO: 16670 - RNA, 20 nt, Human
agcugcugcaaccauuguuc

SEQ ID NO: 16671 - RNA, 23 nt, Human
gcucacuggccaauaaagagcuu

SEQ ID NO: 16672 - RNA, 24 nt, Human
gccucccaccccgcugccugggcc

SEQ ID NO: 16673 - RNA, 27 nt, Human
cggcaggcggguguagucucggcggca

SEQ ID NO: 16674 - RNA, 27 nt, Human
gagagugaguggagagaggagaggcaa

SEQ ID NO: 16675 - RNA, 20 nt, Human
ucuacucccuguaggaguuc

SEQ ID NO: 16676 - RNA, 20 nt, Human
cuaggcuggccccuugucca

SEQ ID NO: 16677 - RNA, 27 nt, Human
uaccacugcacugucugagaauuucca

SEQ ID NO: 16678 - RNA, 23 nt, Human
cugccuuccucucugaguacguu

SEQ ID NO: 16679 - RNA, 21 nt, Human
uugccaauauuugcaccaucu

SEQ ID NO: 16680 - RNA, 22 nt, Human
aggcacaagggcuggagcccag

SEQ ID NO: 16681 - RNA, 22 nt, Human
cgggaagcggagcuugcaguga

SEQ ID NO: 16682 - RNA, 22 nt, Human
ugcagcugcugggcacgcccag

SEQ ID NO: 16683 - RNA, 21 nt, Human
ucuccaauuucacaucuugaa

SEQ ID NO: 16684 - RNA, 22 nt, Human
caggaggcagagguugcaguga

SEQ ID NO: 16685 - RNA, 22 nt, Human
cgggaggcagagguugcgguga

SEQ ID NO: 16686 - RNA, 22 nt, Human
ugggaggcagagguugugguga

SEQ ID NO: 16687 - RNA, 27 nt, Human
aagaggucacugagggccucugucacc

SEQ ID NO: 16688 - RNA, 22 nt, Human
ggcuggugggcagggggguggc

SEQ ID NO: 16689 - RNA, 24 nt, Human
uucugccccagcuguuccuccucc

SEQ ID NO: 16690 - RNA, 22 nt, Human
gcuccuccggaccuccucggca

SEQ ID NO: 16691 - RNA, 23 nt, Human
caucaugagcugagugacugcag

SEQ ID NO: 16692 - RNA, 26 nt, Human
aggcugaggugggaggguugaucacu

SEQ ID NO: 16693 - RNA, 24 nt, Human
agcucacugcagccucauacuccu

SEQ ID NO: 16694 - RNA, 24 nt, Human
cgucuggcuugcauggucucccaa

SEQ ID NO: 16695 - RNA, 21 nt, Human
ggugaggaaguccaggcucca

SEQ ID NO: 16696 - RNA, 17 nt, Human
uguggcaacaggaccua

SEQ ID NO: 16697 - RNA, 26 nt, Human
ucaguauuugccaaauuacaugcaau

SEQ ID NO: 16698 - RNA, 19 nt, Human
ucucacugcagcugggcuu

SEQ ID NO: 16699 - RNA, 30 nt, Human
uugcuuccugccccaaccagauugagaacc

SEQ ID NO: 16700 - RNA, 21 nt, Human
ccugcuguccuuuuuauuguu

SEQ ID NO: 16701 - RNA, 22 nt, Human
ucagggacugaagccagcaugg

SEQ ID NO: 16702 - RNA, 22 nt, Human
ucauaccacugcacugcagccu

SEQ ID NO: 16703 - RNA, 25 nt, Human
cggggagggguuguggggcuggggc

SEQ ID NO: 16704 - RNA, 22 nt, Human
ucuaaaaugagaugccagaagc

SEQ ID NO: 16705 - RNA, 27 nt, Human
agagagaaaagugggguuuuguuuccc

SEQ ID NO: 16706 - RNA, 20 nt, Human
gcacagccauguuuugucuu

SEQ ID NO: 16707 - RNA, 20 nt, Human
uuuagugggagugaaaguuc

SEQ ID NO: 16708 - RNA, 17 nt, Human
aaagaaaaaaugcuuua

SEQ ID NO: 16709 - RNA, 16 nt, Human
aagagagugaucaugu

SEQ ID NO: 16710 - RNA, 21 nt, Human
aauaugcugacuucacuuauu

SEQ ID NO: 16711 - RNA, 26 nt, Human
ugagguggguuuucuucccaucacug

SEQ ID NO: 16712 - RNA, 22 nt, Human
gggauuccaaauaaacacuugc

SEQ ID NO: 16713 - RNA, 22 nt, Human
ccucgcaguuccccuguccuga

SEQ ID NO: 16714 - RNA, 27 nt, Human
cauugcacuccaggcugggcagcaaga

SEQ ID NO: 16715 - RNA, 22 nt, Human
cugcgggagagcagggccuggu

SEQ ID NO: 16716 - RNA, 26 nt, Human
ugacuccaccuagcuauuuggaauaa

SEQ ID NO: 16717 - RNA, 21 nt, Human
aggagccugagccacugggga

SEQ ID NO: 16718 - RNA, 22 nt, Human
cacugcacaccagccugggcaa

SEQ ID NO: 16719 - RNA, 27 nt, Human
uuuauccucccuguuauacuuuggagc

SEQ ID NO: 16720 - RNA, 23 nt, Human
acagacagcuacccccagaaggg

SEQ ID NO: 16721 - RNA, 28 nt, Human
cacugauccuucugggccacguugugcg

SEQ ID NO: 16722 - RNA, 20 nt, Human
gggaucucagccugcccuaa

SEQ ID NO: 16723 - RNA, 25 nt, Human
gagaugggcugaacugagccuagcu

SEQ ID NO: 16724 - RNA, 22 nt, Human
ucacccaggcuggagugcaaug

SEQ ID NO: 16725 - RNA, 22 nt, Human
ucucccaggcuggagugcuaug

SEQ ID NO: 16726 - RNA, 22 nt, Human
ucacccaggcuagagugcagug

SEQ ID NO: 16727 - RNA, 17 nt, Human
accuuuaaaaugccuag

SEQ ID NO: 16728 - RNA, 25 nt, Human
gcccaggcuggagugcagucgugcc

SEQ ID NO: 16729 - RNA, 27 nt, Human
ggucucgaucuccugaccucaugaucc

SEQ ID NO: 16730 - RNA, 23 nt, Human
uggcugcuagcuguguuuugaaa

SEQ ID NO: 16731 - RNA, 23 nt, Human
uucaggaggcccuggugucaggc

SEQ ID NO: 16732 - RNA, 29 nt, Human
uucugaucuguguuucucaggggaccugc

SEQ ID NO: 16733 - RNA, 27 nt, Human
cccuccagaaauuuccacugcuguucu

SEQ ID NO: 16734 - RNA, 23 nt, Human
gugaggcagcggagcugggugaa

SEQ ID NO: 16735 - RNA, 19 nt, Human
agggucgacugcagguugu

SEQ ID NO: 16736 - RNA, 19 nt, Human
ccugagagugucucugaua

SEQ ID NO: 16737 - RNA, 20 nt, Human
ggcagaggagugggagcagc

SEQ ID NO: 16738 - RNA, 23 nt, Human
auuacugcuauuuuaaaauuucu

SEQ ID NO: 16739 - RNA, 27 nt, Human
uguccccaagcagagguggagaagggg

SEQ ID NO: 16740 - RNA, 23 nt, Human
guucugacucacugaaaugcgug

SEQ ID NO: 16741 - RNA, 22 nt, Human
uucacuccagaacacauucaug

SEQ ID NO: 16742 - RNA, 20 nt, Human
ugcuuggacguguucuucca

SEQ ID NO: 16743 - RNA, 21 nt, Human
ccucuuccuacccugccuccc

SEQ ID NO: 16744 - RNA, 25 nt, Human
gaucccaggaggcucuggaggacaa

SEQ ID NO: 16745 - RNA, 24 nt, Human
uugauggauuuucaaaaagccguu

SEQ ID NO: 16746 - RNA, 23 nt, Human
acauggcuuuucagacucagcag

SEQ ID NO: 16747 - RNA, 21 nt, Human
aggaggaagagguugcaguga

SEQ ID NO: 16748 - RNA, 26 nt, Human
ccugcaggugucuagggucucagcuu

SEQ ID NO: 16749 - RNA, 28 nt, Human
guuacucaucuucuuaccugauauccca

SEQ ID NO: 16750 - RNA, 20 nt, Human
auauuuacagaagaaaagca

SEQ ID NO: 16751 - RNA, 17 nt, Human
cccauccugaacuggga

SEQ ID NO: 16752 - RNA, 25 nt, Human
uuaguaaagccauuuacuuuuucua

SEQ ID NO: 16753 - RNA, 26 nt, Human
cucaguucugaaauucauuacauauc

SEQ ID NO: 16754 - RNA, 24 nt, Human
ucaggcuggguucccugugggcau

SEQ ID NO: 16755 - RNA, 23 nt, Human
auggaagcaucuguaguguccau

SEQ ID NO: 16756 - RNA, 23 nt, Human
ucuccugacucuccaucgcucug

SEQ ID NO: 16757 - RNA, 19 nt, Human
agcaggggacucugcccuc

SEQ ID NO: 16758 - RNA, 21 nt, Human
caaaagagugaaugaugacac

SEQ ID NO: 16759 - RNA, 19 nt, Human
cauggcagaaagggggcau

SEQ ID NO: 16760 - RNA, 26 nt, Human
cuuucuggaauccaaaccacagucuu

SEQ ID NO: 16761 - RNA, 19 nt, Human
acuugucauuucuacuuuc

SEQ ID NO: 16762 - RNA, 23 nt, Human
agucucgcucucuugcccaggcu

SEQ ID NO: 16763 - RNA, 23 nt, Human
uucugccauuuucauuucacuuc

SEQ ID NO: 16764 - RNA, 21 nt, Human
cgggguuacaaaaagacauga

SEQ ID NO: 16765 - RNA, 24 nt, Human
gggaacagagguuuagcugcagga

SEQ ID NO: 16766 - RNA, 19 nt, Human
ggcagagugccuuagucag

SEQ ID NO: 16767 - RNA, 20 nt, Human
uuccugugccguguggaccc

SEQ ID NO: 16768 - RNA, 24 nt, Human
caagagagccccagagcagaggaa

SEQ ID NO: 16769 - RNA, 23 nt, Human
gcccuaggcaccugggcugcagg

SEQ ID NO: 16770 - RNA, 22 nt, Human
cgccucaggccaggcugcacug

SEQ ID NO: 16771 - RNA, 20 nt, Human
gcuaugcuuuuuccaaccaa

SEQ ID NO: 16772 - RNA, 27 nt, Human
gggcagcacggccuggcuuucccacgc

SEQ ID NO: 16773 - RNA, 22 nt, Human
cagccucuuuccuaacuuccuu

SEQ ID NO: 16774 - RNA, 22 nt, Human
uccucucucguaaacacacucu

SEQ ID NO: 16775 - RNA, 28 nt, Human
uaccauuuacuagauuagccaaauaguc

SEQ ID NO: 16776 - RNA, 26 nt, Human
auccuguuuuugucaguuuguuugcc

SEQ ID NO: 16777 - RNA, 22 nt, Human
ucugcugccgccccacccagau

SEQ ID NO: 16778 - RNA, 23 nt, Human
ucuguucuaaugguuccauuuag

SEQ ID NO: 16779 - RNA, 22 nt, Human
ggagcuagaagcauuauagcua

SEQ ID NO: 16780 - RNA, 23 nt, Human
caggucuuguccugguccuggcc

SEQ ID NO: 16781 - RNA, 26 nt, Human
uucaaauuugaugaaaucagaguuuu

SEQ ID NO: 16782 - RNA, 23 nt, Human
cagcucuuagcugggagcuccuu

SEQ ID NO: 16783 - RNA, 22 nt, Human
acaaauucggguaggauggagc

SEQ ID NO: 16784 - RNA, 31 nt, Human
cagucauguucaaaggaagcauuucuagaaa

SEQ ID NO: 16785 - RNA, 22 nt, Human
uggaggcggaggcagcugggga

SEQ ID NO: 16786 - RNA, 28 nt, Human
gggaggcuggcugcugcccaccucucuc

SEQ ID NO: 16787 - RNA, 22 nt, Human
ucugucacccaggcuggaguac

SEQ ID NO: 16788 - RNA, 19 nt, Human
ggaggcacgcacccagaga

SEQ ID NO: 16789 - RNA, 27 nt, Human
caaauaagggacugauguucuguuucu

SEQ ID NO: 16790 - RNA, 25 nt, Human
agccagggcugcaggcaaagcugga

SEQ ID NO: 16791 - RNA, 20 nt, Human
caugaccuugcugggcacag

SEQ ID NO: 16792 - RNA, 20 nt, Human
caaagugcugggauuacagg

SEQ ID NO: 16793 - RNA, 22 nt, Human
accuuuuuuaacauagaccaaa

SEQ ID NO: 16794 - RNA, 24 nt, Human
agcucauuucaaaggauuccgcug

SEQ ID NO: 16795 - RNA, 27 nt, Human
auuucaagcucuggguaauaacugcug

SEQ ID NO: 16796 - RNA, 26 nt, Human
gaugcagauuaccuuucugcuccuga

SEQ ID NO: 16797 - RNA, 27 nt, Human
ucuccugguagcaugaccuuuuggccu

SEQ ID NO: 16798 - RNA, 21 nt, Human
cugcacguuucuuucucuccu

SEQ ID NO: 16799 - RNA, 27 nt, Human
cuccagggcauuuuuaggaaaggguuu

SEQ ID NO: 16800 - RNA, 22 nt, Human
cauugucugacugggccuggac

SEQ ID NO: 16801 - RNA, 19 nt, Human
caugccucucagcccgugu

SEQ ID NO: 16802 - RNA, 22 nt, Human
ugcagugccaugaucacagcuc

SEQ ID NO: 16803 - RNA, 22 nt, Human
gccuuuaaucccagcauuuugg

SEQ ID NO: 16804 - RNA, 22 nt, Human
agaccaguuagauuauugaaau

SEQ ID NO: 16805 - RNA, 26 nt, Human
ggcuccccccuugguccagcuggagc

SEQ ID NO: 16806 - RNA, 27 nt, Human
gcuucuuguagcuuaacuacugccucc

SEQ ID NO: 16807 - RNA, 22 nt, Human
aacggcaugauuuuggcucacu

SEQ ID NO: 16808 - RNA, 20 nt, Human
gcagaaaagugcuuagaaag

SEQ ID NO: 16809 - RNA, 20 nt, Human
gcuggaggagagucaccucc

SEQ ID NO: 16810 - RNA, 21 nt, Human
uguaaucccagaacuuuggga

SEQ ID NO: 16811 - RNA, 25 nt, Human
ggaucccaagccuccugcugccaca

SEQ ID NO: 16812 - RNA, 23 nt, Human
ccaacagcguccaguuccuacua

SEQ ID NO: 16813 - RNA, 21 nt, Human
auggggagggagggcgucuga

SEQ ID NO: 16814 - RNA, 22 nt, Human
uccuuaaggacuuacuagccaa

SEQ ID NO: 16815 - RNA, 22 nt, Human
ccuagugccaguuugguagucc

SEQ ID NO: 16816 - RNA, 20 nt, Human
cacuaauccagcuugagugu

SEQ ID NO: 16817 - RNA, 24 nt, Human
ucaauaaauucaucuaccauucca

SEQ ID NO: 16818 - RNA, 25 nt, Human
uuuuauguuccuuuagaaaacauug

SEQ ID NO: 16819 - RNA, 22 nt, Human
ggcuuugggcuugccugccagc

SEQ ID NO: 16820 - RNA, 23 nt, Human
uuccaaggccugaugcauucaua

SEQ ID NO: 16821 - RNA, 27 nt, Human
gcucuguuguccaggcuggagugcaau

SEQ ID NO: 16822 - RNA, 27 nt, Human
uccucauucccuucuguaugacaggua

SEQ ID NO: 16823 - RNA, 20 nt, Human
gaaagagaccaaaacugucu

SEQ ID NO: 16824 - RNA, 18 nt, Human
gccucucccccuccagcc

SEQ ID NO: 16825 - RNA, 23 nt, Human
caccaugucugcacacaccagaa

SEQ ID NO: 16826 - RNA, 27 nt, Human
cccacccugccggaggcugcuccugau

SEQ ID NO: 16827 - RNA, 23 nt, Human
cagaucuuuaacauguuagugaa

SEQ ID NO: 16828 - RNA, 31 nt, Human
ucgccuugacaccgccaucucuuuucuuuaa

SEQ ID NO: 16829 - RNA, 24 nt, Human
cagugagacagucuggaaagugau

SEQ ID NO: 16830 - RNA, 22 nt, Human
cgcaaaacuaccgggcuggcag

SEQ ID NO: 16831 - RNA, 19 nt, Human
gccggguagaaaugccuga

SEQ ID NO: 16832 - RNA, 22 nt, Human
ggaggcagggagacacugcccu

SEQ ID NO: 16833 - RNA, 24 nt, Human
cagcccaguccguccgguccucac

SEQ ID NO: 16834 - RNA, 22 nt, Human
ugcucaggcugggaggcagagg

SEQ ID NO: 16835 - RNA, 23 nt, Human
cacacuuguguauauauguacau

SEQ ID NO: 16836 - RNA, 23 nt, Human
gugacucugaacagcaggaccuu

SEQ ID NO: 16837 - RNA, 24 nt, Human
ucagcacugucccuuagcagugau

SEQ ID NO: 16838 - RNA, 26 nt, Human
caucacaguuuugcaaccucugcucc

SEQ ID NO: 16839 - RNA, 19 nt, Human
agccugagaauuacugcaa

SEQ ID NO: 16840 - RNA, 26 nt, Human
aagcacagccccgaggugugcgaagc

SEQ ID NO: 16841 - RNA, 24 nt, Human
gauuuuuugacauuaauguauuua

SEQ ID NO: 16842 - RNA, 20 nt, Human
cugcagcuaccacgagggcc

SEQ ID NO: 16843 - RNA, 17 nt, Human
acccuuccuccaccuca

SEQ ID NO: 16844 - RNA, 17 nt, Human
ucuggugggaggaaggc

SEQ ID NO: 16845 - RNA, 21 nt, Human
cccauucgguguggugcagug

SEQ ID NO: 16846 - RNA, 22 nt, Human
ggccucgcagcagcaagguggg

SEQ ID NO: 16847 - RNA, 25 nt, Human
uacacaugagaaacguacauucaua

SEQ ID NO: 16848 - RNA, 21 nt, Human
uggaucuaucaccugucauca

SEQ ID NO: 16849 - RNA, 26 nt, Human
uuaucugugacagucaccagcuuuaa

SEQ ID NO: 16850 - RNA, 20 nt, Human
gcucucaucugaggcaucca

SEQ ID NO: 16851 - RNA, 21 nt, Human
ucacaaugcauuuuucaagag

SEQ ID NO: 16852 - RNA, 27 nt, Human
ccucacccucccaaguagcugggacua

SEQ ID NO: 16853 - RNA, 22 nt, Human
acaaaugaaauuuaauuacaaa

SEQ ID NO: 16854 - RNA, 27 nt, Human
ucacaugcaagugaagucauuaaagaa

SEQ ID NO: 16855 - RNA, 22 nt, Human
augagcgccaaguuucccacug

SEQ ID NO: 16856 - RNA, 27 nt, Human
uucauagaccacugaguucuaguuuuu

SEQ ID NO: 16857 - RNA, 21 nt, Human
aaccuguuuuuaacaugugau

SEQ ID NO: 16858 - RNA, 21 nt, Human
cggaagcuaggagugcugcug

SEQ ID NO: 16859 - RNA, 21 nt, Human
uugaucuguaacugcacaacc

SEQ ID NO: 16860 - RNA, 24 nt, Human
gaacucuuuggaggcagagguuau

SEQ ID NO: 16861 - RNA, 28 nt, Human
cccaugggacaaaauuuguacuauuagc

SEQ ID NO: 16862 - RNA, 23 nt, Human
gccuccaggccacauggggcugg

SEQ ID NO: 16863 - RNA, 26 nt, Human
gugggugguaggagaaggaugguuca

SEQ ID NO: 16864 - RNA, 26 nt, Human
cugucaggagcaagcuugcugcuccu

SEQ ID NO: 16865 - RNA, 26 nt, Human
agcacuucugcucugucgucucucca

SEQ ID NO: 16866 - RNA, 22 nt, Human
gggaacuaggaacauggagggg

SEQ ID NO: 16867 - RNA, 22 nt, Human
cccugcuugaacacugaagggc

SEQ ID NO: 16868 - RNA, 23 nt, Human
agguuucccuccgccuccugagg

SEQ ID NO: 16869 - RNA, 20 nt, Human
uggagaaaaugugccuuuca

SEQ ID NO: 16870 - RNA, 21 nt, Human
aacuccuccuuccugcuucag

SEQ ID NO: 16871 - RNA, 20 nt, Human
cagcccagcccagcccuacu

SEQ ID NO: 16872 - RNA, 21 nt, Human
ugguuuuguuguuuuccaaca

SEQ ID NO: 16873 - RNA, 23 nt, Human
acuguucuauuauuuguuuugac

SEQ ID NO: 16874 - RNA, 23 nt, Human
ccuguucuuucuaccauuugaau

SEQ ID NO: 16875 - RNA, 21 nt, Human
cccaacaaaauucacuguucu

SEQ ID NO: 16876 - RNA, 22 nt, Human
agucuuuucugucaccaaauuu

SEQ ID NO: 16877 - RNA, 20 nt, Human
cuaacaugcaaccauuccuc

SEQ ID NO: 16878 - RNA, 20 nt, Human
cagggagccuuccuggccau

SEQ ID NO: 16879 - RNA, 23 nt, Human
ggccauuugggauacuuccucau

SEQ ID NO: 16880 - RNA, 22 nt, Human
ugcccaggcuggagcgcagugg

SEQ ID NO: 16881 - RNA, 22 nt, Human
ucccauuucuuaaaaacggaua

SEQ ID NO: 16882 - RNA, 20 nt, Human
ugaggugagaaugaaagugg

SEQ ID NO: 16883 - RNA, 23 nt, Human
gaagcagcugggcccucugggaa

SEQ ID NO: 16884 - RNA, 30 nt, Human
ccugcuggagcugcucaagaucacgcggga

SEQ ID NO: 16885 - RNA, 18 nt, Human
gcaugugaaagcacuuug

SEQ ID NO: 16886 - RNA, 21 nt, Human
agaggagaaggucugggcagg

SEQ ID NO: 16887 - RNA, 22 nt, Human
uggcccaggguuucaagggagg

SEQ ID NO: 16888 - RNA, 22 nt, Human
ccaaguaacugggauuacaggc

SEQ ID NO: 16889 - RNA, 27 nt, Human
ugggcaacauggcgaaacccugucucu

SEQ ID NO: 16890 - RNA, 27 nt, Human
uucaaaccagccuuccugcucuuucuc

SEQ ID NO: 16891 - RNA, 21 nt, Human
ucgguggcaggggugguagcg

SEQ ID NO: 16892 - RNA, 21 nt, Human
cccaguuuccugaucggggug

SEQ ID NO: 16893 - RNA, 32 nt, Human
ccaggcuuccaagaaagaggaggagaguugaa

SEQ ID NO: 16894 - RNA, 26 nt, Human
aucucggcugacugcaaccacugccu

SEQ ID NO: 16895 - RNA, 22 nt, Human
uguaguauuuaggauguaugca

SEQ ID NO: 16896 - RNA, 22 nt, Human
caggcuggagugcaggggcgca

SEQ ID NO: 16897 - RNA, 26 nt, Human
caccuccagccagccucuuccugcag

SEQ ID NO: 16898 - RNA, 22 nt, Human
ugcacaugagucgcacauguau

SEQ ID NO: 16899 - RNA, 21 nt, Human
ugcaggcagaggcguugagga

SEQ ID NO: 16900 - RNA, 22 nt, Human
ggaaacuuuuuaauugugcaaa

SEQ ID NO: 16901 - RNA, 21 nt, Human
auuccugccagcucugccucc

SEQ ID NO: 16902 - RNA, 22 nt, Human
ggcuuagagagaggaggcagcc

SEQ ID NO: 16903 - RNA, 21 nt, Human
gaaguaugagggaaaaugagu

SEQ ID NO: 16904 - RNA, 18 nt, Human
cuucccuuugccucccca

SEQ ID NO: 16905 - RNA, 22 nt, Human
cugcaucuucccacaguggcuu

SEQ ID NO: 16906 - RNA, 21 nt, Human
uuugagacaaauuuccucuug

SEQ ID NO: 16907 - RNA, 26 nt, Human
ucccacucucauuaauccaucauguu

SEQ ID NO: 16908 - RNA, 30 nt, Human
cccugccccaggaagcccacagccucaccu

SEQ ID NO: 16909 - RNA, 27 nt, Human
accagccuggcuaacauggcaaaaccc

SEQ ID NO: 16910 - RNA, 22 nt, Human
cuguaguuccagcuauacagga

SEQ ID NO: 16911 - RNA, 22 nt, Human
cugagugaagcuaggcaaaugg

SEQ ID NO: 16912 - RNA, 24 nt, Human
ugcuguugcugaaacgcugccgcu

SEQ ID NO: 16913 - RNA, 19 nt, Human
agacgccgcggggccaggu

SEQ ID NO: 16914 - RNA, 26 nt, Human
cucccaugcccguucugaccucagcc

SEQ ID NO: 16915 - RNA, 26 nt, Human
uguucaccccucucugguacuugugg

SEQ ID NO: 16916 - RNA, 26 nt, Human
uuucauuuuccuauuggucugauuuc

SEQ ID NO: 16917 - RNA, 19 nt, Human
ugcaguaagcuaugaucau

SEQ ID NO: 16918 - RNA, 18 nt, Human
ugcacacaauuacuaaag

SEQ ID NO: 16919 - RNA, 20 nt, Human
caggaucuugaugcaacuug

SEQ ID NO: 16920 - RNA, 26 nt, Human
uugagacagggucuugcucugucacc

SEQ ID NO: 16921 - RNA, 22 nt, Human
cuccccugugugccagcccugu

SEQ ID NO: 16922 - RNA, 20 nt, Human
ugcacaacagagacugaaau

SEQ ID NO: 16923 - RNA, 22 nt, Human
ccgagaucaugacacugcacuc

SEQ ID NO: 16924 - RNA, 22 nt, Human
agaccagcccggccaacauggu

SEQ ID NO: 16925 - RNA, 20 nt, Human
ucacauuucuacaagguaau

SEQ ID NO: 16926 - RNA, 18 nt, Human
cuucccuuacccauguua

SEQ ID NO: 16927 - RNA, 19 nt, Human
cacaucuucauucuuuuua

SEQ ID NO: 16928 - RNA, 27 nt, Human
gaccagccuggccaagagaccagccug

SEQ ID NO: 16929 - RNA, 27 nt, Human
ggcucagagcagcaaaggccugaagag

SEQ ID NO: 16930 - RNA, 21 nt, Human
ggaggagaagagaagagccaa

SEQ ID NO: 16931 - RNA, 19 nt, Human
aagagccuucuguagacca

SEQ ID NO: 16932 - RNA, 21 nt, Human
uuaguaaagaaaaguuuacca

SEQ ID NO: 16933 - RNA, 22 nt, Human
gcacaugccaccaugcccagcu

SEQ ID NO: 16934 - RNA, 20 nt, Human
ucugccucugucccccagug

SEQ ID NO: 16935 - RNA, 27 nt, Human
ccugcagcugcugagacaagaggcgaa

SEQ ID NO: 16936 - RNA, 26 nt, Human
agccuccuggccccauccuccugguc

SEQ ID NO: 16937 - RNA, 27 nt, Human
uaacuggagucacuuugcaguuuucaa

SEQ ID NO: 16938 - RNA, 23 nt, Human
uacuaccaaugccaagauaauuc

SEQ ID NO: 16939 - RNA, 20 nt, Human
augauugagggcagguggca

SEQ ID NO: 16940 - RNA, 25 nt, Human
agccccucuagaguagcugguggcc

SEQ ID NO: 16941 - RNA, 24 nt, Human
accccuucccuauaggaacagccc

SEQ ID NO: 16942 - RNA, 22 nt, Human
agcuauuuuccugaaaugcuuc

SEQ ID NO: 16943 - RNA, 22 nt, Human
uccugcucugccgccugccacc

SEQ ID NO: 16944 - RNA, 26 nt, Human
agcccuagaggguagaaaguuuuccc

SEQ ID NO: 16945 - RNA, 27 nt, Human
cguggggacagagaugggugauggaac

SEQ ID NO: 16946 - RNA, 21 nt, Human
gccgggcaugguggugugugc

SEQ ID NO: 16947 - RNA, 19 nt, Human
cacaggcaugugguuuuga

SEQ ID NO: 16948 - RNA, 31 nt, Human
ccuugacuucucugagccucaguuuccuuau

SEQ ID NO: 16949 - RNA, 25 nt, Human
ccucgcgcccuagccgcccugccgg

SEQ ID NO: 16950 - RNA, 21 nt, Human
uacccuuuagacuguagccug

SEQ ID NO: 16951 - RNA, 17 nt, Human
agagccaggcuuccuuc

SEQ ID NO: 16952 - RNA, 23 nt, Human
gacaugcaucuuuaagcuuuauc

SEQ ID NO: 16953 - RNA, 25 nt, Human
agcauuuucauuucacugcacaucu

SEQ ID NO: 16954 - RNA, 20 nt, Human
gagggugagaggaagggugg

SEQ ID NO: 16955 - RNA, 21 nt, Human
acucacuguaaccuccgccuc

SEQ ID NO: 16956 - RNA, 29 nt, Human
acccauaaaugacagugacuuuuucaaua

SEQ ID NO: 16957 - RNA, 22 nt, Human
gucucgaacuccugaccucagg

SEQ ID NO: 16958 - RNA, 22 nt, Human
gucucaaacuccugaccucaga

SEQ ID NO: 16959 - RNA, 19 nt, Human
gcuggugcuccaagcacag

SEQ ID NO: 16960 - RNA, 20 nt, Human
uccagguggaggaagagaua

SEQ ID NO: 16961 - RNA, 19 nt, Human
gggagggcccugcccccau

SEQ ID NO: 16962 - RNA, 23 nt, Human
uggucaagcuugaagauucccca

SEQ ID NO: 16963 - RNA, 24 nt, Human
ugucacucaggcuggaguacagug

SEQ ID NO: 16964 - RNA, 23 nt, Human
ccaugccaccaauuccacugcua

SEQ ID NO: 16965 - RNA, 21 nt, Human
gcuguucuugacagcacucug

SEQ ID NO: 16966 - RNA, 21 nt, Human
acccugaacaacgagccuuuu

SEQ ID NO: 16967 - RNA, 21 nt, Human
ugucuucacccaccugccauc

SEQ ID NO: 16968 - RNA, 22 nt, Human
uaacauaguaagauuucaaagc

SEQ ID NO: 16969 - RNA, 27 nt, Human
uguuuacaaaaaugaauuuuuccuggu

SEQ ID NO: 16970 - RNA, 27 nt, Human
uggccaacaucaugaaaccccgucucu

SEQ ID NO: 16971 - RNA, 23 nt, Human
ggcauugaagcagauuuccagca

SEQ ID NO: 16972 - RNA, 21 nt, Human
cccagccccaacuccaggggc

SEQ ID NO: 16973 - RNA, 22 nt, Human
ccccugcagaacaugaaccuuc

SEQ ID NO: 16974 - RNA, 21 nt, Human
ccaaaccagacauaugcuuag

SEQ ID NO: 16975 - RNA, 20 nt, Human
cugcagaugaucuucucugg

SEQ ID NO: 16976 - RNA, 21 nt, Human
ggauggcaucuguucucucca

SEQ ID NO: 16977 - RNA, 21 nt, Human
agagggaaggcucucuggucu

SEQ ID NO: 16978 - RNA, 17 nt, Human
ggaggcacuuuggaaga

SEQ ID NO: 16979 - RNA, 22 nt, Human
agucaaaguucaaaaauauuca

SEQ ID NO: 16980 - RNA, 26 nt, Human
ccacugugcccucugugucagugugu

SEQ ID NO: 16981 - RNA, 27 nt, Human
cuggaguguuguauauaguguagcaaa

SEQ ID NO: 16982 - RNA, 23 nt, Human
ggcuccugcaggaucaugcagcu

SEQ ID NO: 16983 - RNA, 21 nt, Human
cagcaccucaugcagagggug

SEQ ID NO: 16984 - RNA, 23 nt, Human
cucgcccaggcuggagugcaacg

SEQ ID NO: 16985 - RNA, 21 nt, Human
ccaucaucauggcaucauugc

SEQ ID NO: 16986 - RNA, 26 nt, Human
gcuggguggggacagaagcugcaggg

SEQ ID NO: 16987 - RNA, 22 nt, Human
uaccgcugcacuccagccuggg

SEQ ID NO: 16988 - RNA, 22 nt, Human
ccugccccaacuccuuccagcu

SEQ ID NO: 16989 - RNA, 27 nt, Human
uucauucuuccucaaaguauuuaccau

SEQ ID NO: 16990 - RNA, 21 nt, Human
cacuggcagcuguggaaauga

SEQ ID NO: 16991 - RNA, 23 nt, Human
gggaagggauuuuggcucaaaac

SEQ ID NO: 16992 - RNA, 19 nt, Human
aucugccauaaagccauuc

SEQ ID NO: 16993 - RNA, 21 nt, Human
cagcucaucucauguccugaa

SEQ ID NO: 16994 - RNA, 21 nt, Human
cccaucucuacaguuuuguaa

SEQ ID NO: 16995 - RNA, 22 nt, Human
cugagguacaagaauugcugga

SEQ ID NO: 16996 - RNA, 25 nt, Human
aacgacagagaaggccaaacaaaac

SEQ ID NO: 16997 - RNA, 19 nt, Human
gcagacaccuccucaccca

SEQ ID NO: 16998 - RNA, 23 nt, Human
uuauuucuucccugcccagagcc

SEQ ID NO: 16999 - RNA, 21 nt, Human
caccagggccagccucuagag

SEQ ID NO: 17000 - RNA, 27 nt, Human
ccugccugguugggcuuccuggggcca

SEQ ID NO: 17001 - RNA, 27 nt, Human
ggcucagagaggaaagacgugucccuu

SEQ ID NO: 17002 - RNA, 22 nt, Human
uuccaucucaagacaauuuguc

SEQ ID NO: 17003 - RNA, 21 nt, Human
cuuuucucuuucuccuuaguc

SEQ ID NO: 17004 - RNA, 26 nt, Human
gacgcuggaccuuuucuuuacccaag

SEQ ID NO: 17005 - RNA, 20 nt, Human
gccagccuuggacacuugcu

SEQ ID NO: 17006 - RNA, 24 nt, Human
uggagugggcagaggugcaagaga

SEQ ID NO: 17007 - RNA, 18 nt, Human
ucccuuaaaauaccuaga

SEQ ID NO: 17008 - RNA, 24 nt, Human
ugagcugggcagagcugcggcaca

SEQ ID NO: 17009 - RNA, 25 nt, Human
gcacagcaccuucccagucuccugu

SEQ ID NO: 17010 - RNA, 27 nt, Human
gucccauuucacucucuucucauacgu

SEQ ID NO: 17011 - RNA, 18 nt, Human
cuccugaaaaaagcaguu

SEQ ID NO: 17012 - RNA, 21 nt, Human
ccuaccugccaagacaauugg

SEQ ID NO: 17013 - RNA, 23 nt, Human
caauugcugucuuucucacugug

SEQ ID NO: 17014 - RNA, 21 nt, Human
ucugcaguucucgaugaccga

SEQ ID NO: 17015 - RNA, 27 nt, Human
ccacuccccaccuucaauuccugggcc

SEQ ID NO: 17016 - RNA, 23 nt, Human
cagccugcccugccucucucaca

SEQ ID NO: 17017 - RNA, 21 nt, Human
ccaauccucugacagaagaac

SEQ ID NO: 17018 - RNA, 20 nt, Human
accugccuccucuucggcca

SEQ ID NO: 17019 - RNA, 26 nt, Human
ggccagggccagagcaggcggcccgc

SEQ ID NO: 17020 - RNA, 20 nt, Human
gcucaugcucugaacucugg

SEQ ID NO: 17021 - RNA, 23 nt, Human
uguuaaaagucucucaaauuagg

SEQ ID NO: 17022 - RNA, 22 nt, Human
uccagggcaaugaaagaaaaau

SEQ ID NO: 17023 - RNA, 21 nt, Human
gcauauccaacaugugcucag

SEQ ID NO: 17024 - RNA, 21 nt, Human
cugggucugccgcaaaggccu

SEQ ID NO: 17025 - RNA, 20 nt, Human
gucaccuaaauugguacagg

SEQ ID NO: 17026 - RNA, 25 nt, Human
ugcuaucuuugccuuuugagauacc

SEQ ID NO: 17027 - RNA, 23 nt, Human
cucucagaaaagucugagaagaa

SEQ ID NO: 17028 - RNA, 21 nt, Human
agaaagggaagaacugccuuc

SEQ ID NO: 17029 - RNA, 26 nt, Human
aggagguggaguugcagcuguuggcc

SEQ ID NO: 17030 - RNA, 18 nt, Human
ccugcugugcuuauuugc

SEQ ID NO: 17031 - RNA, 21 nt, Human
cagcuaggaacaaaucuuccu

SEQ ID NO: 17032 - RNA, 20 nt, Human
acacacaccuuucuuuagca

SEQ ID NO: 17033 - RNA, 15 nt, Human
auucauuccucucca

SEQ ID NO: 17034 - RNA, 27 nt, Human
gccuaggaucuucacugucuuacucaa

SEQ ID NO: 17035 - RNA, 26 nt, Human
ugggggcacggaauaagcacauagua

SEQ ID NO: 17036 - RNA, 21 nt, Human
acguuuaaucccagcacuuug

SEQ ID NO: 17037 - RNA, 25 nt, Human
cugugcuccugccuaugcuccuggg

SEQ ID NO: 17038 - RNA, 22 nt, Human
auugcccaggcuugagugcaau

SEQ ID NO: 17039 - RNA, 21 nt, Human
cacgugggccucacauuccag

SEQ ID NO: 17040 - RNA, 22 nt, Human
gccucaagggucuucaggggag

SEQ ID NO: 17041 - RNA, 22 nt, Human
ggccccgccccuucccuuguag

SEQ ID NO: 17042 - RNA, 21 nt, Human
gcaaggcagagccuuuuuacc

SEQ ID NO: 17043 - RNA, 22 nt, Human
gacuacaggcacgcaccaccau

SEQ ID NO: 17044 - RNA, 24 nt, Human
agcaugcguugcacuucuuuuuug

SEQ ID NO: 17045 - RNA, 26 nt, Human
cucugccucccaggcucaagcacuuu

SEQ ID NO: 17046 - RNA, 21 nt, Human
cauggcaggaaggaagaccag

SEQ ID NO: 17047 - RNA, 18 nt, Human
ucagaaauaaguuacaaa

SEQ ID NO: 17048 - RNA, 24 nt, Human
guacaugacucucagugucugugg

SEQ ID NO: 17049 - RNA, 24 nt, Human
ugccuucaggguucccgagacaga

SEQ ID NO: 17050 - RNA, 27 nt, Human
uugaaacacgaacauagacaccaggcu

SEQ ID NO: 17051 - RNA, 27 nt, Human
agcacaaagacacagacuuggggaccu

SEQ ID NO: 17052 - RNA, 26 nt, Human
agccugacagggcuuuugcgcacagc

SEQ ID NO: 17053 - RNA, 27 nt, Human
ggcaaagccuuuaguuucccacgugug

SEQ ID NO: 17054 - RNA, 23 nt, Human
cugccacccucuucuuucucccc

SEQ ID NO: 17055 - RNA, 21 nt, Human
accugggcuggagcuugggga

SEQ ID NO: 17056 - RNA, 26 nt, Human
cggggguggaggagccuuaguguguc

SEQ ID NO: 17057 - RNA, 19 nt, Human
cccagagcugcacaggguu

SEQ ID NO: 17058 - RNA, 22 nt, Human
gggaggaagagagagacugugg

SEQ ID NO: 17059 - RNA, 22 nt, Human
aguggugccaucauugcugucu

SEQ ID NO: 17060 - RNA, 23 nt, Human
gauauauuagcaagucugugaug

SEQ ID NO: 17061 - RNA, 24 nt, Human
uugauguuuuguacuuacaucuuu

SEQ ID NO: 17062 - RNA, 24 nt, Human
cucccuacuuucuuagauuuuaug

SEQ ID NO: 17063 - RNA, 24 nt, Human
ccucucgggcucucucacccagcc

SEQ ID NO: 17064 - RNA, 18 nt, Human
ggggcaaccaauuuugga

SEQ ID NO: 17065 - RNA, 27 nt, Human
gaguaggcgcccaaagcauuguggauu

SEQ ID NO: 17066 - RNA, 32 nt, Human
ccaacuuccccuccaaaccccgaagugaaacc

SEQ ID NO: 17067 - RNA, 22 nt, Human
caugcuguucugaaagggaugg

SEQ ID NO: 17068 - RNA, 23 nt, Human
uucuacccucuauucucuugugu

SEQ ID NO: 17069 - RNA, 26 nt, Human
gccagccugguccaugcagggggcuc

SEQ ID NO: 17070 - RNA, 22 nt, Human
cccucaggggcgauuagcuuag

SEQ ID NO: 17071 - RNA, 22 nt, Human
ugggacaggcugggcagagggg

SEQ ID NO: 17072 - RNA, 28 nt, Human
ucucgaacuccugaccucgugauuugcc

SEQ ID NO: 17073 - RNA, 20 nt, Human
gaaucagagcaagauuuccu

SEQ ID NO: 17074 - RNA, 30 nt, Human
aagauucuguggcuacaggcuucagcagag

SEQ ID NO: 17075 - RNA, 21 nt, Human
ccuacagucaggccacaugcc

SEQ ID NO: 17076 - RNA, 20 nt, Human
ugguggcacgcucacucccu

SEQ ID NO: 17077 - RNA, 25 nt, Human
ucucccacuugauugaccucaccag

SEQ ID NO: 17078 - RNA, 25 nt, Human
uggccagccuuuccacggcgcccac

SEQ ID NO: 17079 - RNA, 20 nt, Human
ugaauaccaacaagguugca

SEQ ID NO: 17080 - RNA, 21 nt, Human
guggggcagaggacagagggu

SEQ ID NO: 17081 - RNA, 21 nt, Human
gggguuuguugcacagucccu

SEQ ID NO: 17082 - RNA, 19 nt, Human
ccucacugcagcuggccuc

SEQ ID NO: 17083 - RNA, 27 nt, Human
cccuccagcaugggacuggccugccuc

SEQ ID NO: 17084 - RNA, 21 nt, Human
ucagcagguucaaauugguuu

SEQ ID NO: 17085 - RNA, 23 nt, Human
ggccuguaaucccagcuacuugg

SEQ ID NO: 17086 - RNA, 23 nt, Human
ucuagugccgaaugacuaugucc

SEQ ID NO: 17087 - RNA, 18 nt, Human
aaaacucaacagagccag

SEQ ID NO: 17088 - RNA, 21 nt, Human
ucgccuaggcuggagugcagu

SEQ ID NO: 17089 - RNA, 21 nt, Human
caggagguggagguugcagug

SEQ ID NO: 17090 - RNA, 26 nt, Human
gcaguuucccuaccuguuuccuccuc

SEQ ID NO: 17091 - RNA, 21 nt, Human
uugcacuaagauuuuauuugg

SEQ ID NO: 17092 - RNA, 23 nt, Human
augacauucuuagcuguaacuua

SEQ ID NO: 17093 - RNA, 24 nt, Human
ccuuguucuuagagcagauucuag

SEQ ID NO: 17094 - RNA, 26 nt, Human
gggaaccgcccuccugauuaaggcgu

SEQ ID NO: 17095 - RNA, 22 nt, Human
aaggcagcauuggggagcagga

SEQ ID NO: 17096 - RNA, 19 nt, Human
gugauauccccuucuuccc

SEQ ID NO: 17097 - RNA, 22 nt, Human
ccaucaucggcuuuccccauuc

SEQ ID NO: 17098 - RNA, 22 nt, Human
uuucaaugcagcacccuugcca

SEQ ID NO: 17099 - RNA, 20 nt, Human
ugcagcucagcagcugccuu

SEQ ID NO: 17100 - RNA, 21 nt, Human
aagauuucaagacuguguaca

SEQ ID NO: 17101 - RNA, 19 nt, Human
cuuaguggucugacauaua

SEQ ID NO: 17102 - RNA, 18 nt, Human
caugccuuucaugccuga

SEQ ID NO: 17103 - RNA, 25 nt, Human
ccccugccaccacuacugcauucac

SEQ ID NO: 17104 - RNA, 27 nt, Human
ucuucaaggaggcccacuugugucuua

SEQ ID NO: 17105 - RNA, 21 nt, Human
uacaaguggaauaagcuuacg

SEQ ID NO: 17106 - RNA, 22 nt, Human
ugggcagcccugugaagccaga

SEQ ID NO: 17107 - RNA, 21 nt, Human
gaaggagggaaucccaccuca

SEQ ID NO: 17108 - RNA, 26 nt, Human
agaggggcaacaggaggcugggaaau

SEQ ID NO: 17109 - RNA, 22 nt, Human
aaagugugggccagcccuccac

SEQ ID NO: 17110 - RNA, 22 nt, Human
gaaguagggagaaaugaaggaa

SEQ ID NO: 17111 - RNA, 22 nt, Human
ucuucuuuuugaaacaauuaug

SEQ ID NO: 17112 - RNA, 23 nt, Human
cccgcugcugggggagagcuggg

SEQ ID NO: 17113 - RNA, 22 nt, Human
uuccuccuccacuccuggccgc

SEQ ID NO: 17114 - RNA, 25 nt, Human
cucugaccuucugacuccugugggc

SEQ ID NO: 17115 - RNA, 27 nt, Human
uggccaacauggcaaaaccccgucugu

SEQ ID NO: 17116 - RNA, 27 nt, Human
ggagagggugaagcagguaucagaguc

SEQ ID NO: 17117 - RNA, 23 nt, Human
gcucauucuccccgugcgcagcc

SEQ ID NO: 17118 - RNA, 22 nt, Human
cugcuccacaucucccugcugc

SEQ ID NO: 17119 - RNA, 22 nt, Human
ggugaagcaucugcuggacaag

SEQ ID NO: 17120 - RNA, 22 nt, Human
guagggagguccaaguaugugc

SEQ ID NO: 17121 - RNA, 20 nt, Human
gaggcugugauucugccuuu

SEQ ID NO: 17122 - RNA, 20 nt, Human
gggggcaaacuuuccucuug

SEQ ID NO: 17123 - RNA, 27 nt, Human
cacagccgaguccugcaucagcccuuu

SEQ ID NO: 17124 - RNA, 21 nt, Human
gucaucugaaauuuuaaccac

SEQ ID NO: 17125 - RNA, 22 nt, Human
ggcaagucacuucaccucucug

SEQ ID NO: 17126 - RNA, 27 nt, Human
uuucauguucagcaugcaauggaauca

SEQ ID NO: 17127 - RNA, 22 nt, Human
guucugcagagacccacucuga

SEQ ID NO: 17128 - RNA, 22 nt, Human
aucacuugaaccugggaggcgg

SEQ ID NO: 17129 - RNA, 26 nt, Human
ucaccccacccauggaauaccugccu

SEQ ID NO: 17130 - RNA, 24 nt, Human
aaaugcuucagugaaaaugcagcu

SEQ ID NO: 17131 - RNA, 32 nt, Human
uaggccccagccccaaauccgccaccauuccg

SEQ ID NO: 17132 - RNA, 27 nt, Human
cagcccagccccacuccucugcugacc

SEQ ID NO: 17133 - RNA, 24 nt, Human
aucucgagcuccugaccucaggug

SEQ ID NO: 17134 - RNA, 23 nt, Human
gucugcaggaacucucccgucug

SEQ ID NO: 17135 - RNA, 21 nt, Human
ggagcccucccuccccacccc

SEQ ID NO: 17136 - RNA, 25 nt, Human
cccuccucacgucaggcuguggagc

SEQ ID NO: 17137 - RNA, 26 nt, Human
ggcaggcggcaggcguggugcacagg

SEQ ID NO: 17138 - RNA, 21 nt, Human
ucugacugaccucagggccuc

SEQ ID NO: 17139 - RNA, 22 nt, Human
acgugcugcuuccgaugugcca

SEQ ID NO: 17140 - RNA, 30 nt, Human
cucugccgccuuuccuccauuccauggcuu

SEQ ID NO: 17141 - RNA, 20 nt, Human
gcuggacagaacucacagcu

SEQ ID NO: 17142 - RNA, 26 nt, Human
uguuuaaugggcuuuucucuauuauu

SEQ ID NO: 17143 - RNA, 21 nt, Human
ggccucggcccccgcaccugg

SEQ ID NO: 17144 - RNA, 23 nt, Human
gauuggguuucaccauguuggcc

SEQ ID NO: 17145 - RNA, 23 nt, Human
aacacuucaacuucaucagugaa

SEQ ID NO: 17146 - RNA, 17 nt, Human
acuuccuuaccuagugg

SEQ ID NO: 17147 - RNA, 20 nt, Human
auguucucuucccaggccuu

SEQ ID NO: 17148 - RNA, 22 nt, Human
cggugcuuucugugaaagccuu

SEQ ID NO: 17149 - RNA, 24 nt, Human
cagauguuguuauuaacucgcucu

SEQ ID NO: 17150 - RNA, 19 nt, Human
auuauuccucuugugguua

SEQ ID NO: 17151 - RNA, 26 nt, Human
ucucaccugcuccucuaccugcucca

SEQ ID NO: 17152 - RNA, 19 nt, Human
aauuauuggcuugucuacu

SEQ ID NO: 17153 - RNA, 18 nt, Human
uucucaucuguaaaacca

SEQ ID NO: 17154 - RNA, 20 nt, Human
uggaaacagcugguacugau

SEQ ID NO: 17155 - RNA, 27 nt, Human
ucccucucucugcuccuucacugcuga

SEQ ID NO: 17156 - RNA, 21 nt, Human
guuuaucucccuuuaaaaccc

SEQ ID NO: 17157 - RNA, 27 nt, Human
agucaagugcuguggcuucaguucccc

SEQ ID NO: 17158 - RNA, 22 nt, Human
gagcccaaacauguggaagagu

SEQ ID NO: 17159 - RNA, 21 nt, Human
guuuauggaaaguaucuuuaa

SEQ ID NO: 17160 - RNA, 26 nt, Human
ucauucuccuaaucugaccacuuuca

SEQ ID NO: 17161 - RNA, 26 nt, Human
cugccucugccuuuucugucucagcg

SEQ ID NO: 17162 - RNA, 21 nt, Human
cggggagggggaaagagcagc

SEQ ID NO: 17163 - RNA, 25 nt, Human
guccuccccaccccaccugccaccg

SEQ ID NO: 17164 - RNA, 22 nt, Human
gccuaggcuggagugcagugag

SEQ ID NO: 17165 - RNA, 26 nt, Human
ugcacaggccucugccugcuggggau

SEQ ID NO: 17166 - RNA, 25 nt, Human
ggucuuucagggcccucccuugagg

SEQ ID NO: 17167 - RNA, 26 nt, Human
cacugcugggcuccuggacugagaau

SEQ ID NO: 17168 - RNA, 21 nt, Human
uagcuuuugacuuugccaaag

SEQ ID NO: 17169 - RNA, 24 nt, Human
ugggccucagugugcccaucugua

SEQ ID NO: 17170 - RNA, 25 nt, Human
ugcuagccaucuugaucuguguuuu

SEQ ID NO: 17171 - RNA, 27 nt, Human
ccugccuggcuucuauuaaugugugcu

SEQ ID NO: 17172 - RNA, 26 nt, Human
caauacaaccagcccaaccaucgguc

SEQ ID NO: 17173 - RNA, 19 nt, Human
ugaaucucccuucacacag

SEQ ID NO: 17174 - RNA, 21 nt, Human
caggguggagaggaauaagag

SEQ ID NO: 17175 - RNA, 28 nt, Human
aggccgguucgccgucugcgucuccccc

SEQ ID NO: 17176 - RNA, 21 nt, Human
cucuccagauucaagugaucc

SEQ ID NO: 17177 - RNA, 25 nt, Human
caguuucacacauaccaaaccaagg

SEQ ID NO: 17178 - RNA, 25 nt, Human
cggagagaagagagagcccggccag

SEQ ID NO: 17179 - RNA, 27 nt, Human
aaacuauuccauugaccuuaauuucuu

SEQ ID NO: 17180 - RNA, 22 nt, Human
auuguggccccuccauuuuccc

SEQ ID NO: 17181 - RNA, 22 nt, Human
gucacucaaucuggaaugcagu

SEQ ID NO: 17182 - RNA, 21 nt, Human
cuguuugcccaggaacuuagg

SEQ ID NO: 17183 - RNA, 26 nt, Human
cccucgggacgagacagccccuggca

SEQ ID NO: 17184 - RNA, 21 nt, Human
ccuucuuuggcuuuccuugcc

SEQ ID NO: 17185 - RNA, 24 nt, Human
gggcuggaauguccuguggccgca

SEQ ID NO: 17186 - RNA, 27 nt, Human
ugccacuacacuccagccuggcgacag

SEQ ID NO: 17187 - RNA, 23 nt, Human
uuuacacauggagagaugcccca

SEQ ID NO: 17188 - RNA, 26 nt, Human
caggcuugccaagagguuggaaggga

SEQ ID NO: 17189 - RNA, 22 nt, Human
uauuuuuggucacuugcuuuau

SEQ ID NO: 17190 - RNA, 20 nt, Human
uaccuucaucagcaccagaa

SEQ ID NO: 17191 - RNA, 18 nt, Human
cuuaccccacacuuuuau

SEQ ID NO: 17192 - RNA, 20 nt, Human
acauccccacccuguguaca

SEQ ID NO: 17193 - RNA, 19 nt, Human
ccuuccugccucuacucca

SEQ ID NO: 17194 - RNA, 22 nt, Human
aguuguacuucauccuauauca

SEQ ID NO: 17195 - RNA, 24 nt, Human
auuucuauuuuuagaaaggguuuu

SEQ ID NO: 17196 - RNA, 22 nt, Human
aaagugcagagauuacagucuc

SEQ ID NO: 17197 - RNA, 24 nt, Human
cucugaguggugcccuucugccca

SEQ ID NO: 17198 - RNA, 25 nt, Human
agaguaaaauggacaagggacgagg

SEQ ID NO: 17199 - RNA, 21 nt, Human
gggaagaguuuagugugaaac

SEQ ID NO: 17200 - RNA, 22 nt, Human
auccuauaucagcacagcugcc

SEQ ID NO: 17201 - RNA, 18 nt, Human
gggauacuuucagaugcu

SEQ ID NO: 17202 - RNA, 22 nt, Human
gaaggugugugcacagagggug

SEQ ID NO: 17203 - RNA, 21 nt, Human
auacuauuuuuucacacuacg

SEQ ID NO: 17204 - RNA, 21 nt, Human
accuccgugugaauggaaggg

SEQ ID NO: 17205 - RNA, 21 nt, Human
cuuccaggaaaggaagcaugg

SEQ ID NO: 17206 - RNA, 14 nt, Human
uccauacaucuucc

SEQ ID NO: 17207 - RNA, 25 nt, Human
caccagacuuuucucuagaagccgu

SEQ ID NO: 17208 - RNA, 20 nt, Human
ucuugcuauguuguccaggc

SEQ ID NO: 17209 - RNA, 25 nt, Human
cauaaugcaguaucuuccccugacu

SEQ ID NO: 17210 - RNA, 23 nt, Human
gaggaagaaagaaaggcagggca

SEQ ID NO: 17211 - RNA, 30 nt, Human
gguuuuaauuugcauuuccauaauaucuaa

SEQ ID NO: 17212 - RNA, 24 nt, Human
aaaguguccauugacauguacaga

SEQ ID NO: 17213 - RNA, 22 nt, Human
uguaaccccuuagcuggcauuu

SEQ ID NO: 17214 - RNA, 22 nt, Human
uuuucugagcucuccccaauca

SEQ ID NO: 17215 - RNA, 26 nt, Human
agacaugcuacaauuuucauuuuugu

SEQ ID NO: 17216 - RNA, 26 nt, Human
uagacaccucuccacuccucauccca

SEQ ID NO: 17217 - RNA, 23 nt, Human
uaaaacgccuacagcugccuccu

SEQ ID NO: 17218 - RNA, 21 nt, Human
guacuugucauagacuccuuu

SEQ ID NO: 17219 - RNA, 27 nt, Human
ccccacccagucucauguuggggaggg

SEQ ID NO: 17220 - RNA, 22 nt, Human
ucuucucucagcuuccacugcc

SEQ ID NO: 17221 - RNA, 21 nt, Human
gggcauuggaagcucucucca

SEQ ID NO: 17222 - RNA, 27 nt, Human
ucuggucaucccuccccacccucucuc

SEQ ID NO: 17223 - RNA, 29 nt, Human
cuucaagaugagccugggcucauagugag

SEQ ID NO: 17224 - RNA, 20 nt, Human
cuuccaauuauauuucccaa

SEQ ID NO: 17225 - RNA, 25 nt, Human
ucugcaacgaugacagcgcuucugc

SEQ ID NO: 17226 - RNA, 25 nt, Human
agcaaaguguuagcugcuguuguau

SEQ ID NO: 17227 - RNA, 24 nt, Human
gagcagcugaauuggcugccaaga

SEQ ID NO: 17228 - RNA, 24 nt, Human
augcuaucauagcacacuacagcc

SEQ ID NO: 17229 - RNA, 22 nt, Human
agaaacaaacaagauagcuuca

SEQ ID NO: 17230 - RNA, 21 nt, Human
caugccugcugcccugcccuc

SEQ ID NO: 17231 - RNA, 25 nt, Human
aaaagcaacuguauaaaugaaugua

SEQ ID NO: 17232 - RNA, 20 nt, Human
ggagaggggcggacggcggc

SEQ ID NO: 17233 - RNA, 24 nt, Human
acaggggcgugaggucccaggaag

SEQ ID NO: 17234 - RNA, 23 nt, Human
gcagggguuucagccugacuguc

SEQ ID NO: 17235 - RNA, 23 nt, Human
uaugagagggcccugccugcugc

SEQ ID NO: 17236 - RNA, 19 nt, Human
uggguaggggccaggcuag

SEQ ID NO: 17237 - RNA, 22 nt, Human
agacuuauacaccccugaguga

SEQ ID NO: 17238 - RNA, 22 nt, Human
accagccugggcaacacaguga

SEQ ID NO: 17239 - RNA, 27 nt, Human
cucacauccucuccaggaaggcaguga

SEQ ID NO: 17240 - RNA, 19 nt, Human
gguuucaucaugguggcca

SEQ ID NO: 17241 - RNA, 27 nt, Human
uagucccgggcuggcgggagugcaguu

SEQ ID NO: 17242 - RNA, 23 nt, Human
ggcucccuggcaggaugcugagc

SEQ ID NO: 17243 - RNA, 24 nt, Human
ccuagggaagggugguggagccag

SEQ ID NO: 17244 - RNA, 23 nt, Human
cggagcugagcagauccgagccg

SEQ ID NO: 17245 - RNA, 23 nt, Human
gccaggaagggggccuggaagac

SEQ ID NO: 17246 - RNA, 24 nt, Human
uagcauuugauacagugucuguga

SEQ ID NO: 17247 - RNA, 22 nt, Human
gccuugcaggcuggagggcggc

SEQ ID NO: 17248 - RNA, 25 nt, Human
uacuaccuaguuaaacauuuacuuu

SEQ ID NO: 17249 - RNA, 23 nt, Human
uccugcuccgggggcagaccaga

SEQ ID NO: 17250 - RNA, 28 nt, Human
gguucugcuguugaguccuggguggcug

SEQ ID NO: 17251 - RNA, 24 nt, Human
acugaauuuaguaaccacucugaa

SEQ ID NO: 17252 - RNA, 22 nt, Human
ggaauuuguuuauuacagcucu

SEQ ID NO: 17253 - RNA, 26 nt, Human
uuuucuuucuuguguugucuuuuuau

SEQ ID NO: 17254 - RNA, 22 nt, Human
gcugcugccacuccagcaaggg

SEQ ID NO: 17255 - RNA, 26 nt, Human
ccuucuggcccucagucuguuccccu

SEQ ID NO: 17256 - RNA, 21 nt, Human
gcccaagauucuucagucugg

SEQ ID NO: 17257 - RNA, 20 nt, Human
ggugacuuccuggggccaag

SEQ ID NO: 17258 - RNA, 23 nt, Human
cuuccauuucugagaacaaguca

SEQ ID NO: 17259 - RNA, 16 nt, Human
aacaggccugcugcua

SEQ ID NO: 17260 - RNA, 23 nt, Human
ucuguccuaaucauacaccagaa

SEQ ID NO: 17261 - RNA, 24 nt, Human
cccucagccgaggcugcuccgcgg

SEQ ID NO: 17262 - RNA, 20 nt, Human
aguuaccaccuccugccuca

SEQ ID NO: 17263 - RNA, 22 nt, Human
ucccacaguauuuugugcaaug

SEQ ID NO: 17264 - RNA, 27 nt, Human
cacugccuagucgggacuuguaacaua

SEQ ID NO: 17265 - RNA, 18 nt, Human
ucagaaauucucugugau

SEQ ID NO: 17266 - RNA, 22 nt, Human
gugaccagagaccaccucugug

SEQ ID NO: 17267 - RNA, 23 nt, Human
gcccccucuucccugguaagaaa

SEQ ID NO: 17268 - RNA, 18 nt, Human
aaucccuggcccaaaggc

SEQ ID NO: 17269 - RNA, 20 nt, Human
uccagucuggcugcuguugu

SEQ ID NO: 17270 - RNA, 21 nt, Human
uacuuucuuuuuaauaggaca

SEQ ID NO: 17271 - RNA, 20 nt, Human
agggcuuuacccucagugaa

SEQ ID NO: 17272 - RNA, 22 nt, Human
gaggcaucugguuacugguuau

SEQ ID NO: 17273 - RNA, 25 nt, Human
cccugucuucccucuggagcuguuu

SEQ ID NO: 17274 - RNA, 23 nt, Human
uucuugcucugcucaucuacaca

SEQ ID NO: 17275 - RNA, 26 nt, Human
cuuaccucccugguccccguuuguca

SEQ ID NO: 17276 - RNA, 21 nt, Human
ucacccagacuggcgugcagu

SEQ ID NO: 17277 - RNA, 26 nt, Human
uuccuuacaaucagagccccucucac

SEQ ID NO: 17278 - RNA, 23 nt, Human
uguugggccucacaaggaccagg

SEQ ID NO: 17279 - RNA, 26 nt, Human
cauguccuuggcagagaugacaggca

SEQ ID NO: 17280 - RNA, 22 nt, Human
gcgcugaggggcccaaugggag

SEQ ID NO: 17281 - RNA, 20 nt, Human
cuguaaucccagaacuuugg

SEQ ID NO: 17282 - RNA, 24 nt, Human
acuagagaccgcucagugcucuua

SEQ ID NO: 17283 - RNA, 22 nt, Human
uccgcugacaccuucccuuucg

SEQ ID NO: 17284 - RNA, 22 nt, Human
aucacuugaacccgggaggcgg

SEQ ID NO: 17285 - RNA, 22 nt, Human
auugcuugaacuggggaggcag

SEQ ID NO: 17286 - RNA, 24 nt, Human
uguuagugguuguaucugcuuuga

SEQ ID NO: 17287 - RNA, 26 nt, Human
gaccgaggcgugcagcggacagcaga

SEQ ID NO: 17288 - RNA, 30 nt, Human
ugcuggucccagcaugaaugcgggccccgg

SEQ ID NO: 17289 - RNA, 22 nt, Human
cugcaaccucuuccuccugguu

SEQ ID NO: 17290 - RNA, 28 nt, Human
ucucaaacuccugaccucaggugauccg

SEQ ID NO: 17291 - RNA, 20 nt, Human
uggccucaugaucagccugc

SEQ ID NO: 17292 - RNA, 25 nt, Human
uuccuccggccccaggagcaacccc

SEQ ID NO: 17293 - RNA, 32 nt, Human
gugcuccugccaccucccaccucucugagggc

SEQ ID NO: 17294 - RNA, 18 nt, Human
gauuucugcucugcugac

SEQ ID NO: 17295 - RNA, 26 nt, Human
ccucagccuccuggggacucgagccg

SEQ ID NO: 17296 - RNA, 22 nt, Human
gcucacgcccguaaucccaggg

SEQ ID NO: 17297 - RNA, 26 nt, Human
agcagcaaccacuagccuccugcccc

SEQ ID NO: 17298 - RNA, 23 nt, Human
uugguugccugauguagagcuca

SEQ ID NO: 17299 - RNA, 23 nt, Human
aagaacaucuuuaugguaaagau

SEQ ID NO: 17300 - RNA, 25 nt, Human
cuaccccccaggcugaagugcagug

SEQ ID NO: 17301 - RNA, 22 nt, Human
ugugugccaggcaccgugcugg

SEQ ID NO: 17302 - RNA, 18 nt, Human
cccauuuugaaugccuua

SEQ ID NO: 17303 - RNA, 21 nt, Human
acccccacccucuccccugcc

SEQ ID NO: 17304 - RNA, 26 nt, Human
gccuaucugccuggaggcaaaggccu

SEQ ID NO: 17305 - RNA, 26 nt, Human
ucucucucgaucacucccucccuucc

SEQ ID NO: 17306 - RNA, 20 nt, Human
ggcucacugcaccucugucu

SEQ ID NO: 17307 - RNA, 20 nt, Human
uugaagcuguauacugugug

SEQ ID NO: 17308 - RNA, 21 nt, Human
cagagucucgcucugucgcca

SEQ ID NO: 17309 - RNA, 27 nt, Human
gugguugugguguagacugugucaggc

SEQ ID NO: 17310 - RNA, 22 nt, Human
ccugcagccccacaguccugcu

SEQ ID NO: 17311 - RNA, 24 nt, Human
gacucacaccuuguggcugccuuc

SEQ ID NO: 17312 - RNA, 27 nt, Human
ucuccaauugccucuugcaggcugagu

SEQ ID NO: 17313 - RNA, 22 nt, Human
ccaggcuggagggcaguggcac

SEQ ID NO: 17314 - RNA, 20 nt, Human
uuggaagcuaauuagcccac

SEQ ID NO: 17315 - RNA, 22 nt, Human
aggccgaggcaggcggaucacc

SEQ ID NO: 17316 - RNA, 22 nt, Human
aggccgaggcagguggaucacu

SEQ ID NO: 17317 - RNA, 21 nt, Human
cugagaugccuguucaucugc

SEQ ID NO: 17318 - RNA, 21 nt, Human
acacugaggcagccuugggga

SEQ ID NO: 17319 - RNA, 18 nt, Human
cccgcugcaccucuuguu

SEQ ID NO: 17320 - RNA, 25 nt, Human
ugggaggcggaggagguugcaguga

SEQ ID NO: 17321 - RNA, 23 nt, Human
ggggcugccggcccugccagugc

SEQ ID NO: 17322 - RNA, 21 nt, Human
uuuguauuugcucacaguguu

SEQ ID NO: 17323 - RNA, 24 nt, Human
cccagugggccuguggcauucaua

SEQ ID NO: 17324 - RNA, 22 nt, Human
uuggucccuguccuugcugccc

SEQ ID NO: 17325 - RNA, 23 nt, Human
uccgcaccgcggccgcucagccu

SEQ ID NO: 17326 - RNA, 21 nt, Human
ucauagcggagagaaacccca

SEQ ID NO: 17327 - RNA, 20 nt, Human
uagccucuucagauuccuua

SEQ ID NO: 17328 - RNA, 20 nt, Human
uggggcuuccucugcucugg

SEQ ID NO: 17329 - RNA, 22 nt, Human
ccgggaggcggagauugcggug

SEQ ID NO: 17330 - RNA, 25 nt, Human
uauccuguguaacacuuggcucuug

SEQ ID NO: 17331 - RNA, 20 nt, Human
ugcaaacugccuucuuguca

SEQ ID NO: 17332 - RNA, 22 nt, Human
gggccuggguacagggcaugag

SEQ ID NO: 17333 - RNA, 20 nt, Human
ggaggaugcugugccuccca

SEQ ID NO: 17334 - RNA, 23 nt, Human
gcugagaacccagcgauaagggg

SEQ ID NO: 17335 - RNA, 20 nt, Human
uugcucuugugccuccuggg

SEQ ID NO: 17336 - RNA, 22 nt, Human
ucaggggguggagguugcagug

SEQ ID NO: 17337 - RNA, 22 nt, Human
ccaggaggcggagauugcagug

SEQ ID NO: 17338 - RNA, 26 nt, Human
gggaggcagagacugguccagagccc

SEQ ID NO: 17339 - RNA, 21 nt, Human
gucugcugggagaaucaagaa

SEQ ID NO: 17340 - RNA, 18 nt, Human
accauaaaaauuaccugc

SEQ ID NO: 17341 - RNA, 24 nt, Human
ggcaauucuagucuuccacaaaac

SEQ ID NO: 17342 - RNA, 24 nt, Human
ccuacuucucuuaucuuugaucgu

SEQ ID NO: 17343 - RNA, 28 nt, Human
cagaaauggggaaauugcagauuuugac

SEQ ID NO: 17344 - RNA, 20 nt, Human
ucuccucuuugugaaauccc

SEQ ID NO: 17345 - RNA, 20 nt, Human
cuaaaugaacacugucuacu

SEQ ID NO: 17346 - RNA, 27 nt, Human
ggaggcuggggcgagaggauugcuuga

SEQ ID NO: 17347 - RNA, 23 nt, Human
acugaaacauucacacagggcuc

SEQ ID NO: 17348 - RNA, 22 nt, Human
ccugcagccccucgcacuaccc

SEQ ID NO: 17349 - RNA, 24 nt, Human
cuguucccucucugucuagguguc

SEQ ID NO: 17350 - RNA, 23 nt, Human
gcuuccccacgggaacauuauuc

SEQ ID NO: 17351 - RNA, 22 nt, Human
auugcuugaacuugggaggugg

SEQ ID NO: 17352 - RNA, 18 nt, Human
acggugauaaaugccugu

SEQ ID NO: 17353 - RNA, 21 nt, Human
cucuaguugucaguaucugag

SEQ ID NO: 17354 - RNA, 25 nt, Human
ggccagggagaggagguggccuagc

SEQ ID NO: 17355 - RNA, 20 nt, Human
gaaauuuuuacuggagagaa

SEQ ID NO: 17356 - RNA, 26 nt, Human
caacagcagaaccugccucuccguga

SEQ ID NO: 17357 - RNA, 25 nt, Human
gaucuggggguuagaguggaggaaa

SEQ ID NO: 17358 - RNA, 27 nt, Human
cugccuaauuaguuuuaucuguuccau

SEQ ID NO: 17359 - RNA, 22 nt, Human
cuccacccuccuccucuucacc

SEQ ID NO: 17360 - RNA, 26 nt, Human
gcuauacuuaacagggcaucauagaa

SEQ ID NO: 17361 - RNA, 29 nt, Human
caugccaugcauuaaaaauccaaaauugc

SEQ ID NO: 17362 - RNA, 27 nt, Human
caaaccugagacuuauuggaaguguac

SEQ ID NO: 17363 - RNA, 22 nt, Human
cuacuggguguuccucucuaaa

SEQ ID NO: 17364 - RNA, 20 nt, Human
ggcaaaacaaaagcuucgag

SEQ ID NO: 17365 - RNA, 21 nt, Human
gacacacacgcaaccuccugg

SEQ ID NO: 17366 - RNA, 23 nt, Human
auagauuuauuuuucaguuccaa

SEQ ID NO: 17367 - RNA, 22 nt, Human
ucuuugaauccccucauggccu

SEQ ID NO: 17368 - RNA, 26 nt, Human
cugaaauguugggguugcuuguuaua

SEQ ID NO: 17369 - RNA, 25 nt, Human
aggagugaccauagccacugcugaa

SEQ ID NO: 17370 - RNA, 27 nt, Human
ucuugccucgauguccuagccuagggg

SEQ ID NO: 17371 - RNA, 24 nt, Human
acaaaccuggauuuuuuauguaca

SEQ ID NO: 17372 - RNA, 23 nt, Human
caggguggagugcagugguagcg

SEQ ID NO: 17373 - RNA, 22 nt, Human
aauauaaaaaguaaccaaccuc

SEQ ID NO: 17374 - RNA, 22 nt, Human
aaacuccugaccucaguugauc

SEQ ID NO: 17375 - RNA, 25 nt, Human
gcaauguauuucgcucaucuggacc

SEQ ID NO: 17376 - RNA, 18 nt, Human
ccuaaauuccuuaucaua

SEQ ID NO: 17377 - RNA, 20 nt, Human
agcauuugucucccaccuca

SEQ ID NO: 17378 - RNA, 24 nt, Human
ucccuguggggagugcagggccag

SEQ ID NO: 17379 - RNA, 26 nt, Human
gggugagggcagcccucagggucggc

SEQ ID NO: 17380 - RNA, 21 nt, Human
uucaguucuguguacauuuua

SEQ ID NO: 17381 - RNA, 32 nt, Human
ggccuggucauugccuccucagcacucccucc

SEQ ID NO: 17382 - RNA, 27 nt, Human
ucuucagagccacagaccucagggugg

SEQ ID NO: 17383 - RNA, 23 nt, Human
acugccaggaguagugagcugua

SEQ ID NO: 17384 - RNA, 27 nt, Human
uccggagucccugcaggugaauaaaca

SEQ ID NO: 17385 - RNA, 21 nt, Human
uuguguguggggaugcuuacc

SEQ ID NO: 17386 - RNA, 21 nt, Human
uccucucacccgacagccugc

SEQ ID NO: 17387 - RNA, 27 nt, Human
ccauacagauuaauauguagcaaaaau

SEQ ID NO: 17388 - RNA, 25 nt, Human
cauccugcucuccuccagccgaggg

SEQ ID NO: 17389 - RNA, 22 nt, Human
cugcaaccuccgccucccaggu

SEQ ID NO: 17390 - RNA, 32 nt, Human
ccuccccggccacgcggagagcuguacagugu

SEQ ID NO: 17391 - RNA, 22 nt, Human
cggcggggcuggggccacugag

SEQ ID NO: 17392 - RNA, 22 nt, Human
uugucacuggguugaaguauau

SEQ ID NO: 17393 - RNA, 24 nt, Human
uacugcagggccaggacugagccc

SEQ ID NO: 17394 - RNA, 23 nt, Human
auguuggcaauaaugaugcauug

SEQ ID NO: 17395 - RNA, 22 nt, Human
guugccugggcuggagaacagu

SEQ ID NO: 17396 - RNA, 21 nt, Human
ucaucucuaacagcucaggau

SEQ ID NO: 17397 - RNA, 18 nt, Human
gcuuuccccucuugggcc

SEQ ID NO: 17398 - RNA, 23 nt, Human
agcggaugcuuucaugcacccuu

SEQ ID NO: 17399 - RNA, 17 nt, Human
gugugguuccugggaca

SEQ ID NO: 17400 - RNA, 20 nt, Human
gcuguucuucaacuccuggg

SEQ ID NO: 17401 - RNA, 21 nt, Human
gucucucuucagcugugacuu

SEQ ID NO: 17402 - RNA, 22 nt, Human
uggacuuuuauuccugugucuu

SEQ ID NO: 17403 - RNA, 23 nt, Human
cucugcaccagccggcccccagg

SEQ ID NO: 17404 - RNA, 26 nt, Human
ggugccuccugacacaccugcagccu

SEQ ID NO: 17405 - RNA, 27 nt, Human
acguucugucaacugugcugugcucuu

SEQ ID NO: 17406 - RNA, 22 nt, Human
agucuaccagugaccucagggc

SEQ ID NO: 17407 - RNA, 23 nt, Human
cacacaccuacuuuucugcuucg

SEQ ID NO: 17408 - RNA, 21 nt, Human
gauauuuccauuucuuccuca

SEQ ID NO: 17409 - RNA, 25 nt, Human
guguggacuggaugaggaaacuagc

SEQ ID NO: 17410 - RNA, 27 nt, Human
cgcaacugagaucuccaugacugugug

SEQ ID NO: 17411 - RNA, 23 nt, Human
caggcacgcgccaccacgcccag

SEQ ID NO: 17412 - RNA, 20 nt, Human
agaagaugugauuugcaaac

SEQ ID NO: 17413 - RNA, 23 nt, Human
uagucucuucucagagcagcacu

SEQ ID NO: 17414 - RNA, 22 nt, Human
ucgagacccaaacccccaaaau

SEQ ID NO: 17415 - RNA, 22 nt, Human
cuguggacugcaagucuuugag

SEQ ID NO: 17416 - RNA, 20 nt, Human
auccuagcaacagauuucuc

SEQ ID NO: 17417 - RNA, 27 nt, Human
gaggcugugcuucagguaugguacaau

SEQ ID NO: 17418 - RNA, 27 nt, Human
gacugcaugguggagagggagcugggg

SEQ ID NO: 17419 - RNA, 24 nt, Human
ccuaccccacaccugggcucucca

SEQ ID NO: 17420 - RNA, 27 nt, Human
ggaggguggagggcccugcgccugcgc

SEQ ID NO: 17421 - RNA, 22 nt, Human
cacucacugaaguuuugcauuc

SEQ ID NO: 17422 - RNA, 22 nt, Human
cagcugcccacacccacacucu

SEQ ID NO: 17423 - RNA, 20 nt, Human
agccgggcccgggaggaggu

SEQ ID NO: 17424 - RNA, 26 nt, Human
gauacaauguauaagcuacucacuua

SEQ ID NO: 17425 - RNA, 22 nt, Human
cuuuaugcagcagucagguaca

SEQ ID NO: 17426 - RNA, 27 nt, Human
gcggcgcuguguggaggcccgcgagcu

SEQ ID NO: 17427 - RNA, 27 nt, Human
uuucucacuuugccaucauguggccuc

SEQ ID NO: 17428 - RNA, 22 nt, Human
auacccuuggauuagagagaag

SEQ ID NO: 17429 - RNA, 22 nt, Human
uugaugcucaguuuuagggucu

SEQ ID NO: 17430 - RNA, 23 nt, Human
acuguucucauuuuauugcuagc

SEQ ID NO: 17431 - RNA, 24 nt, Human
aucuucauacacguuuggaaaugu

SEQ ID NO: 17432 - RNA, 24 nt, Human
gggaaaaaucacuauuaauuucug

SEQ ID NO: 17433 - RNA, 22 nt, Human
gaccuuuugggcucaagugauc

SEQ ID NO: 17434 - RNA, 21 nt, Human
acuaguuauuacagcuguaag

SEQ ID NO: 17435 - RNA, 21 nt, Human
cugaagcccaguuccuuuccc

SEQ ID NO: 17436 - RNA, 24 nt, Human
guguccaggcugcacccacagaug

SEQ ID NO: 17437 - RNA, 24 nt, Human
agguacagucaggggaaaauagau

SEQ ID NO: 17438 - RNA, 19 nt, Human
guacccaggggagauucca

SEQ ID NO: 17439 - RNA, 21 nt, Human
ucuggucucuaggcuggggaa

SEQ ID NO: 17440 - RNA, 21 nt, Human
cugcuuccuguuuguugaggg

SEQ ID NO: 17441 - RNA, 21 nt, Human
gagggggaagugucugccuuu

SEQ ID NO: 17442 - RNA, 24 nt, Human
ucaaaacaauuguugcagcaggcu

SEQ ID NO: 17443 - RNA, 23 nt, Human
gauuggcuccacgaaagugauac

SEQ ID NO: 17444 - RNA, 26 nt, Human
cagcacuucggcuccucuaaccugug

SEQ ID NO: 17445 - RNA, 22 nt, Human
uuuccuucucuccuccuuuauu

SEQ ID NO: 17446 - RNA, 28 nt, Human
accccugagguaaacacuccacuaagcu

SEQ ID NO: 17447 - RNA, 20 nt, Human
aauggguauggaaugaauca

SEQ ID NO: 17448 - RNA, 22 nt, Human
gcugcuugcugugagugucucu

SEQ ID NO: 17449 - RNA, 30 nt, Human
ccugucucagggaauugccugcugggguga

SEQ ID NO: 17450 - RNA, 24 nt, Human
uagggaggagggaauuacuaggga

SEQ ID NO: 17451 - RNA, 27 nt, Human
cugaguauuuuucuaaucugaccaauc

SEQ ID NO: 17452 - RNA, 26 nt, Human
cggcuuuucucccaaaaaucggcuga

SEQ ID NO: 17453 - RNA, 22 nt, Human
uaauccagagacugacuucacu

SEQ ID NO: 17454 - RNA, 25 nt, Human
gugaccacaggcugguguguaggug

SEQ ID NO: 17455 - RNA, 27 nt, Human
aaagugcugggauuaugggcgggugug

SEQ ID NO: 17456 - RNA, 24 nt, Human
aggaagggaaguggaacuuuccau

SEQ ID NO: 17457 - RNA, 25 nt, Human
cugugugauuguaaucacaugguga

SEQ ID NO: 17458 - RNA, 18 nt, Human
uacugcacugccuggcuc

SEQ ID NO: 17459 - RNA, 21 nt, Human
ggauccucaguucucaaaugu

SEQ ID NO: 17460 - RNA, 22 nt, Human
uucgugcgugggcuucuuucuc

SEQ ID NO: 17461 - RNA, 22 nt, Human
gggaauacuuaugcauggggag

SEQ ID NO: 17462 - RNA, 23 nt, Human
cuuccccaaugcuccaucccaac

SEQ ID NO: 17463 - RNA, 20 nt, Human
ccuccagggccucuccuugg

SEQ ID NO: 17464 - RNA, 22 nt, Human
uguuacccaggcuggucuucaa

SEQ ID NO: 17465 - RNA, 22 nt, Human
ggaagcagaggcuggaggauca

SEQ ID NO: 17466 - RNA, 25 nt, Human
auggaaacuacaagaguggcugguu

SEQ ID NO: 17467 - RNA, 19 nt, Human
ugugugacugacugugggu

SEQ ID NO: 17468 - RNA, 20 nt, Human
uguuguaggaaaagcuguuc

SEQ ID NO: 17469 - RNA, 22 nt, Human
aaaggcagccuuuuucuggccu

SEQ ID NO: 17470 - RNA, 27 nt, Human
gucacccaggcuggagugcaauggcgc

SEQ ID NO: 17471 - RNA, 26 nt, Human
acuugaauuccuaguaacuuucuugg

SEQ ID NO: 17472 - RNA, 22 nt, Human
ucacucaggcuggagcacagug

SEQ ID NO: 17473 - RNA, 23 nt, Human
caccagccagaaaucucugauau

SEQ ID NO: 17474 - RNA, 24 nt, Human
acucaauaaaagcacaaaagugca

SEQ ID NO: 17475 - RNA, 28 nt, Human
cagccacucuucccagaacauaugucau

SEQ ID NO: 17476 - RNA, 22 nt, Human
uuaaauuugucaguuugcaaaa

SEQ ID NO: 17477 - RNA, 19 nt, Human
ccucacaacccugcuuaca

SEQ ID NO: 17478 - RNA, 22 nt, Human
acugcagccuccgccucccggg

SEQ ID NO: 17479 - RNA, 24 nt, Human
cagccucuccccaaaguacuugaa

SEQ ID NO: 17480 - RNA, 19 nt, Human
uugggagcuugcugugucu

SEQ ID NO: 17481 - RNA, 27 nt, Human
aucagccuggccaucuggauuuucaca

SEQ ID NO: 17482 - RNA, 21 nt, Human
cugccuuggccucacugaggc

SEQ ID NO: 17483 - RNA, 23 nt, Human
uccuauuuagcuaagcagcagug

SEQ ID NO: 17484 - RNA, 17 nt, Human
acacuccuucaguucag

SEQ ID NO: 17485 - RNA, 22 nt, Human
cugcccaggccaggacugaggc

SEQ ID NO: 17486 - RNA, 17 nt, Human
gaaacaaucacauuguu

SEQ ID NO: 17487 - RNA, 21 nt, Human
agccaacacgcaccugccuca

SEQ ID NO: 17488 - RNA, 24 nt, Human
ggcacaagagggucgaggagccag

SEQ ID NO: 17489 - RNA, 25 nt, Human
gcugcuggggccucagacgagaccc

SEQ ID NO: 17490 - RNA, 19 nt, Human
gaggugagcaugagcuuga

SEQ ID NO: 17491 - RNA, 23 nt, Human
accauuuuaagaacagaugacuc

SEQ ID NO: 17492 - RNA, 26 nt, Human
cugcggccuccaccaaccccgcggcc

SEQ ID NO: 17493 - RNA, 20 nt, Human
uuccacccucugccccuucc

SEQ ID NO: 17494 - RNA, 23 nt, Human
gcccccgggccugcacagauacc

SEQ ID NO: 17495 - RNA, 21 nt, Human
uuuccuacaaaauggagggag

SEQ ID NO: 17496 - RNA, 21 nt, Human
gcuucgagccugaccccacca

SEQ ID NO: 17497 - RNA, 25 nt, Human
ucuccugacucuccaucgcucuguc

SEQ ID NO: 17498 - RNA, 27 nt, Human
cggcccagccaccauguccauccacuu

SEQ ID NO: 17499 - RNA, 22 nt, Human
ggagcaagaaucacacucaggc

SEQ ID NO: 17500 - RNA, 21 nt, Human
gcccgguuggcgugggccaga

SEQ ID NO: 17501 - RNA, 23 nt, Human
uccucuugaagauauugaaaaag

SEQ ID NO: 17502 - RNA, 22 nt, Human
aaaaggagaggaagcguucacc

SEQ ID NO: 17503 - RNA, 27 nt, Human
ucacccaggcuggagugaucucagcuc

SEQ ID NO: 17504 - RNA, 20 nt, Human
uccccuggcaacugcugauc

SEQ ID NO: 17505 - RNA, 26 nt, Human
ugaacuucaaaagcuuuuugauguau

SEQ ID NO: 17506 - RNA, 21 nt, Human
gucugggacuacuggcugaag

SEQ ID NO: 17507 - RNA, 26 nt, Human
agccugguuugucaucccugcccuag

SEQ ID NO: 17508 - RNA, 18 nt, Human
auuggguuuagucaauca

SEQ ID NO: 17509 - RNA, 20 nt, Human
aagggagggagaugagaagu

SEQ ID NO: 17510 - RNA, 27 nt, Human
cacuacagugucgccgccucugccugc

SEQ ID NO: 17511 - RNA, 22 nt, Human
uuucuagcccucucccucaguc

SEQ ID NO: 17512 - RNA, 24 nt, Human
caagaaacaagagcuauggcauuu

SEQ ID NO: 17513 - RNA, 26 nt, Human
cugccucuuggcuucucagccccuuu

SEQ ID NO: 17514 - RNA, 23 nt, Human
aacuauacauuguauguaaauuc

SEQ ID NO: 17515 - RNA, 19 nt, Human
aacugauuacaacagacug

SEQ ID NO: 17516 - RNA, 17 nt, Human
gaaggcauccagcaaga

SEQ ID NO: 17517 - RNA, 24 nt, Human
acuguagugaguguauauaugcuc

SEQ ID NO: 17518 - RNA, 22 nt, Human
agaggcagcagcagccucuucc

SEQ ID NO: 17519 - RNA, 21 nt, Human
auugcaaacacuuuuuaaaaa

SEQ ID NO: 17520 - RNA, 25 nt, Human
ugacacuccacagugugccugcaac

SEQ ID NO: 17521 - RNA, 30 nt, Human
ucucuucccggcuuguucccucuuugcuga

SEQ ID NO: 17522 - RNA, 25 nt, Human
ucauaaagucaguugcucaaaaaga

SEQ ID NO: 17523 - RNA, 23 nt, Human
ugccggccugcugcagcugcagu

SEQ ID NO: 17524 - RNA, 23 nt, Human
cacgccugugaucccagcuacuc

SEQ ID NO: 17525 - RNA, 27 nt, Human
gggaggcagagguugcagccggcugag

SEQ ID NO: 17526 - RNA, 25 nt, Human
aagucucccuucuguuucuucagca

SEQ ID NO: 17527 - RNA, 23 nt, Human
acugcuuccuccaccguuuucac

SEQ ID NO: 17528 - RNA, 22 nt, Human
cucugcauccucugucauuuua

SEQ ID NO: 17529 - RNA, 26 nt, Human
uccuucugcaacugaaauuacauauu

SEQ ID NO: 17530 - RNA, 22 nt, Human
uccgcaccaucuucacugaugu

SEQ ID NO: 17531 - RNA, 22 nt, Human
gcaaguuuauuuacaaauguug

SEQ ID NO: 17532 - RNA, 26 nt, Human
aaccauggucaugugaguuaugagcu

SEQ ID NO: 17533 - RNA, 20 nt, Human
cccauuccaccacagugccc

SEQ ID NO: 17534 - RNA, 24 nt, Human
ccgucuccugaggguccugcuggu

SEQ ID NO: 17535 - RNA, 23 nt, Human
uugccagccacagcugcugccuc

SEQ ID NO: 17536 - RNA, 26 nt, Human
caagagaguuuuguuuuguuuugguu

SEQ ID NO: 17537 - RNA, 22 nt, Human
ucuugaacuccugaccucguga

SEQ ID NO: 17538 - RNA, 18 nt, Human
cccuugcugucauccccu

SEQ ID NO: 17539 - RNA, 21 nt, Human
guggugggugaaacacugccu

SEQ ID NO: 17540 - RNA, 25 nt, Human
caguaugggaagaguucuuuguaau

SEQ ID NO: 17541 - RNA, 26 nt, Human
ucagaaacaucucugcucucugugaa

SEQ ID NO: 17542 - RNA, 22 nt, Human
cacacucaggagacacaggugu

SEQ ID NO: 17543 - RNA, 21 nt, Human
uagggacuuaaauuaguuuug

SEQ ID NO: 17544 - RNA, 26 nt, Human
aacagcuuccuguuacugagaugucu

SEQ ID NO: 17545 - RNA, 19 nt, Human
aaaaccaagcagaagugaa

SEQ ID NO: 17546 - RNA, 22 nt, Human
gggauauaccaaggcagaggag

SEQ ID NO: 17547 - RNA, 23 nt, Human
aaauacuggauuuauaaagcaaa

SEQ ID NO: 17548 - RNA, 20 nt, Human
cacuuccuaaaguugcagaa

SEQ ID NO: 17549 - RNA, 20 nt, Human
gcauguaugugcacaugugu

SEQ ID NO: 17550 - RNA, 27 nt, Human
aaguuugcugcuuagaguuggaagugc

SEQ ID NO: 17551 - RNA, 21 nt, Human
uuuaccuccuuuucucuuuca

SEQ ID NO: 17552 - RNA, 20 nt, Human
gagggcacagggcucugcug

SEQ ID NO: 17553 - RNA, 23 nt, Human
cuucauucucagacucugguagc

SEQ ID NO: 17554 - RNA, 18 nt, Human
ugccuauguaauucaaag

SEQ ID NO: 17555 - RNA, 28 nt, Human
uuauuucucucacacuuuugcuugaauu

SEQ ID NO: 17556 - RNA, 22 nt, Human
auagcacgugacccuggaacgc

SEQ ID NO: 17557 - RNA, 17 nt, Human
aacaaauucuaaugggc

SEQ ID NO: 17558 - RNA, 22 nt, Human
acugcaacuuccgcaucccagg

SEQ ID NO: 17559 - RNA, 21 nt, Human
cagagguuuaguuuacagucu

SEQ ID NO: 17560 - RNA, 25 nt, Human
guugcccaagggcgugguccacggu

SEQ ID NO: 17561 - RNA, 24 nt, Human
aacucacaaaggucuccuucaccg

SEQ ID NO: 17562 - RNA, 20 nt, Human
aaugaggacuucuggaacau

SEQ ID NO: 17563 - RNA, 22 nt, Human
ucgagucccuggagcaggcagu

SEQ ID NO: 17564 - RNA, 27 nt, Human
ggggggaacuaggagagcaggaguaga

SEQ ID NO: 17565 - RNA, 21 nt, Human
uagauccagauguugccaagg

SEQ ID NO: 17566 - RNA, 26 nt, Human
agaggcaccaguccagcaaauaaagc

SEQ ID NO: 17567 - RNA, 21 nt, Human
uuuucaaugcuaauuauagcu

SEQ ID NO: 17568 - RNA, 21 nt, Human
acgggugggugcaguggcuca

SEQ ID NO: 17569 - RNA, 29 nt, Human
ggaggcucagcagcaggacgacuugagcc

SEQ ID NO: 17570 - RNA, 24 nt, Human
gagcgucagcauccagguuuauga

SEQ ID NO: 17571 - RNA, 21 nt, Human
gaagguuugggggcugugggg

SEQ ID NO: 17572 - RNA, 20 nt, Human
accaacaacagcagacuucu

SEQ ID NO: 17573 - RNA, 25 nt, Human
cagaaacaguuuccccacugauggg

SEQ ID NO: 17574 - RNA, 25 nt, Human
cucuguuugacaaaccucuaaccca

SEQ ID NO: 17575 - RNA, 22 nt, Human
aaaauggagaaaauuagaccgg

SEQ ID NO: 17576 - RNA, 27 nt, Human
gggaggcacaggggcaaagcaauaccc

SEQ ID NO: 17577 - RNA, 23 nt, Human
uuguuggcaaaucagaugcagcu

SEQ ID NO: 17578 - RNA, 22 nt, Human
gccagguccugguagaaccuuu

SEQ ID NO: 17579 - RNA, 21 nt, Human
gaguuagcacugaacugcuuu

SEQ ID NO: 17580 - RNA, 19 nt, Human
guuaaaaaauauugcccgg

SEQ ID NO: 17581 - RNA, 28 nt, Human
ugucugguggguggagucaggcuucucu

SEQ ID NO: 17582 - RNA, 26 nt, Human
uaccugcacugucucugaggacuuac

SEQ ID NO: 17583 - RNA, 25 nt, Human
aagucacaaccucccaggcuccuca

SEQ ID NO: 17584 - RNA, 22 nt, Human
uagcaugcuuccuuucucuccu

SEQ ID NO: 17585 - RNA, 26 nt, Human
auucugaacauguuuugucauucaca

SEQ ID NO: 17586 - RNA, 27 nt, Human
ucuucuucuguuugccuaacucccccg

SEQ ID NO: 17587 - RNA, 27 nt, Human
gcugccucugcugccgggccuggacca

SEQ ID NO: 17588 - RNA, 27 nt, Human
ccucaucucacugugcuguggucuguc

SEQ ID NO: 17589 - RNA, 22 nt, Human
gcaacauggugagaccccaucu

SEQ ID NO: 17590 - RNA, 22 nt, Human
gcaacauggcaagacccugucu

SEQ ID NO: 17591 - RNA, 22 nt, Human
cucuggccccaggcuugucacu

SEQ ID NO: 17592 - RNA, 26 nt, Human
cggcuggagugcaguggcaugaucuc

SEQ ID NO: 17593 - RNA, 19 nt, Human
ggccucgguccuugccgca

SEQ ID NO: 17594 - RNA, 22 nt, Human
ucgaggugcagcaauugcuugg

SEQ ID NO: 17595 - RNA, 19 nt, Human
ggagcugggggagcuguuc

SEQ ID NO: 17596 - RNA, 20 nt, Human
uggccauggugugugcagug

SEQ ID NO: 17597 - RNA, 26 nt, Human
cccgccggcccugccuguagauacgc

SEQ ID NO: 17598 - RNA, 21 nt, Human
cugagccugagccaaugggac

SEQ ID NO: 17599 - RNA, 21 nt, Human
ucugccccagaggccucucuc

SEQ ID NO: 17600 - RNA, 20 nt, Human
ugggagcagagguggagcga

SEQ ID NO: 17601 - RNA, 28 nt, Human
cucaucuaaagacaccuuccuuuccacu

SEQ ID NO: 17602 - RNA, 25 nt, Human
agagaggcauuaaagaaccagggaa

SEQ ID NO: 17603 - RNA, 25 nt, Human
ccuauuugcugaccacacuccggcu

SEQ ID NO: 17604 - RNA, 23 nt, Human
cuuuuuuguuuuccucucagacu

SEQ ID NO: 17605 - RNA, 22 nt, Human
augggaaauaagugguccaccu

SEQ ID NO: 17606 - RNA, 27 nt, Human
caggugcuuucaucacagcuaaaccug

SEQ ID NO: 17607 - RNA, 24 nt, Human
agcaccauguggaguggaggugga

SEQ ID NO: 17608 - RNA, 21 nt, Human
gguccuguguuuuuucugcca

SEQ ID NO: 17609 - RNA, 22 nt, Human
ccaguuucagauuuacucugaa

SEQ ID NO: 17610 - RNA, 23 nt, Human
uuugggaaaagaaaagucaaggg

SEQ ID NO: 17611 - RNA, 20 nt, Human
cguggaggaaagauuaugaa

SEQ ID NO: 17612 - RNA, 24 nt, Human
uuuccugagaugcacuuacuucuc

SEQ ID NO: 17613 - RNA, 20 nt, Human
uauaucucugugucucucca

SEQ ID NO: 17614 - RNA, 27 nt, Human
gggguuucgccauguugcccaggcuag

SEQ ID NO: 17615 - RNA, 21 nt, Human
ugagccaagauugugccacug

SEQ ID NO: 17616 - RNA, 26 nt, Human
gacuugguccuaagcaccugccucag

SEQ ID NO: 17617 - RNA, 22 nt, Human
cucuccaaaaauaagcuggagu

SEQ ID NO: 17618 - RNA, 27 nt, Human
uccuuuccucauucauccuggagagga

SEQ ID NO: 17619 - RNA, 27 nt, Human
acugcaaccuccgccuccagguucaag

SEQ ID NO: 17620 - RNA, 27 nt, Human
uucuuggucuugucaaaccuugccuga

SEQ ID NO: 17621 - RNA, 23 nt, Human
ucuuagucuauagaaaugaucau

SEQ ID NO: 17622 - RNA, 22 nt, Human
cuguuugcagaagcuguuuaga

SEQ ID NO: 17623 - RNA, 22 nt, Human
aggacccuugacaucuccaucu

SEQ ID NO: 17624 - RNA, 21 nt, Human
gcauguucuccucuaucuuag

SEQ ID NO: 17625 - RNA, 23 nt, Human
uggcaaaaagauggcagacacaa

SEQ ID NO: 17626 - RNA, 29 nt, Human
agccacauuugcaaccuuggccaucuguc

SEQ ID NO: 17627 - RNA, 19 nt, Human
acucucugcccugccuccc

SEQ ID NO: 17628 - RNA, 21 nt, Human
ccucccccauuucuguguccu

SEQ ID NO: 17629 - RNA, 22 nt, Human
auucugggcagcugccaccuca

SEQ ID NO: 17630 - RNA, 23 nt, Human
gccucucugacauaugcuaaccc

SEQ ID NO: 17631 - RNA, 27 nt, Human
uagguguaugugucugaccucaggccu

SEQ ID NO: 17632 - RNA, 22 nt, Human
ucuuccauugugagaccacugc

SEQ ID NO: 17633 - RNA, 22 nt, Human
ccagguucccucccagaggagc

SEQ ID NO: 17634 - RNA, 20 nt, Human
acuuuagaaccugagauaug

SEQ ID NO: 17635 - RNA, 21 nt, Human
ugucauuguuccuuccccaga

SEQ ID NO: 17636 - RNA, 22 nt, Human
gaucuuccccauuguccacuca

SEQ ID NO: 17637 - RNA, 21 nt, Human
cuguuuugacagaaacugaca

SEQ ID NO: 17638 - RNA, 24 nt, Human
ugcuuguacugcuagaagcacuuu

SEQ ID NO: 17639 - RNA, 26 nt, Human
cugggagccggaggcgcggggaccuc

SEQ ID NO: 17640 - RNA, 24 nt, Human
cuguccucugcuuugcuguuaucc

SEQ ID NO: 17641 - RNA, 16 nt, Human
cccccaccccccacca

SEQ ID NO: 17642 - RNA, 27 nt, Human
aacacauguaaaaugcuuuuuaacagc

SEQ ID NO: 17643 - RNA, 23 nt, Human
agggaaagcagggcagccgggac

SEQ ID NO: 17644 - RNA, 19 nt, Human
uuaacuuccauaucugcca

SEQ ID NO: 17645 - RNA, 26 nt, Human
cuccccuggacccuugcuggugucca

SEQ ID NO: 17646 - RNA, 21 nt, Human
cauuuggggagaaugagggag

SEQ ID NO: 17647 - RNA, 27 nt, Human
gguaucuuggcuuaauaauuccuuaua

SEQ ID NO: 17648 - RNA, 27 nt, Human
cugcccgccacauccucugccugcugu

SEQ ID NO: 17649 - RNA, 19 nt, Human
agugauaauaaauucuucc

SEQ ID NO: 17650 - RNA, 22 nt, Human
uuuggggucagccagggccagg

SEQ ID NO: 17651 - RNA, 21 nt, Human
gagcacucucucagcaugaac

SEQ ID NO: 17652 - RNA, 22 nt, Human
ggcaggugcugacaucgucccc

SEQ ID NO: 17653 - RNA, 23 nt, Human
uccugucaccaccagaaaagcaa

SEQ ID NO: 17654 - RNA, 27 nt, Human
ggcuuggcaucugcacuccagcccagg

SEQ ID NO: 17655 - RNA, 23 nt, Human
aauucacaccagugugcucucag

SEQ ID NO: 17656 - RNA, 28 nt, Human
gucuuaacuguugagccuuuccuuucau

SEQ ID NO: 17657 - RNA, 23 nt, Human
ggcucacuguaaccuccgccucc

SEQ ID NO: 17658 - RNA, 24 nt, Human
cuuugcagagaaccucagaucagg

SEQ ID NO: 17659 - RNA, 22 nt, Human
uaggauuauaaagcaagacuga

SEQ ID NO: 17660 - RNA, 23 nt, Human
cgaguagcugggacuacaggcac

SEQ ID NO: 17661 - RNA, 23 nt, Human
cgaguagcugggaccacaggcau

SEQ ID NO: 17662 - RNA, 21 nt, Human
aguuauacugaacaaaauuuu

SEQ ID NO: 17663 - RNA, 27 nt, Human
gugaacaagcaaacccagagggcucca

SEQ ID NO: 17664 - RNA, 25 nt, Human
uuugucaccaggcuggagugcagug

SEQ ID NO: 17665 - RNA, 18 nt, Human
ucaacuugcauuauuaua

SEQ ID NO: 17666 - RNA, 21 nt, Human
ucauuuacacauauuuuugca

SEQ ID NO: 17667 - RNA, 25 nt, Human
guccaggcuggacaccugccauugc

SEQ ID NO: 17668 - RNA, 31 nt, Human
guaccuccugccagcaucucuuggguuugcu

SEQ ID NO: 17669 - RNA, 23 nt, Human
cucagugccugcuucucagugcu

SEQ ID NO: 17670 - RNA, 23 nt, Human
uucuccaggaauuuccucuaugg

SEQ ID NO: 17671 - RNA, 21 nt, Human
gcucaauuuugucuguacuca

SEQ ID NO: 17672 - RNA, 23 nt, Human
ucuaguugcccucuaccugacuc

SEQ ID NO: 17673 - RNA, 24 nt, Human
acccaggcugcagugcaauggcgc

SEQ ID NO: 17674 - RNA, 29 nt, Human
gcuugcucuugugccuccugggcaagggc

SEQ ID NO: 17675 - RNA, 22 nt, Human
ggacuccugccaccagcaucca

SEQ ID NO: 17676 - RNA, 25 nt, Human
aucaauauucauugaacugcugcua

SEQ ID NO: 17677 - RNA, 21 nt, Human
agcuauuuuuguauuuuuagu

SEQ ID NO: 17678 - RNA, 28 nt, Human
cacacucagcaaccacacggaucugaca

SEQ ID NO: 17679 - RNA, 27 nt, Human
cagcauuccucagcucugugacuugug

SEQ ID NO: 17680 - RNA, 23 nt, Human
aacuuuucaccagccuuugagag

SEQ ID NO: 17681 - RNA, 22 nt, Human
aguguuagaggaggagauggga

SEQ ID NO: 17682 - RNA, 22 nt, Human
agggaauccgccugcagaggac

SEQ ID NO: 17683 - RNA, 22 nt, Human
cccaucuccuccuaugccaccu

SEQ ID NO: 17684 - RNA, 23 nt, Human
ugcuguugaauaacaccauggcu

SEQ ID NO: 17685 - RNA, 23 nt, Human
cauuuuucuacuuugcuuuucuc

SEQ ID NO: 17686 - RNA, 21 nt, Human
ucauggagugaauaagaaaga

SEQ ID NO: 17687 - RNA, 26 nt, Human
ggccuggaucccuaccggcugggauu

SEQ ID NO: 17688 - RNA, 19 nt, Human
ggaaaucaggauuguuaug

SEQ ID NO: 17689 - RNA, 22 nt, Human
aaauccugaugcccaacuugca

SEQ ID NO: 17690 - RNA, 21 nt, Human
gguggacagauugagcaaaga

SEQ ID NO: 17691 - RNA, 22 nt, Human
caccaucagagacgaagggaag

SEQ ID NO: 17692 - RNA, 17 nt, Human
gcccuuauaaugccuua

SEQ ID NO: 17693 - RNA, 27 nt, Human
cagcccagcaaccugucgcucuuggag

SEQ ID NO: 17694 - RNA, 22 nt, Human
caggccauccagcgugcagccu

SEQ ID NO: 17695 - RNA, 22 nt, Human
guggaaagagcacugaacuagg

SEQ ID NO: 17696 - RNA, 23 nt, Human
uaaagaaugccauggccgggugc

SEQ ID NO: 17697 - RNA, 20 nt, Human
cagugaggaaauggcaacac

SEQ ID NO: 17698 - RNA, 24 nt, Human
auucgccacucucccaccccccag

SEQ ID NO: 17699 - RNA, 18 nt, Human
ccuuuuuaccaccaauaa

SEQ ID NO: 17700 - RNA, 19 nt, Human
auuauuuuguuggagagga

SEQ ID NO: 17701 - RNA, 23 nt, Human
gcauccucaguucugugcccagc

SEQ ID NO: 17702 - RNA, 25 nt, Human
agccauagugucacuuccacacaau

SEQ ID NO: 17703 - RNA, 22 nt, Human
cucaaaacucuaccacaaccug

SEQ ID NO: 17704 - RNA, 25 nt, Human
gaucucaggugaccugcccaccucg

SEQ ID NO: 17705 - RNA, 20 nt, Human
ggccugacccucagcacuuu

SEQ ID NO: 17706 - RNA, 24 nt, Human
cugcgccugcugccccaacucggc

SEQ ID NO: 17707 - RNA, 21 nt, Human
guuguuaucucccuccuggcc

SEQ ID NO: 17708 - RNA, 26 nt, Human
aacugcacgaaaguaucuuucugaaa

SEQ ID NO: 17709 - RNA, 24 nt, Human
gcagcauuuugcugcuuuaucaaa

SEQ ID NO: 17710 - RNA, 27 nt, Human
cgcagggcagaggagagcagcugucaa

SEQ ID NO: 17711 - RNA, 22 nt, Human
gccucuccugcucagcaccaug

SEQ ID NO: 17712 - RNA, 22 nt, Human
cuuuugggggcuucccggucua

SEQ ID NO: 17713 - RNA, 24 nt, Human
uacuacauuuuaaacauucacauc

SEQ ID NO: 17714 - RNA, 22 nt, Human
guccuguuuccauacauguuuu

SEQ ID NO: 17715 - RNA, 16 nt, Human
gcacagcacuaaagca

SEQ ID NO: 17716 - RNA, 19 nt, Human
cucucccucucccccagcu

SEQ ID NO: 17717 - RNA, 22 nt, Human
gagguagggcuggcuggaggaa

SEQ ID NO: 17718 - RNA, 21 nt, Human
uccaauacuucauuaauuuca

SEQ ID NO: 17719 - RNA, 19 nt, Human
gucguauuauucacuugua

SEQ ID NO: 17720 - RNA, 24 nt, Human
aaccuuauaccugaauuacaguuu

SEQ ID NO: 17721 - RNA, 19 nt, Human
cucauuacuuuuccauucc

SEQ ID NO: 17722 - RNA, 20 nt, Human
uacauacugcucuaguuucu

SEQ ID NO: 17723 - RNA, 23 nt, Human
cuggugcgcagguacacugaugc

SEQ ID NO: 17724 - RNA, 20 nt, Human
aacugcaguuuuaacuuuuu

SEQ ID NO: 17725 - RNA, 26 nt, Human
ucaauuuagucuucucucauuggcca

SEQ ID NO: 17726 - RNA, 22 nt, Human
ccauugcacuccaaccugggug

SEQ ID NO: 17727 - RNA, 20 nt, Human
uccaggccugugacacuggc

SEQ ID NO: 17728 - RNA, 22 nt, Human
uggugagugguugaccaagaac

SEQ ID NO: 17729 - RNA, 26 nt, Human
ccacaucuuccuucucugaaguccag

SEQ ID NO: 17730 - RNA, 26 nt, Human
uggggaggcaggaggcacaugugagg

SEQ ID NO: 17731 - RNA, 21 nt, Human
acucagaaaccuccagaggaa

SEQ ID NO: 17732 - RNA, 21 nt, Human
uguaauaaacuuuuugaugcu

SEQ ID NO: 17733 - RNA, 26 nt, Human
agaccugugaaauuucuucacuacau

SEQ ID NO: 17734 - RNA, 22 nt, Human
ggcaaagcagcaacacacaugc

SEQ ID NO: 17735 - RNA, 21 nt, Human
agcuuaagugggcagacacug

SEQ ID NO: 17736 - RNA, 25 nt, Human
ugguggcgggugccuguaaucccag

SEQ ID NO: 17737 - RNA, 24 nt, Human
accaggauauugacauugauacag

SEQ ID NO: 17738 - RNA, 22 nt, Human
aaagcacacaggcuuuagaguc

SEQ ID NO: 17739 - RNA, 27 nt, Human
cugugugacuccaggucccaggaaccu

SEQ ID NO: 17740 - RNA, 22 nt, Human
ugucuaagaaaacuagcuuaaa

SEQ ID NO: 17741 - RNA, 22 nt, Human
agaugccaccaaaaccugcuau

SEQ ID NO: 17742 - RNA, 28 nt, Human
gcucucgaacuccugaccucaucgucca

SEQ ID NO: 17743 - RNA, 22 nt, Human
ccaggaggucaaggcuauggug

SEQ ID NO: 17744 - RNA, 24 nt, Human
caacagcaaauuagacaaaaccca

SEQ ID NO: 17745 - RNA, 22 nt, Human
cugaggcaagagaauuguuuga

SEQ ID NO: 17746 - RNA, 19 nt, Human
cgcccaggcugggugcagu

SEQ ID NO: 17747 - RNA, 22 nt, Human
acucuguggagucuagcugcca

SEQ ID NO: 17748 - RNA, 27 nt, Human
ugucauuguuuaagaaagccauuuguu

SEQ ID NO: 17749 - RNA, 26 nt, Human
ugacccuucuacauuugagggcccag

SEQ ID NO: 17750 - RNA, 21 nt, Human
cacagccgccugaaagccaca

SEQ ID NO: 17751 - RNA, 22 nt, Human
agccugcacacaccugccugca

SEQ ID NO: 17752 - RNA, 21 nt, Human
ugaaggcauaaaagcaguuga

SEQ ID NO: 17753 - RNA, 22 nt, Human
ugaccagcucagugcugguuua

SEQ ID NO: 17754 - RNA, 26 nt, Human
caugucacugucccugggccacccag

SEQ ID NO: 17755 - RNA, 22 nt, Human
gccuguaaucccgguacuuugg

SEQ ID NO: 17756 - RNA, 23 nt, Human
cucagcaccacccauucuccuca

SEQ ID NO: 17757 - RNA, 22 nt, Human
aucacuugaacccgggacgcag

SEQ ID NO: 17758 - RNA, 27 nt, Human
guagggaggcccugagaacuaaauuuu

SEQ ID NO: 17759 - RNA, 21 nt, Human
ggcucagugcaaccuccgccu

SEQ ID NO: 17760 - RNA, 26 nt, Human
ucggcucucuggacacuugcgacacc

SEQ ID NO: 17761 - RNA, 28 nt, Human
gguuuucuugggggaaaauaccacaauc

SEQ ID NO: 17762 - RNA, 27 nt, Human
ucccuccaccaccacagcacaccggug

SEQ ID NO: 17763 - RNA, 22 nt, Human
agacaacccuggguagccugug

SEQ ID NO: 17764 - RNA, 23 nt, Human
ugccuguagucucagcuacuugg

SEQ ID NO: 17765 - RNA, 23 nt, Human
ugccuguagucccagcuaccugg

SEQ ID NO: 17766 - RNA, 20 nt, Human
aucaaauuugcacuucauga

SEQ ID NO: 17767 - RNA, 23 nt, Human
ucaugucccagaagaccaaaaag

SEQ ID NO: 17768 - RNA, 21 nt, Human
cgcuauuaucagaucaugccc

SEQ ID NO: 17769 - RNA, 22 nt, Human
agaggugugggagcagaggaau

SEQ ID NO: 17770 - RNA, 27 nt, Human
cauugccauuuuuaauucauucugguc

SEQ ID NO: 17771 - RNA, 21 nt, Human
gguggggagcggaaagcagga

SEQ ID NO: 17772 - RNA, 23 nt, Human
uggcaaugaagucaguagauagg

SEQ ID NO: 17773 - RNA, 26 nt, Human
accacagccuggcagccuggucuccg

SEQ ID NO: 17774 - RNA, 20 nt, Human
cagccuuggcccugcagccu

SEQ ID NO: 17775 - RNA, 19 nt, Human
uuugaaccuuucucaugga

SEQ ID NO: 17776 - RNA, 22 nt, Human
uaauuucuugaaaaucuuauca

SEQ ID NO: 17777 - RNA, 23 nt, Human
ucaaauaucagaaaaacccagag

SEQ ID NO: 17778 - RNA, 26 nt, Human
agccauauguggaauauugacaugug

SEQ ID NO: 17779 - RNA, 23 nt, Human
gcaguaucucucccugucugucu

SEQ ID NO: 17780 - RNA, 19 nt, Human
guacagagcguacagcccu

SEQ ID NO: 17781 - RNA, 24 nt, Human
gcuuaccugugacagcagcucugu

SEQ ID NO: 17782 - RNA, 20 nt, Human
gacaugcauuuuaacuuuuu

SEQ ID NO: 17783 - RNA, 27 nt, Human
cagucauuuagcaacacugcagaaaug

SEQ ID NO: 17784 - RNA, 21 nt, Human
uggauauuaaaaaucuguaaa

SEQ ID NO: 17785 - RNA, 22 nt, Human
guucccuuacauuuacuggacc

SEQ ID NO: 17786 - RNA, 20 nt, Human
auugaaucuacaacucugaa

SEQ ID NO: 17787 - RNA, 26 nt, Human
uggugggggugggcuccuuacagaac

SEQ ID NO: 17788 - RNA, 22 nt, Human
acccgagcuggagugcaguggu

SEQ ID NO: 17789 - RNA, 27 nt, Human
ugaauucaugggcucaucuuuaaagcu

SEQ ID NO: 17790 - RNA, 27 nt, Human
uacuguguguugcagaaaacugccuuc

SEQ ID NO: 17791 - RNA, 24 nt, Human
ggcagcaaaugcugacaaggauga

SEQ ID NO: 17792 - RNA, 19 nt, Human
cuaacccuuaucaccagcu

SEQ ID NO: 17793 - RNA, 26 nt, Human
cugauauuuaaagaucuuugcuugca

SEQ ID NO: 17794 - RNA, 21 nt, Human
ccugcugccccucacuucagg

SEQ ID NO: 17795 - RNA, 27 nt, Human
caaccaaagaaaacauaccucaauaca

SEQ ID NO: 17796 - RNA, 20 nt, Human
guggggaggagaagugggga

SEQ ID NO: 17797 - RNA, 25 nt, Human
gcuuacuuuuuaccaggagugcagu

SEQ ID NO: 17798 - RNA, 25 nt, Human
uugcugagcugccucuugugccucu

SEQ ID NO: 17799 - RNA, 28 nt, Human
gacuucuaaauguuucugcuucccagaa

SEQ ID NO: 17800 - RNA, 20 nt, Human
cucacuugguaccagcauuu

SEQ ID NO: 17801 - RNA, 25 nt, Human
uucucuagcccaucauuaccuguga

SEQ ID NO: 17802 - RNA, 21 nt, Human
aaaggcaugggagaagguugg

SEQ ID NO: 17803 - RNA, 22 nt, Human
gguuuccucuuuggaaaaagaa

SEQ ID NO: 17804 - RNA, 18 nt, Human
ccccuagacucaggcuuc

SEQ ID NO: 17805 - RNA, 22 nt, Human
ucuuggggacucagcaggcugg

SEQ ID NO: 17806 - RNA, 26 nt, Human
ucucugagaggcaacagaagcagcaa

SEQ ID NO: 17807 - RNA, 24 nt, Human
cuggucuguaacaguuuccaggcc

SEQ ID NO: 17808 - RNA, 21 nt, Human
cuuacuaauuuaaagaugcug

SEQ ID NO: 17809 - RNA, 21 nt, Human
ucucccugugucuggguccaa

SEQ ID NO: 17810 - RNA, 21 nt, Human
acaaguucugaggauuacagc

SEQ ID NO: 17811 - RNA, 23 nt, Human
cauccagauugcucacaugugcu

SEQ ID NO: 17812 - RNA, 18 nt, Human
auguccuaguggagggag

SEQ ID NO: 17813 - RNA, 21 nt, Human
gggaggcggagguuacaguga

SEQ ID NO: 17814 - RNA, 18 nt, Human
uacaguuuuuacauugua

SEQ ID NO: 17815 - RNA, 27 nt, Human
ugaaucuucucccuuguccugcuuggg

SEQ ID NO: 17816 - RNA, 27 nt, Human
cuacaucuuuauucucuaaauguagua

SEQ ID NO: 17817 - RNA, 22 nt, Human
ucuagauggcggcugugccuua

SEQ ID NO: 17818 - RNA, 21 nt, Human
agugcacacuucccaugcuuc

SEQ ID NO: 17819 - RNA, 22 nt, Human
accuucaggcugcacagaggca

SEQ ID NO: 17820 - RNA, 22 nt, Human
guccaggcgugugcauucauga

SEQ ID NO: 17821 - RNA, 22 nt, Human
ccugagcagcagccaccaggga

SEQ ID NO: 17822 - RNA, 23 nt, Human
gaagcagcugcagcugaugggga

SEQ ID NO: 17823 - RNA, 22 nt, Human
aacuucuguucuuaugcguggc

SEQ ID NO: 17824 - RNA, 24 nt, Human
cuuugcaggcucagcugcuguucu

SEQ ID NO: 17825 - RNA, 24 nt, Human
aucuuaacugcuguauuuucauuu

SEQ ID NO: 17826 - RNA, 20 nt, Human
uguuuucugaaccaguucuu

SEQ ID NO: 17827 - RNA, 22 nt, Human
gccaucuccccacuccgcugcc

SEQ ID NO: 17828 - RNA, 25 nt, Human
ccaccgucuuccagacaccccaccu

SEQ ID NO: 17829 - RNA, 24 nt, Human
uccauggcgccagccuccuccccc

SEQ ID NO: 17830 - RNA, 18 nt, Human
ucuauagagcaguuuaca

SEQ ID NO: 17831 - RNA, 19 nt, Human
gcuucaggcugggggcagu

SEQ ID NO: 17832 - RNA, 21 nt, Human
cuggggcagugaaggaaggga

SEQ ID NO: 17833 - RNA, 27 nt, Human
agcauuuucuuacacccccuccccagc

SEQ ID NO: 17834 - RNA, 27 nt, Human
ucagaaucauggagaaaaugggcgggg

SEQ ID NO: 17835 - RNA, 22 nt, Human
caugccuguagucccagcacuu

SEQ ID NO: 17836 - RNA, 27 nt, Human
cccaaaaugcugggauuacaagcguga

SEQ ID NO: 17837 - RNA, 22 nt, Human
ugcucuccccugcccugcugcc

SEQ ID NO: 17838 - RNA, 27 nt, Human
uuacaacugaagaucaugcuauauuuu

SEQ ID NO: 17839 - RNA, 22 nt, Human
ucuuccucuagcugucuggcug

SEQ ID NO: 17840 - RNA, 21 nt, Human
ggggcagucaccugcccagau

SEQ ID NO: 17841 - RNA, 26 nt, Human
ugcggcccaauccaagguggggugga

SEQ ID NO: 17842 - RNA, 25 nt, Human
cagccugggggcaaguuagcacuuu

SEQ ID NO: 17843 - RNA, 25 nt, Human
caggcagcggagccaggggcuguga

SEQ ID NO: 17844 - RNA, 22 nt, Human
gcgggauggagucucugucacc

SEQ ID NO: 17845 - RNA, 22 nt, Human
aaaugagauauggcuauuugga

SEQ ID NO: 17846 - RNA, 18 nt, Human
cccuguugcccaggcugg

SEQ ID NO: 17847 - RNA, 22 nt, Human
ucauccagaacugguaccgagg

SEQ ID NO: 17848 - RNA, 21 nt, Human
auggaauaaugggaaaggagg

SEQ ID NO: 17849 - RNA, 27 nt, Human
uggucucaggccuccaacuuuggccuu

SEQ ID NO: 17850 - RNA, 20 nt, Human
ccgcugcucucagcugggcc

SEQ ID NO: 17851 - RNA, 26 nt, Human
accagccugucacaacugagcaguuc

SEQ ID NO: 17852 - RNA, 24 nt, Human
auuguaauaaaccacuuccucauu

SEQ ID NO: 17853 - RNA, 28 nt, Human
ggcggugaggaugcaggucccagccagu

SEQ ID NO: 17854 - RNA, 23 nt, Human
gcagauccacaaaacuaacagga

SEQ ID NO: 17855 - RNA, 23 nt, Human
gcucaggaacugcuuuugauuca

SEQ ID NO: 17856 - RNA, 20 nt, Human
cauacuauguggaugugaca

SEQ ID NO: 17857 - RNA, 23 nt, Human
gccucuguguaucucagcauuuu

SEQ ID NO: 17858 - RNA, 16 nt, Human
ggcuucucccaccuga

SEQ ID NO: 17859 - RNA, 22 nt, Human
aaaaaugcaaauucucaggccc

SEQ ID NO: 17860 - RNA, 26 nt, Human
cucuccaaacccccaaagcagagaga

SEQ ID NO: 17861 - RNA, 21 nt, Human
guacacagauggcagugccau

SEQ ID NO: 17862 - RNA, 22 nt, Human
ugacaccauuuuccugccucag

SEQ ID NO: 17863 - RNA, 19 nt, Human
ccugccaagcccaggcugg

SEQ ID NO: 17864 - RNA, 24 nt, Human
cguuuaaaguacugagcaguauua

SEQ ID NO: 17865 - RNA, 26 nt, Human
guaagggcucucaaagauucacacau

SEQ ID NO: 17866 - RNA, 19 nt, Human
gaagcuuggaaacaguaaa

SEQ ID NO: 17867 - RNA, 23 nt, Human
gacugcucagaaaaaugagggag

SEQ ID NO: 17868 - RNA, 23 nt, Human
ccagcacuuuucuagcucucccg

SEQ ID NO: 17869 - RNA, 23 nt, Human
augucuaucucauuugcugccuu

SEQ ID NO: 17870 - RNA, 25 nt, Human
cuugcauauucuccuuucauccugg

SEQ ID NO: 17871 - RNA, 23 nt, Human
gcuguggcugcugucauggcacc

SEQ ID NO: 17872 - RNA, 20 nt, Human
uggaaagagaagagugaaga

SEQ ID NO: 17873 - RNA, 21 nt, Human
auucauaguaaaguucguuuu

SEQ ID NO: 17874 - RNA, 21 nt, Human
cagaaguggaaaugggaguua

SEQ ID NO: 17875 - RNA, 22 nt, Human
gugaugauucugaaauccaggc

SEQ ID NO: 17876 - RNA, 19 nt, Human
gaaagagaaugaacugugg

SEQ ID NO: 17877 - RNA, 22 nt, Human
acaauaauuucagguuuuguaa

SEQ ID NO: 17878 - RNA, 21 nt, Human
ggcucaccgcaaccuccgccc

SEQ ID NO: 17879 - RNA, 28 nt, Human
ggacaucacaggcuucaguaccugacca

SEQ ID NO: 17880 - RNA, 19 nt, Human
cccaggcuggagugcaguc

SEQ ID NO: 17881 - RNA, 22 nt, Human
gccugccaggcugacgugcauc

SEQ ID NO: 17882 - RNA, 22 nt, Human
uucuccuccauuggucccaggc

SEQ ID NO: 17883 - RNA, 21 nt, Human
cugggucugggaaguacucug

SEQ ID NO: 17884 - RNA, 27 nt, Human
ccucucgggggcaggagggcgaugcag

SEQ ID NO: 17885 - RNA, 23 nt, Human
cuugccaccugcugcugcuaucu

SEQ ID NO: 17886 - RNA, 24 nt, Human
guacauggaaaccagaaaugcaac

SEQ ID NO: 17887 - RNA, 24 nt, Human
gaaggcugucgaccucuacuccuc

SEQ ID NO: 17888 - RNA, 20 nt, Human
uacauuuucaaaaugcagua

SEQ ID NO: 17889 - RNA, 22 nt, Human
aagugaccuauaccuguguuuc

SEQ ID NO: 17890 - RNA, 19 nt, Human
gguggguggagggagggag

SEQ ID NO: 17891 - RNA, 26 nt, Human
uauacagcugucacaagagucuagau

SEQ ID NO: 17892 - RNA, 22 nt, Human
ccccucacugauggacaaggag

SEQ ID NO: 17893 - RNA, 26 nt, Human
uucaaguucuguuuauaguaaaaagg

SEQ ID NO: 17894 - RNA, 25 nt, Human
gugccaccacguggcccugagccac

SEQ ID NO: 17895 - RNA, 22 nt, Human
augaggcagagugaugcacacc

SEQ ID NO: 17896 - RNA, 26 nt, Human
uguugcauuguauuccaaacguguuu

SEQ ID NO: 17897 - RNA, 22 nt, Human
cacagcugaguucuuagaguug

SEQ ID NO: 17898 - RNA, 32 nt, Human
ucggggagacgacccaaggaauuucagaguau

SEQ ID NO: 17899 - RNA, 19 nt, Human
cuucccuucuuuaaaguuc

SEQ ID NO: 17900 - RNA, 23 nt, Human
cuggucccagcauccagcugccu

SEQ ID NO: 17901 - RNA, 27 nt, Human
ccucuucuccucucgcuucccugccgg

SEQ ID NO: 17902 - RNA, 21 nt, Human
acagacaugagccacugugcc

SEQ ID NO: 17903 - RNA, 27 nt, Human
ugggcugcucggucgaugccugugcca

SEQ ID NO: 17904 - RNA, 22 nt, Human
uguuggggaggggaaugggagg

SEQ ID NO: 17905 - RNA, 24 nt, Human
agagaagaccuccaguauaucgca

SEQ ID NO: 17906 - RNA, 23 nt, Human
ugaaagcuccuggcaaugcugga

SEQ ID NO: 17907 - RNA, 24 nt, Human
cccucccuccucugucccuagguc

SEQ ID NO: 17908 - RNA, 21 nt, Human
ccagccugggcaauacaguga

SEQ ID NO: 17909 - RNA, 22 nt, Human
agucagauugaggcugggagac

SEQ ID NO: 17910 - RNA, 25 nt, Human
cucagaauauccuuacaauuacaug

SEQ ID NO: 17911 - RNA, 26 nt, Human
ugugugaccuaggcuggacaucagac

SEQ ID NO: 17912 - RNA, 21 nt, Human
ugggaggcagagguugcagug

SEQ ID NO: 17913 - RNA, 19 nt, Human
aaguuugcagaggcugagg

SEQ ID NO: 17914 - RNA, 22 nt, Human
uauuaaaaugauguguuuucuu

SEQ ID NO: 17915 - RNA, 27 nt, Human
uguuuuuaaaaagaaccuuuccauacu

SEQ ID NO: 17916 - RNA, 21 nt, Human
ugacaggccagggagagggug

SEQ ID NO: 17917 - RNA, 24 nt, Human
ggggacauugaacaaguuguuuca

SEQ ID NO: 17918 - RNA, 26 nt, Human
cuccuagcucuucgcagagcaaccag

SEQ ID NO: 17919 - RNA, 27 nt, Human
cacugccucuguuccuccuugagccug

SEQ ID NO: 17920 - RNA, 22 nt, Human
aggcgugucugagcagacgggg

SEQ ID NO: 17921 - RNA, 28 nt, Human
cagcuugauccuggaggucuuuucuagu

SEQ ID NO: 17922 - RNA, 22 nt, Human
uacucuuuugucuuucucuuua

SEQ ID NO: 17923 - RNA, 22 nt, Human
gaguugagauaaacacucucau

SEQ ID NO: 17924 - RNA, 21 nt, Human
gggagaugcuugccgugauga

SEQ ID NO: 17925 - RNA, 23 nt, Human
uguugcccaggcuggagggcaau

SEQ ID NO: 17926 - RNA, 23 nt, Human
uguugcccaugcuggagugcaau

SEQ ID NO: 17927 - RNA, 21 nt, Human
uaaccccuaaggaagugcagu

SEQ ID NO: 17928 - RNA, 24 nt, Human
caccuuucauaaucuuugcuuuau

SEQ ID NO: 17929 - RNA, 22 nt, Human
aauaaugaagauauacucagua

SEQ ID NO: 17930 - RNA, 27 nt, Human
ccccugccuucccaggaguacacccca

SEQ ID NO: 17931 - RNA, 21 nt, Human
agugcuagauuuagcacagua

SEQ ID NO: 17932 - RNA, 23 nt, Human
aaaauugaaaauguauagucaga

SEQ ID NO: 17933 - RNA, 21 nt, Human
gugcucaacccuaugcauuuu

SEQ ID NO: 17934 - RNA, 23 nt, Human
cgagacaccugagacaugcugaa

SEQ ID NO: 17935 - RNA, 26 nt, Human
acugcaccuggacagccuccucuuuu

SEQ ID NO: 17936 - RNA, 19 nt, Human
gguauuucgauuagaagaa

SEQ ID NO: 17937 - RNA, 19 nt, Human
gcuggccaagagcuuuuaa

SEQ ID NO: 17938 - RNA, 25 nt, Human
cucuuuugacuguauauuuguguuu

SEQ ID NO: 17939 - RNA, 21 nt, Human
ggaagugucagagauucagaa

SEQ ID NO: 17940 - RNA, 21 nt, Human
uuucguguaugcauucacauu

SEQ ID NO: 17941 - RNA, 17 nt, Human
cuucccuugcugggagu

SEQ ID NO: 17942 - RNA, 23 nt, Human
aagccauaggaguccugggggug

SEQ ID NO: 17943 - RNA, 20 nt, Human
gaggaagaagaaccuccuuu

SEQ ID NO: 17944 - RNA, 26 nt, Human
gcuugugcuccccuuggagaagggcu

SEQ ID NO: 17945 - RNA, 23 nt, Human
cuucacccacugccucugccucc

SEQ ID NO: 17946 - RNA, 25 nt, Human
acccaggguggagugcagugguagc

SEQ ID NO: 17947 - RNA, 27 nt, Human
gcaggucuucaucaugccuugucuuuu

SEQ ID NO: 17948 - RNA, 20 nt, Human
ugggaggccucggaagccac

SEQ ID NO: 17949 - RNA, 20 nt, Human
cccaccccccagcgucaucu

SEQ ID NO: 17950 - RNA, 27 nt, Human
caggcuggagugcaauggugagaucuc

SEQ ID NO: 17951 - RNA, 21 nt, Human
ccgccguggagagcgaggcca

SEQ ID NO: 17952 - RNA, 21 nt, Human
ccucccggcccugccugcugg

SEQ ID NO: 17953 - RNA, 26 nt, Human
ccugcaggagcgguuauuguggcauc

SEQ ID NO: 17954 - RNA, 25 nt, Human
gagguccuuccagccaccuuauuuc

SEQ ID NO: 17955 - RNA, 23 nt, Human
cuccaaagucaucuugccagucc

SEQ ID NO: 17956 - RNA, 21 nt, Human
cucugaggacaguguggcugg

SEQ ID NO: 17957 - RNA, 21 nt, Human
gcuccugcgccuuccccagca

SEQ ID NO: 17958 - RNA, 22 nt, Human
uauuuccucaaauuugccucaa

SEQ ID NO: 17959 - RNA, 19 nt, Human
ugugauaaaauguuaacaa

SEQ ID NO: 17960 - RNA, 23 nt, Human
aguauguacuucagugcaccuua

SEQ ID NO: 17961 - RNA, 26 nt, Human
ccucuuucucaccuacccccugccgc

SEQ ID NO: 17962 - RNA, 22 nt, Human
ccaaguagcuuggauuacaggu

SEQ ID NO: 17963 - RNA, 21 nt, Human
gacaaaagcagaugcacuuug

SEQ ID NO: 17964 - RNA, 25 nt, Human
caugcccacagaucaacuggaaugg

SEQ ID NO: 17965 - RNA, 21 nt, Human
cgcagcgcuccgggcugcagu

SEQ ID NO: 17966 - RNA, 24 nt, Human
ugaccugcccuguccucuccagcu

SEQ ID NO: 17967 - RNA, 27 nt, Human
uucagaaggagcguggcccagccaaca

SEQ ID NO: 17968 - RNA, 23 nt, Human
cccauuaaaaaugagauuucuua

SEQ ID NO: 17969 - RNA, 27 nt, Human
ucuccuccuaugccaccugccugggcc

SEQ ID NO: 17970 - RNA, 25 nt, Human
cuggacccacagaauuccuucagga

SEQ ID NO: 17971 - RNA, 21 nt, Human
gcuggcugggguggccugugu

SEQ ID NO: 17972 - RNA, 27 nt, Human
ccugcagcaucuuacaucuguagcuug

SEQ ID NO: 17973 - RNA, 23 nt, Human
agaggucacagaugggccgugca

SEQ ID NO: 17974 - RNA, 19 nt, Human
auucuucuucagaaucuca

SEQ ID NO: 17975 - RNA, 22 nt, Human
uuucugugcccuccugacccau

SEQ ID NO: 17976 - RNA, 21 nt, Human
cagcucucugcgggaaccugg

SEQ ID NO: 17977 - RNA, 21 nt, Human
uugcugugcuucaaacuacua

SEQ ID NO: 17978 - RNA, 21 nt, Human
acaaauaacucuucacuuugu

SEQ ID NO: 17979 - RNA, 24 nt, Human
acugcugcugccuggccacugcuc

SEQ ID NO: 17980 - RNA, 27 nt, Human
ugaggggaauuucugcaacccauaguc

SEQ ID NO: 17981 - RNA, 22 nt, Human
agacugccaaagaagccuugcc

SEQ ID NO: 17982 - RNA, 21 nt, Human
cugccuggccuuguccucagc

SEQ ID NO: 17983 - RNA, 24 nt, Human
ccucccacuuuuccucccccauag

SEQ ID NO: 17984 - RNA, 21 nt, Human
agggucugagccuugccuggg

SEQ ID NO: 17985 - RNA, 24 nt, Human
cauacucauucuggggcucaggcu

SEQ ID NO: 17986 - RNA, 23 nt, Human
guuaacugaucaggaagugcagu

SEQ ID NO: 17987 - RNA, 23 nt, Human
caccaucauccugaucuaaccau

SEQ ID NO: 17988 - RNA, 18 nt, Human
gcuaauaaaaauuuauua

SEQ ID NO: 17989 - RNA, 22 nt, Human
cagccccaggagccagaccacu

SEQ ID NO: 17990 - RNA, 22 nt, Human
cugaaggugaaagauaccagag

SEQ ID NO: 17991 - RNA, 16 nt, Human
cccauacaaguuuaua

SEQ ID NO: 17992 - RNA, 20 nt, Human
ugcaggcuggggacccuggg

SEQ ID NO: 17993 - RNA, 25 nt, Human
gguccuugggucaaaaguuguaaau

SEQ ID NO: 17994 - RNA, 22 nt, Human
ugcucaauaaggcagugcagug

SEQ ID NO: 17995 - RNA, 27 nt, Human
ggaccggaagagagaauuggagcugua

SEQ ID NO: 17996 - RNA, 21 nt, Human
uccccaugggcucuggagggg

SEQ ID NO: 17997 - RNA, 19 nt, Human
cucuaguauuucguuuucu

SEQ ID NO: 17998 - RNA, 27 nt, Human
ucaggcugaacugcauguauauggcuc

SEQ ID NO: 17999 - RNA, 24 nt, Human
ggcaaacagguggaucccauggca

SEQ ID NO: 18000 - RNA, 22 nt, Human
uugagauugugccauugcacuc

SEQ ID NO: 18001 - RNA, 19 nt, Human
acuucauucucucuugccc

SEQ ID NO: 18002 - RNA, 26 nt, Human
cccugucuccucucuguuacucagag

SEQ ID NO: 18003 - RNA, 25 nt, Human
gaugcuuaaauuuccacuguuggac

SEQ ID NO: 18004 - RNA, 27 nt, Human
gacugggucagcccugggggaucagaa

SEQ ID NO: 18005 - RNA, 27 nt, Human
ucccuccagcauccuaggaacuuuaug

SEQ ID NO: 18006 - RNA, 24 nt, Human
gcaacugaaaggacaacacuaucu

SEQ ID NO: 18007 - RNA, 22 nt, Human
ugucuguguccuuguuuaauau

SEQ ID NO: 18008 - RNA, 28 nt, Human
gcugcggaggcaggcugagggcgcaggg

SEQ ID NO: 18009 - RNA, 21 nt, Human
gcuccacccucuuuagcuguu

SEQ ID NO: 18010 - RNA, 23 nt, Human
gccauucucucacaucccgugcg

SEQ ID NO: 18011 - RNA, 19 nt, Human
guucuuaaaauuagugaga

SEQ ID NO: 18012 - RNA, 19 nt, Human
ggccuggaauuagcuuggg

SEQ ID NO: 18013 - RNA, 21 nt, Human
cuugagcgagccaguugccgg

SEQ ID NO: 18014 - RNA, 25 nt, Human
aagagccuggaacuuccuccucucu

SEQ ID NO: 18015 - RNA, 22 nt, Human
aggcugagagcagggaucuacc

SEQ ID NO: 18016 - RNA, 23 nt, Human
aggacgcauuccaaaucauacuc

SEQ ID NO: 18017 - RNA, 19 nt, Human
cuuacuuauuaccuagauu

SEQ ID NO: 18018 - RNA, 25 nt, Human
caguggcaucaucucagcucacugc

SEQ ID NO: 18019 - RNA, 22 nt, Human
gggaagcggagcuugcagugag

SEQ ID NO: 18020 - RNA, 22 nt, Human
aagcugccuucucucccuacuu

SEQ ID NO: 18021 - RNA, 20 nt, Human
aaaguugccuggugaaggaa

SEQ ID NO: 18022 - RNA, 28 nt, Human
aguggagacacguggcaaggcaggaggg

SEQ ID NO: 18023 - RNA, 20 nt, Human
agcugaggugacugcagucu

SEQ ID NO: 18024 - RNA, 25 nt, Human
ugucucugaaacuccucuuugucau

SEQ ID NO: 18025 - RNA, 19 nt, Human
ugaagguuaaacauuugua

SEQ ID NO: 18026 - RNA, 24 nt, Human
augcacagaccugaggaacuuuac

SEQ ID NO: 18027 - RNA, 24 nt, Human
caccugaggucaggaguuugcgac

SEQ ID NO: 18028 - RNA, 22 nt, Human
cucggccucccaaguagcugag

SEQ ID NO: 18029 - RNA, 22 nt, Human
cucagccucccaaguagcuaag

SEQ ID NO: 18030 - RNA, 23 nt, Human
ugcugaaaugcugccucuugccu

SEQ ID NO: 18031 - RNA, 25 nt, Human
ucaaaacaacuucaaccuggaggug

SEQ ID NO: 18032 - RNA, 20 nt, Human
aaaaggacuauuaauagaac

SEQ ID NO: 18033 - RNA, 27 nt, Human
aaauguccaucuuugggaaauuuucua

SEQ ID NO: 18034 - RNA, 19 nt, Human
agagggccagggaggagga

SEQ ID NO: 18035 - RNA, 18 nt, Human
acuguggucucuccuggg

SEQ ID NO: 18036 - RNA, 27 nt, Human
cacuuuuucuuuuuucucagcaaacug

SEQ ID NO: 18037 - RNA, 25 nt, Human
ccgcauccuccucugggcucgcgau

SEQ ID NO: 18038 - RNA, 22 nt, Human
ccuccuccucuucugggcuccc

SEQ ID NO: 18039 - RNA, 29 nt, Human
ugucgcccaggcuggagugcagucgugcc

SEQ ID NO: 18040 - RNA, 18 nt, Human
gcugccaggcugcagccu

SEQ ID NO: 18041 - RNA, 25 nt, Human
cuucaaaaacuuugggaaagggugg

SEQ ID NO: 18042 - RNA, 23 nt, Human
cccagcacuugcgcaccugggag

SEQ ID NO: 18043 - RNA, 27 nt, Human
caggcugguaugcagucauguuguauc

SEQ ID NO: 18044 - RNA, 22 nt, Human
ggggaagagauaggaaccagca

SEQ ID NO: 18045 - RNA, 22 nt, Human
gcgcagcccagcccagcccagc

SEQ ID NO: 18046 - RNA, 21 nt, Human
ucgaggcagagacccuccgcc

SEQ ID NO: 18047 - RNA, 22 nt, Human
gccgggccacaccucagugcca

SEQ ID NO: 18048 - RNA, 21 nt, Human
gcuucauuccuaguacaucuu

SEQ ID NO: 18049 - RNA, 25 nt, Human
ccucuaaaaauuacaguauugucug

SEQ ID NO: 18050 - RNA, 23 nt, Human
auucucaaagccucuuauuuuuc

SEQ ID NO: 18051 - RNA, 27 nt, Human
uucaaucaggcugagcugaauguagug

SEQ ID NO: 18052 - RNA, 22 nt, Human
caugaggucaggaguucaagac

SEQ ID NO: 18053 - RNA, 22 nt, Human
gguuguaccccagcugccacuc

SEQ ID NO: 18054 - RNA, 22 nt, Human
ugcuucuuauccugaacacuug

SEQ ID NO: 18055 - RNA, 22 nt, Human
ugaauggaugcauguaaaaugg

SEQ ID NO: 18056 - RNA, 26 nt, Human
uccagcagucaugggacccaggauag

SEQ ID NO: 18057 - RNA, 28 nt, Human
gacugucuucgccuucuugcacuucgcg

SEQ ID NO: 18058 - RNA, 22 nt, Human
caggaaguggcaguugcaguga

SEQ ID NO: 18059 - RNA, 22 nt, Human
cugcucugugcuuuucucucug

SEQ ID NO: 18060 - RNA, 16 nt, Human
gagccaggcuuccuuc

SEQ ID NO: 18061 - RNA, 26 nt, Human
cagcacucacggcaugcacccuacuc

SEQ ID NO: 18062 - RNA, 19 nt, Human
auauuuaaaaauuagccag

SEQ ID NO: 18063 - RNA, 25 nt, Human
caaacuggaaauacaacaagaagug

SEQ ID NO: 18064 - RNA, 22 nt, Human
gaguuuggagccugagcucugg

SEQ ID NO: 18065 - RNA, 18 nt, Human
gcuguugcaacacugccu

SEQ ID NO: 18066 - RNA, 27 nt, Human
agcuagcacuaacucguguuuggagcu

SEQ ID NO: 18067 - RNA, 21 nt, Human
guauggaguucacacugugug

SEQ ID NO: 18068 - RNA, 24 nt, Human
cggugaucccggcgacugcgcugg

SEQ ID NO: 18069 - RNA, 20 nt, Human
cucucgcucuccugccccac

SEQ ID NO: 18070 - RNA, 22 nt, Human
ccuccuacuucuugcugccuca

SEQ ID NO: 18071 - RNA, 25 nt, Human
uagaauucagaaaauuguugggagg

SEQ ID NO: 18072 - RNA, 22 nt, Human
ugacagagggaaacuccaucuc

SEQ ID NO: 18073 - RNA, 22 nt, Human
gugcuccaggccagggguuaca

SEQ ID NO: 18074 - RNA, 23 nt, Human
cccgcugaaucuuggcucuuguc

SEQ ID NO: 18075 - RNA, 27 nt, Human
gccauuuuuccuuuuuggaggaaaugg

SEQ ID NO: 18076 - RNA, 20 nt, Human
acuccaucuucugcguuccc

SEQ ID NO: 18077 - RNA, 28 nt, Human
cuuuugucaguauggcuuuuaguacuga

SEQ ID NO: 18078 - RNA, 25 nt, Human
caccagcucuccagccaggacgauc

SEQ ID NO: 18079 - RNA, 25 nt, Human
aauagaucagccacuuuuaaggugc

SEQ ID NO: 18080 - RNA, 24 nt, Human
ggugcuggccacaccagcccccuu

SEQ ID NO: 18081 - RNA, 21 nt, Human
cucccucucugcucuccuguc

SEQ ID NO: 18082 - RNA, 26 nt, Human
gcagagcaguccucucuggggagccu

SEQ ID NO: 18083 - RNA, 22 nt, Human
cgccccugcgcguccagcucuu

SEQ ID NO: 18084 - RNA, 20 nt, Human
uccaccccacucagccuccc

SEQ ID NO: 18085 - RNA, 22 nt, Human
uuacagacauauagaacagcgc

SEQ ID NO: 18086 - RNA, 27 nt, Human
gggcgccugugaggcaggcgaaucucu

SEQ ID NO: 18087 - RNA, 19 nt, Human
uuaagagaggaaauguaca

SEQ ID NO: 18088 - RNA, 20 nt, Human
ggcuggggguuggucuugga

SEQ ID NO: 18089 - RNA, 22 nt, Human
aggcuggagugcaguggcgcaa

SEQ ID NO: 18090 - RNA, 26 nt, Human
gaagaagacaaagagagauugaaaug

SEQ ID NO: 18091 - RNA, 20 nt, Human
ccuacuucaggggauguaga

SEQ ID NO: 18092 - RNA, 21 nt, Human
ugcuccaguaaaaucuugccu

SEQ ID NO: 18093 - RNA, 20 nt, Human
uuucucuguccuuggcuauu

SEQ ID NO: 18094 - RNA, 22 nt, Human
uuuguggacugguggccagucg

SEQ ID NO: 18095 - RNA, 26 nt, Human
ccugccugucugucucuccaucuguu

SEQ ID NO: 18096 - RNA, 23 nt, Human
cugccuggcccuccccacaaugc

SEQ ID NO: 18097 - RNA, 27 nt, Human
gggagagagagggaggaguaaaacugg

SEQ ID NO: 18098 - RNA, 22 nt, Human
gcuguggaucaagacacuuugg

SEQ ID NO: 18099 - RNA, 27 nt, Human
ugcagcucugucccagccuucacugug

SEQ ID NO: 18100 - RNA, 23 nt, Human
gcucugcgaugauggcagaagag

SEQ ID NO: 18101 - RNA, 24 nt, Human
caggcuggggucugcagugcagca

SEQ ID NO: 18102 - RNA, 26 nt, Human
aaugcugaugaaucacuguuuuuaga

SEQ ID NO: 18103 - RNA, 22 nt, Human
ucuuaaaaugguaaccuggggg

SEQ ID NO: 18104 - RNA, 24 nt, Human
ggagaggccaucccggggcguccc

SEQ ID NO: 18105 - RNA, 23 nt, Human
ggagcugucagucacucgugcuu

SEQ ID NO: 18106 - RNA, 22 nt, Human
cccacccccugcaccuccaccu

SEQ ID NO: 18107 - RNA, 22 nt, Human
ccuuugagguagaccaggauuu

SEQ ID NO: 18108 - RNA, 26 nt, Human
gagggaaacacagcagcaucucucca

SEQ ID NO: 18109 - RNA, 27 nt, Human
cucuggaggaagccgcccagucccuag

SEQ ID NO: 18110 - RNA, 23 nt, Human
ugugucagacauggauugcagug

SEQ ID NO: 18111 - RNA, 26 nt, Human
ccgucucuacuaaaaauaccaaaaau

SEQ ID NO: 18112 - RNA, 22 nt, Human
acagccuugaugaucucaggga

SEQ ID NO: 18113 - RNA, 22 nt, Human
cuaggaggcggagguugcagug

SEQ ID NO: 18114 - RNA, 22 nt, Human
ccaggaggcggagguuguagug

SEQ ID NO: 18115 - RNA, 22 nt, Human
ccgggaggcggagguuguggug

SEQ ID NO: 18116 - RNA, 19 nt, Human
acccuccacuuccuccucc

SEQ ID NO: 18117 - RNA, 24 nt, Human
cuggucccucugcagucucuauac

SEQ ID NO: 18118 - RNA, 28 nt, Human
cgcgcauuguaaccuuugcacugucuca

SEQ ID NO: 18119 - RNA, 22 nt, Human
uauugugcaccuacuauguggc

SEQ ID NO: 18120 - RNA, 22 nt, Human
ucaagaagacuuccuuuucuac

SEQ ID NO: 18121 - RNA, 21 nt, Human
gaccagccaacagcuugauag

SEQ ID NO: 18122 - RNA, 22 nt, Human
uguaauaaaucugucuauaucg

SEQ ID NO: 18123 - RNA, 27 nt, Human
ucuacuuccugucugcaugcccaaggc

SEQ ID NO: 18124 - RNA, 17 nt, Human
uggaaaccuugcugcua

SEQ ID NO: 18125 - RNA, 20 nt, Human
cauuguuugcagggcaaaca

SEQ ID NO: 18126 - RNA, 22 nt, Human
auaacaaaagauacuuucuaac

SEQ ID NO: 18127 - RNA, 23 nt, Human
ugcugaaagugagcauuguugau

SEQ ID NO: 18128 - RNA, 23 nt, Human
gcugcacgucacccuccugagcc

SEQ ID NO: 18129 - RNA, 22 nt, Human
cuuguuggcuuccgugugucau

SEQ ID NO: 18130 - RNA, 21 nt, Human
uguccccacugggccugaguc

SEQ ID NO: 18131 - RNA, 26 nt, Human
gccgcgcuccagccucaccaggcucc

SEQ ID NO: 18132 - RNA, 23 nt, Human
agccuggcuggagagcugcuaug

SEQ ID NO: 18133 - RNA, 27 nt, Human
caggcuggaaugcaguggugugcucug

SEQ ID NO: 18134 - RNA, 22 nt, Human
ggcagaguccuggagcuggcuc

SEQ ID NO: 18135 - RNA, 24 nt, Human
gccugaucccccgcucccuccucc

SEQ ID NO: 18136 - RNA, 21 nt, Human
ggguuuggaagaaagagagaa

SEQ ID NO: 18137 - RNA, 25 nt, Human
caggaccugggaaugcacaggaccc

SEQ ID NO: 18138 - RNA, 23 nt, Human
ccuucuuagaggguucagucuag

SEQ ID NO: 18139 - RNA, 22 nt, Human
aagugaccuggacgugaaggaa

SEQ ID NO: 18140 - RNA, 26 nt, Human
ggggccuugggcccacccucacaggg

SEQ ID NO: 18141 - RNA, 23 nt, Human
cccaagucuccugacuccuggcc

SEQ ID NO: 18142 - RNA, 29 nt, Human
uuucacagugccagccucuaccuaaggaa

SEQ ID NO: 18143 - RNA, 21 nt, Human
acaugggggaccgggagcagc

SEQ ID NO: 18144 - RNA, 26 nt, Human
uguacuuucauuuuaauuauuuucua

SEQ ID NO: 18145 - RNA, 27 nt, Human
ggggugauuucagagagggcagagggg

SEQ ID NO: 18146 - RNA, 21 nt, Human
ugcuuguaaucccagcacuuu

SEQ ID NO: 18147 - RNA, 21 nt, Human
ugccuguaaucucagcacuuu

SEQ ID NO: 18148 - RNA, 24 nt, Human
ggaucuaccuugggucuuacuuga

SEQ ID NO: 18149 - RNA, 22 nt, Human
gucauccaggcuggagugcggu

SEQ ID NO: 18150 - RNA, 22 nt, Human
gucguccaggcuggagugcagu

SEQ ID NO: 18151 - RNA, 21 nt, Human
ccuugaagauuuuuguaaagg

SEQ ID NO: 18152 - RNA, 20 nt, Human
guugugcuuuucuucauaua

SEQ ID NO: 18153 - RNA, 22 nt, Human
ugaacuccuggacuuagacgau

SEQ ID NO: 18154 - RNA, 22 nt, Human
agggauuacaggcaugagccac

SEQ ID NO: 18155 - RNA, 23 nt, Human
cugggcgccuggagcaguuucac

SEQ ID NO: 18156 - RNA, 22 nt, Human
ccugcagggccugugagcugcu

SEQ ID NO: 18157 - RNA, 23 nt, Human
cugacuucgugcaacuuuuccuc

SEQ ID NO: 18158 - RNA, 23 nt, Human
ucugugguucuucucauucucau

SEQ ID NO: 18159 - RNA, 22 nt, Human
acaggcaauuuagucauuauga

SEQ ID NO: 18160 - RNA, 27 nt, Human
gacuuaaccuuuuauuuccuguccuuc

SEQ ID NO: 18161 - RNA, 20 nt, Human
auacugagaagcaacuugca

SEQ ID NO: 18162 - RNA, 22 nt, Human
cuuccuacccucucuaauggcc

SEQ ID NO: 18163 - RNA, 21 nt, Human
uuguaugguagaccaaaaaga

SEQ ID NO: 18164 - RNA, 23 nt, Human
ggcaaggaagacacagacucgca

SEQ ID NO: 18165 - RNA, 31 nt, Human
gggagagaaggcccggaggggcucugcguuc

SEQ ID NO: 18166 - RNA, 22 nt, Human
ccaggagguggagguuacagug

SEQ ID NO: 18167 - RNA, 24 nt, Human
ggaccccuccuacucuucuuagcg

SEQ ID NO: 18168 - RNA, 24 nt, Human
gugagacaagggauguucuaccug

SEQ ID NO: 18169 - RNA, 20 nt, Human
ugagacugaggaugaggaca

SEQ ID NO: 18170 - RNA, 24 nt, Human
uauguaucacauaugaugcagccu

SEQ ID NO: 18171 - RNA, 22 nt, Human
uugcccaggcuggaguacaaug

SEQ ID NO: 18172 - RNA, 19 nt, Human
ugaggggugggagagccag

SEQ ID NO: 18173 - RNA, 22 nt, Human
ugcacuccaggcugggcagcaa

SEQ ID NO: 18174 - RNA, 22 nt, Human
caagaucaucaaaucaaauucc

SEQ ID NO: 18175 - RNA, 23 nt, Human
uuugggaaaugaagaugcacauc

SEQ ID NO: 18176 - RNA, 23 nt, Human
acccuccacccucugccuugcaa

SEQ ID NO: 18177 - RNA, 25 nt, Human
gaagaaaagaguccagguaaauggu

SEQ ID NO: 18178 - RNA, 20 nt, Human
ggcucacugcaccuccaccu

SEQ ID NO: 18179 - RNA, 21 nt, Human
auugccuuccccaggagccag

SEQ ID NO: 18180 - RNA, 26 nt, Human
ccagagaggugguggaauaggaccgc

SEQ ID NO: 18181 - RNA, 22 nt, Human
ggaguuuccuccauaaacuauu

SEQ ID NO: 18182 - RNA, 18 nt, Human
gaugguacaagaacuuca

SEQ ID NO: 18183 - RNA, 26 nt, Human
aaacccgcugccagagcccaccucuc

SEQ ID NO: 18184 - RNA, 21 nt, Human
cugccugcgcccugcucccac

SEQ ID NO: 18185 - RNA, 18 nt, Human
aguagccuccuccugggc

SEQ ID NO: 18186 - RNA, 22 nt, Human
cugggaggcggagaguacagug

SEQ ID NO: 18187 - RNA, 24 nt, Human
agccugugagccccaggcacuuug

SEQ ID NO: 18188 - RNA, 20 nt, Human
cugguggcagugggagcugc

SEQ ID NO: 18189 - RNA, 22 nt, Human
gcuagacccaaacauaugcaca

SEQ ID NO: 18190 - RNA, 20 nt, Human
cugggacgggccauugccug

SEQ ID NO: 18191 - RNA, 22 nt, Human
caaacuccugggcucaagcgau

SEQ ID NO: 18192 - RNA, 28 nt, Human
ucaggggcuuuggaagcucuguugcagg

SEQ ID NO: 18193 - RNA, 21 nt, Human
gggacccccauccgugcugcc

SEQ ID NO: 18194 - RNA, 23 nt, Human
ccauuucuaaaauggcagcuuca

SEQ ID NO: 18195 - RNA, 25 nt, Human
agugaagaugcaaucagacaagugu

SEQ ID NO: 18196 - RNA, 22 nt, Human
uggacuucucccgucucuaggg

SEQ ID NO: 18197 - RNA, 27 nt, Human
ggcaguuucaguccauaucaauugugu

SEQ ID NO: 18198 - RNA, 24 nt, Human
cuguucacgcuccaccugucuggu

SEQ ID NO: 18199 - RNA, 19 nt, Human
uucccaggggccaggcugg

SEQ ID NO: 18200 - RNA, 24 nt, Human
uuagaaaacacuuuuaaacuuuuu

SEQ ID NO: 18201 - RNA, 21 nt, Human
cuugugaguuuggaaguuugg

SEQ ID NO: 18202 - RNA, 19 nt, Human
acagcaucgugaucacuga

SEQ ID NO: 18203 - RNA, 28 nt, Human
gaaugugggaaagcuuuucguuguaagu

SEQ ID NO: 18204 - RNA, 21 nt, Human
uccagccuggauaacagagcg

SEQ ID NO: 18205 - RNA, 21 nt, Human
aggacuaguauagaauuaagc

SEQ ID NO: 18206 - RNA, 29 nt, Human
cucucgaucucaccuccauccccauccac

SEQ ID NO: 18207 - RNA, 23 nt, Human
cuguggucaguguggcugcauag

SEQ ID NO: 18208 - RNA, 18 nt, Human
agaaauuugauuugaaaa

SEQ ID NO: 18209 - RNA, 22 nt, Human
ggcgcagaggcgggaggcggag

SEQ ID NO: 18210 - RNA, 24 nt, Human
agccuccuccuuuucugaaagcau

SEQ ID NO: 18211 - RNA, 21 nt, Human
gcuuugagaaaacauuucuua

SEQ ID NO: 18212 - RNA, 25 nt, Human
gguggaacaggagggguggggagga

SEQ ID NO: 18213 - RNA, 25 nt, Human
gccaucacaccuggcuaauuuuugu

SEQ ID NO: 18214 - RNA, 19 nt, Human
ucccaggcuggaggucagu

SEQ ID NO: 18215 - RNA, 20 nt, Human
uggaugccauuugauuguaa

SEQ ID NO: 18216 - RNA, 23 nt, Human
ggguggguuuaauaacauauuau

SEQ ID NO: 18217 - RNA, 25 nt, Human
gguuucaaagcagucagaaaaagaa

SEQ ID NO: 18218 - RNA, 24 nt, Human
ggggguggacaaacuggagucugg

SEQ ID NO: 18219 - RNA, 22 nt, Human
uggccaagauggugaaacccca

SEQ ID NO: 18220 - RNA, 20 nt, Human
uuacagucuuagagguugca

SEQ ID NO: 18221 - RNA, 26 nt, Human
auuuuauuaugcaaccaguuuaucca

SEQ ID NO: 18222 - RNA, 25 nt, Human
uggucucaauaaaaugcuaacuugc

SEQ ID NO: 18223 - RNA, 25 nt, Human
uacaggcacgugccaccacgcccag

SEQ ID NO: 18224 - RNA, 20 nt, Human
ugugacggcgggggucggug

SEQ ID NO: 18225 - RNA, 25 nt, Human
ccaagagacccugaagagccugggu

SEQ ID NO: 18226 - RNA, 30 nt, Human
uggcauuuucugacuucuuccuccuccucc

SEQ ID NO: 18227 - RNA, 19 nt, Human
gggcucucuuuccuucuug

SEQ ID NO: 18228 - RNA, 24 nt, Human
uguugaacagauccacacugcucu

SEQ ID NO: 18229 - RNA, 22 nt, Human
ccccugaguuggagcucauucu

SEQ ID NO: 18230 - RNA, 24 nt, Human
cuguuguccaggcuggagugcaau

SEQ ID NO: 18231 - RNA, 23 nt, Human
cuuuuucugaaccaagcacuguc

SEQ ID NO: 18232 - RNA, 22 nt, Human
ggggaggcggagguuacaguga

SEQ ID NO: 18233 - RNA, 24 nt, Human
gccaugagaugauacauccaaagc

SEQ ID NO: 18234 - RNA, 27 nt, Human
cccuccuggcccuccaaggcgggggga

SEQ ID NO: 18235 - RNA, 24 nt, Human
ggggcagggagagagggaaccugc

SEQ ID NO: 18236 - RNA, 24 nt, Human
cacaugaaccacuccaaaaaucag

SEQ ID NO: 18237 - RNA, 21 nt, Human
ucugguauuucuugcugcuug

SEQ ID NO: 18238 - RNA, 27 nt, Human
guuccuuaaaaguucuagcugcuuucu

SEQ ID NO: 18239 - RNA, 23 nt, Human
uuuccaggugguaagcaccagga

SEQ ID NO: 18240 - RNA, 26 nt, Human
gagaauguauuagacuaaauacaaac

SEQ ID NO: 18241 - RNA, 27 nt, Human
acccuguggcccuggcucugcuguccc

SEQ ID NO: 18242 - RNA, 25 nt, Human
cuccuagacccccagggagccagug

SEQ ID NO: 18243 - RNA, 24 nt, Human
gcauauacuugauuacaaaugaaa

SEQ ID NO: 18244 - RNA, 23 nt, Human
ccugcggcugcccccaugaccua

SEQ ID NO: 18245 - RNA, 20 nt, Human
ccuucaggcuguagggcugc

SEQ ID NO: 18246 - RNA, 21 nt, Human
uguguagugcuggacagugac

SEQ ID NO: 18247 - RNA, 21 nt, Human
ggcauuucaaaaggcagugaa

SEQ ID NO: 18248 - RNA, 20 nt, Human
cccauaauuuucuucaugca

SEQ ID NO: 18249 - RNA, 24 nt, Human
uccucccaggcugagagaguucug

SEQ ID NO: 18250 - RNA, 20 nt, Human
gucguggcucacugcagccu

SEQ ID NO: 18251 - RNA, 27 nt, Human
cuuugggcaccuuccagggcccucucc

SEQ ID NO: 18252 - RNA, 26 nt, Human
cgccagguuccccagccgcccacaac

SEQ ID NO: 18253 - RNA, 22 nt, Human
ggcccaggcugugaguuccagg

SEQ ID NO: 18254 - RNA, 21 nt, Human
aacuucaaaucugugauugcu

SEQ ID NO: 18255 - RNA, 22 nt, Human
cuauauccuuaaccauucuguc

SEQ ID NO: 18256 - RNA, 22 nt, Human
cuucuaugcauccgauucuuaa

SEQ ID NO: 18257 - RNA, 22 nt, Human
uccauuagcugggacuuaaaug

SEQ ID NO: 18258 - RNA, 24 nt, Human
uccuccaggaagccuucccagcua

SEQ ID NO: 18259 - RNA, 21 nt, Human
ggguccccagggagaccgugu

SEQ ID NO: 18260 - RNA, 16 nt, Human
aaugucgaacucugaa

SEQ ID NO: 18261 - RNA, 27 nt, Human
gccggguucuagucuccuuugcacuga

SEQ ID NO: 18262 - RNA, 29 nt, Human
gccucccucccugccccuccuuuuauguc

SEQ ID NO: 18263 - RNA, 22 nt, Human
cccgccuggccaagaugacugc

SEQ ID NO: 18264 - RNA, 21 nt, Human
gguuuggcaagucugcccuag

SEQ ID NO: 18265 - RNA, 19 nt, Human
ucauggcugauugcagccu

SEQ ID NO: 18266 - RNA, 25 nt, Human
gucucaagacugggcucacauucug

SEQ ID NO: 18267 - RNA, 21 nt, Human
guggccauggugugugcagug

SEQ ID NO: 18268 - RNA, 24 nt, Human
aaccauuuucuuaggcugucucac

SEQ ID NO: 18269 - RNA, 22 nt, Human
gaccccugugcggugcggaggg

SEQ ID NO: 18270 - RNA, 23 nt, Human
ccagggguaggauaguauaggaa

SEQ ID NO: 18271 - RNA, 21 nt, Human
uugucuucuggcuuuucagcu

SEQ ID NO: 18272 - RNA, 22 nt, Human
aaagaagccggugcugaaggag

SEQ ID NO: 18273 - RNA, 21 nt, Human
gauagaacauuuuacauuaua

SEQ ID NO: 18274 - RNA, 21 nt, Human
auccccaccccaccccgacgu

SEQ ID NO: 18275 - RNA, 22 nt, Human
gaaagagaucaggcaacaguga

SEQ ID NO: 18276 - RNA, 21 nt, Human
ccaugguucugccuccuggcc

SEQ ID NO: 18277 - RNA, 24 nt, Human
cccagccucugagucccguggggc

SEQ ID NO: 18278 - RNA, 23 nt, Human
accugccuggccgggcguggugg

SEQ ID NO: 18279 - RNA, 25 nt, Human
aucacaaauagccacauucugcucu

SEQ ID NO: 18280 - RNA, 22 nt, Human
ucuccacccuucucagaguucc

SEQ ID NO: 18281 - RNA, 20 nt, Human
gcuggccuugguaugugcca

SEQ ID NO: 18282 - RNA, 21 nt, Human
cugcuccccgcccccucacuu

SEQ ID NO: 18283 - RNA, 21 nt, Human
uucggcugcauuucuucacgc

SEQ ID NO: 18284 - RNA, 25 nt, Human
ggacgucuggggugggaauggggga

SEQ ID NO: 18285 - RNA, 22 nt, Human
ugcagccugcuccagccuggcc

SEQ ID NO: 18286 - RNA, 23 nt, Human
uaauauaauaaaacucugauuug

SEQ ID NO: 18287 - RNA, 23 nt, Human
cucaaggagcuuccagugcagag

SEQ ID NO: 18288 - RNA, 22 nt, Human
guuaccagcuucugagcuagag

SEQ ID NO: 18289 - RNA, 21 nt, Human
aggagguggcgguugcuguga

SEQ ID NO: 18290 - RNA, 23 nt, Human
gccagugcuaucggaggacucug

SEQ ID NO: 18291 - RNA, 21 nt, Human
aucaguauuuccuauuggaaa

SEQ ID NO: 18292 - RNA, 21 nt, Human
ugccuguaaucccagcacuuu

SEQ ID NO: 18293 - RNA, 21 nt, Human
uucucauaguugcuucagauc

SEQ ID NO: 18294 - RNA, 20 nt, Human
caguaaaauaaauuuauuuc

SEQ ID NO: 18295 - RNA, 26 nt, Human
gauguucuucaacgauuuggaaguca

SEQ ID NO: 18296 - RNA, 24 nt, Human
uguacggaugauucaguggcuggc

SEQ ID NO: 18297 - RNA, 21 nt, Human
ugggcauggaagaaagacugg

SEQ ID NO: 18298 - RNA, 22 nt, Human
augcacucagagcacagagccg

SEQ ID NO: 18299 - RNA, 22 nt, Human
ccaaaacaacugguuauaugcc

SEQ ID NO: 18300 - RNA, 26 nt, Human
ucacccagcacccacaacuagcgccu

SEQ ID NO: 18301 - RNA, 21 nt, Human
ccacccagcaaagagugggcu

SEQ ID NO: 18302 - RNA, 21 nt, Human
acacaaaauuacuuuguggua

SEQ ID NO: 18303 - RNA, 21 nt, Human
uuuagauacuuuuugcugcua

SEQ ID NO: 18304 - RNA, 23 nt, Human
cccaggaggcggagcuggcagug

SEQ ID NO: 18305 - RNA, 22 nt, Human
ccagaaggcagagguugcagug

SEQ ID NO: 18306 - RNA, 24 nt, Human
aggaaagagaggagccgucgcagg

SEQ ID NO: 18307 - RNA, 26 nt, Human
cugccucaccuucaucuagccuggcc

SEQ ID NO: 18308 - RNA, 27 nt, Human
uuuuccuccucuauuaaacaugggaaa

SEQ ID NO: 18309 - RNA, 16 nt, Human
aaggugaggagcuuga

SEQ ID NO: 18310 - RNA, 25 nt, Human
gccugcccugucuccugggaucaga

SEQ ID NO: 18311 - RNA, 21 nt, Human
cugucaaauuagcacaacaaa

SEQ ID NO: 18312 - RNA, 27 nt, Human
uccaugaagacaaauaguguggaguga

SEQ ID NO: 18313 - RNA, 26 nt, Human
gucuccauuuuucccaggacaggaaa

SEQ ID NO: 18314 - RNA, 23 nt, Human
guggagaggauccuucugcuuua

SEQ ID NO: 18315 - RNA, 22 nt, Human
ucucgcccaggcuggagugcaa

SEQ ID NO: 18316 - RNA, 22 nt, Human
guucacugcagucuugaccuuu

SEQ ID NO: 18317 - RNA, 22 nt, Human
uccucuuggagucuagaacauc

SEQ ID NO: 18318 - RNA, 20 nt, Human
ccuccccugaggcucaggga

SEQ ID NO: 18319 - RNA, 19 nt, Human
agccuuccccuugcccagg

SEQ ID NO: 18320 - RNA, 25 nt, Human
ugacuacucuugucuuccucucuca

SEQ ID NO: 18321 - RNA, 23 nt, Human
acaaagggcccugaaguuugagu

SEQ ID NO: 18322 - RNA, 20 nt, Human
uuucuucugcgccucaggcu

SEQ ID NO: 18323 - RNA, 19 nt, Human
uuuuucuguguuacacuca

SEQ ID NO: 18324 - RNA, 27 nt, Human
uuguccaggcuggagugcaauagcgcg

SEQ ID NO: 18325 - RNA, 23 nt, Human
cugcugagcuggaagcugugggg

SEQ ID NO: 18326 - RNA, 26 nt, Human
cacucccgccucagggccaggcccag

SEQ ID NO: 18327 - RNA, 21 nt, Human
uucacgccuuccaccuccugc

SEQ ID NO: 18328 - RNA, 23 nt, Human
ggauugauggaggcuggcaaggg

SEQ ID NO: 18329 - RNA, 20 nt, Human
ccuuccagccaccuuauuuc

SEQ ID NO: 18330 - RNA, 27 nt, Human
uucuaucuuuuguuuccuuuuuuccca

SEQ ID NO: 18331 - RNA, 23 nt, Human
ucugaagagauggcaccagggaa

SEQ ID NO: 18332 - RNA, 20 nt, Human
auccaggccaucaccuauca

SEQ ID NO: 18333 - RNA, 27 nt, Human
gucucucuggcuccugaccuggccuuu

SEQ ID NO: 18334 - RNA, 22 nt, Human
ucagcccaggagccaccagauc

SEQ ID NO: 18335 - RNA, 25 nt, Human
uauuaaaauuugaugaaauuuacug

SEQ ID NO: 18336 - RNA, 20 nt, Human
auaguaccuucucuuugcca

SEQ ID NO: 18337 - RNA, 27 nt, Human
ugagacgccaccauuccuggaaaccac

SEQ ID NO: 18338 - RNA, 27 nt, Human
agcccuguaucguauucaccuucaguu

SEQ ID NO: 18339 - RNA, 24 nt, Human
uaaaacaauucaaauuugauagua

SEQ ID NO: 18340 - RNA, 26 nt, Human
aacauugcacuucagccuggugacau

SEQ ID NO: 18341 - RNA, 27 nt, Human
cuccagccucggccucccaaaguacug

SEQ ID NO: 18342 - RNA, 21 nt, Human
ucaugcuguuucucuguuugc

SEQ ID NO: 18343 - RNA, 30 nt, Human
cuuguccuccccuggccuccagucuccccu

SEQ ID NO: 18344 - RNA, 21 nt, Human
uggguuucugauugcaucacu

SEQ ID NO: 18345 - RNA, 19 nt, Human
cuggcagagccucugagau

SEQ ID NO: 18346 - RNA, 22 nt, Human
caaaccugaacaguuccuuuau

SEQ ID NO: 18347 - RNA, 21 nt, Human
cagcucaguuggcuuugugaa

SEQ ID NO: 18348 - RNA, 29 nt, Human
ccuuggccuuggcuccacagggugugcuu

SEQ ID NO: 18349 - RNA, 19 nt, Human
uugucaaggagagugcagu

SEQ ID NO: 18350 - RNA, 21 nt, Human
aucaccuaggcuggagugcag

SEQ ID NO: 18351 - RNA, 19 nt, Human
cccccagccacucccucca

SEQ ID NO: 18352 - RNA, 24 nt, Human
ugggccaugccgucucacccacag

SEQ ID NO: 18353 - RNA, 23 nt, Human
agcuggugguguggcuuuguggg

SEQ ID NO: 18354 - RNA, 26 nt, Human
uagaaaacguggacucauuucacuau

SEQ ID NO: 18355 - RNA, 23 nt, Human
aaaauugaugggauuuggucaac

SEQ ID NO: 18356 - RNA, 25 nt, Human
gaggcugugauaacuuaggaggcag

SEQ ID NO: 18357 - RNA, 21 nt, Human
cuucuaggcuaagcaaaaaga

SEQ ID NO: 18358 - RNA, 20 nt, Human
gacagauucaucaaaaauga

SEQ ID NO: 18359 - RNA, 24 nt, Human
gacagauuuuaaaaauugauauga

SEQ ID NO: 18360 - RNA, 22 nt, Human
uguugcccaggcuggagcgcag

SEQ ID NO: 18361 - RNA, 26 nt, Human
cuguccaggaugcagggagcucgggc

SEQ ID NO: 18362 - RNA, 22 nt, Human
cuccacugcuucaggucacuuc

SEQ ID NO: 18363 - RNA, 18 nt, Human
gaagccugcaugugccca

SEQ ID NO: 18364 - RNA, 24 nt, Human
auaagagaccuguuuuaaaaagga

SEQ ID NO: 18365 - RNA, 21 nt, Human
guuccugguuugaauccuggc

SEQ ID NO: 18366 - RNA, 23 nt, Human
uuggugcaguguuugauguucaa

SEQ ID NO: 18367 - RNA, 22 nt, Human
aucgauacugccugguaaucca

SEQ ID NO: 18368 - RNA, 21 nt, Human
acugagucucaauggacuucu

SEQ ID NO: 18369 - RNA, 21 nt, Human
caccggguuccagcaccacac

SEQ ID NO: 18370 - RNA, 20 nt, Human
gcucacugaacuccuucccc

SEQ ID NO: 18371 - RNA, 17 nt, Human
ugugacugucaugugaa

SEQ ID NO: 18372 - RNA, 26 nt, Human
ggcugggauggagcacuucuucuggu

SEQ ID NO: 18373 - RNA, 24 nt, Human
gccaggacagaucacuugagguca

SEQ ID NO: 18374 - RNA, 22 nt, Human
guauuccaaucacugugcuuaa

SEQ ID NO: 18375 - RNA, 22 nt, Human
cuuugggcaugagaugcucaga

SEQ ID NO: 18376 - RNA, 24 nt, Human
uucucucucaccucuaggcccucu

SEQ ID NO: 18377 - RNA, 21 nt, Human
cccuaaaacauguguugccug

SEQ ID NO: 18378 - RNA, 27 nt, Human
cucuggcccucgcuuuaccggaguagg

SEQ ID NO: 18379 - RNA, 21 nt, Human
ccccaagauaucaggccagaa

SEQ ID NO: 18380 - RNA, 26 nt, Human
cagguaagggaaagccucagcuccuu

SEQ ID NO: 18381 - RNA, 27 nt, Human
ugcagaacugccauuauuuucugucag

SEQ ID NO: 18382 - RNA, 27 nt, Human
caggaugugcacaaggcaauugaaaug

SEQ ID NO: 18383 - RNA, 21 nt, Human
uaaauucguucccacagccuu

SEQ ID NO: 18384 - RNA, 21 nt, Human
agaaggcaggaauguguggca

SEQ ID NO: 18385 - RNA, 27 nt, Human
cugguuggaaaugccauuguuuugggg

SEQ ID NO: 18386 - RNA, 27 nt, Human
cugucuagccagguccagguagcccac

SEQ ID NO: 18387 - RNA, 22 nt, Human
cccacacacuuuuaugaccacc

SEQ ID NO: 18388 - RNA, 20 nt, Human
gagaaaaauaucuguaagag

SEQ ID NO: 18389 - RNA, 25 nt, Human
cccgccuggccccugggccugccaa

SEQ ID NO: 18390 - RNA, 28 nt, Human
cuucacgccugggugacccccacugccg

SEQ ID NO: 18391 - RNA, 19 nt, Human
cugugugugcugcaaguga

SEQ ID NO: 18392 - RNA, 26 nt, Human
ugugcagucccagagccuccuaaaau

SEQ ID NO: 18393 - RNA, 29 nt, Human
ucugcccccugcuggcucuucugcccaau

SEQ ID NO: 18394 - RNA, 20 nt, Human
ggaaguaacaggaccucuuu

SEQ ID NO: 18395 - RNA, 23 nt, Human
ccuuuauguccuguacaucauuc

SEQ ID NO: 18396 - RNA, 22 nt, Human
uggcacacaccaguaaucccag

SEQ ID NO: 18397 - RNA, 21 nt, Human
gcuggggcucagccuggggga

SEQ ID NO: 18398 - RNA, 18 nt, Human
acaggaagcuuuuuguau

SEQ ID NO: 18399 - RNA, 22 nt, Human
ucagcaucuucagcacuuaccg

SEQ ID NO: 18400 - RNA, 22 nt, Human
augagacauggcugucucacag

SEQ ID NO: 18401 - RNA, 26 nt, Human
accaucaacaugaauuacuguacuau

SEQ ID NO: 18402 - RNA, 27 nt, Human
caggcuggagugcaguggcucgaucuc

SEQ ID NO: 18403 - RNA, 20 nt, Human
agaccuacauucccucuccu

SEQ ID NO: 18404 - RNA, 24 nt, Human
agcaggaagccaggcugagugagc

SEQ ID NO: 18405 - RNA, 21 nt, Human
aguugggcuggaugaucucca

SEQ ID NO: 18406 - RNA, 25 nt, Human
ccacagccacacagccgccgccacu

SEQ ID NO: 18407 - RNA, 30 nt, Human
gggccauccaaccauccaaccuuuaaaaaa

SEQ ID NO: 18408 - RNA, 21 nt, Human
aaagcagcacuggaaacuuuu

SEQ ID NO: 18409 - RNA, 21 nt, Human
uucaaacacacaguauucgug

SEQ ID NO: 18410 - RNA, 21 nt, Human
augacacccucccauacccca

SEQ ID NO: 18411 - RNA, 20 nt, Human
uagaagcagugugcagguga

SEQ ID NO: 18412 - RNA, 22 nt, Human
uuugcugauacuaucucuuguc

SEQ ID NO: 18413 - RNA, 22 nt, Human
uuaaugccaccauugauuucaa

SEQ ID NO: 18414 - RNA, 29 nt, Human
cacagccgccuacgcccaccuauggccag

SEQ ID NO: 18415 - RNA, 18 nt, Human
uuagugugugugcuuaca

SEQ ID NO: 18416 - RNA, 25 nt, Human
acacaggaagccugugaccauggca

SEQ ID NO: 18417 - RNA, 27 nt, Human
ggaccagaacccuggggucagacccau

SEQ ID NO: 18418 - RNA, 21 nt, Human
acuugcgcugucacucagccu

SEQ ID NO: 18419 - RNA, 20 nt, Human
uagcagaauauucacaaguu

SEQ ID NO: 18420 - RNA, 20 nt, Human
ggucuccaccugucucccau

SEQ ID NO: 18421 - RNA, 21 nt, Human
aguuccugugggugugucucu

SEQ ID NO: 18422 - RNA, 21 nt, Human
gccucugcuccuaucaggguu

SEQ ID NO: 18423 - RNA, 31 nt, Human
ggcugguuucaaacuccugaccucaggugau

SEQ ID NO: 18424 - RNA, 25 nt, Human
cauacagcugccuaccuaaugagga

SEQ ID NO: 18425 - RNA, 21 nt, Human
uucaccguauuccaaaccaga

SEQ ID NO: 18426 - RNA, 20 nt, Human
ggacacaaaugggaauuuaa

SEQ ID NO: 18427 - RNA, 20 nt, Human
cuucuacugcuuuucaguuc

SEQ ID NO: 18428 - RNA, 21 nt, Human
gaugcccaggcucacuucagu

SEQ ID NO: 18429 - RNA, 23 nt, Human
ggagaaacuuuguaugugcacac

SEQ ID NO: 18430 - RNA, 19 nt, Human
ccucucucacaggcccuua

SEQ ID NO: 18431 - RNA, 27 nt, Human
uccuuccagauccccggccaagcccag

SEQ ID NO: 18432 - RNA, 17 nt, Human
ggaguuucuuuccugcc

SEQ ID NO: 18433 - RNA, 20 nt, Human
cccggggccagagacauaug

SEQ ID NO: 18434 - RNA, 22 nt, Human
ucucaucuucucaucccuagga

SEQ ID NO: 18435 - RNA, 20 nt, Human
ggcuaauuaauuugcuuuau

SEQ ID NO: 18436 - RNA, 27 nt, Human
aagacuugccugcuagggaccucgccu

SEQ ID NO: 18437 - RNA, 23 nt, Human
aaauguucuuuuaauggucaguu

SEQ ID NO: 18438 - RNA, 20 nt, Human
accuuaacuuaaauguaaug

SEQ ID NO: 18439 - RNA, 19 nt, Human
cgccuggguggaggcaggg

SEQ ID NO: 18440 - RNA, 22 nt, Human
augaaugauaaacucucugcuu

SEQ ID NO: 18441 - RNA, 20 nt, Human
uggggacugcagcuaacuua

SEQ ID NO: 18442 - RNA, 23 nt, Human
uuuggagaaauaaaaauaucuaa

SEQ ID NO: 18443 - RNA, 22 nt, Human
ugagucugcuuucuuuugucuu

SEQ ID NO: 18444 - RNA, 28 nt, Human
gccucucccugcacucccuccuggagcu

SEQ ID NO: 18445 - RNA, 22 nt, Human
auuugucuuauaacaugaccca

SEQ ID NO: 18446 - RNA, 31 nt, Human
auacuaauaaaauacauacuauagauucuuu

SEQ ID NO: 18447 - RNA, 21 nt, Human
ugccuagggaaaauuccaaug

SEQ ID NO: 18448 - RNA, 24 nt, Human
aguauuuugguauuugaccugucc

SEQ ID NO: 18449 - RNA, 27 nt, Human
ggacagcuucagccaggaggcugugag

SEQ ID NO: 18450 - RNA, 24 nt, Human
ucuccaauccacacauauuguuuu

SEQ ID NO: 18451 - RNA, 21 nt, Human
caacuuucugaagccgugugg

SEQ ID NO: 18452 - RNA, 23 nt, Human
cacacuugugacgucgggcauuc

SEQ ID NO: 18453 - RNA, 26 nt, Human
uggacacucagggucccaucacagcc

SEQ ID NO: 18454 - RNA, 21 nt, Human
gaggucaggaguuucagacca

SEQ ID NO: 18455 - RNA, 26 nt, Human
uccugccucuguuguagaagacaugu

SEQ ID NO: 18456 - RNA, 18 nt, Human
gcuccccggcucuucugu

SEQ ID NO: 18457 - RNA, 23 nt, Human
agaagcagcaucuucccauuucc

SEQ ID NO: 18458 - RNA, 22 nt, Human
ccagccugggaaacaagaguga

SEQ ID NO: 18459 - RNA, 26 nt, Human
gggaaaacacugcagcggugcucgga

SEQ ID NO: 18460 - RNA, 24 nt, Human
gauuugaaugucauaauugcagug

SEQ ID NO: 18461 - RNA, 26 nt, Human
cagggucccugaacugcugcgggccc

SEQ ID NO: 18462 - RNA, 21 nt, Human
cucaagauuaucaacugugug

SEQ ID NO: 18463 - RNA, 24 nt, Human
accagccugaccaacguuaaguaa

SEQ ID NO: 18464 - RNA, 22 nt, Human
gaagagauguuucacaagaagu

SEQ ID NO: 18465 - RNA, 20 nt, Human
caaugccagcauaaauccau

SEQ ID NO: 18466 - RNA, 25 nt, Human
gguggcccagccgcucagggccagg

SEQ ID NO: 18467 - RNA, 21 nt, Human
uuacccacucucucccugugg

SEQ ID NO: 18468 - RNA, 21 nt, Human
acugcgaggacugccuugcca

SEQ ID NO: 18469 - RNA, 22 nt, Human
caggcgguugaggcugcaguga

SEQ ID NO: 18470 - RNA, 23 nt, Human
ggaggugggcacagguggugagc

SEQ ID NO: 18471 - RNA, 22 nt, Human
ccgggacgcagggguugcagug

SEQ ID NO: 18472 - RNA, 23 nt, Human
gcaacaaaaaugucacuuuaucu

SEQ ID NO: 18473 - RNA, 19 nt, Human
ucuuacucucguucauaca

SEQ ID NO: 18474 - RNA, 20 nt, Human
cuggaggacguggacugggg

SEQ ID NO: 18475 - RNA, 27 nt, Human
cuaccaggccaucuccccaguuuccca

SEQ ID NO: 18476 - RNA, 22 nt, Human
acaaguguuuacuaacacugga

SEQ ID NO: 18477 - RNA, 24 nt, Human
cccuuuucauucuccuccuccucc

SEQ ID NO: 18478 - RNA, 20 nt, Human
auuucaugacgucucucugc

SEQ ID NO: 18479 - RNA, 21 nt, Human
ucugacuccuauggugaccuc

SEQ ID NO: 18480 - RNA, 21 nt, Human
ugaaaugcagaacucaagccu

SEQ ID NO: 18481 - RNA, 22 nt, Human
gagaaugugauuccuuuugaug

SEQ ID NO: 18482 - RNA, 22 nt, Human
cucacaccacuagccucagggg

SEQ ID NO: 18483 - RNA, 23 nt, Human
aaggaaaaagcaacuauguucac

SEQ ID NO: 18484 - RNA, 23 nt, Human
gaagcagcgguucucggcgcugc

SEQ ID NO: 18485 - RNA, 22 nt, Human
cauguaaagaaaaauaaaacug

SEQ ID NO: 18486 - RNA, 25 nt, Human
agcaauugucugauuaaucacuggc

SEQ ID NO: 18487 - RNA, 22 nt, Human
ugcaguucugggcagcauccuc

SEQ ID NO: 18488 - RNA, 26 nt, Human
uuauauuuucacagacuuuugaagca

SEQ ID NO: 18489 - RNA, 21 nt, Human
ggggugagaguaagcugcuga

SEQ ID NO: 18490 - RNA, 22 nt, Human
ggcucacugcaacccccaucuc

SEQ ID NO: 18491 - RNA, 20 nt, Human
ggcggggccucuuuauuucu

SEQ ID NO: 18492 - RNA, 32 nt, Human
ggaagagcagugguuguccagcaagguccuag

SEQ ID NO: 18493 - RNA, 23 nt, Human
auggagucuugcuccuguugugc

SEQ ID NO: 18494 - RNA, 18 nt, Human
uuagaacagccuaccauu

SEQ ID NO: 18495 - RNA, 22 nt, Human
gccacgacaggcccgugugaca

SEQ ID NO: 18496 - RNA, 22 nt, Human
cucuuaucuucugccaggauca

SEQ ID NO: 18497 - RNA, 19 nt, Human
ucagcuccaugucuuguac

SEQ ID NO: 18498 - RNA, 21 nt, Human
ucaauaaacagccacuauuuc

SEQ ID NO: 18499 - RNA, 25 nt, Human
ccucuucccaacuuccuccagguca

SEQ ID NO: 18500 - RNA, 29 nt, Human
ucacgaaucagcugcaggucucuguuuug

SEQ ID NO: 18501 - RNA, 27 nt, Human
cugccuuucacugaauuuucugagggc

SEQ ID NO: 18502 - RNA, 24 nt, Human
gcacugguuuguucccugugucau

SEQ ID NO: 18503 - RNA, 22 nt, Human
ggacauuuucaugcauauuuua

SEQ ID NO: 18504 - RNA, 27 nt, Human
cuuccacugcuaguagcuagcacuuac

SEQ ID NO: 18505 - RNA, 24 nt, Human
cuccccaccccaccccugcgacaa

SEQ ID NO: 18506 - RNA, 21 nt, Human
gugggcccagguucugcucuu

SEQ ID NO: 18507 - RNA, 27 nt, Human
auuuaucugaacaccauucagaaacuu

SEQ ID NO: 18508 - RNA, 25 nt, Human
accauagcacaggcuaauuuuuugu

SEQ ID NO: 18509 - RNA, 24 nt, Human
gggagugugugguguuagggugca

SEQ ID NO: 18510 - RNA, 27 nt, Human
gggaggcagagguugcagugaaccgag

SEQ ID NO: 18511 - RNA, 22 nt, Human
aaggaaacccagagugcccagc

SEQ ID NO: 18512 - RNA, 26 nt, Human
ggugcgaucauagcucacugcagccu

SEQ ID NO: 18513 - RNA, 29 nt, Human
ggucuacaaaugcccuacucucuuaugca

SEQ ID NO: 18514 - RNA, 23 nt, Human
uuuugauuugcuuccaccagggg

SEQ ID NO: 18515 - RNA, 23 nt, Human
auggcuccuugcccucaagcaau

SEQ ID NO: 18516 - RNA, 26 nt, Human
ggaccugggcucucuccacgauucug

SEQ ID NO: 18517 - RNA, 21 nt, Human
aacguuauacuccauucucau

SEQ ID NO: 18518 - RNA, 21 nt, Human
auggguggaauugacaaugaa

SEQ ID NO: 18519 - RNA, 21 nt, Human
cucgaauuaugaucaaggggg

SEQ ID NO: 18520 - RNA, 19 nt, Human
cuucccuuccuuaaaguac

SEQ ID NO: 18521 - RNA, 26 nt, Human
cuuuguccuguugcugguuaacauuc

SEQ ID NO: 18522 - RNA, 23 nt, Human
caaacuauaugcaaaaaugagua

SEQ ID NO: 18523 - RNA, 20 nt, Human
ccugcucuguucccuggcau

SEQ ID NO: 18524 - RNA, 27 nt, Human
ccgagacucccaagcggcucugugcag

SEQ ID NO: 18525 - RNA, 27 nt, Human
ccagagucaacagcgagcgagcagccg

SEQ ID NO: 18526 - RNA, 24 nt, Human
ucuccacugcuuggauaugaaacu

SEQ ID NO: 18527 - RNA, 19 nt, Human
uugcccagucaauucagug

SEQ ID NO: 18528 - RNA, 26 nt, Human
ugccuaggagcuggcuggcagguguu

SEQ ID NO: 18529 - RNA, 19 nt, Human
ucguuuucuccugccugug

SEQ ID NO: 18530 - RNA, 22 nt, Human
aucugcuggagaaacugccauu

SEQ ID NO: 18531 - RNA, 22 nt, Human
ucccaccuuuguugugccucac

SEQ ID NO: 18532 - RNA, 22 nt, Human
ucucagaugggaugacugcggg

SEQ ID NO: 18533 - RNA, 22 nt, Human
agagccuuuuucacaauuccau

SEQ ID NO: 18534 - RNA, 21 nt, Human
acaccugugcuggcgcuggaa

SEQ ID NO: 18535 - RNA, 27 nt, Human
gacugauuuuaugagcagggguuugau

SEQ ID NO: 18536 - RNA, 16 nt, Human
uggcagcaggcggugg

SEQ ID NO: 18537 - RNA, 21 nt, Human
ucuccuguaccucuugagccu

SEQ ID NO: 18538 - RNA, 24 nt, Human
ggucuaaauuaugagguaccaaga

SEQ ID NO: 18539 - RNA, 27 nt, Human
caccacugcacuccagucuggcaacag

SEQ ID NO: 18540 - RNA, 27 nt, Human
aucagggcacuagcccaggaaugacuc

SEQ ID NO: 18541 - RNA, 21 nt, Human
cgagucuugcucuguuaccca

SEQ ID NO: 18542 - RNA, 25 nt, Human
cuccucucugggccuuggcuuggga

SEQ ID NO: 18543 - RNA, 20 nt, Human
aaaccugaaccaccuucugc

SEQ ID NO: 18544 - RNA, 27 nt, Human
ucacugcacuccagcagucaugggacc

SEQ ID NO: 18545 - RNA, 26 nt, Human
acacccagagggaguagaauacgcag

SEQ ID NO: 18546 - RNA, 25 nt, Human
augggaggaaaagcccaggagaagu

SEQ ID NO: 18547 - RNA, 23 nt, Human
agaggaagauuugucuacuugcu

SEQ ID NO: 18548 - RNA, 24 nt, Human
accuggucgugauguggcauucag

SEQ ID NO: 18549 - RNA, 24 nt, Human
gagguaagcuaauuaaugcaguga

SEQ ID NO: 18550 - RNA, 26 nt, Human
aaggagcagaggcucucccggcagga

SEQ ID NO: 18551 - RNA, 22 nt, Human
gacuucucccaucuaguggaaa

SEQ ID NO: 18552 - RNA, 19 nt, Human
cuggcuggccaacuggugg

SEQ ID NO: 18553 - RNA, 21 nt, Human
uucucauaagcaccuaaaacc

SEQ ID NO: 18554 - RNA, 26 nt, Human
ccugcaggggccucggccccucacau

SEQ ID NO: 18555 - RNA, 21 nt, Human
acaaaagccagccaccaccuu

SEQ ID NO: 18556 - RNA, 26 nt, Human
ugagacaagauuucgccauguugccc

SEQ ID NO: 18557 - RNA, 20 nt, Human
aucaccuucagaaucauguc

SEQ ID NO: 18558 - RNA, 22 nt, Human
gcacagccuccccauccuuccu

SEQ ID NO: 18559 - RNA, 22 nt, Human
cugggcuggaguagaggacucu

SEQ ID NO: 18560 - RNA, 22 nt, Human
augaaguaggacaguucuguug

SEQ ID NO: 18561 - RNA, 22 nt, Human
ugugagccgccaugucuggcca

SEQ ID NO: 18562 - RNA, 21 nt, Human
uuucacauguccucauucuca

SEQ ID NO: 18563 - RNA, 20 nt, Human
agcucacugaaccucugccu

SEQ ID NO: 18564 - RNA, 22 nt, Human
cagcucuucagagcaagcacug

SEQ ID NO: 18565 - RNA, 21 nt, Human
ccagcucuaccccgauuccag

SEQ ID NO: 18566 - RNA, 23 nt, Human
ugaaaccacauuuuuugguuuga

SEQ ID NO: 18567 - RNA, 28 nt, Human
gggggcuggccagucagggagggcuagg

SEQ ID NO: 18568 - RNA, 25 nt, Human
uuuucaucuuccuucuuuggaucua

SEQ ID NO: 18569 - RNA, 23 nt, Human
ugacauccuuuauaggcaccuua

SEQ ID NO: 18570 - RNA, 22 nt, Human
aauauugauaauaacaaaaaga

SEQ ID NO: 18571 - RNA, 22 nt, Human
uaaggggccgguucaagaagga

SEQ ID NO: 18572 - RNA, 23 nt, Human
uauaacggggcagagaacuuucu

SEQ ID NO: 18573 - RNA, 27 nt, Human
ccauuguacuccagcuugggcaacaga

SEQ ID NO: 18574 - RNA, 19 nt, Human
gcguauacuacacacucau

SEQ ID NO: 18575 - RNA, 19 nt, Human
agacugccacugccccuac

SEQ ID NO: 18576 - RNA, 24 nt, Human
uuggaguugggggcccagggagaa

SEQ ID NO: 18577 - RNA, 20 nt, Human
uaggacgauuucugucucca

SEQ ID NO: 18578 - RNA, 21 nt, Human
ggaagaaagugugagcaggga

SEQ ID NO: 18579 - RNA, 24 nt, Human
acugcugcuacugccccucuccga

SEQ ID NO: 18580 - RNA, 22 nt, Human
acuuggcuguaaucaguuaugc

SEQ ID NO: 18581 - RNA, 23 nt, Human
uguggaacuuaguuugaauuuga

SEQ ID NO: 18582 - RNA, 22 nt, Human
uuuucagagacucaacagucuc

SEQ ID NO: 18583 - RNA, 22 nt, Human
uaagcuugggcccaggaggcuu

SEQ ID NO: 18584 - RNA, 20 nt, Human
ccccacugcuccuaagaucc

SEQ ID NO: 18585 - RNA, 21 nt, Human
accagccugggcgcaguggug

SEQ ID NO: 18586 - RNA, 26 nt, Human
cgggaggcagaguuugccuuccuuuc

SEQ ID NO: 18587 - RNA, 22 nt, Human
uuccuguuuucaccaucuuucu

SEQ ID NO: 18588 - RNA, 27 nt, Human
ccccugccccuucuacacucuccuggg

SEQ ID NO: 18589 - RNA, 25 nt, Human
acuccacugcuuaccuacuuucuuc

SEQ ID NO: 18590 - RNA, 21 nt, Human
accuuccugguucaagcgauu

SEQ ID NO: 18591 - RNA, 27 nt, Human
gcaccgcagaagaacugaagacuguug

SEQ ID NO: 18592 - RNA, 25 nt, Human
ggcggcaaaggaaaaugcuuggaca

SEQ ID NO: 18593 - RNA, 21 nt, Human
cugggccagacgcaguggcuc

SEQ ID NO: 18594 - RNA, 22 nt, Human
uuuguuuuauucuucaguguuc

SEQ ID NO: 18595 - RNA, 22 nt, Human
cuggugugugugggagggaggg

SEQ ID NO: 18596 - RNA, 24 nt, Human
agaccaaugccuuccacugcuccu

SEQ ID NO: 18597 - RNA, 24 nt, Human
guaggggccucucccucacugcug

SEQ ID NO: 18598 - RNA, 21 nt, Human
aggccuuugugucuguguccu

SEQ ID NO: 18599 - RNA, 25 nt, Human
auacggacaguuuucacacauaucu

SEQ ID NO: 18600 - RNA, 23 nt, Human
gccuguaaucccagcuacucagg

SEQ ID NO: 18601 - RNA, 22 nt, Human
ugccaaauauucagcaucugua

SEQ ID NO: 18602 - RNA, 29 nt, Human
ugucuaccucagaauuaaaacuuuaagga

SEQ ID NO: 18603 - RNA, 23 nt, Human
cagaaggcuccacccugccgucc

SEQ ID NO: 18604 - RNA, 21 nt, Human
cacaaauguggagaaugcgga

SEQ ID NO: 18605 - RNA, 22 nt, Human
ccagauggucauccagacucag

SEQ ID NO: 18606 - RNA, 25 nt, Human
uagccucuuuauggucucugagaaa

SEQ ID NO: 18607 - RNA, 26 nt, Human
uucugccuucuccaccagggucgcuc

SEQ ID NO: 18608 - RNA, 23 nt, Human
uuguucuguguccuuuuaucucu

SEQ ID NO: 18609 - RNA, 18 nt, Human
aaacccacaacuaaaaau

SEQ ID NO: 18610 - RNA, 21 nt, Human
cagugccucuccuggucgugg

SEQ ID NO: 18611 - RNA, 20 nt, Human
gggggccaggcuggaggcag

SEQ ID NO: 18612 - RNA, 24 nt, Human
ccaucaucagcugcaucagccuuc

SEQ ID NO: 18613 - RNA, 20 nt, Human
gccacucaggcagccugugg

SEQ ID NO: 18614 - RNA, 20 nt, Human
ccggccccacaccgccagcu

SEQ ID NO: 18615 - RNA, 22 nt, Human
ggaggcaucauggaaagacugg

SEQ ID NO: 18616 - RNA, 24 nt, Human
ucuuccucucucgcccaaguucuc

SEQ ID NO: 18617 - RNA, 22 nt, Human
uuaaagguuuuaauaggaccuu

SEQ ID NO: 18618 - RNA, 22 nt, Human
auuuuucuuugcagcgaaacuc

SEQ ID NO: 18619 - RNA, 20 nt, Human
uugucccguaaauguuaaca

SEQ ID NO: 18620 - RNA, 23 nt, Human
ugcugaugcuuugucuucagaga

SEQ ID NO: 18621 - RNA, 19 nt, Human
uaaagaggaagugcacugg

SEQ ID NO: 18622 - RNA, 30 nt, Human
gggggcgcuucccuuccagcaucaccugca

SEQ ID NO: 18623 - RNA, 21 nt, Human
cuccacccuguccuguggucc

SEQ ID NO: 18624 - RNA, 18 nt, Human
acugagaaggaaaaagga

SEQ ID NO: 18625 - RNA, 26 nt, Human
gccuguaaucccagcuacucaggaga

SEQ ID NO: 18626 - RNA, 19 nt, Human
acaaguguuuuuaaaaaga

SEQ ID NO: 18627 - RNA, 26 nt, Human
cuggguguuugugugggauaaauacu

SEQ ID NO: 18628 - RNA, 17 nt, Human
uugcuugaauagcaaua

SEQ ID NO: 18629 - RNA, 22 nt, Human
ggagaacuuauagcugugcaaa

SEQ ID NO: 18630 - RNA, 22 nt, Human
cgccgccgccuccacagccugg

SEQ ID NO: 18631 - RNA, 25 nt, Human
gagcccuguuugggcucaggagaua

SEQ ID NO: 18632 - RNA, 27 nt, Human
uggaagagaagcaucaugagccaauuu

SEQ ID NO: 18633 - RNA, 22 nt, Human
ugcgauuacaggcaugagccac

SEQ ID NO: 18634 - RNA, 22 nt, Human
gaacuccugggcucaagccauc

SEQ ID NO: 18635 - RNA, 22 nt, Human
cccucauuagggcccuggauga

SEQ ID NO: 18636 - RNA, 21 nt, Human
cuccaccccuacccccaaccc

SEQ ID NO: 18637 - RNA, 25 nt, Human
aacucacagcccucccuuuuccugu

SEQ ID NO: 18638 - RNA, 26 nt, Human
gcccuuccgugguuaauuucuuccca

SEQ ID NO: 18639 - RNA, 22 nt, Human
ggagaaaccugaaagcagccca

SEQ ID NO: 18640 - RNA, 24 nt, Human
uuagcucauucaauaaagcacuuu

SEQ ID NO: 18641 - RNA, 23 nt, Human
gcagaggcccaggagucacugga

SEQ ID NO: 18642 - RNA, 21 nt, Human
ccacugagccaagaucgcucc

SEQ ID NO: 18643 - RNA, 21 nt, Human
agguaggcagagguugcagug

SEQ ID NO: 18644 - RNA, 21 nt, Human
cccaccccagcacagccaccu

SEQ ID NO: 18645 - RNA, 21 nt, Human
ugaugaccucaaagcacuuuc

SEQ ID NO: 18646 - RNA, 22 nt, Human
ugccacuccucccugcuugcau

SEQ ID NO: 18647 - RNA, 24 nt, Human
agccuuauguuucuccaauguuac

SEQ ID NO: 18648 - RNA, 23 nt, Human
gugccccggggguagggggcgca

SEQ ID NO: 18649 - RNA, 24 nt, Human
gcccagucugccuguuguggggcu

SEQ ID NO: 18650 - RNA, 22 nt, Human
agagggccacgccuccauucac

SEQ ID NO: 18651 - RNA, 22 nt, Human
gcucuauggcccuuccucauca

SEQ ID NO: 18652 - RNA, 23 nt, Human
aagucagagagacuagaugcuuu

SEQ ID NO: 18653 - RNA, 26 nt, Human
cagacaccuuccacucugaggucuca

SEQ ID NO: 18654 - RNA, 26 nt, Human
uggcacacaguaggugcucauuggcu

SEQ ID NO: 18655 - RNA, 24 nt, Human
cucacacacagcauucuguucucc

SEQ ID NO: 18656 - RNA, 18 nt, Human
uuuaauaacauuaccuua

SEQ ID NO: 18657 - RNA, 26 nt, Human
ggcacugcuggccuuucuccugcccg

SEQ ID NO: 18658 - RNA, 19 nt, Human
gccuuagccagggcucaga

SEQ ID NO: 18659 - RNA, 29 nt, Human
uaaaccuucaaaaguuaauagaagugaga

SEQ ID NO: 18660 - RNA, 22 nt, Human
gggaaagaguugcaguaaaguu

SEQ ID NO: 18661 - RNA, 26 nt, Human
aagggauaaaacuuagauggcagcuu

SEQ ID NO: 18662 - RNA, 22 nt, Human
aaaggcauccucaaaagaaaga

SEQ ID NO: 18663 - RNA, 22 nt, Human
ccauggccuggcagacagcccu

SEQ ID NO: 18664 - RNA, 22 nt, Human
gggcaagcccugcccacagaaa

SEQ ID NO: 18665 - RNA, 24 nt, Human
cugugauugugccacuguacucca

SEQ ID NO: 18666 - RNA, 16 nt, Human
cccagguagagcuggg

SEQ ID NO: 18667 - RNA, 21 nt, Human
cauaugagaggagcuuagaaa

SEQ ID NO: 18668 - RNA, 21 nt, Human
gucucuggcugcccucggccu

SEQ ID NO: 18669 - RNA, 28 nt, Human
gccacuagacucuucacuguuagcuuuu

SEQ ID NO: 18670 - RNA, 21 nt, Human
gcacuuccuguucauguacga

SEQ ID NO: 18671 - RNA, 22 nt, Human
ugaaggaugaagaaaucuacug

SEQ ID NO: 18672 - RNA, 26 nt, Human
gcuaaauuuuuguuggcuugcuugcu

SEQ ID NO: 18673 - RNA, 21 nt, Human
ucacaaaccgcuggguuuuug

SEQ ID NO: 18674 - RNA, 18 nt, Human
uucuacaacuucaaugga

SEQ ID NO: 18675 - RNA, 21 nt, Human
uucucccacacugcuaggugg

SEQ ID NO: 18676 - RNA, 20 nt, Human
ucuuauuaugcuccaauaua

SEQ ID NO: 18677 - RNA, 18 nt, Human
augcauuuugcugccuuu

SEQ ID NO: 18678 - RNA, 22 nt, Human
aauuuucagcaccaaagcuuca

SEQ ID NO: 18679 - RNA, 22 nt, Human
cgcucauucccugaauggcagu

SEQ ID NO: 18680 - RNA, 20 nt, Human
ccuguucugcuguugugucc

SEQ ID NO: 18681 - RNA, 21 nt, Human
gcccccacugugaaggggcug

SEQ ID NO: 18682 - RNA, 21 nt, Human
ucugagcucauccuuugccag

SEQ ID NO: 18683 - RNA, 22 nt, Human
ggacacugcgggacagagggug

SEQ ID NO: 18684 - RNA, 18 nt, Human
aggcuggaguggaguggc

SEQ ID NO: 18685 - RNA, 30 nt, Human
gacauguggguggagaagggaggguggcca

SEQ ID NO: 18686 - RNA, 22 nt, Human
auaauuggaacgcacacugccg

SEQ ID NO: 18687 - RNA, 27 nt, Human
gucaacugacaguccaaaggcuccaca

SEQ ID NO: 18688 - RNA, 27 nt, Human
agggaaagcagggcagccgggaccugc

SEQ ID NO: 18689 - RNA, 27 nt, Human
ucuccaauuucacaucuugaaauagag

SEQ ID NO: 18690 - RNA, 28 nt, Human
ccaauuuuuacauaggaggaaacggcuc

SEQ ID NO: 18691 - RNA, 23 nt, Human
gccuacgcuucucccugaaguuu

SEQ ID NO: 18692 - RNA, 24 nt, Human
auauauugaacaccuucaugcuua

SEQ ID NO: 18693 - RNA, 23 nt, Human
ugaccagccgugagcauguuugg

SEQ ID NO: 18694 - RNA, 21 nt, Human
ccccgcguagccgcugccucc

SEQ ID NO: 18695 - RNA, 21 nt, Human
gaggcaauuugccugccuugu

SEQ ID NO: 18696 - RNA, 25 nt, Human
caggaauggcuuaaggugaaaucgu

SEQ ID NO: 18697 - RNA, 20 nt, Human
cagauguuuuuaaaguuucu

SEQ ID NO: 18698 - RNA, 19 nt, Human
cccacgcccccuccuuguc

SEQ ID NO: 18699 - RNA, 21 nt, Human
ugacaugcauuuuaacuuuuu

SEQ ID NO: 18700 - RNA, 21 nt, Human
aguuaguuuuuaaucucucca

SEQ ID NO: 18701 - RNA, 26 nt, Human
ccagccuggcgacagagggagacucc

SEQ ID NO: 18702 - RNA, 27 nt, Human
gcccuccacccccaccucaagugccuu

SEQ ID NO: 18703 - RNA, 20 nt, Human
gaagagggagaaggagaggc

SEQ ID NO: 18704 - RNA, 24 nt, Human
aaaacacuugcaaacauuuuauuc

SEQ ID NO: 18705 - RNA, 22 nt, Human
uguggugaucccauaaaaggcc

SEQ ID NO: 18706 - RNA, 26 nt, Human
gaucugaucagacuguauuaaaaaug

SEQ ID NO: 18707 - RNA, 21 nt, Human
ccucugccaguccuggagacu

SEQ ID NO: 18708 - RNA, 21 nt, Human
accaacaagaaccacuccuuc

SEQ ID NO: 18709 - RNA, 26 nt, Human
ugguggguucugacauuauucuucca

SEQ ID NO: 18710 - RNA, 24 nt, Human
uccuugggggucugagaugaggcc

SEQ ID NO: 18711 - RNA, 21 nt, Human
gcuggccuguggcacagcccu

SEQ ID NO: 18712 - RNA, 21 nt, Human
ugucccaggcuguggugccac

SEQ ID NO: 18713 - RNA, 23 nt, Human
ccgacauggugucgccuccuccc

SEQ ID NO: 18714 - RNA, 27 nt, Human
aauaagaaggaaaaauuccaggaggga

SEQ ID NO: 18715 - RNA, 22 nt, Human
acucacugucaaugauuauuuu

SEQ ID NO: 18716 - RNA, 25 nt, Human
uggaaagaggguuuaagaugcuagg

SEQ ID NO: 18717 - RNA, 26 nt, Human
gcuggcugggagcccuuuuguuuuag

SEQ ID NO: 18718 - RNA, 22 nt, Human
cgguagucccuguuuuugcagu

SEQ ID NO: 18719 - RNA, 26 nt, Human
cugcuucucuggggcugggcucuacu

SEQ ID NO: 18720 - RNA, 16 nt, Human
ccuccucuguguugcc

SEQ ID NO: 18721 - RNA, 23 nt, Human
uguauauguuuuuauuuucaaau

SEQ ID NO: 18722 - RNA, 27 nt, Human
cacuacacuccagccugggagacagag

SEQ ID NO: 18723 - RNA, 21 nt, Human
accuguaauccuugcauuuug

SEQ ID NO: 18724 - RNA, 22 nt, Human
uugaccaggcuggagugcagug

SEQ ID NO: 18725 - RNA, 19 nt, Human
cccuuuaccccuccagaga

SEQ ID NO: 18726 - RNA, 21 nt, Human
ucacccaggaggauggcaaag

SEQ ID NO: 18727 - RNA, 21 nt, Human
aaaccacuggugucugcucag

SEQ ID NO: 18728 - RNA, 24 nt, Human
gagaaaccuacauuuggacaauga

SEQ ID NO: 18729 - RNA, 20 nt, Human
ugucuucucccuuguuugag

SEQ ID NO: 18730 - RNA, 21 nt, Human
acagaguucagucucaucuug

SEQ ID NO: 18731 - RNA, 19 nt, Human
ugcuuuguguuuucugcuc

SEQ ID NO: 18732 - RNA, 28 nt, Human
auccugaagccagcuugcaccuccaguu

SEQ ID NO: 18733 - RNA, 27 nt, Human
gaugcagaggaauucaucuacugucug

SEQ ID NO: 18734 - RNA, 22 nt, Human
ccugaguagcugggauuacagg

SEQ ID NO: 18735 - RNA, 22 nt, Human
gagggagaagaguggucucagc

SEQ ID NO: 18736 - RNA, 23 nt, Human
gugccacauuuauuuuuauaucu

SEQ ID NO: 18737 - RNA, 18 nt, Human
aauaucucccucucucca

SEQ ID NO: 18738 - RNA, 27 nt, Human
uguuuuuaaaaacuugcuucaugcccu

SEQ ID NO: 18739 - RNA, 22 nt, Human
gucacccagacuggaaugcagu

SEQ ID NO: 18740 - RNA, 25 nt, Human
uuuuccuuuucucuucaucuuuggc

SEQ ID NO: 18741 - RNA, 23 nt, Human
aaagucaagggaaaguucuccug

SEQ ID NO: 18742 - RNA, 24 nt, Human
accaggauccagccucacuucuag

SEQ ID NO: 18743 - RNA, 29 nt, Human
cugccugacaccugggacaggcugggcag

SEQ ID NO: 18744 - RNA, 26 nt, Human
uuacuuguuucuguccccgggagccu

SEQ ID NO: 18745 - RNA, 19 nt, Human
gauuacaggcgugcgccac

SEQ ID NO: 18746 - RNA, 21 nt, Human
cccacuuguaagccagcgcuu

SEQ ID NO: 18747 - RNA, 25 nt, Human
aacacagccauuauuuuauugucua

SEQ ID NO: 18748 - RNA, 21 nt, Human
ccaugguccagccaccaggcu

SEQ ID NO: 18749 - RNA, 18 nt, Human
ugggauguccuacuauca

SEQ ID NO: 18750 - RNA, 21 nt, Human
uuuggacauaacuaagccagg

SEQ ID NO: 18751 - RNA, 19 nt, Human
acagacagagaaggcugca

SEQ ID NO: 18752 - RNA, 28 nt, Human
ccggggcguuucuuugccgauuuuugaa

SEQ ID NO: 18753 - RNA, 25 nt, Human
gggucggccccuuccagggccagga

SEQ ID NO: 18754 - RNA, 27 nt, Human
ggcucagacaacaaaagcggaagaugc

SEQ ID NO: 18755 - RNA, 20 nt, Human
accacugaauucauguaaua

SEQ ID NO: 18756 - RNA, 20 nt, Human
aagcuauucaaguauuccua

SEQ ID NO: 18757 - RNA, 26 nt, Human
uaccuugccuaguguaucuuaucccu

SEQ ID NO: 18758 - RNA, 23 nt, Human
agggcugcugccuuccuguccuc

SEQ ID NO: 18759 - RNA, 22 nt, Human
aguggcaagaucauagcucauu

SEQ ID NO: 18760 - RNA, 22 nt, Human
auccaggcuggagugcaguggc

SEQ ID NO: 18761 - RNA, 22 nt, Human
gaugcagccacugucucuuguc

SEQ ID NO: 18762 - RNA, 21 nt, Human
ccagaggacaagccacaaaaa

SEQ ID NO: 18763 - RNA, 22 nt, Human
guucauguuccgcgugccugaa

SEQ ID NO: 18764 - RNA, 24 nt, Human
ugucucccaggcuggaggucagug

SEQ ID NO: 18765 - RNA, 27 nt, Human
ucuucuuucuuucuuaagcccuuugcu

SEQ ID NO: 18766 - RNA, 28 nt, Human
ccagacaacacauuuuuuaaaaagacuc

SEQ ID NO: 18767 - RNA, 25 nt, Human
guccaggcuggagugcaauggcacg

SEQ ID NO: 18768 - RNA, 20 nt, Human
cagaggagaagagacaugua

SEQ ID NO: 18769 - RNA, 22 nt, Human
gugguggcugacuucgggcugg

SEQ ID NO: 18770 - RNA, 22 nt, Human
uucagccagcaguaaugcuagg

SEQ ID NO: 18771 - RNA, 22 nt, Human
uuccuguuuucuucugauugcu

SEQ ID NO: 18772 - RNA, 27 nt, Human
caggcagccucugagcaagcacugugu

SEQ ID NO: 18773 - RNA, 21 nt, Human
gaccgaggaacaacuuggaag

SEQ ID NO: 18774 - RNA, 22 nt, Human
ugugagccgcugcggccgacca

SEQ ID NO: 18775 - RNA, 20 nt, Human
ggaagcggagguugugguga

SEQ ID NO: 18776 - RNA, 21 nt, Human
gcuuguuuccaccuccugggc

SEQ ID NO: 18777 - RNA, 23 nt, Human
ucugagguucggcucacacugag

SEQ ID NO: 18778 - RNA, 27 nt, Human
gagggcuuuggacaggaguaccgaggc

SEQ ID NO: 18779 - RNA, 27 nt, Human
ugcugcauuuuacccucaucaugcacc

SEQ ID NO: 18780 - RNA, 21 nt, Human
cugccucucugugcccagcuc

SEQ ID NO: 18781 - RNA, 19 nt, Human
cagugugcaaauggcagcu

SEQ ID NO: 18782 - RNA, 23 nt, Human
ugacuucaucuauuuuuuauuug

SEQ ID NO: 18783 - RNA, 19 nt, Human
uaguuuggggaggggaagc

SEQ ID NO: 18784 - RNA, 22 nt, Human
agcuuccugacuagcugggacu

SEQ ID NO: 18785 - RNA, 21 nt, Human
ccaagcagaccuucccucuca

SEQ ID NO: 18786 - RNA, 21 nt, Human
uuucaauaaaagagagaagca

SEQ ID NO: 18787 - RNA, 21 nt, Human
gacggugaugaggaaggacuu

SEQ ID NO: 18788 - RNA, 22 nt, Human
uccuuguaauuuugauuacaaa

SEQ ID NO: 18789 - RNA, 21 nt, Human
agagacacagagugaugugag

SEQ ID NO: 18790 - RNA, 21 nt, Human
caccagccacacaaggguccu

SEQ ID NO: 18791 - RNA, 27 nt, Human
gcgcgucuccagccucugcacacacau

SEQ ID NO: 18792 - RNA, 24 nt, Human
uccucauucucacccauuuggcua

SEQ ID NO: 18793 - RNA, 19 nt, Human
cucuggagauagauggaga

SEQ ID NO: 18794 - RNA, 19 nt, Human
cccucaugaacacagggau

SEQ ID NO: 18795 - RNA, 20 nt, Human
ugccuugggaucagagcaga

SEQ ID NO: 18796 - RNA, 26 nt, Human
cucuuggaagcgaaucaugcaugcaa

SEQ ID NO: 18797 - RNA, 24 nt, Human
cccauuuuacacacagugaaacug

SEQ ID NO: 18798 - RNA, 20 nt, Human
cugaggcuuaggccucucug

SEQ ID NO: 18799 - RNA, 20 nt, Human
aagcuaagugagagagccag

SEQ ID NO: 18800 - RNA, 23 nt, Human
agaggugcgccacugggagccac

SEQ ID NO: 18801 - RNA, 27 nt, Human
ucuuuuggcccucuucuuucugaggcc

SEQ ID NO: 18802 - RNA, 22 nt, Human
ccucccaaaggcugucauuuca

SEQ ID NO: 18803 - RNA, 20 nt, Human
cucccaggcugaagugcagu

SEQ ID NO: 18804 - RNA, 27 nt, Human
cccugcaccugcccugcccggccucau

SEQ ID NO: 18805 - RNA, 27 nt, Human
uuguccagggucaauuugaguguaaag

SEQ ID NO: 18806 - RNA, 20 nt, Human
uguguuucugcaagugccau

SEQ ID NO: 18807 - RNA, 21 nt, Human
ggcccggccccgggagcggag

SEQ ID NO: 18808 - RNA, 17 nt, Human
aucacaccucuuaguuu

SEQ ID NO: 18809 - RNA, 21 nt, Human
ugaccucaggccagugugccg

SEQ ID NO: 18810 - RNA, 27 nt, Human
cccaucauuaccugugaacugcagugg

SEQ ID NO: 18811 - RNA, 22 nt, Human
cugcagccucagcguccugggc

SEQ ID NO: 18812 - RNA, 25 nt, Human
ucagaggaggcucauuagcuggcua

SEQ ID NO: 18813 - RNA, 22 nt, Human
auauauuuucauugaaaugcac

SEQ ID NO: 18814 - RNA, 18 nt, Human
ccucacugcgccagccuc

SEQ ID NO: 18815 - RNA, 27 nt, Human
ccagcacuggugucucugugcuuccuu

SEQ ID NO: 18816 - RNA, 23 nt, Human
caucauaaccaccccagccuggg

SEQ ID NO: 18817 - RNA, 26 nt, Human
uaagcuuuugcuguagauugccuagu

SEQ ID NO: 18818 - RNA, 23 nt, Human
agucugaacaguucagcuacagu

SEQ ID NO: 18819 - RNA, 20 nt, Human
uccauccuggcggcccagaa

SEQ ID NO: 18820 - RNA, 26 nt, Human
ucggaaucccuggaaaagccgggagg

SEQ ID NO: 18821 - RNA, 25 nt, Human
ccagcaauguggaaguuccaucgau

SEQ ID NO: 18822 - RNA, 21 nt, Human
aaaaagcuuuuggcagugagu

SEQ ID NO: 18823 - RNA, 21 nt, Human
caggagcaauuugcacaugua

SEQ ID NO: 18824 - RNA, 20 nt, Human
ugucaguguuugggaaauua

SEQ ID NO: 18825 - RNA, 22 nt, Human
uccucugcucuugaucuguguu

SEQ ID NO: 18826 - RNA, 25 nt, Human
gcacagccccauugacacaaacccu

SEQ ID NO: 18827 - RNA, 19 nt, Human
agacacugugcagagggug

SEQ ID NO: 18828 - RNA, 22 nt, Human
gcugccucacucccuaccugag

SEQ ID NO: 18829 - RNA, 20 nt, Human
uucagaaaaugaaaaccaug

SEQ ID NO: 18830 - RNA, 20 nt, Human
uuccuccaaaacaaacgaca

SEQ ID NO: 18831 - RNA, 23 nt, Human
ggauggcccaaaguccagggucu

SEQ ID NO: 18832 - RNA, 22 nt, Human
cgguggccagagccgagggucc

SEQ ID NO: 18833 - RNA, 28 nt, Human
gcuuuauggccuuuccaucauaguugcc

SEQ ID NO: 18834 - RNA, 22 nt, Human
cugcagccucauacuccugggc

SEQ ID NO: 18835 - RNA, 22 nt, Human
cccugcagguuccuucuagcug

SEQ ID NO: 18836 - RNA, 27 nt, Human
ugcuguuucuagaaucauaaccuggac

SEQ ID NO: 18837 - RNA, 19 nt, Human
aggccugaaguucugugau

SEQ ID NO: 18838 - RNA, 21 nt, Human
ugucacugcugacauaacucc

SEQ ID NO: 18839 - RNA, 19 nt, Human
cuuaaggguaaaaaguaca

SEQ ID NO: 18840 - RNA, 23 nt, Human
ugggaggucaggugggguggaug

SEQ ID NO: 18841 - RNA, 27 nt, Human
gggggcccaucccugcccaccuccugg

SEQ ID NO: 18842 - RNA, 21 nt, Human
gcaggcaauuagcccagaagg

SEQ ID NO: 18843 - RNA, 21 nt, Human
ggcgacgaccugcaacccgcu

SEQ ID NO: 18844 - RNA, 16 nt, Human
cuucugguccuagcca

SEQ ID NO: 18845 - RNA, 24 nt, Human
uuacaugaauugcauuuuacuuua

SEQ ID NO: 18846 - RNA, 27 nt, Human
gggcucgggggaucccggacacccucu

SEQ ID NO: 18847 - RNA, 24 nt, Human
cuagaaacacacauuucuuugaau

SEQ ID NO: 18848 - RNA, 22 nt, Human
cucggggccucggagcaaccac

SEQ ID NO: 18849 - RNA, 23 nt, Human
cagcuccuucccagcccagccuc

SEQ ID NO: 18850 - RNA, 19 nt, Human
ccaggcuggagugcagugg

SEQ ID NO: 18851 - RNA, 23 nt, Human
gagucuucacaccuguugacuca

SEQ ID NO: 18852 - RNA, 21 nt, Human
aucagccuggccaacaugaug

SEQ ID NO: 18853 - RNA, 25 nt, Human
gguuacaucuuggaaaaaaugcaga

SEQ ID NO: 18854 - RNA, 22 nt, Human
aagggaggguggagggugaggc

SEQ ID NO: 18855 - RNA, 29 nt, Human
ggggaugagaggggacucguggggcaagc

SEQ ID NO: 18856 - RNA, 20 nt, Human
gacuccacucaggugcacac

SEQ ID NO: 18857 - RNA, 23 nt, Human
aucacccagacuggcgugcagug

SEQ ID NO: 18858 - RNA, 22 nt, Human
ugcaaccucugccucccagguu

SEQ ID NO: 18859 - RNA, 22 nt, Human
uacaaccucugccucccggguu

SEQ ID NO: 18860 - RNA, 26 nt, Human
gaugcagaugucuccagcccucaccu

SEQ ID NO: 18861 - RNA, 22 nt, Human
agggcuuccgcagagcacuuuu

SEQ ID NO: 18862 - RNA, 26 nt, Human
aaucauuucugcaucagcugcugaaa

SEQ ID NO: 18863 - RNA, 22 nt, Human
gccuuguaaucccagcacuuug

SEQ ID NO: 18864 - RNA, 23 nt, Human
uugcuuagcugucaacaaaaaga

SEQ ID NO: 18865 - RNA, 19 nt, Human
uucucugaccugagucuuu

SEQ ID NO: 18866 - RNA, 22 nt, Human
ucccaaaacucaauucugguuu

SEQ ID NO: 18867 - RNA, 24 nt, Human
acaucacaaaacugagcacucuuc

SEQ ID NO: 18868 - RNA, 25 nt, Human
gggcgaagugcaguggcucaugccu

SEQ ID NO: 18869 - RNA, 24 nt, Human
aggcagugucuggaugaugcugug

SEQ ID NO: 18870 - RNA, 23 nt, Human
ggccuccucuccucuccuaaccu

SEQ ID NO: 18871 - RNA, 27 nt, Human
ugggaaccauggugucaauacauauca

SEQ ID NO: 18872 - RNA, 27 nt, Human
gcaauggauaaacagcucugacuuuca

SEQ ID NO: 18873 - RNA, 23 nt, Human
ggcuaggaggcucgaccaccuca

SEQ ID NO: 18874 - RNA, 19 nt, Human
uucagaucuuccuuccucc

SEQ ID NO: 18875 - RNA, 27 nt, Human
auacauacuguccaauuuucauuaaau

SEQ ID NO: 18876 - RNA, 16 nt, Human
caggcagcugcugugg

SEQ ID NO: 18877 - RNA, 26 nt, Human
gaggaggcaagguucgcagagaacag

SEQ ID NO: 18878 - RNA, 25 nt, Human
gaggacagcugcagagguggcagug

SEQ ID NO: 18879 - RNA, 26 nt, Human
uguuacaagcaaaucaacauaguugc

SEQ ID NO: 18880 - RNA, 22 nt, Human
ccuaucucugaguuuugggacc

SEQ ID NO: 18881 - RNA, 19 nt, Human
acucacugcagugcucuuc

SEQ ID NO: 18882 - RNA, 27 nt, Human
gaccagcccagccugcauacuugccac

SEQ ID NO: 18883 - RNA, 21 nt, Human
agaugccacugaaaugcugaa

SEQ ID NO: 18884 - RNA, 17 nt, Human
cauguuacacuggcugg

SEQ ID NO: 18885 - RNA, 21 nt, Human
agaaaugugguauguggagaa

SEQ ID NO: 18886 - RNA, 22 nt, Human
gaccaagccucccuguguagca

SEQ ID NO: 18887 - RNA, 22 nt, Human
auucucucccccaccccgaauu

SEQ ID NO: 18888 - RNA, 23 nt, Human
agaggaagagccgcacacuuuua

SEQ ID NO: 18889 - RNA, 20 nt, Human
cuucccauuuccagccuuaa

SEQ ID NO: 18890 - RNA, 22 nt, Human
cccaguagcugggaccacaggu

SEQ ID NO: 18891 - RNA, 26 nt, Human
ccccaggccucugccugcuuucucag

SEQ ID NO: 18892 - RNA, 27 nt, Human
ccagugcugggacaaagauggggaagg

SEQ ID NO: 18893 - RNA, 20 nt, Human
gaaagugccugaaagaccuu

SEQ ID NO: 18894 - RNA, 21 nt, Human
gauggugaugaacucuuuaga

SEQ ID NO: 18895 - RNA, 31 nt, Human
cgcccagcugcaccugccagccuggcuucug

SEQ ID NO: 18896 - RNA, 23 nt, Human
gccguuccuucccccucuaggcc

SEQ ID NO: 18897 - RNA, 31 nt, Human
caacagugucuguguugcccgagcugcugag

SEQ ID NO: 18898 - RNA, 22 nt, Human
gccccuccucccggcuggacug

SEQ ID NO: 18899 - RNA, 26 nt, Human
gagggaggaucacuugaacucaggaa

SEQ ID NO: 18900 - RNA, 17 nt, Human
uugacaucucuugccuu

SEQ ID NO: 18901 - RNA, 20 nt, Human
gcuguucuucuguucugcag

SEQ ID NO: 18902 - RNA, 26 nt, Human
ucuggcuucaugcaauuguuacuuca

SEQ ID NO: 18903 - RNA, 25 nt, Human
cucaaagcaauaucagguaaaccaa

SEQ ID NO: 18904 - RNA, 18 nt, Human
cuucugccuuagucucag

SEQ ID NO: 18905 - RNA, 22 nt, Human
uaucaaaaaacaaaugagcucu

SEQ ID NO: 18906 - RNA, 27 nt, Human
ucuccaccucccguccuccccaucauu

SEQ ID NO: 18907 - RNA, 24 nt, Human
cccuucccuucuuuauaaugaaaa

SEQ ID NO: 18908 - RNA, 24 nt, Human
aggaaaucaaccaaugcugcggaa

SEQ ID NO: 18909 - RNA, 27 nt, Human
aaauagcugggauuacaggugcaugcc

SEQ ID NO: 18910 - RNA, 29 nt, Human
ucucuguucugcugacaggcagagaguca

SEQ ID NO: 18911 - RNA, 22 nt, Human
caggcuggagugcagugaugca

SEQ ID NO: 18912 - RNA, 22 nt, Human
cgggcuggagugcaguggugca

SEQ ID NO: 18913 - RNA, 20 nt, Human
ggguuaccuuugcaccagcu

SEQ ID NO: 18914 - RNA, 25 nt, Human
gaagacuucugguauuaucucucua

SEQ ID NO: 18915 - RNA, 22 nt, Human
ccaacaccaccaccaccaccgc

SEQ ID NO: 18916 - RNA, 30 nt, Human
ggggcugcuucucaggaggccaggcccuuc

SEQ ID NO: 18917 - RNA, 19 nt, Human
cagccucuuuuucuucugc

SEQ ID NO: 18918 - RNA, 22 nt, Human
ccagagcagggggaccuaggcu

SEQ ID NO: 18919 - RNA, 25 nt, Human
uuugcagcccauacggucucuguca

SEQ ID NO: 18920 - RNA, 20 nt, Human
ggggagccaggcgagggggg

SEQ ID NO: 18921 - RNA, 20 nt, Human
cuugguuggcccccuuguca

SEQ ID NO: 18922 - RNA, 27 nt, Human
gccuuucugguuccaucuccuugggug

SEQ ID NO: 18923 - RNA, 22 nt, Human
uacuucucaacagacaugauaa

SEQ ID NO: 18924 - RNA, 20 nt, Human
uuucuccuugacacagacag

SEQ ID NO: 18925 - RNA, 20 nt, Human
aaugucccaccuuggagcuc

SEQ ID NO: 18926 - RNA, 20 nt, Human
uggagauucugaagugccuu

SEQ ID NO: 18927 - RNA, 26 nt, Human
uaggcuaggugcaguggcuuguuccu

SEQ ID NO: 18928 - RNA, 23 nt, Human
guuuuacugcauuuucacaacau

SEQ ID NO: 18929 - RNA, 32 nt, Human
gauucugccuuucugcuggagggaaguguuuu

SEQ ID NO: 18930 - RNA, 26 nt, Human
aaucagcucuggaggugauuccacau

SEQ ID NO: 18931 - RNA, 20 nt, Human
aggugcccgccaccacgccc

SEQ ID NO: 18932 - RNA, 27 nt, Human
acagugauuccugccucacaggugaag

SEQ ID NO: 18933 - RNA, 22 nt, Human
ggcaccucugggagcugggaug

SEQ ID NO: 18934 - RNA, 26 nt, Human
aaauugagcaguucaugacccaggau

SEQ ID NO: 18935 - RNA, 21 nt, Human
uuuuggggggcuggagugggu

SEQ ID NO: 18936 - RNA, 21 nt, Human
cagugguaauaaauggugcua

SEQ ID NO: 18937 - RNA, 22 nt, Human
uguuuccuuugguuuucugcca

SEQ ID NO: 18938 - RNA, 31 nt, Human
cccuccgcgcucuccgcuuguggauaacuag

SEQ ID NO: 18939 - RNA, 25 nt, Human
cauccuggcccgcagagccugccgc

SEQ ID NO: 18940 - RNA, 20 nt, Human
ucuguggcuguauguggguu

SEQ ID NO: 18941 - RNA, 22 nt, Human
ucacccaggcugaagugcagug

SEQ ID NO: 18942 - RNA, 22 nt, Human
aaaaccugcccuguuguauaua

SEQ ID NO: 18943 - RNA, 22 nt, Human
cccccauccucucccacacaca

SEQ ID NO: 18944 - RNA, 21 nt, Human
caggcuggccagcauggugaa

SEQ ID NO: 18945 - RNA, 27 nt, Human
uaauuaguucaacugauccauuccaca

SEQ ID NO: 18946 - RNA, 23 nt, Human
cugacucuuccccaggaagggaa

SEQ ID NO: 18947 - RNA, 21 nt, Human
aucuccuuagaaaagccauua

SEQ ID NO: 18948 - RNA, 21 nt, Human
ugagacuauauuuaugaucag

SEQ ID NO: 18949 - RNA, 27 nt, Human
cggguccacagcugagguugccucuga

SEQ ID NO: 18950 - RNA, 20 nt, Human
gcgagguucugagaauugcg

SEQ ID NO: 18951 - RNA, 22 nt, Human
cuuugccuagguugccaaaaag

SEQ ID NO: 18952 - RNA, 26 nt, Human
ggagcgggcggcagacccggagcagc

SEQ ID NO: 18953 - RNA, 26 nt, Human
cccacugcacuugccaccugagucac

SEQ ID NO: 18954 - RNA, 22 nt, Human
ggcagcuguauucuggagucug

SEQ ID NO: 18955 - RNA, 19 nt, Human
aaagugcaucacagccaga

SEQ ID NO: 18956 - RNA, 23 nt, Human
aucuaccugccaggccucaggcc

SEQ ID NO: 18957 - RNA, 32 nt, Human
cugccucucugcaaaguugagcacuacaggac

SEQ ID NO: 18958 - RNA, 27 nt, Human
cuccaaaacauuucuaagacuacuaag

SEQ ID NO: 18959 - RNA, 23 nt, Human
gugugcagccaccauguucagcu

SEQ ID NO: 18960 - RNA, 20 nt, Human
gagaugaaaguuaacauagu

SEQ ID NO: 18961 - RNA, 22 nt, Human
cccgccacccaccuccuccucc

SEQ ID NO: 18962 - RNA, 21 nt, Human
aaggcacagagucggucuccc

SEQ ID NO: 18963 - RNA, 24 nt, Human
auacaguguaauaucaucagucca

SEQ ID NO: 18964 - RNA, 24 nt, Human
uaguaguguuugguauguuuuaug

SEQ ID NO: 18965 - RNA, 22 nt, Human
uccugguaugucucaccaggaa

SEQ ID NO: 18966 - RNA, 21 nt, Human
gccauuguacuccagcuuggg

SEQ ID NO: 18967 - RNA, 26 nt, Human
gggugaggagauggggacaggugaau

SEQ ID NO: 18968 - RNA, 21 nt, Human
acccccaggcucacagcagug

SEQ ID NO: 18969 - RNA, 22 nt, Human
uugcccagacuggagagcagug

SEQ ID NO: 18970 - RNA, 21 nt, Human
ggagggagcgcugggagcgag

SEQ ID NO: 18971 - RNA, 21 nt, Human
cuucaggcugggcacgguggc

SEQ ID NO: 18972 - RNA, 21 nt, Human
agaucucaugacugagaugug

SEQ ID NO: 18973 - RNA, 22 nt, Human
ugcauuucucuucucagcucuu

SEQ ID NO: 18974 - RNA, 22 nt, Human
caggagccacugggacagggug

SEQ ID NO: 18975 - RNA, 26 nt, Human
ugggcugcucugagacauggaggaag

SEQ ID NO: 18976 - RNA, 22 nt, Human
caggacuuaacggcuccaggau

SEQ ID NO: 18977 - RNA, 22 nt, Human
caaacuccugggcuaaagcgau

SEQ ID NO: 18978 - RNA, 30 nt, Human
uggugauuucuacgcaacacuaauuaaagc

SEQ ID NO: 18979 - RNA, 23 nt, Human
cuuaaguucucacaucacacuca

SEQ ID NO: 18980 - RNA, 19 nt, Human
acagcuggcccaggaaagg

SEQ ID NO: 18981 - RNA, 26 nt, Human
gcaugcuggggaggugaaugccacau

SEQ ID NO: 18982 - RNA, 27 nt, Human
cguugguuuguuauguagugugcuuuu

SEQ ID NO: 18983 - RNA, 21 nt, Human
accugcucucuuuccugggcc

SEQ ID NO: 18984 - RNA, 32 nt, Human
aaucgcuugcuuguugaaaauauuucucuagu

SEQ ID NO: 18985 - RNA, 18 nt, Human
caaggaggggagagaagu

SEQ ID NO: 18986 - RNA, 20 nt, Human
cuucugaugagacugcagcc

SEQ ID NO: 18987 - RNA, 23 nt, Human
gauucauucucuuucauugcucu

SEQ ID NO: 18988 - RNA, 22 nt, Human
aggcuaaggcaggagaaucacu

SEQ ID NO: 18989 - RNA, 24 nt, Human
uuacagcccagugcucaucccagc

SEQ ID NO: 18990 - RNA, 19 nt, Human
uuacauccuuuacauucag

SEQ ID NO: 18991 - RNA, 22 nt, Human
cucagccucccaaguagccggg

SEQ ID NO: 18992 - RNA, 23 nt, Human
uggccugagaaaucccuauguac

SEQ ID NO: 18993 - RNA, 21 nt, Human
uuuauagcacuuuagcacagg

SEQ ID NO: 18994 - RNA, 21 nt, Human
ccagccccaacacccgacggg

SEQ ID NO: 18995 - RNA, 22 nt, Human
ucugaaaagugaaagauuucua

SEQ ID NO: 18996 - RNA, 23 nt, Human
guccugcugagaaauugcacuga

SEQ ID NO: 18997 - RNA, 26 nt, Human
ucuuucucccucaacugaaggggugc

SEQ ID NO: 18998 - RNA, 27 nt, Human
uuccauuccagccuaacauccaaugca

SEQ ID NO: 18999 - RNA, 22 nt, Human
accagccugaccaacaugguga

SEQ ID NO: 19000 - RNA, 22 nt, Human
accagccuggccaacauaguga

SEQ ID NO: 19001 - RNA, 27 nt, Human
gauggcugcugcuccuuguacccaccc

SEQ ID NO: 19002 - RNA, 25 nt, Human
uagacacaucuauaauuuuacacac

SEQ ID NO: 19003 - RNA, 26 nt, Human
agacagucauuuuaaaaugguggcug

SEQ ID NO: 19004 - RNA, 20 nt, Human
cuugccagcuggggcugggg

SEQ ID NO: 19005 - RNA, 22 nt, Human
uaaacucagguguguccaaguc

SEQ ID NO: 19006 - RNA, 22 nt, Human
ugggcuaacaggcugacacuuc

SEQ ID NO: 19007 - RNA, 20 nt, Human
cuaucgccucucucucccau

SEQ ID NO: 19008 - RNA, 21 nt, Human
ucugcccuccagauccacggu

SEQ ID NO: 19009 - RNA, 21 nt, Human
uguuuuuaaaauaaguaccua

SEQ ID NO: 19010 - RNA, 23 nt, Human
aucuauuguuggaagucuuuggu

SEQ ID NO: 19011 - RNA, 24 nt, Human
acaccccagccucugacuugcugu

SEQ ID NO: 19012 - RNA, 22 nt, Human
auacacccagacagacccagaa

SEQ ID NO: 19013 - RNA, 23 nt, Human
cccacagggcaccagugccaccc

SEQ ID NO: 19014 - RNA, 22 nt, Human
gggagcuggaggucggcgcuuc

SEQ ID NO: 19015 - RNA, 22 nt, Human
uugcuuccuguugccagcauga

SEQ ID NO: 19016 - RNA, 25 nt, Human
gugcuguccgggugccagggcugca

SEQ ID NO: 19017 - RNA, 20 nt, Human
uuuccaggugguaagcacca

SEQ ID NO: 19018 - RNA, 20 nt, Human
ucucaaguccugcugcccag

SEQ ID NO: 19019 - RNA, 20 nt, Human
cagcaucuacuacucugucu

SEQ ID NO: 19020 - RNA, 22 nt, Human
aagcucucuccccacccuaccu

SEQ ID NO: 19021 - RNA, 29 nt, Human
acugucagggcuagccugccugcuuacgc

SEQ ID NO: 19022 - RNA, 26 nt, Human
accaccucccaaaggcugucauuuca

SEQ ID NO: 19023 - RNA, 23 nt, Human
gcaacuuagagguggggagcaga

SEQ ID NO: 19024 - RNA, 21 nt, Human
ucagcucuaggcuucuguaaa

SEQ ID NO: 19025 - RNA, 23 nt, Human
cagacucucaaucugccgguggu

SEQ ID NO: 19026 - RNA, 22 nt, Human
gaggcaggcucccccugccuuu

SEQ ID NO: 19027 - RNA, 26 nt, Human
gugggccgcacuggggcuggcaaguc

SEQ ID NO: 19028 - RNA, 21 nt, Human
aaucaccuucagaaucauguc

SEQ ID NO: 19029 - RNA, 22 nt, Human
ggugauuuuuauauguuccgcu

SEQ ID NO: 19030 - RNA, 26 nt, Human
cuacuuccuccuccccacuuguccgc

SEQ ID NO: 19031 - RNA, 22 nt, Human
gguggcuuuguuugcugggaca

SEQ ID NO: 19032 - RNA, 28 nt, Human
ccuccuguuccaccucagguuuucacag

SEQ ID NO: 19033 - RNA, 26 nt, Human
ccucagcauccugaauacaucauccg

SEQ ID NO: 19034 - RNA, 26 nt, Human
gccagaccucacugcugcacuuucca

SEQ ID NO: 19035 - RNA, 22 nt, Human
gucgacgccaaaggaacacuga

SEQ ID NO: 19036 - RNA, 28 nt, Human
cuuccagcugcuaucaugguauucucau

SEQ ID NO: 19037 - RNA, 23 nt, Human
gguauagagagcagaagaguagc

SEQ ID NO: 19038 - RNA, 28 nt, Human
ccccaggacccccacaccaccccagcuc

SEQ ID NO: 19039 - RNA, 23 nt, Human
cacugccuuacaugugacuaugu

SEQ ID NO: 19040 - RNA, 19 nt, Human
cuuaaauuucuugcuauac

SEQ ID NO: 19041 - RNA, 27 nt, Human
gcaaguccagggagagcuaaagagguu

SEQ ID NO: 19042 - RNA, 23 nt, Human
gcagggcuggucagggugucugg

SEQ ID NO: 19043 - RNA, 22 nt, Human
caugcugguuuccuuccugccu

SEQ ID NO: 19044 - RNA, 23 nt, Human
gacaucucaagucuuuuaaccau

SEQ ID NO: 19045 - RNA, 25 nt, Human
cagcugucuguggcuucccaugucu

SEQ ID NO: 19046 - RNA, 21 nt, Human
ccacaaaccauuacuacuuga

SEQ ID NO: 19047 - RNA, 22 nt, Human
aaucaaucaugcccugccuugu

SEQ ID NO: 19048 - RNA, 21 nt, Human
caguggcgcgggcuacuggaa

SEQ ID NO: 19049 - RNA, 24 nt, Human
gggguauuuaaaaaggacugaaca

SEQ ID NO: 19050 - RNA, 22 nt, Human
gaguggcugggauugcaggugu

SEQ ID NO: 19051 - RNA, 22 nt, Human
gacucacugcaaaaucugccuc

SEQ ID NO: 19052 - RNA, 27 nt, Human
uaacacugugaacuucuaaagcaagag

SEQ ID NO: 19053 - RNA, 24 nt, Human
gaccuguccacccgggaggaaggg

SEQ ID NO: 19054 - RNA, 23 nt, Human
aaggucagggaaugcuuaagcuc

SEQ ID NO: 19055 - RNA, 26 nt, Human
auccagagcuggagugcagcggcaca

SEQ ID NO: 19056 - RNA, 24 nt, Human
augcuucaaaaguucugcugccug

SEQ ID NO: 19057 - RNA, 23 nt, Human
gcugggagacagagucaggcugu

SEQ ID NO: 19058 - RNA, 20 nt, Human
ccugacaucacagcagccuc

SEQ ID NO: 19059 - RNA, 21 nt, Human
uagauguuuuaacuuauuuau

SEQ ID NO: 19060 - RNA, 21 nt, Human
uaauacuacugcacagaguca

SEQ ID NO: 19061 - RNA, 15 nt, Human
accauaaaacccuau

SEQ ID NO: 19062 - RNA, 25 nt, Human
uccuccuccuccucaccaagggccc

SEQ ID NO: 19063 - RNA, 21 nt, Human
ucucacaacuagcgguccugg

SEQ ID NO: 19064 - RNA, 21 nt, Human
gccagauuuugggauuacaaa

SEQ ID NO: 19065 - RNA, 25 nt, Human
ccgccugguuacuguguccuguaaa

SEQ ID NO: 19066 - RNA, 26 nt, Human
uucuagucuucauaauuucuucacuc

SEQ ID NO: 19067 - RNA, 28 nt, Human
gguggagugauuccaagugggaugguug

SEQ ID NO: 19068 - RNA, 27 nt, Human
ggcugugccugagaaugguagcauuuu

SEQ ID NO: 19069 - RNA, 22 nt, Human
uguggaggaacuuuucaagcug

SEQ ID NO: 19070 - RNA, 18 nt, Human
gggcggucuucugcucca

SEQ ID NO: 19071 - RNA, 21 nt, Human
ccccaaaacaaaacaaaccuu

SEQ ID NO: 19072 - RNA, 21 nt, Human
uacccaggcuggagugcaaug

SEQ ID NO: 19073 - RNA, 26 nt, Human
cgcugccucugcugccgggccuggac

SEQ ID NO: 19074 - RNA, 20 nt, Human
accugagcccugcucuccag

SEQ ID NO: 19075 - RNA, 23 nt, Human
cugcugcagcaggaggaguuacg

SEQ ID NO: 19076 - RNA, 23 nt, Human
agagucuccgaggccauugagaa

SEQ ID NO: 19077 - RNA, 27 nt, Human
gaucucagauuccugcuuuucucaccc

SEQ ID NO: 19078 - RNA, 23 nt, Human
aguuugcagagcaugccagggga

SEQ ID NO: 19079 - RNA, 22 nt, Human
cacaccuauaaucccagcacuu

SEQ ID NO: 19080 - RNA, 18 nt, Human
ggagggaggcugggaggc

SEQ ID NO: 19081 - RNA, 22 nt, Human
aauuaaaacaaaaaucuugggg

SEQ ID NO: 19082 - RNA, 24 nt, Human
aggcccuggggaggcagggguugg

SEQ ID NO: 19083 - RNA, 19 nt, Human
gcucuggcaucaucauccc

SEQ ID NO: 19084 - RNA, 26 nt, Human
guaccacacugaguucuaucaguuau

SEQ ID NO: 19085 - RNA, 20 nt, Human
gaaagagauuuaaacucuga

SEQ ID NO: 19086 - RNA, 23 nt, Human
ucuucgggugugaucauauauca

SEQ ID NO: 19087 - RNA, 27 nt, Human
cgugggugugcagugcccagcacggga

SEQ ID NO: 19088 - RNA, 21 nt, Human
ggcuucacagugccugccuuc

SEQ ID NO: 19089 - RNA, 26 nt, Human
cccagcugccaccucuccauccugcu

SEQ ID NO: 19090 - RNA, 23 nt, Human
acuauuucuucagccccuucucu

SEQ ID NO: 19091 - RNA, 21 nt, Human
caguauaaauuucugucuuuc

SEQ ID NO: 19092 - RNA, 23 nt, Human
aaccaggucagaugauguaacag

SEQ ID NO: 19093 - RNA, 22 nt, Human
cccugagcuccaaccagcgggc

SEQ ID NO: 19094 - RNA, 22 nt, Human
gaccuucccaaaaugguucuua

SEQ ID NO: 19095 - RNA, 22 nt, Human
ccaaagugcagggauuacaggc

SEQ ID NO: 19096 - RNA, 22 nt, Human
agagggcauggaggcuccauac

SEQ ID NO: 19097 - RNA, 21 nt, Human
uggucccaggggccaaguaga

SEQ ID NO: 19098 - RNA, 23 nt, Human
gcgcuaugccuuuaacacccgcg

SEQ ID NO: 19099 - RNA, 24 nt, Human
gcuauagcuacagcucuagcuauc

SEQ ID NO: 19100 - RNA, 22 nt, Human
cuggugaggaaguccaggcucc

SEQ ID NO: 19101 - RNA, 20 nt, Human
cuacuucccugucccucuga

SEQ ID NO: 19102 - RNA, 24 nt, Human
aucucuuuauuagugaaucaugcu

SEQ ID NO: 19103 - RNA, 24 nt, Human
ggagagggaggcugcagacgccug

SEQ ID NO: 19104 - RNA, 24 nt, Human
ggagcccaggcccaggaacugaag

SEQ ID NO: 19105 - RNA, 27 nt, Human
acuccucuucugccugccuuuggggau

SEQ ID NO: 19106 - RNA, 24 nt, Human
agaguguuauaacaccaucuggag

SEQ ID NO: 19107 - RNA, 23 nt, Human
acauggcugaacgcguguguaca

SEQ ID NO: 19108 - RNA, 22 nt, Human
ccaaaaugcugggauuacaagc

SEQ ID NO: 19109 - RNA, 21 nt, Human
uuccaaauggaugaauuuuca

SEQ ID NO: 19110 - RNA, 26 nt, Human
gauuaccauaauuuugcucauugaag

SEQ ID NO: 19111 - RNA, 20 nt, Human
aggauggggacagaaagcgc

SEQ ID NO: 19112 - RNA, 22 nt, Human
ugcugcccaggcuggaguacag

SEQ ID NO: 19113 - RNA, 27 nt, Human
ucuauguuuguauauuuuuauaacucc

SEQ ID NO: 19114 - RNA, 26 nt, Human
ggcugacagagcaagacacugucuca

SEQ ID NO: 19115 - RNA, 21 nt, Human
cucagcuuuugaugguacuga

SEQ ID NO: 19116 - RNA, 22 nt, Human
uccucaaggaaauacaaccuag

SEQ ID NO: 19117 - RNA, 22 nt, Human
caagcuggagugaagugguaca

SEQ ID NO: 19118 - RNA, 21 nt, Human
ugggcccucuuucaaagucca

SEQ ID NO: 19119 - RNA, 25 nt, Human
gccaucaugccugacuaauuuuugu

SEQ ID NO: 19120 - RNA, 21 nt, Human
uucuuacaguuaagaagcccu

SEQ ID NO: 19121 - RNA, 25 nt, Human
gccuguaaacacaacaguauuuaua

SEQ ID NO: 19122 - RNA, 23 nt, Human
acaccagcccauacgcugcucuu

SEQ ID NO: 19123 - RNA, 20 nt, Human
aacaauucuuguaacuuucu

SEQ ID NO: 19124 - RNA, 21 nt, Human
uucucagauaccauggaugug

SEQ ID NO: 19125 - RNA, 20 nt, Human
uggccccugucauccucaug

SEQ ID NO: 19126 - RNA, 30 nt, Human; identical to SEQ ID NO: 5724

SEQ ID NO: 19127 - RNA, 22 nt, Human
uaugacugcacuccagccuggg

SEQ ID NO: 19128 - RNA, 27 nt, Human
gcucuucacugcuccuccuggccugcc

SEQ ID NO: 19129 - RNA, 22 nt, Human
auuuuagcaaaagcauccaaga

SEQ ID NO: 19130 - RNA, 18 nt, Human
cccagggcuucagucuuc

SEQ ID NO: 19131 - RNA, 21 nt, Human
aacauugcagcuuucucucca

SEQ ID NO: 19132 - RNA, 21 nt, Human
ccuccaucacgccuguuacca

SEQ ID NO: 19133 - RNA, 22 nt, Human
ucccuccugggcucaagcaguu

SEQ ID NO: 19134 - RNA, 25 nt, Human
agccaggcuggagugcaguggugca

SEQ ID NO: 19135 - RNA, 24 nt, Human
gugaugucuggucaacuggccuac

SEQ ID NO: 19136 - RNA, 26 nt, Human
aucaagcauuacacacaaaaaaucaa

SEQ ID NO: 19137 - RNA, 22 nt, Human
cccucugcagcuuccaggcugg

SEQ ID NO: 19138 - RNA, 26 nt, Human
aaccagcagaacauuaggccugugca

SEQ ID NO: 19139 - RNA, 25 nt, Human
caucguggcuguggagagggucaag

SEQ ID NO: 19140 - RNA, 20 nt, Human
ccauauguacauuuguacuu

SEQ ID NO: 19141 - RNA, 24 nt, Human
gcagagcugugaucuagaggcucu

SEQ ID NO: 19142 - RNA, 27 nt, Human
ccagcacugccguauugccagcacaga

SEQ ID NO: 19143 - RNA, 24 nt, Human
aaaacauccuuuuuuccagccucu

SEQ ID NO: 19144 - RNA, 26 nt, Human
guaucauagggagaccccgucucuac

SEQ ID NO: 19145 - RNA, 26 nt, Human
cccaccaaggucuucagccaucaaca

SEQ ID NO: 19146 - RNA, 27 nt, Human
ugucucccaggcugcuggagugcagug

SEQ ID NO: 19147 - RNA, 21 nt, Human
cuuuaagguuuggagcacuua

SEQ ID NO: 19148 - RNA, 23 nt, Human
uguggcccuggcuggaguucagu

SEQ ID NO: 19149 - RNA, 23 nt, Human
ggcugcugagcugggaugaggca

SEQ ID NO: 19150 - RNA, 22 nt, Human
gccuuagguaaacaacuuagau

SEQ ID NO: 19151 - RNA, 22 nt, Human
ggcucacugcaaccuccacccc

SEQ ID NO: 19152 - RNA, 26 nt, Human
gguccugccagggcuucucgagggcu

SEQ ID NO: 19153 - RNA, 22 nt, Human
gggccuccagccugggacugcu

SEQ ID NO: 19154 - RNA, 28 nt, Human
agguuucccagagaggaaggcguggcuc

SEQ ID NO: 19155 - RNA, 25 nt, Human
cuuuucugauaaaauccaucccgug

SEQ ID NO: 19156 - RNA, 22 nt, Human
acagccucagaagaccagcgag

SEQ ID NO: 19157 - RNA, 27 nt, Human
ccugccugccuuauuugcuuacugagc

SEQ ID NO: 19158 - RNA, 24 nt, Human
uacuguggccugcaggaggguugg

SEQ ID NO: 19159 - RNA, 22 nt, Human
ggcuuacugcaaccuccaccuc

SEQ ID NO: 19160 - RNA, 22 nt, Human
cucccagcccucuccucauucu

SEQ ID NO: 19161 - RNA, 20 nt, Human
caguuacucuuaauucuuua

SEQ ID NO: 19162 - RNA, 20 nt, Human
uugcuccucacacuuuugga

SEQ ID NO: 19163 - RNA, 21 nt, Human
ucaugccacaguaugucgucu

SEQ ID NO: 19164 - RNA, 21 nt, Human
ugucacuggugggcacuggac

SEQ ID NO: 19165 - RNA, 27 nt, Human
cugggaggcccagguguagcgguccga

SEQ ID NO: 19166 - RNA, 19 nt, Human
agcuuagaaucaguauuug

SEQ ID NO: 19167 - RNA, 27 nt, Human
ccugcagcuccccugggcuccgcggcc

SEQ ID NO: 19168 - RNA, 24 nt, Human
ggccgucagcaauaccucugagug

SEQ ID NO: 19169 - RNA, 21 nt, Human
cuuauuuucuuuaaaaagcuu

SEQ ID NO: 19170 - RNA, 20 nt, Human
cagaaauuguuuuugucucc

SEQ ID NO: 19171 - RNA, 27 nt, Human
ugcccccaguuacuguaaauguggccc

SEQ ID NO: 19172 - RNA, 22 nt, Human
uguucacuguauuuaguagaca

SEQ ID NO: 19173 - RNA, 24 nt, Human
ucuuccucauuaucuuugaugcua

SEQ ID NO: 19174 - RNA, 22 nt, Human
gcugcuggguggguacuuccuu

SEQ ID NO: 19175 - RNA, 22 nt, Human
accuuuucaggcccucagucua

SEQ ID NO: 19176 - RNA, 22 nt, Human
cccacuuccugcucccuguguu

SEQ ID NO: 19177 - RNA, 22 nt, Human
gcagccgcagagauguugaugc

SEQ ID NO: 19178 - RNA, 28 nt, Human
uccuccucccgucacagaugugagccag

SEQ ID NO: 19179 - RNA, 21 nt, Human
ccuggcucacaggcugugggg

SEQ ID NO: 19180 - RNA, 26 nt, Human
ucaaugaucauaucaauuggcaguga

SEQ ID NO: 19181 - RNA, 23 nt, Human
gacaggacucugcugcagagggg

SEQ ID NO: 19182 - RNA, 24 nt, Human
aauggcaccagcuuuuucagcucu

SEQ ID NO: 19183 - RNA, 26 nt, Human
uucauuucguugguuucucuccugcc

SEQ ID NO: 19184 - RNA, 19 nt, Human
uuuccaucugauccuucca

SEQ ID NO: 19185 - RNA, 22 nt, Human
agccgaguggagggaggcaaag

SEQ ID NO: 19186 - RNA, 21 nt, Human
ucucaucuguugcacuguauu

SEQ ID NO: 19187 - RNA, 21 nt, Human
auaaugagaaacugaacugua

SEQ ID NO: 19188 - RNA, 23 nt, Human
guucaagcgaugcuccugccuca

SEQ ID NO: 19189 - RNA, 20 nt, Human
gcaagggcuccccacugccu

SEQ ID NO: 19190 - RNA, 26 nt, Human
cucauacgcagcucaucuuaaaccaa

SEQ ID NO: 19191 - RNA, 23 nt, Human
ggagaacaagucggcuguggaga

SEQ ID NO: 19192 - RNA, 21 nt, Human
uggcuuaccuuuccugccuuu

SEQ ID NO: 19193 - RNA, 22 nt, Human
agauagcaaacuucaaggcuuu

SEQ ID NO: 19194 - RNA, 26 nt, Human
gggagggaggggugugcaggagccgc

SEQ ID NO: 19195 - RNA, 27 nt, Human
ggugaagcuggcucaggugcacaugcc

SEQ ID NO: 19196 - RNA, 27 nt, Human
aucauucucucauucaccaguggugac

SEQ ID NO: 19197 - RNA, 23 nt, Human
cccugcuucuccccuuugucauc

SEQ ID NO: 19198 - RNA, 22 nt, Human
ccaacgccagcaccaaugucgc

SEQ ID NO: 19199 - RNA, 27 nt, Human
cguagccgccuccgagcccgccgccac

SEQ ID NO: 19200 - RNA, 27 nt, Human
caggcuggagugcagugagcuauuaca

SEQ ID NO: 19201 - RNA, 26 nt, Human
cggagguggaggugcagggucaacug

SEQ ID NO: 19202 - RNA, 21 nt, Human
gauugcacuccaaccugggcg

SEQ ID NO: 19203 - RNA, 21 nt, Human
ugcaggagacucuugcaguga

SEQ ID NO: 19204 - RNA, 27 nt, Human
gcucuguagcccaggccagagugcagu

SEQ ID NO: 19205 - RNA, 20 nt, Human
uuacgauaacuuacagcccu

SEQ ID NO: 19206 - RNA, 20 nt, Human
agucaccuaacccucuguca

SEQ ID NO: 19207 - RNA, 22 nt, Human
ucaacuccugggcucaagcagu

SEQ ID NO: 19208 - RNA, 23 nt, Human
ugcaggauuuuuagagcauuaaa

SEQ ID NO: 19209 - RNA, 26 nt, Human
auugguggcaucacagaccccagcug

SEQ ID NO: 19210 - RNA, 23 nt, Human
accugccauugccuccucuccac

SEQ ID NO: 19211 - RNA, 23 nt, Human
ccugccuguuccccuucucccgg

SEQ ID NO: 19212 - RNA, 19 nt, Human
cuguuaucuucaagccagg

SEQ ID NO: 19213 - RNA, 22 nt, Human
cagggaggggugggagagggaa

SEQ ID NO: 19214 - RNA, 24 nt, Human
uugcugccccaccaucuugcugac

SEQ ID NO: 19215 - RNA, 27 nt, Human
ccccacccccucggggcagaguuugca

SEQ ID NO: 19216 - RNA, 22 nt, Human
ggacagcuucagaaucugacac

SEQ ID NO: 19217 - RNA, 18 nt, Human
guuccugaaauccugagu

SEQ ID NO: 19218 - RNA, 21 nt, Human
uuuguauauaucacucucucc

SEQ ID NO: 19219 - RNA, 22 nt, Human
uucugagcauucgcuguacccu

SEQ ID NO: 19220 - RNA, 27 nt, Human
ccaggcaacaggacuaaacuaccucca

SEQ ID NO: 19221 - RNA, 22 nt, Human
gcucagcccugaguuggcauca

SEQ ID NO: 19222 - RNA, 23 nt, Human
gacacuuuuauguuaaugcucug

SEQ ID NO: 19223 - RNA, 22 nt, Human
caccacugcacuccaggcuggg

SEQ ID NO: 19224 - RNA, 27 nt, Human
gcugucacaauuauuaccaucucucca

SEQ ID NO: 19225 - RNA, 22 nt, Human
uuucacaaccuucuguggcuca

SEQ ID NO: 19226 - RNA, 21 nt, Human
cucccugcacucuggcucuuu

SEQ ID NO: 19227 - RNA, 26 nt, Human
cagauccagagguucccuuggcaguc

SEQ ID NO: 19228 - RNA, 19 nt, Human
aguccaggaaucaugcugg

SEQ ID NO: 19229 - RNA, 21 nt, Human
ugcagggaaauugacugcagg

SEQ ID NO: 19230 - RNA, 21 nt, Human
caucaugcggugggugcugcc

SEQ ID NO: 19231 - RNA, 21 nt, Human
acuugcuauuuuaaacaaaua

SEQ ID NO: 19232 - RNA, 22 nt, Human
gggauuacaggugugagccaca

SEQ ID NO: 19233 - RNA, 26 nt, Human
uucuguuuaauuuucacuuuuggcaa

SEQ ID NO: 19234 - RNA, 27 nt, Human
uuaaggauugagacaaaaacugugauu

SEQ ID NO: 19235 - RNA, 23 nt, Human
uguuugaaagccucugcgucuuu

SEQ ID NO: 19236 - RNA, 25 nt, Human
cccuuucccuucugacuacgugaaa

SEQ ID NO: 19237 - RNA, 27 nt, Human
cacuuugguuccagcauccuguccagc

SEQ ID NO: 19238 - RNA, 26 nt, Human
cauuguacuccagccugggcaacaag

SEQ ID NO: 19239 - RNA, 21 nt, Human
cuccauggucccgaccaggaa

SEQ ID NO: 19240 - RNA, 18 nt, Human
aucuguucucuccaugcc

SEQ ID NO: 19241 - RNA, 21 nt, Human
aguaaagcaucugcacuugac

SEQ ID NO: 19242 - RNA, 28 nt, Human
uggggaaaggggacaaggaaggaaaaga

SEQ ID NO: 19243 - RNA, 26 nt, Human
uucauucugugaccucaggggucaca

SEQ ID NO: 19244 - RNA, 27 nt, Human
uuaacacuuuagugccugacugcuguu

SEQ ID NO: 19245 - RNA, 23 nt, Human
uguggcccaggcuggagugcagu

SEQ ID NO: 19246 - RNA, 21 nt, Human
gggcugagaaaaaacacagaa

SEQ ID NO: 19247 - RNA, 22 nt, Human
cuaggguaggggcacugcugca

SEQ ID NO: 19248 - RNA, 26 nt, Human
gccuuucucuuaccuugccuuaggcc

SEQ ID NO: 19249 - RNA, 27 nt, Human
guaaaacugaggcacgagcaaagugaa

SEQ ID NO: 19250 - RNA, 32 nt, Human
cugugugcuaccagugcaagaucugggcucua

SEQ ID NO: 19251 - RNA, 22 nt, Human
gaccauccuggccaauauggug

SEQ ID NO: 19252 - RNA, 22 nt, Human
gaccaucuuggccaacauggug

SEQ ID NO: 19253 - RNA, 27 nt, Human
cacugcccuuuuugaaaucaccuggua

SEQ ID NO: 19254 - RNA, 20 nt, Human
ucauucuuuauucuauuuua

SEQ ID NO: 19255 - RNA, 22 nt, Human
acugcugggagggagggggcag

SEQ ID NO: 19256 - RNA, 22 nt, Human
gcucccacaagccucugcccag

SEQ ID NO: 19257 - RNA, 27 nt, Human
aggggaaacugcaggucaagggcugau

SEQ ID NO: 19258 - RNA, 23 nt, Human
aagugacccaggacauaugccug

SEQ ID NO: 19259 - RNA, 22 nt, Human
agccuccuuccuuucugugaga

SEQ ID NO: 19260 - RNA, 23 nt, Human
gggacagcuguuccuuugggcug

SEQ ID NO: 19261 - RNA, 22 nt, Human
uguccacgucugugugagcugu

SEQ ID NO: 19262 - RNA, 24 nt, Human
gguggggccccugaugggagcccu

SEQ ID NO: 19263 - RNA, 23 nt, Human
uccucuauuuguucagaucucau

SEQ ID NO: 19264 - RNA, 20 nt, Human
uggcccccgucuuugcuucc

SEQ ID NO: 19265 - RNA, 23 nt, Human
guggcugcgugccccugcugcug

SEQ ID NO: 19266 - RNA, 27 nt, Human
caaagcccuuauguuuaaucagcgaug

SEQ ID NO: 19267 - RNA, 20 nt, Human
ucuugaggaagcccaggcuc

SEQ ID NO: 19268 - RNA, 22 nt, Human
ugcugggacguugugugcaaua

SEQ ID NO: 19269 - RNA, 21 nt, Human
aucaguugcuuccuggacuug

SEQ ID NO: 19270 - RNA, 22 nt, Human
uguugcagccaaagauuuugga

SEQ ID NO: 19271 - RNA, 24 nt, Human
ggacucagaaauguggugggaggg

SEQ ID NO: 19272 - RNA, 21 nt, Human
caccuacagaccggcuccucc

SEQ ID NO: 19273 - RNA, 23 nt, Human
gguggaaacuccuauccuaucau

SEQ ID NO: 19274 - RNA, 21 nt, Human
auacagugugcauucucucca

SEQ ID NO: 19275 - RNA, 20 nt, Human
ggacagaauaugaccaccuu

SEQ ID NO: 19276 - RNA, 23 nt, Human
uucauucuauuucgcccuucaca

SEQ ID NO: 19277 - RNA, 32 nt, Human
gggagaggaugggagugggcagagguggcacc

SEQ ID NO: 19278 - RNA, 26 nt, Human
cucugccucccggguucaagcaauua

SEQ ID NO: 19279 - RNA, 23 nt, Human
gcugggagagauggauggcggga

SEQ ID NO: 19280 - RNA, 23 nt, Human
caccuucugggagcaggagggag

SEQ ID NO: 19281 - RNA, 24 nt, Human
ccaugaucucaaccacgaaauggg

SEQ ID NO: 19282 - RNA, 23 nt, Human
agaaaaacuacagcaucauugca

SEQ ID NO: 19283 - RNA, 23 nt, Human
uuuucuuucuuucuuuuuuguac

SEQ ID NO: 19284 - RNA, 24 nt, Human
gcugugugacaucauaguccucua

SEQ ID NO: 19285 - RNA, 29 nt, Human
ccaacugcuguuucagccucugcacccca

SEQ ID NO: 19286 - RNA, 26 nt, Human
uuaacaaugccuacuuuccauucacu

SEQ ID NO: 19287 - RNA, 25 nt, Human
gauacuuuuucuuuuguaagugcua

SEQ ID NO: 19288 - RNA, 20 nt, Human
ucagccugagccucugcuuc

SEQ ID NO: 19289 - RNA, 21 nt, Human
agauacuuguuuguuucuuuc

SEQ ID NO: 19290 - RNA, 22 nt, Human
aauauuaggggaguagagccag

SEQ ID NO: 19291 - RNA, 23 nt, Human
ucugcaccuccuuucccucucuc

SEQ ID NO: 19292 - RNA, 21 nt, Human
agcuucaugacuuccuugcac

SEQ ID NO: 19293 - RNA, 22 nt, Human
gccacagagcagcuuauaggua

SEQ ID NO: 19294 - RNA, 25 nt, Human
cccugcugagucccaggcugagccu

SEQ ID NO: 19295 - RNA, 23 nt, Human
cccacccccagcgagucccaccu

SEQ ID NO: 19296 - RNA, 22 nt, Human
ugaggugccuuucuuaacugac

SEQ ID NO: 19297 - RNA, 23 nt, Human
ccugcaguggugguugugacggg

SEQ ID NO: 19298 - RNA, 23 nt, Human
auugucauugauacaugcauugc

SEQ ID NO: 19299 - RNA, 22 nt, Human
ggacagaaguagcucuggcugu

SEQ ID NO: 19300 - RNA, 20 nt, Human
gacugaggagaaugauagag

SEQ ID NO: 19301 - RNA, 25 nt, Human
gggugauuuguugauuggcaaugag

SEQ ID NO: 19302 - RNA, 26 nt, Human
cugggcugugaacagcacugcuccac

SEQ ID NO: 19303 - RNA, 20 nt, Human
ucaguaggugccucuguacc

SEQ ID NO: 19304 - RNA, 22 nt, Human
cauugguuugucuugcauucuu

SEQ ID NO: 19305 - RNA, 27 nt, Human
cugcggucguucccucggcuguggacc

SEQ ID NO: 19306 - RNA, 20 nt, Human
gggggguggagggggaauga

SEQ ID NO: 19307 - RNA, 22 nt, Human
gacaggcugcacaucucaguau

SEQ ID NO: 19308 - RNA, 26 nt, Human
aauccuuccuugcaggaaaccagucu

SEQ ID NO: 19309 - RNA, 22 nt, Human
aaucacaucucugauuucagug

SEQ ID NO: 19310 - RNA, 27 nt, Human
cccauacccacacagucacagucacac

SEQ ID NO: 19311 - RNA, 22 nt, Human
caugccuuuaaucccaacacuu

SEQ ID NO: 19312 - RNA, 19 nt, Human
gguauaccuggggcugguc

SEQ ID NO: 19313 - RNA, 23 nt, Human
ccggccacuagggcaccaucuuc

SEQ ID NO: 19314 - RNA, 23 nt, Human
uguuaacccaaguuugcuugucu

SEQ ID NO: 19315 - RNA, 23 nt, Human
cucgagaccacgcuccuuccucg

SEQ ID NO: 19316 - RNA, 20 nt, Human
cccuucuggcccucagucug

SEQ ID NO: 19317 - RNA, 25 nt, Human
uguagccaggaugcagcucccaggc

SEQ ID NO: 19318 - RNA, 27 nt, Human
uuccagaagccucuccuccccgccgcc

SEQ ID NO: 19319 - RNA, 23 nt, Human
gaagcuuccacaaaauuagaaag

SEQ ID NO: 19320 - RNA, 27 nt, Human
acuuggagagagggaagaggggcguuu

SEQ ID NO: 19321 - RNA, 26 nt, Human
ccucuguucuggaggacgagccuucu

SEQ ID NO: 19322 - RNA, 22 nt, Human
ugacccgcuuccuaguccugaa

SEQ ID NO: 19323 - RNA, 24 nt, Human
agaaccaaggagcacucaaauagg

SEQ ID NO: 19324 - RNA, 19 nt, Human
ccgggaccugccaccagcc

SEQ ID NO: 19325 - RNA, 22 nt, Human
uugcuagaauuuuuucuaaucu

SEQ ID NO: 19326 - RNA, 20 nt, Human
caguguugcaacauaaugaa

SEQ ID NO: 19327 - RNA, 23 nt, Human
cagcuggccccagcugugaucau

SEQ ID NO: 19328 - RNA, 26 nt, Human
cagaucuuugagaggucuguguacag

SEQ ID NO: 19329 - RNA, 26 nt, Human
uagucccauugauguacuuuaccuga

SEQ ID NO: 19330 - RNA, 24 nt, Human
cgggugagccaagggcacuuugcu

SEQ ID NO: 19331 - RNA, 21 nt, Human
cuggggcucagaccacaugcc

SEQ ID NO: 19332 - RNA, 26 nt, Human
ccacccagaaccugagugcgggccuc

SEQ ID NO: 19333 - RNA, 25 nt, Human
gaucaugugaaaauauuuaauuugc

SEQ ID NO: 19334 - RNA, 23 nt, Human
aucacauucuuagcacaccuaca

SEQ ID NO: 19335 - RNA, 22 nt, Human
acauucucuggcagcaccucca

SEQ ID NO: 19336 - RNA, 21 nt, Human
ucucuagcugaucagaauuuu

SEQ ID NO: 19337 - RNA, 27 nt, Human
ccaggacaauuuauuaguuuucucagu

SEQ ID NO: 19338 - RNA, 27 nt, Human
gacagaacuguuccugccguugccgcc

SEQ ID NO: 19339 - RNA, 20 nt, Human
gacaacacccccuccuuccu

SEQ ID NO: 19340 - RNA, 22 nt, Human
ggcacugugauuccugccccau

SEQ ID NO: 19341 - RNA, 21 nt, Human
cuucuuccugauggaauuuau

SEQ ID NO: 19342 - RNA, 20 nt, Human
caccccucagcuugaggacc

SEQ ID NO: 19343 - RNA, 17 nt, Human
uauccucugcagcaucc

SEQ ID NO: 19344 - RNA, 24 nt, Human
caaaccuguaauggcuuguaaaca

SEQ ID NO: 19345 - RNA, 26 nt, Human
uucuuuauuguagcaacauacacucu

SEQ ID NO: 19346 - RNA, 19 nt, Human
gcauaaauagccaugugaa

SEQ ID NO: 19347 - RNA, 20 nt, Human
cuguacauuucacaaaaagg

SEQ ID NO: 19348 - RNA, 20 nt, Human
cucuacugcugccugggggc

SEQ ID NO: 19349 - RNA, 27 nt, Human
guccaggcuggucugaaacccuugagc

SEQ ID NO: 19350 - RNA, 20 nt, Human
acucuuagccaaggcuucuu

SEQ ID NO: 19351 - RNA, 22 nt, Human
ucucuaaccuccuuuacccuca

SEQ ID NO: 19352 - RNA, 21 nt, Human
agcaauacuuucugcauagug

SEQ ID NO: 19353 - RNA, 24 nt, Human
cuaucugccaaaauggcuuagaca

SEQ ID NO: 19354 - RNA, 20 nt, Human
acuuugagaaaaucaguccu

SEQ ID NO: 19355 - RNA, 23 nt, Human
cuggaggacuagaaccuggaggg

SEQ ID NO: 19356 - RNA, 20 nt, Human
uccuggagugccuucauuga

SEQ ID NO: 19357 - RNA, 25 nt, Human
gaacaaugugccuacauuaccagcu

SEQ ID NO: 19358 - RNA, 23 nt, Human
ccuucacugcagagccuugccuu

SEQ ID NO: 19359 - RNA, 22 nt, Human
gaacgcauuuuggguuguuuaa

SEQ ID NO: 19360 - RNA, 27 nt, Human
ucugcuauuucugccacuucucuuaga

SEQ ID NO: 19361 - RNA, 26 nt, Human
accauggcaggacugggggaacugga

SEQ ID NO: 19362 - RNA, 27 nt, Human
gacuaaaacaaauggcucuuucacaug

SEQ ID NO: 19363 - RNA, 21 nt, Human
ccuugaagaaagaggccuagg

SEQ ID NO: 19364 - RNA, 24 nt, Human
gcugcuccgaggacccaggaaagg

SEQ ID NO: 19365 - RNA, 26 nt, Human
cuggaaaucaggguuaguauugucca

SEQ ID NO: 19366 - RNA, 22 nt, Human
uuugcagaaugaugcagguuca

SEQ ID NO: 19367 - RNA, 18 nt, Human
caugccacuccccggccu

SEQ ID NO: 19368 - RNA, 21 nt, Human
uucuccaggacaaccugcugg

SEQ ID NO: 19369 - RNA, 22 nt, Human
ggcauguugccuuguuuccgcu

SEQ ID NO: 19370 - RNA, 23 nt, Human
ccuaguaagcauacuuucuuaag

SEQ ID NO: 19371 - RNA, 21 nt, Human
agcauguggcaggcagugggg

SEQ ID NO: 19372 - RNA, 22 nt, Human
ccaagauggugaaaccccaucu

SEQ ID NO: 19373 - RNA, 22 nt, Human
cacuugaagugagaagaugauc

SEQ ID NO: 19374 - RNA, 24 nt, Human
uuggucccuaaaaacagucugcac

SEQ ID NO: 19375 - RNA, 23 nt, Human
ugugaacauugaauuacuuucug

SEQ ID NO: 19376 - RNA, 21 nt, Human
agaagaccugggcuuagcaau

SEQ ID NO: 19377 - RNA, 22 nt, Human
aaaaagcuuuuguaaucaguua

SEQ ID NO: 19378 - RNA, 24 nt, Human
ggcccaagugauccuuccaccuca

SEQ ID NO: 19379 - RNA, 22 nt, Human
uuauagaaggggauuuguggcu

SEQ ID NO: 19380 - RNA, 25 nt, Human
uacugauacuacaacuuuuguuuuc

SEQ ID NO: 19381 - RNA, 22 nt, Human
caaacaucuucucaagcaguca

SEQ ID NO: 19382 - RNA, 27 nt, Human
ccugcugcuucuguaccccgccugucc

SEQ ID NO: 19383 - RNA, 25 nt, Human
ggagcaccuucauuaguacagcuug

SEQ ID NO: 19384 - RNA, 23 nt, Human
gugccucagccguucuugacauc

SEQ ID NO: 19385 - RNA, 27 nt, Human
cuaccugcagcuaagcagugagcagaa

SEQ ID NO: 19386 - RNA, 28 nt, Human
ggagcuccugccugcgguuuuguguaug

SEQ ID NO: 19387 - RNA, 20 nt, Human
agaugauaaaaugaggcaga

SEQ ID NO: 19388 - RNA, 22 nt, Human
cgcucgccgccucgucucccag

SEQ ID NO: 19389 - RNA, 21 nt, Human
gcaguuagcagaccuaaagca

SEQ ID NO: 19390 - RNA, 23 nt, Human
cccuccagaguuaccuggggagg

SEQ ID NO: 19391 - RNA, 23 nt, Human
agggaaagagacccagaaaggac

SEQ ID NO: 19392 - RNA, 21 nt, Human
guacauacauauauacuuaua

SEQ ID NO: 19393 - RNA, 19 nt, Human
gacuacaggcgcucgccau

SEQ ID NO: 19394 - RNA, 19 nt, Human
cugagccucacaucuccuu

SEQ ID NO: 19395 - RNA, 21 nt, Human
agaaggcaggcuucuggcuuc

SEQ ID NO: 19396 - RNA, 26 nt, Human
agugcugaggcuggaagaaaaacgca

SEQ ID NO: 19397 - RNA, 22 nt, Human
ucuaaguaagaacacugagaua

SEQ ID NO: 19398 - RNA, 25 nt, Human
acuaucuuuuuaacaucucuuguac

SEQ ID NO: 19399 - RNA, 25 nt, Human
gagcaagcaccaaccuccagacuca

SEQ ID NO: 19400 - RNA, 25 nt, Human
cucuguuuaugaaaaagaauaaaaa

SEQ ID NO: 19401 - RNA, 23 nt, Human
aagcuguuuaguuuguuaauuga

SEQ ID NO: 19402 - RNA, 24 nt, Human
ugaggguauggagagaugguauac

SEQ ID NO: 19403 - RNA, 22 nt, Human
ugccuguaaucccagcauuuug

SEQ ID NO: 19404 - RNA, 22 nt, Human
ugccuguaaccccagcacuuug

SEQ ID NO: 19405 - RNA, 18 nt, Human
ggaggccagagaggccag

SEQ ID NO: 19406 - RNA, 27 nt, Human
cccagcacuuuuuaugcucccacugug

SEQ ID NO: 19407 - RNA, 24 nt, Human
cuucccuuuuauaguucaucagcc

SEQ ID NO: 19408 - RNA, 18 nt, Human
uguuuugcaguccugggc

SEQ ID NO: 19409 - RNA, 25 nt, Human
cagccaucaugacauuuaccaugaa

SEQ ID NO: 19410 - RNA, 26 nt, Human
uuguugucuguggcauauucuuugua

SEQ ID NO: 19411 - RNA, 21 nt, Human
uccagccugggcaacagagug

SEQ ID NO: 19412 - RNA, 23 nt, Human
ccuggucugaggaggagggacuc

SEQ ID NO: 19413 - RNA, 25 nt, Human
uccuggcuuuaaccccuccuuggcc

SEQ ID NO: 19414 - RNA, 26 nt, Human
uuugaggcucuaagcuucucaugugg

SEQ ID NO: 19415 - RNA, 21 nt, Human
cugccucccagguucaagcac

SEQ ID NO: 19416 - RNA, 26 nt, Human
ccugcagggaucauagcugacucaga

SEQ ID NO: 19417 - RNA, 20 nt, Human
gauuuugguaaugauguuga

SEQ ID NO: 19418 - RNA, 27 nt, Human
cauugucugacugggccuggaccuaua

SEQ ID NO: 19419 - RNA, 21 nt, Human
gguuucugcugguuguagguc

SEQ ID NO: 19420 - RNA, 23 nt, Human
agcucacugcaaccucaauccug

SEQ ID NO: 19421 - RNA, 24 nt, Human
ucauggcaacaagagcugcagccu

SEQ ID NO: 19422 - RNA, 22 nt, Human
gccuggcgccuccccucuccag

SEQ ID NO: 19423 - RNA, 29 nt, Human
cugccuggaccccauugucugucugcuuc

SEQ ID NO: 19424 - RNA, 20 nt, Human
auccagucuaauagguuugg

SEQ ID NO: 19425 - RNA, 21 nt, Human
caccuguuuuuaagcuguuuc

SEQ ID NO: 19426 - RNA, 18 nt, Human
acacccaggcuggagugc

SEQ ID NO: 19427 - RNA, 27 nt, Human
gcuccaggaugauggagacagagcgac

SEQ ID NO: 19428 - RNA, 24 nt, Human
uucaagcaucaccaaacacaguuu

SEQ ID NO: 19429 - RNA, 22 nt, Human
accugggcuggagugaggugga

SEQ ID NO: 19430 - RNA, 23 nt, Human
uccaaacuuguuucucagacuuc

SEQ ID NO: 19431 - RNA, 23 nt, Human
agcgcugugcucugagcuuagaa

SEQ ID NO: 19432 - RNA, 27 nt, Human
auggggccagagucuguguggacaacc

SEQ ID NO: 19433 - RNA, 26 nt, Human
gagaggagccggcuguggagccccgc

SEQ ID NO: 19434 - RNA, 23 nt, Human
aagcuaagaucacuauaggucca

SEQ ID NO: 19435 - RNA, 23 nt, Human
gucccauucauuucaacacgucc

SEQ ID NO: 19436 - RNA, 20 nt, Human
accucagaagauaaaaagaa

SEQ ID NO: 19437 - RNA, 24 nt, Human
ggagcugagaaaaccccuuaguac

SEQ ID NO: 19438 - RNA, 27 nt, Human
gcccccagcccccgucacgccaguccc

SEQ ID NO: 19439 - RNA, 27 nt, Human
ugaccaacaagauggaaagaaccacgc

SEQ ID NO: 19440 - RNA, 21 nt, Human
uuaccugcauuauuacauuag

SEQ ID NO: 19441 - RNA, 26 nt, Human
accugcauccccagcacugguccugg

SEQ ID NO: 19442 - RNA, 22 nt, Human
cauacgcaccacaucucuaucu

SEQ ID NO: 19443 - RNA, 22 nt, Human
acugcaaccuccgccucucagg

SEQ ID NO: 19444 - RNA, 23 nt, Human
auccucuccauuuucccaaauaa

SEQ ID NO: 19445 - RNA, 20 nt, Human
ugcauuccauccgcucugca

SEQ ID NO: 19446 - RNA, 31 nt, Human
cagcgccagagaagccaggugaccagggacc

SEQ ID NO: 19447 - RNA, 20 nt, Human
acaaauauucaugcagcgga

SEQ ID NO: 19448 - RNA, 23 nt, Human
gccacccagaaccugagugcggg

SEQ ID NO: 19449 - RNA, 21 nt, Human
cuuucucucaccccuggagcc

SEQ ID NO: 19450 - RNA, 22 nt, Human
agcaggagcuggggcagaggcu

SEQ ID NO: 19451 - RNA, 25 nt, Human
cuagagggaagcucacagcaugaug

SEQ ID NO: 19452 - RNA, 23 nt, Human
gggaucauaguuuauaugcaucu

SEQ ID NO: 19453 - RNA, 23 nt, Human
cgagcagugagccaaggagcagc

SEQ ID NO: 19454 - RNA, 25 nt, Human
agggaaagcugacaucugcagggaa

SEQ ID NO: 19455 - RNA, 22 nt, Human
ugugacaaccaggagcccuguc

SEQ ID NO: 19456 - RNA, 20 nt, Human
caaaaccauuagaauuguua

SEQ ID NO: 19457 - RNA, 21 nt, Human
ccauuuuuccaaagaagaguc

SEQ ID NO: 19458 - RNA, 21 nt, Human
auacaauaaagucuuaccuca

SEQ ID NO: 19459 - RNA, 23 nt, Human
ggagcugggccaggcaggaagac

SEQ ID NO: 19460 - RNA, 17 nt, Human
aacuuauaucauuuuca

SEQ ID NO: 19461 - RNA, 21 nt, Human
acgaggacgaggaguggccca

SEQ ID NO: 19462 - RNA, 21 nt, Human
acaacuccugcugugugcaaa

SEQ ID NO: 19463 - RNA, 20 nt, Human
ccauaauuuauuuggagauu

SEQ ID NO: 19464 - RNA, 27 nt, Human
cuugcagaggcaugugugcuagggaug

SEQ ID NO: 19465 - RNA, 26 nt, Human
ccucuaccuuugauauuccacuuagc

SEQ ID NO: 19466 - RNA, 21 nt, Human
cgccaugugauggagcugauc

SEQ ID NO: 19467 - RNA, 23 nt, Human
ccaccucacuggccuugcuggag

SEQ ID NO: 19468 - RNA, 21 nt, Human
ucaucccaaaagcaacaugga

SEQ ID NO: 19469 - RNA, 23 nt, Human
gggggauguuguggaauauggca

SEQ ID NO: 19470 - RNA, 27 nt, Human
ucucucugcucuccauuaagugcauuc

SEQ ID NO: 19471 - RNA, 21 nt, Human
acuucugcacucucugcucug

SEQ ID NO: 19472 - RNA, 27 nt, Human
cuggggucucugcacacagcuuuugcu

SEQ ID NO: 19473 - RNA, 27 nt, Human
ggaaaucgcuacagcuuggacuauuuu

SEQ ID NO: 19474 - RNA, 25 nt, Human
caggaggcccucgagguugcucugg

SEQ ID NO: 19475 - RNA, 26 nt, Human
ucagagcccagcucaugcacaucagc

SEQ ID NO: 19476 - RNA, 22 nt, Human
aaaauugaggaagguggcccuu

SEQ ID NO: 19477 - RNA, 22 nt, Human
gugccuggugagucugccugug

SEQ ID NO: 19478 - RNA, 23 nt, Human
aggacuccacugugccccacuuu

SEQ ID NO: 19479 - RNA, 31 nt, Human
gggacuccacauccuccagcccccacaaucc

SEQ ID NO: 19480 - RNA, 19 nt, Human
gggacacggcccagaugcu

SEQ ID NO: 19481 - RNA, 25 nt, Human
guuucugguacuccuaugcaauauu

SEQ ID NO: 19482 - RNA, 22 nt, Human
aaagaacaaacauguuuuugug

SEQ ID NO: 19483 - RNA, 22 nt, Human
aaacuccugaccucaaguaauc

SEQ ID NO: 19484 - RNA, 22 nt, Human
agaccagccugggcaacauagu

SEQ ID NO: 19485 - RNA, 23 nt, Human
ucugccugcaguccugugugagc

SEQ ID NO: 19486 - RNA, 22 nt, Human
gugugagccaccacacccagcc

SEQ ID NO: 19487 - RNA, 21 nt, Human
cugcgugugucucagcaccgc

SEQ ID NO: 19488 - RNA, 22 nt, Human
cucccgcuucuccuccuccucc

SEQ ID NO: 19489 - RNA, 19 nt, Human
uaauuucaucuuuauuucc

SEQ ID NO: 19490 - RNA, 26 nt, Human
guggucagggcugaagucggagaagc

SEQ ID NO: 19491 - RNA, 23 nt, Human
gcagccgccucacaggucggcgg

SEQ ID NO: 19492 - RNA, 27 nt, Human
ccugggcaacagagcaaaacucugucu

SEQ ID NO: 19493 - RNA, 22 nt, Human
uuucagugagccaagaaauuca

SEQ ID NO: 19494 - RNA, 22 nt, Human
gcccaggcuggaguucagcggu

SEQ ID NO: 19495 - RNA, 21 nt, Human
aacugcucuggcugggcauuc

SEQ ID NO: 19496 - RNA, 20 nt, Human
cuguaaccaccucucugucu

SEQ ID NO: 19497 - RNA, 27 nt, Human
agcucacugcaacuuccgcaucccagg

SEQ ID NO: 19498 - RNA, 22 nt, Human
ccgccuguaaucccagcacuuu

SEQ ID NO: 19499 - RNA, 22 nt, Human
acgccugucaucccagcacuuu

SEQ ID NO: 19500 - RNA, 19 nt, Human
ugucuucaggggccacacc

SEQ ID NO: 19501 - RNA, 22 nt, Human
ucuuuauuuucuuuaugucgac

SEQ ID NO: 19502 - RNA, 22 nt, Human
gccuuucucugccugcccugcc

SEQ ID NO: 19503 - RNA, 22 nt, Human
cgccuucugcuccagcugcauc

SEQ ID NO: 19504 - RNA, 27 nt, Human
uuguugugaggagucuagccaguuggu

SEQ ID NO: 19505 - RNA, 22 nt, Human
ccuuucucucuuucuuuugugc

SEQ ID NO: 19506 - RNA, 27 nt, Human
gccuggguaacagagugagacugucuc

SEQ ID NO: 19507 - RNA, 31 nt, Human
caccagugaaccccagucagccuggaccccu

SEQ ID NO: 19508 - RNA, 21 nt, Human
ucuaaagagaaaauaugcaga

SEQ ID NO: 19509 - RNA, 22 nt, Human
ggccuguaaucccagcacuuug

SEQ ID NO: 19510 - RNA, 27 nt, Human
cucuuugcuugcugaucucguaccuua

SEQ ID NO: 19511 - RNA, 20 nt, Human
cagugagagacuucggcgga

SEQ ID NO: 19512 - RNA, 26 nt, Human
gaggcugaggcaagagaauuguuuga

SEQ ID NO: 19513 - RNA, 23 nt, Human
ugaguagcugggauuacaggcau

SEQ ID NO: 19514 - RNA, 25 nt, Human
uccuuucuuauuaauuucagucuug

SEQ ID NO: 19515 - RNA, 23 nt, Human
ccuuagcaaauucuguuuuucua

SEQ ID NO: 19516 - RNA, 21 nt, Human
agguggccuagcaggcacagg

SEQ ID NO: 19517 - RNA, 20 nt, Human
uuccaaaugugaacuuuuug

SEQ ID NO: 19518 - RNA, 18 nt, Human
caacuggugacugguuag

SEQ ID NO: 19519 - RNA, 20 nt, Human
ccugcucugccccuuggagc

SEQ ID NO: 19520 - RNA, 21 nt, Human
aggcagacugguggcagugga

SEQ ID NO: 19521 - RNA, 26 nt, Human
ccagaagagagaggagagccucagga

SEQ ID NO: 19522 - RNA, 22 nt, Human
acacuguuuucaauaaaugcac

SEQ ID NO: 19523 - RNA, 20 nt, Human
aaagcaauccagaugugguu

SEQ ID NO: 19524 - RNA, 21 nt, Human
ugaaaauacuuucaggcucca

SEQ ID NO: 19525 - RNA, 21 nt, Human
cuaacaacuuuaaguaaguuc

SEQ ID NO: 19526 - RNA, 23 nt, Human
cugccaggcugggguguuuucgg

SEQ ID NO: 19527 - RNA, 27 nt, Human
ucucaugcacuaugcacucagaaaaau

SEQ ID NO: 19528 - RNA, 21 nt, Human
ucauuuauaaagccacuguga

SEQ ID NO: 19529 - RNA, 24 nt, Human
agcaggaggagauacuuaaaacau

SEQ ID NO: 19530 - RNA, 24 nt, Human
uuaaucacaucacuuccauggcau

SEQ ID NO: 19531 - RNA, 19 nt, Human
cucuccaacaugaaggauc

SEQ ID NO: 19532 - RNA, 20 nt, Human
cugccaccauccucaugcac

SEQ ID NO: 19533 - RNA, 23 nt, Human
ugcuggcaucucugcagcucaaa

SEQ ID NO: 19534 - RNA, 20 nt, Human
ccagggaacagccacucccc

SEQ ID NO: 19535 - RNA, 20 nt, Human
ucucacugcaaccucugccu

SEQ ID NO: 19536 - RNA, 24 nt, Human
ucuaggaggcuggcagcucagcug

SEQ ID NO: 19537 - RNA, 17 nt, Human
uugcaauuuugucucca

SEQ ID NO: 19538 - RNA, 26 nt, Human
auacuaauaaaauacauacuauagau

SEQ ID NO: 19539 - RNA, 22 nt, Human
gauucuuagaaguauguccuca

SEQ ID NO: 19540 - RNA, 22 nt, Human
ggggauguggaauuuuuauaca

SEQ ID NO: 19541 - RNA, 22 nt, Human
acccuuguuugcacagcauuaa

SEQ ID NO: 19542 - RNA, 24 nt, Human
gauagcaauucauauaacccucua

SEQ ID NO: 19543 - RNA, 26 nt, Human
aauggcuucagcagcacgcuugacaa

SEQ ID NO: 19544 - RNA, 27 nt, Human
ccacuggacuccagccugcgugacaga

SEQ ID NO: 19545 - RNA, 26 nt, Human
acuguccuugcucaugccugccucuu

SEQ ID NO: 19546 - RNA, 24 nt, Human
uccagaaaugucuucagaaaguaa

SEQ ID NO: 19547 - RNA, 22 nt, Human
ccuggacaccggaaaaggcgau

SEQ ID NO: 19548 - RNA, 22 nt, Human
uaauucuagagucucuguuacu

SEQ ID NO: 19549 - RNA, 22 nt, Human
ugaagaaauauuuugauugcaa

SEQ ID NO: 19550 - RNA, 22 nt, Human
auuuauuuaucccuucuugccu

SEQ ID NO: 19551 - RNA, 24 nt, Human
ccacuguacuccagccugaagagc

SEQ ID NO: 19552 - RNA, 21 nt, Human
aaccugacuuaagaguuuuca

SEQ ID NO: 19553 - RNA, 22 nt, Human
aaguacauaucuuaauuuugga

SEQ ID NO: 19554 - RNA, 22 nt, Human
gagcucccugcugugugccugc

SEQ ID NO: 19555 - RNA, 25 nt, Human
cacagcucccuccagaagcugcaag

SEQ ID NO: 19556 - RNA, 18 nt, Human
ugcagcucagagugucau

SEQ ID NO: 19557 - RNA, 25 nt, Human
accucuucugccgucucagccuggg

SEQ ID NO: 19558 - RNA, 32 nt, Human
acuggccuccccuggcuccugccuggaagaau

SEQ ID NO: 19559 - RNA, 29 nt, Human
gggaccugccacugcacaccagcccagcu

SEQ ID NO: 19560 - RNA, 27 nt, Human
ucaugccacugcgcccagcuaauuuuu

SEQ ID NO: 19561 - RNA, 24 nt, Human
uggccuauccgcugccagccuuga

SEQ ID NO: 19562 - RNA, 20 nt, Human
ggcuacuguaaaagcgucac

SEQ ID NO: 19563 - RNA, 27 nt, Human
ggcaggcaagagagaggauucagacgc

SEQ ID NO: 19564 - RNA, 27 nt, Human
uugcccaggcuggagugcaguggcgca

SEQ ID NO: 19565 - RNA, 23 nt, Human
agucauuuucuucacauucucau

SEQ ID NO: 19566 - RNA, 22 nt, Human
agaggaggagagggaggcugca

SEQ ID NO: 19567 - RNA, 23 nt, Human
gcacagccagauccuauaggaau

SEQ ID NO: 19568 - RNA, 23 nt, Human
uucacaccgcugcacucaagcuu

SEQ ID NO: 19569 - RNA, 24 nt, Human
uaacccacagugguaccaugagau

SEQ ID NO: 19570 - RNA, 27 nt, Human
cucugcaggagucugcaggucacccgg

SEQ ID NO: 19571 - RNA, 22 nt, Human
ggugguugcguacuaugagcac

SEQ ID NO: 19572 - RNA, 24 nt, Human
guaguggaacaggagaaucugggc

SEQ ID NO: 19573 - RNA, 22 nt, Human
uggcacacgccuguaaucucag

SEQ ID NO: 19574 - RNA, 32 nt, Human
gggcuauuauuuccugaacuggaugucccuaa

SEQ ID NO: 19575 - RNA, 27 nt, Human
uccuaaccuggccacaguugggggagg

SEQ ID NO: 19576 - RNA, 25 nt, Human
cuguuggguuuucuuguugaucuca

SEQ ID NO: 19577 - RNA, 22 nt, Human
uuuucucccuuuuaauccuggc

SEQ ID NO: 19578 - RNA, 24 nt, Human
ucccugacuggagcuaaaucccac

SEQ ID NO: 19579 - RNA, 23 nt, Human
cugucccaggagcaaaugcugga

SEQ ID NO: 19580 - RNA, 21 nt, Human
caccucccgggcucaagcgau

SEQ ID NO: 19581 - RNA, 21 nt, Human
uuaggauaagagggcugcuau

SEQ ID NO: 19582 - RNA, 25 nt, Human
aacgugguauuuaaagguaauauuu

SEQ ID NO: 19583 - RNA, 22 nt, Human
acagaaaccugguuuucuuggc

SEQ ID NO: 19584 - RNA, 27 nt, Human
ugcccaggcuggaguucagcggugcaa

SEQ ID NO: 19585 - RNA, 22 nt, Human
guccucugucuuugaggcuggu

SEQ ID NO: 19586 - RNA, 22 nt, Human
uccuguagucccagcacucugg

SEQ ID NO: 19587 - RNA, 22 nt, Human
auaaaguguggucagaggcccc

SEQ ID NO: 19588 - RNA, 25 nt, Human
gcuggccuccgccugggucaugggc

SEQ ID NO: 19589 - RNA, 27 nt, Human
cuuagguagcugguuguacaucuuucc

SEQ ID NO: 19590 - RNA, 27 nt, Human
ccauuucuccuuuccuuccucccaucc

SEQ ID NO: 19591 - RNA, 24 nt, Human
cacgaugcccagacuuggagcaag

SEQ ID NO: 19592 - RNA, 28 nt, Human
gcaaacugccuuuuccacacaaaggcug

SEQ ID NO: 19593 - RNA, 26 nt, Human
ccuccgccuccuggguucaagcaagu

SEQ ID NO: 19594 - RNA, 22 nt, Human
augucccuugugcauugagugc

SEQ ID NO: 19595 - RNA, 23 nt, Human
caagagaguagccucuccaguuu

SEQ ID NO: 19596 - RNA, 22 nt, Human
guugcccaggcuggagugcaga

SEQ ID NO: 19597 - RNA, 21 nt, Human
agaaauuccauguuuugcgca

SEQ ID NO: 19598 - RNA, 20 nt, Human
uuuucaguuucuccccauga

SEQ ID NO: 19599 - RNA, 22 nt, Human
gaacuccuggcuucaagcaguc

SEQ ID NO: 19600 - RNA, 20 nt, Human
ccugggguuugcaaguuguu

SEQ ID NO: 19601 - RNA, 21 nt, Human
gcucagcgcccagccugggga

SEQ ID NO: 19602 - RNA, 21 nt, Human
uuuuaauuuucaauguuuugu

SEQ ID NO: 19603 - RNA, 22 nt, Human
aggcugaggcaggagaauggca

SEQ ID NO: 19604 - RNA, 22 nt, Human
aggcuaaggcaggagaauggcg

SEQ ID NO: 19605 - RNA, 23 nt, Human
guuagaaaguuuucacccaggga

SEQ ID NO: 19606 - RNA, 22 nt, Human
gucaccaaggcuuagugcagug

SEQ ID NO: 19607 - RNA, 20 nt, Human
acuauauuacaucauuucag

SEQ ID NO: 19608 - RNA, 20 nt, Human
uugaaaaguauacacaaaaa

SEQ ID NO: 19609 - RNA, 31 nt, Human
cuccugcuccgggggcagaccagacucugac

SEQ ID NO: 19610 - RNA, 22 nt, Human
gcacguugugcacugaccuuug

SEQ ID NO: 19611 - RNA, 19 nt, Human
guagagacuuggccuccca

SEQ ID NO: 19612 - RNA, 21 nt, Human
ccgaggagggagcuugcggug

SEQ ID NO: 19613 - RNA, 27 nt, Human
ugccuaggaugccagaccagaguugag

SEQ ID NO: 19614 - RNA, 18 nt, Human
cccuuugagagguggcuc

SEQ ID NO: 19615 - RNA, 20 nt, Human
auuauuauacugcuauuuuu

SEQ ID NO: 19616 - RNA, 27 nt, Human
cucaacgcacuucgcggaccucagccc

SEQ ID NO: 19617 - RNA, 22 nt, Human
guugcccaggcuggggugcagu

SEQ ID NO: 19618 - RNA, 21 nt, Human
aggagguugagaaugcaguga

SEQ ID NO: 19619 - RNA, 28 nt, Human
ccaccuccagccugggagauagccuugc

SEQ ID NO: 19620 - RNA, 22 nt, Human
accagcacauuucuccuguuua

SEQ ID NO: 19621 - RNA, 26 nt, Human
cguccucgggacuccucgcucccacc

SEQ ID NO: 19622 - RNA, 25 nt, Human
uugcuuccugggaagaucuuugcaa

SEQ ID NO: 19623 - RNA, 21 nt, Human
aaggaugaaauaaucacucau

SEQ ID NO: 19624 - RNA, 27 nt, Human
caggagacagcacaccaccaggcucca

SEQ ID NO: 19625 - RNA, 23 nt, Human
aagccugcccuccuuugccuuca

SEQ ID NO: 19626 - RNA, 26 nt, Human
gccaggauucuaaauagacggcccag

SEQ ID NO: 19627 - RNA, 27 nt, Human
ccagcacuuuuucauggcuuuuagguu

SEQ ID NO: 19628 - RNA, 21 nt, Human
gggccugggcaggagggaggu

SEQ ID NO: 19629 - RNA, 26 nt, Human
cacagcuguagugggguucuaggcau

SEQ ID NO: 19630 - RNA, 26 nt, Human
uaguaaaaagauucucugcgagcaac

SEQ ID NO: 19631 - RNA, 28 nt, Human
ucucccacugcuaaugacauacccgaga

SEQ ID NO: 19632 - RNA, 27 nt, Human
gcagccagugucucccaucagugccuu

SEQ ID NO: 19633 - RNA, 29 nt, Human
gugugauagucaccaugccaugcagggau

SEQ ID NO: 19634 - RNA, 27 nt, Human
ugauuuauuuaaagagccguugaugcc

SEQ ID NO: 19635 - RNA, 24 nt, Human
gggucagucuggcucgagcuguuu

SEQ ID NO: 19636 - RNA, 22 nt, Human
ccaaaguacugggauuacaggc

SEQ ID NO: 19637 - RNA, 21 nt, Human
uauacuuuaguagacauuuau

SEQ ID NO: 19638 - RNA, 20 nt, Human
cugagccuagugggugggac

SEQ ID NO: 19639 - RNA, 21 nt, Human
ccucugcugcuuuccuuccuu

SEQ ID NO: 19640 - RNA, 24 nt, Human
cugcugcugcugcugcugcugcug

SEQ ID NO: 19641 - RNA, 25 nt, Human
aagcgagugucugacgaccacccau

SEQ ID NO: 19642 - RNA, 27 nt, Human
gucguuuuuguuccaagaaugauauga

SEQ ID NO: 19643 - RNA, 23 nt, Human
aggagcagagguggccgccgugg

SEQ ID NO: 19644 - RNA, 24 nt, Human
ccaggacugacuuccuccccacac

SEQ ID NO: 19645 - RNA, 25 nt, Human
cugucuugucuguguguauauuguu

SEQ ID NO: 19646 - RNA, 22 nt, Human
ucuuacaaaaauauauuuugga

SEQ ID NO: 19647 - RNA, 20 nt, Human
cccaucaauacacaggauuu

SEQ ID NO: 19648 - RNA, 28 nt, Human
ggaccccuggagccagaggguuuucuaa

SEQ ID NO: 19649 - RNA, 19 nt, Human
ccauuucucaucuuaauua

SEQ ID NO: 19650 - RNA, 27 nt, Human
cagcccugcaacuugacccagguaggg

SEQ ID NO: 19651 - RNA, 22 nt, Human
ccugcagcuccacaaacugacc

SEQ ID NO: 19652 - RNA, 30 nt, Human
gcuucagugagccaugaucaugccacugca

SEQ ID NO: 19653 - RNA, 22 nt, Human
uguucugacccucugugcacug

SEQ ID NO: 19654 - RNA, 27 nt, Human
gagaaucacuuggaccugggaggcaga

SEQ ID NO: 19655 - RNA, 21 nt, Human
cuggguggcagggggugggug

SEQ ID NO: 19656 - RNA, 20 nt, Human
uaguguccugggacauggua

SEQ ID NO: 19657 - RNA, 22 nt, Human
uuuauuucucagccugcccuug

SEQ ID NO: 19658 - RNA, 26 nt, Human
ccacuugggcaggaggcagggagggg

SEQ ID NO: 19659 - RNA, 26 nt, Human
ggugcugccugugacucugaacagca

SEQ ID NO: 19660 - RNA, 23 nt, Human
gcaguguggauaauguuuaguuc

SEQ ID NO: 19661 - RNA, 22 nt, Human
gcccccgcggcuggaggguggu

SEQ ID NO: 19662 - RNA, 23 nt, Human
cccggccaccagcccccugcccc

SEQ ID NO: 19663 - RNA, 19 nt, Human
cccaggcuggagugcagua

SEQ ID NO: 19664 - RNA, 21 nt, Human
uucucauuuucaaugcacauu

SEQ ID NO: 19665 - RNA, 19 nt, Human
cccaggcuggggugcagug

SEQ ID NO: 19666 - RNA, 28 nt, Human
gcucuugaauuccugggcucaagcaguc

SEQ ID NO: 19667 - RNA, 26 nt, Human
cccuccagccagagacagaggaugug

SEQ ID NO: 19668 - RNA, 22 nt, Human
uagucuguuuucuaaagccagg

SEQ ID NO: 19669 - RNA, 26 nt, Human
gaagcauuucugauacuuucugucaa

SEQ ID NO: 19670 - RNA, 19 nt, Human
gcgccuggcagaccccaga

SEQ ID NO: 19671 - RNA, 20 nt, Human
acucgagagggggagggggu

SEQ ID NO: 19672 - RNA, 19 nt, Human
ggggaaucuggugaagggu

SEQ ID NO: 19673 - RNA, 22 nt, Human
acuuagguuucaggaaguugcc

SEQ ID NO: 19674 - RNA, 27 nt, Human
cugggaggcugaggcgggcagaucacc

SEQ ID NO: 19675 - RNA, 26 nt, Human
ucgcccaggcuggagugcaauggcgu

SEQ ID NO: 19676 - RNA, 22 nt, Human
ugggaccugguucucuccaucg

SEQ ID NO: 19677 - RNA, 23 nt, Human
ugcugggacacugagcaggaggg

SEQ ID NO: 19678 - RNA, 27 nt, Human
ggagagggagagacggagccccagaag

SEQ ID NO: 19679 - RNA, 20 nt, Human
cccacucugucgagccuggg

SEQ ID NO: 19680 - RNA, 23 nt, Human
caggaaagggagacaaagacugg

SEQ ID NO: 19681 - RNA, 22 nt, Human
uguccuggcuaccagcucucac

SEQ ID NO: 19682 - RNA, 22 nt, Human
gagugagacuucuggagccagc

SEQ ID NO: 19683 - RNA, 22 nt, Human
ccccgcccuccaucucaccuca

SEQ ID NO: 19684 - RNA, 22 nt, Human
auccuuccauuucuucugcaca

SEQ ID NO: 19685 - RNA, 22 nt, Human
uagucccagaaauaaacugaga

SEQ ID NO: 19686 - RNA, 26 nt, Human
gagcuggaccaacacaauucucucca

SEQ ID NO: 19687 - RNA, 21 nt, Human
guggagggacuccugggacag

SEQ ID NO: 19688 - RNA, 21 nt, Human
acccccacccaccuagccgcc

SEQ ID NO: 19689 - RNA, 26 nt, Human
ugcugccugccuucuugccaugucua

SEQ ID NO: 19690 - RNA, 21 nt, Human
aguaagccucuccccuccaga

SEQ ID NO: 19691 - RNA, 28 nt, Human
cugcagaggggaccucagccugucacug

SEQ ID NO: 19692 - RNA, 21 nt, Human
ugcuccaaaccaacauggagu

SEQ ID NO: 19693 - RNA, 22 nt, Human
cagguuucuuaaaaacagcugu

SEQ ID NO: 19694 - RNA, 27 nt, Human
ggaggcugaggcacgagauuccuugaa

SEQ ID NO: 19695 - RNA, 25 nt, Human
cagagucuuaugggaucuucacuuc

SEQ ID NO: 19696 - RNA, 28 nt, Human
ccuugucuuauuccacuaguuuauuccu

SEQ ID NO: 19697 - RNA, 21 nt, Human
gcagcgugcuagcacacugcc

SEQ ID NO: 19698 - RNA, 22 nt, Human
uagucaggggcucaggagcaga

SEQ ID NO: 19699 - RNA, 21 nt, Human
ucggcgcucgcccaccucuuc

SEQ ID NO: 19700 - RNA, 23 nt, Human
ccaccucuccuuuggccauucca

SEQ ID NO: 19701 - RNA, 23 nt, Human
ccacuccagagauggggcugcuu

SEQ ID NO: 19702 - RNA, 24 nt, Human
ugcuauccugaaaauucuguaggu

SEQ ID NO: 19703 - RNA, 21 nt, Human
cacacaguccccagacucagc

SEQ ID NO: 19704 - RNA, 21 nt, Human
cccagccuccaccuccugugu

SEQ ID NO: 19705 - RNA, 22 nt, Human
uauaugaggauguauguguaua

SEQ ID NO: 19706 - RNA, 22 nt, Human
gccuguaaucccagcacuuuaa

SEQ ID NO: 19707 - RNA, 22 nt, Human
gccuguaaucccgacacuuugg

SEQ ID NO: 19708 - RNA, 22 nt, Human
ggacauggcugacuuugccaac

SEQ ID NO: 19709 - RNA, 19 nt, Human
ucucaauaaacaauguaca

SEQ ID NO: 19710 - RNA, 20 nt, Human
gcacacaggugcacagacca

SEQ ID NO: 19711 - RNA, 26 nt, Human
ccgcagcgcuugcccugcgccaggga

SEQ ID NO: 19712 - RNA, 21 nt, Human
gggcccagggugcuguuggug

SEQ ID NO: 19713 - RNA, 26 nt, Human
caguccugcaaccuggauuuucugcc

SEQ ID NO: 19714 - RNA, 22 nt, Human
agucccacucuggagcacuguc

SEQ ID NO: 19715 - RNA, 22 nt, Human
gguaaauguaaagaguguggga

SEQ ID NO: 19716 - RNA, 24 nt, Human
ggucacacagagauacgcaaacac

SEQ ID NO: 19717 - RNA, 27 nt, Human
gcugccuucccccugccccaccucucc

SEQ ID NO: 19718 - RNA, 19 nt, Human
aaagaaagaagccagaaaa

SEQ ID NO: 19719 - RNA, 22 nt, Human
auuucuuaaacuaaacaggaaa

SEQ ID NO: 19720 - RNA, 20 nt, Human
aaaauacagaaauuagccgg

SEQ ID NO: 19721 - RNA, 23 nt, Human
uuaguaaagugcuuauuuuugua

SEQ ID NO: 19722 - RNA, 21 nt, Human
ugcccugcggaguugcacucu

SEQ ID NO: 19723 - RNA, 26 nt, Human
gucaucuguggauccauccagaacag

SEQ ID NO: 19724 - RNA, 21 nt, Human
ccaaagugcauuugccuagga

SEQ ID NO: 19725 - RNA, 21 nt, Human
cgagacuccgguguacaaucc

SEQ ID NO: 19726 - RNA, 24 nt, Human
ugagacaagagggacaagugggga

SEQ ID NO: 19727 - RNA, 20 nt, Human
ggucggagagagcacuucua

SEQ ID NO: 19728 - RNA, 27 nt, Human
agcuaacuuucuucuugucuagcuauu

SEQ ID NO: 19729 - RNA, 23 nt, Human
acaauuucaaaaugcaugugauu

SEQ ID NO: 19730 - RNA, 22 nt, Human
uugggauuuuaaaaacaugaga

SEQ ID NO: 19731 - RNA, 23 nt, Human
cagaagaguaagaggaucaagac

SEQ ID NO: 19732 - RNA, 20 nt, Human
auggaucaccauuauauuuu

SEQ ID NO: 19733 - RNA, 21 nt, Human
gugcaaccucugccucccagg

SEQ ID NO: 19734 - RNA, 26 nt, Human
guguuuucacaccuuucuccaaggau

SEQ ID NO: 19735 - RNA, 20 nt, Human
aaaguguccagugacaggga

SEQ ID NO: 19736 - RNA, 22 nt, Human
aaacccaguaaaacagauucua

SEQ ID NO: 19737 - RNA, 24 nt, Human
uggaauuuuaagugucuguggaaa

SEQ ID NO: 19738 - RNA, 24 nt, Human
ggcugaggugggaggaucgguuga

SEQ ID NO: 19739 - RNA, 21 nt, Human
gaggcuuaagcaacuucuucc

SEQ ID NO: 19740 - RNA, 24 nt, Human
uugggaauauuaggugauccuguu

SEQ ID NO: 19741 - RNA, 17 nt, Human
uugccucucccuuuguc

SEQ ID NO: 19742 - RNA, 18 nt, Human
ggagccccuucaaacuuc

SEQ ID NO: 19743 - RNA, 22 nt, Human
aaacaccagcugcucccccuca

SEQ ID NO: 19744 - RNA, 21 nt, Human
gacuucuguuugucuuacgcu

SEQ ID NO: 19745 - RNA, 23 nt, Human
cuccagccucacagaugcuggcc

SEQ ID NO: 19746 - RNA, 25 nt, Human
agggagcauguuucacaguggcugg

SEQ ID NO: 19747 - RNA, 26 nt, Human
uuuguuucucugggcgguuguggcag

SEQ ID NO: 19748 - RNA, 22 nt, Human
ucuaauauuaucuuagaaaaau

SEQ ID NO: 19749 - RNA, 23 nt, Human
cuuaaaaagcaaaauaaacuugg

SEQ ID NO: 19750 - RNA, 23 nt, Human
agccccauggcaccugcccagcc

SEQ ID NO: 19751 - RNA, 21 nt, Human
gcgcugggcuggugugcagug

SEQ ID NO: 19752 - RNA, 23 nt, Human
cagggccuuguugaacagaucca

SEQ ID NO: 19753 - RNA, 22 nt, Human
uucagccucccaaagugcaggg

SEQ ID NO: 19754 - RNA, 20 nt, Human
uggccagccuggggcacuga

SEQ ID NO: 19755 - RNA, 27 nt, Human
gaggaagacgccgaggccugggccaug

SEQ ID NO: 19756 - RNA, 20 nt, Human
cacccaggcugcagugcaau

SEQ ID NO: 19757 - RNA, 22 nt, Human
gagcccagagccuccugccaca

SEQ ID NO: 19758 - RNA, 21 nt, Human
uuauaauugaugagcaagaca

SEQ ID NO: 19759 - RNA, 25 nt, Human
uuuauuucucacuguauuuuccuca

SEQ ID NO: 19760 - RNA, 22 nt, Human
caccugcaaucccagcacuuug

SEQ ID NO: 19761 - RNA, 25 nt, Human
augucacccaccccuugucaagcau

SEQ ID NO: 19762 - RNA, 26 nt, Human
gcugggugggauugggggcugggccc

SEQ ID NO: 19763 - RNA, 22 nt, Human
aggcgggcggaucaugagguua

SEQ ID NO: 19764 - RNA, 21 nt, Human
ccugcccucaggagccccgga

SEQ ID NO: 19765 - RNA, 22 nt, Human
ucccugggccuuccauccuuca

SEQ ID NO: 19766 - RNA, 27 nt, Human
uacugcacugccuggcucagcugcacg

SEQ ID NO: 19767 - RNA, 22 nt, Human
agcccagcccugucaguguugu

SEQ ID NO: 19768 - RNA, 21 nt, Human
gaagggagaacccccaauaaa

SEQ ID NO: 19769 - RNA, 26 nt, Human
gguccacucucacaggcuccguuaag

SEQ ID NO: 19770 - RNA, 22 nt, Human
agccugagccccucccucccag

SEQ ID NO: 19771 - RNA, 25 nt, Human
ggggugagaggaugugaguggccgg

SEQ ID NO: 19772 - RNA, 23 nt, Human
gggaggaggggguagaggaaagg

SEQ ID NO: 19773 - RNA, 24 nt, Human
gaggcuggaccacacaggagaagc

SEQ ID NO: 19774 - RNA, 24 nt, Human
gggucaucuguaccucugccuccu

SEQ ID NO: 19775 - RNA, 27 nt, Human
caaaacaaucccgacaaucccuuaucc

SEQ ID NO: 19776 - RNA, 26 nt, Human
gcuuggauaugaaacuguagagggag

SEQ ID NO: 19777 - RNA, 23 nt, Human
gguuuuggaagucccuagcaagc

SEQ ID NO: 19778 - RNA, 26 nt, Human
cuuccacuucuaugcaaaugccucca

SEQ ID NO: 19779 - RNA, 19 nt, Human
gccagccuccuccuggacc

SEQ ID NO: 19780 - RNA, 28 nt, Human
auucuucccacggauccaaaggcuguac

SEQ ID NO: 19781 - RNA, 20 nt, Human
cugagccuggguagcggcgc

SEQ ID NO: 19782 - RNA, 17 nt, Human
cagacccuguuuucaug

SEQ ID NO: 19783 - RNA, 23 nt, Human
gggggauguuacaacaccaugcu

SEQ ID NO: 19784 - RNA, 24 nt, Human
ucuaggaacuguugguagguuucu

SEQ ID NO: 19785 - RNA, 26 nt, Human
ccaucuuucucccucggggagacgac

SEQ ID NO: 19786 - RNA, 24 nt, Human
gugcugacccacauggucaagacc

SEQ ID NO: 19787 - RNA, 21 nt, Human
ggacuggcagucuacuucuac

SEQ ID NO: 19788 - RNA, 21 nt, Human
cagggcgaauggggcccaggg

SEQ ID NO: 19789 - RNA, 21 nt, Human
caggucacagcucauugucca

SEQ ID NO: 19790 - RNA, 20 nt, Human
caacuccacacccuagcccu

SEQ ID NO: 19791 - RNA, 26 nt, Human
ugagauggguggacaggaggaaggac

SEQ ID NO: 19792 - RNA, 21 nt, Human
aagcaguucuggauggugugc

SEQ ID NO: 19793 - RNA, 24 nt, Human
agaacguggcgaaaccccguaucu

SEQ ID NO: 19794 - RNA, 19 nt, Human
uuguaaguauaugggccua

SEQ ID NO: 19795 - RNA, 23 nt, Human
ugacuuggaauugugugcugcuu

SEQ ID NO: 19796 - RNA, 22 nt, Human
cuuauucuagcacagugccuug

SEQ ID NO: 19797 - RNA, 22 nt, Human
uuggccaaggaacaacugaguc

SEQ ID NO: 19798 - RNA, 26 nt, Human
ugggcagcugucccuugcuugccugc

SEQ ID NO: 19799 - RNA, 20 nt, Human
cacagccccugcagggaaag

SEQ ID NO: 19800 - RNA, 22 nt, Human
uaucgcccaggcuggagugcaa

SEQ ID NO: 19801 - RNA, 28 nt, Human
ugugcugaauuccugggccuccugcaga

SEQ ID NO: 19802 - RNA, 24 nt, Human
cuucucuccugcuuccuccaggga

SEQ ID NO: 19803 - RNA, 23 nt, Human
aaggaggagaacuugggagccag

SEQ ID NO: 19804 - RNA, 21 nt, Human
ccaaaacaaucccgacaaucc

SEQ ID NO: 19805 - RNA, 25 nt, Human
cacuggguccagccuugaucaguga

SEQ ID NO: 19806 - RNA, 22 nt, Human
caggaggugcugcuuucuguga

SEQ ID NO: 19807 - RNA, 19 nt, Human
aacauuuuugcuuucucca

SEQ ID NO: 19808 - RNA, 27 nt, Human
auucucccugcauccuuguccuugcag

SEQ ID NO: 19809 - RNA, 24 nt, Human
ccagaagcagcugguggcgccuga

SEQ ID NO: 19810 - RNA, 22 nt, Human
gccccccaggauggauaugaga

SEQ ID NO: 19811 - RNA, 21 nt, Human
gggcucuucuuggcagagggg

SEQ ID NO: 19812 - RNA, 26 nt, Human
gcagguccuaaauggcauuguuugaa

SEQ ID NO: 19813 - RNA, 21 nt, Human
agucaggccaaaacugagaug

SEQ ID NO: 19814 - RNA, 22 nt, Human
gggugaauuguuuuuguccuca

SEQ ID NO: 19815 - RNA, 22 nt, Human
uacugcccaggcuggaauccaa

SEQ ID NO: 19816 - RNA, 26 nt, Human
auuauugcuguugcuugaauagcaau

SEQ ID NO: 19817 - RNA, 19 nt, Human
uagucccagcuuucucugg

SEQ ID NO: 19818 - RNA, 21 nt, Human
caguaucccucuuagcauuaa

SEQ ID NO: 19819 - RNA, 18 nt, Human
ugacuuaauucuuucuaa

SEQ ID NO: 19820 - RNA, 24 nt, Human
cagugcaaaccacuucuccaugcu

SEQ ID NO: 19821 - RNA, 25 nt, Human
ggguggggaaggggcugggagccag

SEQ ID NO: 19822 - RNA, 27 nt, Human
aaccugccugugcaugaccugaucauu

SEQ ID NO: 19823 - RNA, 29 nt, Human
ccuuuggcuuccuguugacuucuucccga

SEQ ID NO: 19824 - RNA, 25 nt, Human
agagagaggggaagggggucucaua

SEQ ID NO: 19825 - RNA, 23 nt, Human
cucagguuugcuuccccugugcc

SEQ ID NO: 19826 - RNA, 21 nt, Human
ugagcacagagugccucuuac

SEQ ID NO: 19827 - RNA, 23 nt, Human
uuuucuuuuauuuuucuaaugag

SEQ ID NO: 19828 - RNA, 21 nt, Human
uacagugcucacugcauuuaa

SEQ ID NO: 19829 - RNA, 30 nt, Human
cacgagggaguugggacaggaggauugaug

SEQ ID NO: 19830 - RNA, 16 nt, Human
cuucccuucuuaaaca

SEQ ID NO: 19831 - RNA, 20 nt, Human
uguuucuacaguuugcagug

SEQ ID NO: 19832 - RNA, 20 nt, Human
ccaccaucuccucugugcca

SEQ ID NO: 19833 - RNA, 24 nt, Human
agccuagaucugaugggggaagcc

SEQ ID NO: 19834 - RNA, 22 nt, Human
ccgaguagcugagacuucaggu

SEQ ID NO: 19835 - RNA, 16 nt, Human
acugaaaaaugcuguu

SEQ ID NO: 19836 - RNA, 21 nt, Human
aacacaaagcuccaccaggag

SEQ ID NO: 19837 - RNA, 28 nt, Human
gggagggaaggagagggagggugggugg

SEQ ID NO: 19838 - RNA, 25 nt, Human
gaagaacaaaauaugaugagaggug

SEQ ID NO: 19839 - RNA, 23 nt, Human
aggaagccuuugcuacuccauca

SEQ ID NO: 19840 - RNA, 25 nt, Human
gcguugagccacuaagcagaggacc

SEQ ID NO: 19841 - RNA, 27 nt, Human
cucugcucuccugaaucuugggcaugc

SEQ ID NO: 19842 - RNA, 24 nt, Human
gcccucccccuccucucggugcag

SEQ ID NO: 19843 - RNA, 20 nt, Human
uuuucucauucaagaaggca

SEQ ID NO: 19844 - RNA, 25 nt, Human
cuucugcuuuccacuccaauucaca

SEQ ID NO: 19845 - RNA, 18 nt, Human
guuuaaaaauauuuacug

SEQ ID NO: 19846 - RNA, 27 nt, Human
ccccaaaauauugaaguucaucugaaa

SEQ ID NO: 19847 - RNA, 26 nt, Human
uucaacaaacagggagaauccagugu

SEQ ID NO: 19848 - RNA, 23 nt, Human
uaguccuggccagacccugcugc

SEQ ID NO: 19849 - RNA, 24 nt, Human
ugcagcuccguuuggcagugcaau

SEQ ID NO: 19850 - RNA, 21 nt, Human
agggaugagagggagggagaa

SEQ ID NO: 19851 - RNA, 23 nt, Human
gcugaacccacaaaaaucuaaau

SEQ ID NO: 19852 - RNA, 26 nt, Human
ggcaggcagcggcgccgucucccggu

SEQ ID NO: 19853 - RNA, 27 nt, Human
ugcuguugcugccacuuggauggggac

SEQ ID NO: 19854 - RNA, 21 nt, Human
cucauuucccagcccucuucu

SEQ ID NO: 19855 - RNA, 24 nt, Human
cugucgcccaugcuggagugcagu

SEQ ID NO: 19856 - RNA, 24 nt, Human
uaucugaauuuugcagcugcagaa

SEQ ID NO: 19857 - RNA, 28 nt, Human
uugauuccugaucaucagaaauuucacc

SEQ ID NO: 19858 - RNA, 18 nt, Human
gcugcuucuccucuuguu

SEQ ID NO: 19859 - RNA, 20 nt, Human
gcggguuuuaauuuauuuca

SEQ ID NO: 19860 - RNA, 28 nt, Human
ccguguucugucugugucuucaggaguc

SEQ ID NO: 19861 - RNA, 22 nt, Human
aaaaggagggagggacuuugaa

SEQ ID NO: 19862 - RNA, 22 nt, Human
aaaaugcuggcauuacaggugu

SEQ ID NO: 19863 - RNA, 25 nt, Human
ccgccccaccacacacauauuuuua

SEQ ID NO: 19864 - RNA, 22 nt, Human
ccugagcagcugggauuacagg

SEQ ID NO: 19865 - RNA, 20 nt, Human
uauuuauguauaugcacaua

SEQ ID NO: 19866 - RNA, 25 nt, Human
agccuccuccuggaccucuuggccc

SEQ ID NO: 19867 - RNA, 24 nt, Human
gccaggcccaagggacaaaaagaa

SEQ ID NO: 19868 - RNA, 25 nt, Human
ucuggguuuuuucuacacugucaau

SEQ ID NO: 19869 - RNA, 21 nt, Human
gcugaacugcagugacuuuua

SEQ ID NO: 19870 - RNA, 26 nt, Human
acagaaggaugucccggguguguaca

SEQ ID NO: 19871 - RNA, 21 nt, Human
uguacagcacugcauucucug

SEQ ID NO: 19872 - RNA, 27 nt, Human
auccagacuggaggccgacugcccugg

SEQ ID NO: 19873 - RNA, 26 nt, Human
gcaggcaggaacaaacagggcugccu

SEQ ID NO: 19874 - RNA, 22 nt, Human
agucacuuguuugaaaauaaau

SEQ ID NO: 19875 - RNA, 19 nt, Human
gcaacaacagauucucuug

SEQ ID NO: 19876 - RNA, 29 nt, Human
ugcagcugaaauugguggggaguucaaua

SEQ ID NO: 19877 - RNA, 25 nt, Human
ccaacacuuuuuccauuucuucaga

SEQ ID NO: 19878 - RNA, 23 nt, Human
uguuacuuagaaaaucauaagga

SEQ ID NO: 19879 - RNA, 20 nt, Human
ugcucucaaacugcaucuuu

SEQ ID NO: 19880 - RNA, 20 nt, Human
uugguuguggcuucaaggga

SEQ ID NO: 19881 - RNA, 27 nt, Human
uucucucugaacacacauugcuauucc

SEQ ID NO: 19882 - RNA, 23 nt, Human
cgccucugccgggagggagggag

SEQ ID NO: 19883 - RNA, 24 nt, Human
agaaacauuguauauuuugcaaaa

SEQ ID NO: 19884 - RNA, 23 nt, Human
gucgccuaggcuggagugcagug

SEQ ID NO: 19885 - RNA, 21 nt, Human
aguaugggcuacacagcagcu

SEQ ID NO: 19886 - RNA, 25 nt, Human
ggaaggggaagaacaggacuccagg

SEQ ID NO: 19887 - RNA, 26 nt, Human
aaguacugggauuacagcuuccauga

SEQ ID NO: 19888 - RNA, 21 nt, Human
ccuggcaccgagcgaugagga

SEQ ID NO: 19889 - RNA, 23 nt, Human
cucccaccuccuuccccccacca

SEQ ID NO: 19890 - RNA, 17 nt, Human
uugugugcccugugcca

SEQ ID NO: 19891 - RNA, 25 nt, Human
aauggcagcagaaaacuugugugaa

SEQ ID NO: 19892 - RNA, 22 nt, Human
gcucacugcaaccuccgccucc

SEQ ID NO: 19893 - RNA, 23 nt, Human
uauuuuguuuuaguaugaaaauc

SEQ ID NO: 19894 - RNA, 25 nt, Human
gauuguucuacuauuacaguguaaa

SEQ ID NO: 19895 - RNA, 24 nt, Human
ucaaauuacugaagaucucaucau

SEQ ID NO: 19896 - RNA, 19 nt, Human
gccgugagcugagauugcg

SEQ ID NO: 19897 - RNA, 21 nt, Human
gaaagcuggggguggggaggg

SEQ ID NO: 19898 - RNA, 22 nt, Human
cccugcuccagaaggugccggu

SEQ ID NO: 19899 - RNA, 20 nt, Human
cagaaagcauuuucugcaaa

SEQ ID NO: 19900 - RNA, 19 nt, Human
ccauggucagacuguacaa

SEQ ID NO: 19901 - RNA, 27 nt, Human
aagacuugccugcgauguggucucugc

SEQ ID NO: 19902 - RNA, 27 nt, Human
cuuucugcauucuucucuccacaugcc

SEQ ID NO: 19903 - RNA, 27 nt, Human
gagaugcagagaaauguggaauuugug

SEQ ID NO: 19904 - RNA, 22 nt, Human
gccccaggaaaccccaucaguc

SEQ ID NO: 19905 - RNA, 22 nt, Human
aaucuguuucuuuuuccuuuuc

SEQ ID NO: 19906 - RNA, 27 nt, Human
gcugccucuggaggugccuuuggccac

SEQ ID NO: 19907 - RNA, 25 nt, Human
uugcccaaggugacagauaggguaa

SEQ ID NO: 19908 - RNA, 21 nt, Human
cucagccacuuucagccuuau

SEQ ID NO: 19909 - RNA, 25 nt, Human
accuaggcuggagugcagcggcaug

SEQ ID NO: 19910 - RNA, 22 nt, Human
uccgcccaggcugggugcaguc

SEQ ID NO: 19911 - RNA, 22 nt, Human
uggucucaaacuccuagguuca

SEQ ID NO: 19912 - RNA, 27 nt, Human
ggggucugagucucugcuggcuaagcc

SEQ ID NO: 19913 - RNA, 23 nt, Human
ggucuagcuggccacugcuggag

SEQ ID NO: 19914 - RNA, 24 nt, Human
ucugccuggccaccugccuggacc

SEQ ID NO: 19915 - RNA, 22 nt, Human
caacacagugagacuccaucuc

SEQ ID NO: 19916 - RNA, 22 nt, Human
ucaugccacaucacuccaaccu

SEQ ID NO: 19917 - RNA, 24 nt, Human
gcagaaggcuaggaauuuuagcag

SEQ ID NO: 19918 - RNA, 19 nt, Human
gcugucuggaccagugggg

SEQ ID NO: 19919 - RNA, 19 nt, Human
gacuacaggcgccugccag

SEQ ID NO: 19920 - RNA, 20 nt, Human
ccauucuucuuugugagaca

SEQ ID NO: 19921 - RNA, 20 nt, Human
uagaauuacagcaguuucaa

SEQ ID NO: 19922 - RNA, 20 nt, Human
cugguuuucgcuuuccuccg

SEQ ID NO: 19923 - RNA, 23 nt, Human
guggagcuuccccagggagccag

SEQ ID NO: 19924 - RNA, 22 nt, Human
cccuggaacaggaacucgccug

SEQ ID NO: 19925 - RNA, 26 nt, Human
uggcugaagaggcaggauggcuuggg

SEQ ID NO: 19926 - RNA, 25 nt, Human
uggagguaagagagaaaaugaaaga

SEQ ID NO: 19927 - RNA, 20 nt, Human
ugcagcuccugcggcaccau

SEQ ID NO: 19928 - RNA, 24 nt, Human
ccugcugcugugcccagucugagu

SEQ ID NO: 19929 - RNA, 22 nt, Human
aguccccagaacucugccugcc

SEQ ID NO: 19930 - RNA, 21 nt, Human
cccaaauccugcucuggacuc

SEQ ID NO: 19931 - RNA, 22 nt, Human
augagagggcccugccugcugc

SEQ ID NO: 19932 - RNA, 22 nt, Human
agacauguccccguggcugugg

SEQ ID NO: 19933 - RNA, 24 nt, Human
aacaaaacccacacacaacaaaac

SEQ ID NO: 19934 - RNA, 24 nt, Human
cagcucuucaaggaagugggcugc

SEQ ID NO: 19935 - RNA, 27 nt, Human
ugggaggugggguuuugccauguugcc

SEQ ID NO: 19936 - RNA, 23 nt, Human
ccuggguuuggaagggggaugca

SEQ ID NO: 19937 - RNA, 22 nt, Human
cgaggcucugagucucagguca

SEQ ID NO: 19938 - RNA, 25 nt, Human
uggucucaaaagucaccugccuaca

SEQ ID NO: 19939 - RNA, 20 nt, Human
gccccaggcauauacaagcu

SEQ ID NO: 19940 - RNA, 25 nt, Human
ucucaggaaccucaggcccugcuug

SEQ ID NO: 19941 - RNA, 23 nt, Human
uguuggccaggcugguggugagc

SEQ ID NO: 19942 - RNA, 26 nt, Human
gaugggaggaaaagcccaggagaagu

SEQ ID NO: 19943 - RNA, 32 nt, Human; identical to SEQ ID NO: 7574

SEQ ID NO: 19944 - RNA, 29 nt, Human
cccuuauuccuccaaggcugugugcccac

SEQ ID NO: 19945 - RNA, 22 nt, Human
ccuccagugcccaccugccuca

SEQ ID NO: 19946 - RNA, 22 nt, Human
ccagagcugccuaugcccagcc

SEQ ID NO: 19947 - RNA, 28 nt, Human
uacuguuugccucaaacgcuguguuuaa

SEQ ID NO: 19948 - RNA, 21 nt, Human
uucgcacacauuaauuagggu

SEQ ID NO: 19949 - RNA, 22 nt, Human
ccuguaaucccauguacucugg

SEQ ID NO: 19950 - RNA, 20 nt, Human
gucuuccucuuguuuacgac

SEQ ID NO: 19951 - RNA, 22 nt, Human
aaucaguuuuuugauagcuuuu

SEQ ID NO: 19952 - RNA, 19 nt, Human
gugauaauggaccaaccuc

SEQ ID NO: 19953 - RNA, 23 nt, Human
cucaggccggcugugaacguagu

SEQ ID NO: 19954 - RNA, 25 nt, Human
cuuccacacuuccacccccagcucc

SEQ ID NO: 19955 - RNA, 24 nt, Human
agcuucauuaaagaacauguuuua

SEQ ID NO: 19956 - RNA, 27 nt, Human
uggagaaauguuuuuccuucaagaaaa

SEQ ID NO: 19957 - RNA, 21 nt, Human
ccaaacacugaguccucuguc

SEQ ID NO: 19958 - RNA, 25 nt, Human
ugcauccauucuauuuuuaacuucc

SEQ ID NO: 19959 - RNA, 22 nt, Human
ugcccaggcuggcgugcagugg

SEQ ID NO: 19960 - RNA, 22 nt, Human
gauuaaccguuuuacucuaacu

SEQ ID NO: 19961 - RNA, 23 nt, Human
auauuuuagggccagggauuauu

SEQ ID NO: 19962 - RNA, 19 nt, Human
uuagugguauuauuacaag

SEQ ID NO: 19963 - RNA, 25 nt, Human
gugagcuuggagguucuaugugcca

SEQ ID NO: 19964 - RNA, 20 nt, Human
ccugacucauuaauaaugga

SEQ ID NO: 19965 - RNA, 19 nt, Human
cuuuuuaaaaaacuuucua

SEQ ID NO: 19966 - RNA, 28 nt, Human
ggggugggaggccccacccuucuccccu

SEQ ID NO: 19967 - RNA, 21 nt, Human
gaaugugauuuuucugcacua

SEQ ID NO: 19968 - RNA, 20 nt, Human
agagacaguauuuugcugaa

SEQ ID NO: 19969 - RNA, 23 nt, Human
acaaucacaguucacugcagccu

SEQ ID NO: 19970 - RNA, 18 nt, Human
uugccuaggcuggagugc

SEQ ID NO: 19971 - RNA, 24 nt, Human
ccuuucucucuuguccaauggggc

SEQ ID NO: 19972 - RNA, 21 nt, Human
ucacacaucaaaccaccaaga

SEQ ID NO: 19973 - RNA, 27 nt, Human
ugaccaagagcaggcuuccugcuccau

SEQ ID NO: 19974 - RNA, 20 nt, Human
cauggcagaagaaugggaau

SEQ ID NO: 19975 - RNA, 19 nt, Human
gaaaaacaaaaguuugcuu

SEQ ID NO: 19976 - RNA, 28 nt, Human
ggaccagcuucagcuuucggacucuggu

SEQ ID NO: 19977 - RNA, 26 nt, Human
accugcaugcucagacuucuuguggc

SEQ ID NO: 19978 - RNA, 22 nt, Human
cguggccaagagaaacuuccua

SEQ ID NO: 19979 - RNA, 21 nt, Human
cuacaucuuguuuucuaggaa

SEQ ID NO: 19980 - RNA, 20 nt, Human
acuaguucuuauaauuuauc

SEQ ID NO: 19981 - RNA, 20 nt, Human
uauaagugcgggcaccaagg

SEQ ID NO: 19982 - RNA, 24 nt, Human
ugaccucauaaccuaauggccuug

SEQ ID NO: 19983 - RNA, 26 nt, Human
aaaacaaugcaaaaccuuugagguag

SEQ ID NO: 19984 - RNA, 19 nt, Human
uucuuuauauugucauugu

SEQ ID NO: 19985 - RNA, 25 nt, Human
ggcagagaugccucccugagcuaga

SEQ ID NO: 19986 - RNA, 22 nt, Human
caggcccaggaaccaaugcuac

SEQ ID NO: 19987 - RNA, 22 nt, Human
gccaaaacccagccaucgggga

SEQ ID NO: 19988 - RNA, 22 nt, Human
gggaagguggagcaagaaauga

SEQ ID NO: 19989 - RNA, 21 nt, Human
ccucucugggggcugagggac

SEQ ID NO: 19990 - RNA, 20 nt, Human
uggguguuucccugccuugu

SEQ ID NO: 19991 - RNA, 23 nt, Human
cuagagaccucuguaguccuggg

SEQ ID NO: 19992 - RNA, 22 nt, Human
gggugguugugccagccugccu

SEQ ID NO: 19993 - RNA, 27 nt, Human
gcugggccucugguucugacacuuucu

SEQ ID NO: 19994 - RNA, 23 nt, Human
aggcuggagugcaacggcacgau

SEQ ID NO: 19995 - RNA, 27 nt, Human
ucaugccagcuauaaucuccccugccu

SEQ ID NO: 19996 - RNA, 27 nt, Human
uccuccaggaacugcaggucaaguugu

SEQ ID NO: 19997 - RNA, 22 nt, Human
ccccaggcuuggggcaauuggu

SEQ ID NO: 19998 - RNA, 24 nt, Human
ccugcagcugguuacaagaaugug

SEQ ID NO: 19999 - RNA, 23 nt, Human
cacugccuaacuguguacagugu

SEQ ID NO: 20000 - RNA, 22 nt, Human
uccggcccucgccuccucccuc

SEQ ID NO: 20001 - RNA, 26 nt, Human
uugcccaggcggacgggagggaggca

SEQ ID NO: 20002 - RNA, 21 nt, Human
ggcccugcuucuucccauuga

SEQ ID NO: 20003 - RNA, 27 nt, Human
uggucucaauaaaaugcuaacuugcca

SEQ ID NO: 20004 - RNA, 21 nt, Human
cuguaacuucuuaaucuaaga

SEQ ID NO: 20005 - RNA, 19 nt, Human
uugccuccucuuuuuuggu

SEQ ID NO: 20006 - RNA, 21 nt, Human
cuuagaauaaaagauguagca

SEQ ID NO: 20007 - RNA, 22 nt, Human
agcauuuucaguaauuccuaca

SEQ ID NO: 20008 - RNA, 24 nt, Human
aaacucaucacauaaagaaauuca

SEQ ID NO: 20009 - RNA, 21 nt, Human
acacauuuacuugaauaguac

SEQ ID NO: 20010 - RNA, 23 nt, Human
aaccguaugaauguagagaaucu

SEQ ID NO: 20011 - RNA, 21 nt, Human
gggguccucgcucaggcacag

SEQ ID NO: 20012 - RNA, 27 nt, Human
gagguccucaggucagcugggagccag

SEQ ID NO: 20013 - RNA, 20 nt, Human
cagugguuggcuuugaugaa

SEQ ID NO: 20014 - RNA, 23 nt, Human
cauucccccaccuauccccauuc

SEQ ID NO: 20015 - RNA, 24 nt, Human
ccccugccagcauccucgugggcu

SEQ ID NO: 20016 - RNA, 20 nt, Human
ucccugccaccccucucucc

SEQ ID NO: 20017 - RNA, 24 nt, Human
cccagccucagccugcgccugagc

SEQ ID NO: 20018 - RNA, 22 nt, Human
gaggcuggauacggugcaguga

SEQ ID NO: 20019 - RNA, 22 nt, Human
uuucccuuaagaaucaaaagca

SEQ ID NO: 20020 - RNA, 18 nt, Human
uuauuuuuagagucuucu

SEQ ID NO: 20021 - RNA, 22 nt, Human
acagcucuggccacaacagggc

SEQ ID NO: 20022 - RNA, 22 nt, Human
cauuuauacuuauuaucccagu

SEQ ID NO: 20023 - RNA, 27 nt, Human
acuauugcugcuuucucuucuacuucu

SEQ ID NO: 20024 - RNA, 27 nt, Human
cucagucgcccaggcuggagugcagca

SEQ ID NO: 20025 - RNA, 23 nt, Human
ugggcuuucuggaauccaaacca

SEQ ID NO: 20026 - RNA, 27 nt, Human
ccacggcuucccucuuggcucauucca

SEQ ID NO: 20027 - RNA, 22 nt, Human
cauuuccucucaaaccuuaucc

SEQ ID NO: 20028 - RNA, 22 nt, Human
cacagcacagagaagacaaaau

SEQ ID NO: 20029 - RNA, 19 nt, Human
cacucugucuucuuugcua

SEQ ID NO: 20030 - RNA, 22 nt, Human
guggaaagguacuaugugucca

SEQ ID NO: 20031 - RNA, 21 nt, Human
ucuccccuagcucaccaggcc

SEQ ID NO: 20032 - RNA, 20 nt, Human
ugcagagcagagaugccuuc

SEQ ID NO: 20033 - RNA, 25 nt, Human
ugaccucaugcaucuccaccugcuc

SEQ ID NO: 20034 - RNA, 21 nt, Human
gagggccccaggagaggcaga

SEQ ID NO: 20035 - RNA, 27 nt, Human
ugcacacacgugcagauaugcuguccg

SEQ ID NO: 20036 - RNA, 22 nt, Human
augauggccacaacaugaaaac

SEQ ID NO: 20037 - RNA, 22 nt, Human
cagcccaggaggggcagguucc

SEQ ID NO: 20038 - RNA, 21 nt, Human
guaaccuccauuaaauuuggu

SEQ ID NO: 20039 - RNA, 22 nt, Human
ccaaguagcugggucuacaggu

SEQ ID NO: 20040 - RNA, 28 nt, Human
ggcacuuuucacacucugucuuaaaauc

SEQ ID NO: 20041 - RNA, 30 nt, Human
gcgccguuguacuccagccugggcaacaga

SEQ ID NO: 20042 - RNA, 21 nt, Human
uaugugaaaaauuaacuuuuu

SEQ ID NO: 20043 - RNA, 27 nt, Human
cucaguaauuucaaaauacagauuuga

SEQ ID NO: 20044 - RNA, 23 nt, Human
uaguaaaauauuaccuguuuuca

SEQ ID NO: 20045 - RNA, 23 nt, Human
ccacagccacagagucaggcucu

SEQ ID NO: 20046 - RNA, 27 nt, Human
cuguggcugcuggcugaggguucugcu

SEQ ID NO: 20047 - RNA, 24 nt, Human
aaagaacaccagagaucagaaauu

SEQ ID NO: 20048 - RNA, 20 nt, Human
ggcccaggcuggagugcagu

SEQ ID NO: 20049 - RNA, 22 nt, Human
agccucccaaguagcugggagc

SEQ ID NO: 20050 - RNA, 22 nt, Human
cgucacugcacuccagcuuggg

SEQ ID NO: 20051 - RNA, 22 nt, Human
acuuuccacccccucccuggcc

SEQ ID NO: 20052 - RNA, 23 nt, Human
gcagaaaagaagucacaagaaaa

SEQ ID NO: 20053 - RNA, 21 nt, Human
cacaucuggcuuucucagcca

SEQ ID NO: 20054 - RNA, 26 nt, Human
cauggcagaaggcaaagcaaaggcag

SEQ ID NO: 20055 - RNA, 23 nt, Human
guuggggcacugggcgucugacu

SEQ ID NO: 20056 - RNA, 19 nt, Human
cccaggaggcccugcaguu

SEQ ID NO: 20057 - RNA, 28 nt, Human
agcaaggaugauucagcacugccccuca

SEQ ID NO: 20058 - RNA, 22 nt, Human
uccucuuggaagcaagaucgcu

SEQ ID NO: 20059 - RNA, 21 nt, Human
uucaaccuccuagugucuguu

SEQ ID NO: 20060 - RNA, 26 nt, Human
gaccccaauccccaaccucccaggac

SEQ ID NO: 20061 - RNA, 22 nt, Human
uguagcccagucuggagugcag

SEQ ID NO: 20062 - RNA, 23 nt, Human
aagucacugcaaaaccagguuuu

SEQ ID NO: 20063 - RNA, 21 nt, Human
ugagagcugccuccuggaagc

SEQ ID NO: 20064 - RNA, 24 nt, Human
ugcauccacaucuguaggcauauu

SEQ ID NO: 20065 - RNA, 24 nt, Human
aaggaccuguuuggggcagcaggg

SEQ ID NO: 20066 - RNA, 25 nt, Human
ugcauacuuaccuagugaaacuuuu

SEQ ID NO: 20067 - RNA, 29 nt, Human
ucuccucacaugggugucugugguucucu

SEQ ID NO: 20068 - RNA, 25 nt, Human
uucucacugccacugcucuugccuc

SEQ ID NO: 20069 - RNA, 23 nt, Human
agcugggacccggggugucggag

SEQ ID NO: 20070 - RNA, 25 nt, Human
acuuagggcaucuccugcugccuuc

SEQ ID NO: 20071 - RNA, 22 nt, Human
ggccuucagggcucagagcagc

SEQ ID NO: 20072 - RNA, 29 nt, Human
gucuugcaagcagccuccugggcagucgu

SEQ ID NO: 20073 - RNA, 22 nt, Human
gcugggguuuguugugauggcc

SEQ ID NO: 20074 - RNA, 26 nt, Human
cugugcucucccuccuuuccucuccc

SEQ ID NO: 20075 - RNA, 24 nt, Human
uaaucagcuguugcaggcaguguc

SEQ ID NO: 20076 - RNA, 28 nt, Human
cggagcagcagagucugcagcagcagca

SEQ ID NO: 20077 - RNA, 22 nt, Human
gagggagggaauagaaaggggc

SEQ ID NO: 20078 - RNA, 22 nt, Human
auugaggucaggagcucaagac

SEQ ID NO: 20079 - RNA, 19 nt, Human
gacauuuucacagcccuuc

SEQ ID NO: 20080 - RNA, 21 nt, Human
guggaggagggaggaggguga

SEQ ID NO: 20081 - RNA, 24 nt, Human
ggccacuuggaaguuuaggguaga

SEQ ID NO: 20082 - RNA, 28 nt, Human
ccggacaugcaggugaauauuuuaauag

SEQ ID NO: 20083 - RNA, 21 nt, Human
caagcuagcucuggccugugu

SEQ ID NO: 20084 - RNA, 27 nt, Human
cagcguaacuacccuaaaagcauauca

SEQ ID NO: 20085 - RNA, 22 nt, Human
ggaagggaaugaaacauuuaug

SEQ ID NO: 20086 - RNA, 25 nt, Human
ccauugcauuuaaguucccuaggag

SEQ ID NO: 20087 - RNA, 21 nt, Human
ucagaaguauguuggugggaa

SEQ ID NO: 20088 - RNA, 19 nt, Human
gggaggcagcagacaggga

SEQ ID NO: 20089 - RNA, 21 nt, Human
ugucuauauggagaaagcaca

SEQ ID NO: 20090 - RNA, 22 nt, Human
cacaaguaaucccaagcaacau

SEQ ID NO: 20091 - RNA, 20 nt, Human
cugguuggaugucauccccc

SEQ ID NO: 20092 - RNA, 21 nt, Human
guuauuuuucugucaucaaac

SEQ ID NO: 20093 - RNA, 19 nt, Human
gugucucucuccuggucau

SEQ ID NO: 20094 - RNA, 23 nt, Human
gcuagugcuguugagaagggggu

SEQ ID NO: 20095 - RNA, 22 nt, Human
ggccuccucuucaucuuggcac

SEQ ID NO: 20096 - RNA, 25 nt, Human
gccuuggccuccagccuggagaagg

SEQ ID NO: 20097 - RNA, 25 nt, Human
cgagucugcuuucugugccuaguug

SEQ ID NO: 20098 - RNA, 25 nt, Human
agcaggacuaggcaugucagaggac

SEQ ID NO: 20099 - RNA, 22 nt, Human
uucccugagcuuuggugcaucu

SEQ ID NO: 20100 - RNA, 27 nt, Human
ccucuccuucuuagcuaucauugcuuc

SEQ ID NO: 20101 - RNA, 23 nt, Human
cagugauuaguugaacagcacau

SEQ ID NO: 20102 - RNA, 22 nt, Human
ucuccccggcuggagugcagug

SEQ ID NO: 20103 - RNA, 26 nt, Human
ggugagcacucuggggugggaggguc

SEQ ID NO: 20104 - RNA, 22 nt, Human
acgaucauggcucacugcagcc

SEQ ID NO: 20105 - RNA, 22 nt, Human
gcgaucauagcucacugcagcc

SEQ ID NO: 20106 - RNA, 26 nt, Human
ccuccaccuccuggguuuaagcaaug

SEQ ID NO: 20107 - RNA, 18 nt, Human
gcaccuugucauguacca

SEQ ID NO: 20108 - RNA, 26 nt, Human
aggcagcaggaagcagggugaagaau

SEQ ID NO: 20109 - RNA, 22 nt, Human
cuuuuggugagaacauccccuu

SEQ ID NO: 20110 - RNA, 25 nt, Human
aacauaguuuauuuuuacacugucu

SEQ ID NO: 20111 - RNA, 21 nt, Human
guuuaacaggagugcagaggg

SEQ ID NO: 20112 - RNA, 19 nt, Human
uucucucucuacauguuca

SEQ ID NO: 20113 - RNA, 24 nt, Human
agaaauuuauuacuuguugcaaag

SEQ ID NO: 20114 - RNA, 21 nt, Human
ugcccugcucugaagccuuga

SEQ ID NO: 20115 - RNA, 21 nt, Human
cccaccccucacagacugccu

SEQ ID NO: 20116 - RNA, 25 nt, Human
cucucaucuccuggaaccauggcca

SEQ ID NO: 20117 - RNA, 29 nt, Human
acaucccgcuucugaagcugcugcagcuc

SEQ ID NO: 20118 - RNA, 27 nt, Human
ccuuccaggaauuccuuguugacaaca

SEQ ID NO: 20119 - RNA, 20 nt, Human
uagccagacagccagccugc

SEQ ID NO: 20120 - RNA, 22 nt, Human
ucuuccacuccuucucucacug

SEQ ID NO: 20121 - RNA, 21 nt, Human
guugcccaggcugguuucgaa

SEQ ID NO: 20122 - RNA, 27 nt, Human
cgcagccgcccgccugcaacgugcacu

SEQ ID NO: 20123 - RNA, 21 nt, Human
cuggcccaggcuagagugcag

SEQ ID NO: 20124 - RNA, 27 nt, Human
ugccuguaauuccagcugcuugggagc

SEQ ID NO: 20125 - RNA, 24 nt, Human
agcccuuccuccuucccucaccac

SEQ ID NO: 20126 - RNA, 23 nt, Human
cgaguagcugggacuacaggcau

SEQ ID NO: 20127 - RNA, 21 nt, Human
agccuuacuugaaucuugccu

SEQ ID NO: 20128 - RNA, 25 nt, Human
uuugcuguggcuggagcuggacagu

SEQ ID NO: 20129 - RNA, 22 nt, Human
cuuaccucucagccuuagcucu

SEQ ID NO: 20130 - RNA, 21 nt, Human
gagggaggaguaaaacugggc

SEQ ID NO: 20131 - RNA, 20 nt, Human
aaucacugcaccucuuuguc

SEQ ID NO: 20132 - RNA, 23 nt, Human
caguucugagugaguucugagcc

SEQ ID NO: 20133 - RNA, 21 nt, Human
caggugauucuccugccucag

SEQ ID NO: 20134 - RNA, 25 nt, Human
gccacugggaccagcaggugaagcg

SEQ ID NO: 20135 - RNA, 21 nt, Human
gaagggaagaaaggcugaguc

SEQ ID NO: 20136 - RNA, 26 nt, Human
guauuuucaccaagccuuuucauaau

SEQ ID NO: 20137 - RNA, 19 nt, Human
cuucagcaaaaauauuuua

SEQ ID NO: 20138 - RNA, 25 nt, Human
cagcugggagccugcuuucugccag

SEQ ID NO: 20139 - RNA, 21 nt, Human
gccucuccccuuuaccccucc

SEQ ID NO: 20140 - RNA, 19 nt, Human
gguuuaauagauccuggcc

SEQ ID NO: 20141 - RNA, 23 nt, Human
agauggugccacugcacucuaac

SEQ ID NO: 20142 - RNA, 27 nt, Human
ucgcccaggcuggagcgcagucccgca

SEQ ID NO: 20143 - RNA, 26 nt, Human
agaguuuuaaaccccaggaacagaga

SEQ ID NO: 20144 - RNA, 26 nt, Human
gagaggcauggagaagaaacucucau

SEQ ID NO: 20145 - RNA, 31 nt, Human
ucugggacugagcaugaggccauagacagau

SEQ ID NO: 20146 - RNA, 27 nt, Human
ccucucgggggcgggcucccggcgcua

SEQ ID NO: 20147 - RNA, 22 nt, Human
ugccacugcacuccggccuagg

SEQ ID NO: 20148 - RNA, 23 nt, Human
ugcuccuucauuuuacuacuucu

SEQ ID NO: 20149 - RNA, 29 nt, Human
uacuuuucacucacuuugcaccuuucccu

SEQ ID NO: 20150 - RNA, 20 nt, Human
acuugggaauauaaaggagg

SEQ ID NO: 20151 - RNA, 27 nt, Human
cuguuuggaaauggggagcuggccuag

SEQ ID NO: 20152 - RNA, 21 nt, Human
ucaggcaauuagacacuuugg

SEQ ID NO: 20153 - RNA, 21 nt, Human
auucagucugcuuuuggauuu

SEQ ID NO: 20154 - RNA, 26 nt, Human
ugccgggguguccuggaaucugugcc

SEQ ID NO: 20155 - RNA, 22 nt, Human
gccccucccuuugcccuucacg

SEQ ID NO: 20156 - RNA, 21 nt, Human
ggcgcugaggggaaaggaagc

SEQ ID NO: 20157 - RNA, 22 nt, Human
uauuuaagguagcuucagcuag

SEQ ID NO: 20158 - RNA, 22 nt, Human
uaaaaaguuuuaguuuugauga

SEQ ID NO: 20159 - RNA, 27 nt, Human
gcuggaaggaaggagccagcgugcaaa

SEQ ID NO: 20160 - RNA, 21 nt, Human
ugguaccauuucacaccagca

SEQ ID NO: 20161 - RNA, 23 nt, Human
acagggccaccaggagugcgugg

SEQ ID NO: 20162 - RNA, 28 nt, Human
ggaauacuugguuucuuuucuuacuuau

SEQ ID NO: 20163 - RNA, 23 nt, Human
cggcugggagacagcgagccaga

SEQ ID NO: 20164 - RNA, 27 nt, Human
ggagagggcggcgaagaggacccgcag

SEQ ID NO: 20165 - RNA, 15 nt, Human
cuucccuuaucccca

SEQ ID NO: 20166 - RNA, 25 nt, Human
ccacuugggcucuguuuucucagcu

SEQ ID NO: 20167 - RNA, 20 nt, Human
gaguccuugaaaauauuuuu

SEQ ID NO: 20168 - RNA, 23 nt, Human
aggggugugauggggcagaggaa

SEQ ID NO: 20169 - RNA, 23 nt, Human
uagcuauccuuggcuuucugugc

SEQ ID NO: 20170 - RNA, 24 nt, Human
caggcagcuucugugguucagcuu

SEQ ID NO: 20171 - RNA, 24 nt, Human
gcaaucucuuccacacaugugcag

SEQ ID NO: 20172 - RNA, 20 nt, Human
caggaaggaagaggguugug

SEQ ID NO: 20173 - RNA, 27 nt, Human
ucuaggcccucaccucaaaccuugcca

SEQ ID NO: 20174 - RNA, 26 nt, Human
cacuucggucucccaaagugcuggga

SEQ ID NO: 20175 - RNA, 22 nt, Human
cgucccaaccaugggcugcugc

SEQ ID NO: 20176 - RNA, 22 nt, Human
uuccucucccaccaugcgauga

SEQ ID NO: 20177 - RNA, 22 nt, Human
aaaaucaaaguuucagcaaugg

SEQ ID NO: 20178 - RNA, 20 nt, Human
ucugccuggcguuucacuug

SEQ ID NO: 20179 - RNA, 21 nt, Human
aauaggauuagaaaaggauug

SEQ ID NO: 20180 - RNA, 22 nt, Human
ggaagcaggaagaaaugcucau

SEQ ID NO: 20181 - RNA, 22 nt, Human
guggcuucaguucucaugcugc

SEQ ID NO: 20182 - RNA, 25 nt, Human
uuuuccucuggccgcagagguguag

SEQ ID NO: 20183 - RNA, 23 nt, Human
agcaggaggaacuuucaaaaguc

SEQ ID NO: 20184 - RNA, 24 nt, Human
gggcuggggcgcagagggagcccg

SEQ ID NO: 20185 - RNA, 22 nt, Human
ucacauggguggucacagggag

SEQ ID NO: 20186 - RNA, 22 nt, Human
guggccuuuuuuauaacuaagg

SEQ ID NO: 20187 - RNA, 23 nt, Human
gguauuguacucgggaggcugag

SEQ ID NO: 20188 - RNA, 22 nt, Human
aaaguacugggauuacaagcau

SEQ ID NO: 20189 - RNA, 27 nt, Human
ccguuccccuccccgcucuucuuccaa

SEQ ID NO: 20190 - RNA, 20 nt, Human
uucuagcccuguaucuguca

SEQ ID NO: 20191 - RNA, 21 nt, Human
ccacaguuuuaguuggugcug

SEQ ID NO: 20192 - RNA, 23 nt, Human
ccuucuccuccagcacugugcca

SEQ ID NO: 20193 - RNA, 25 nt, Human
cacccagcaauagcuguacauugua

SEQ ID NO: 20194 - RNA, 25 nt, Human
auacacaggcuaucaacauguuauu

SEQ ID NO: 20195 - RNA, 22 nt, Human
gcccaagcuggagugcaauggc

SEQ ID NO: 20196 - RNA, 21 nt, Human
uaagaaaauauuuugucuaaa

SEQ ID NO: 20197 - RNA, 27 nt, Human
acuccuaucauuuucugaauuacuugg

SEQ ID NO: 20198 - RNA, 25 nt, Human
ccugcccgccugccccuccugccga

SEQ ID NO: 20199 - RNA, 23 nt, Human
agagaauacucauuuuuguccag

SEQ ID NO: 20200 - RNA, 22 nt, Human
uguggaaagaggagcugggacc

SEQ ID NO: 20201 - RNA, 23 nt, Human
agccuuuuucacaagggaacuca

SEQ ID NO: 20202 - RNA, 22 nt, Human
auggaaagggcuaugugggaga

SEQ ID NO: 20203 - RNA, 20 nt, Human
gugagaauugagccaaggaa

SEQ ID NO: 20204 - RNA, 24 nt, Human
agagaaggcagcaggcggccuuug

SEQ ID NO: 20205 - RNA, 24 nt, Human
ugcugcccucucuggugccugugg

SEQ ID NO: 20206 - RNA, 30 nt, Human
uuuuguauuuguuuucugugagagcacuga

SEQ ID NO: 20207 - RNA, 21 nt, Human
ccucagauccugucauugccu

SEQ ID NO: 20208 - RNA, 23 nt, Human
ccuaccagaguuuuuaaucuuua

SEQ ID NO: 20209 - RNA, 28 nt, Human
aaugcagccggagccucaguccccagca

SEQ ID NO: 20210 - RNA, 23 nt, Human
augacaucacugcacucagacca

SEQ ID NO: 20211 - RNA, 21 nt, Human
agacaggucugagugccugaa

SEQ ID NO: 20212 - RNA, 22 nt, Human
uauugcacuccagucuggguaa

SEQ ID NO: 20213 - RNA, 21 nt, Human
accauuugguauucagucaca

SEQ ID NO: 20214 - RNA, 23 nt, Human
gagcgcggcccucaggagcaagg

SEQ ID NO: 20215 - RNA, 25 nt, Human
gagccugucucucccuacccucuuc

SEQ ID NO: 20216 - RNA, 24 nt, Human
ggagcagcccugcccagggggcau

SEQ ID NO: 20217 - RNA, 22 nt, Human
aaaagauucugggguuacuuga

SEQ ID NO: 20218 - RNA, 22 nt, Human
ugccacuucugccuccagauca

SEQ ID NO: 20219 - RNA, 21 nt, Human
accuguaaucccagcgcuuug

SEQ ID NO: 20220 - RNA, 21 nt, Human
accuguagucccagcacuuug

SEQ ID NO: 20221 - RNA, 22 nt, Human
gcuuccgugugggucagugggg

SEQ ID NO: 20222 - RNA, 18 nt, Human
uagaaugacaaacauuag

SEQ ID NO: 20223 - RNA, 23 nt, Human
agagggagcgagcgggcggccgg

SEQ ID NO: 20224 - RNA, 19 nt, Human
cagauuauuauguucucag

SEQ ID NO: 20225 - RNA, 22 nt, Human
ccgggaggcagagguaguagug

SEQ ID NO: 20226 - RNA, 23 nt, Human
gguaacacagcuuuaacuauguc

SEQ ID NO: 20227 - RNA, 29 nt, Human
ucauucuuaucuccagccugggaaaaguu

SEQ ID NO: 20228 - RNA, 23 nt, Human
acgggcggcagguugcaguggag

SEQ ID NO: 20229 - RNA, 26 nt, Human
gcccugaccucaggggccagggcacu

SEQ ID NO: 20230 - RNA, 24 nt, Human
cucuucuucaaagcugaccuugcu

SEQ ID NO: 20231 - RNA, 23 nt, Human
ccuuaucagagcuaagggugggu

SEQ ID NO: 20232 - RNA, 23 nt, Human
cccuucuugcuguccccaacaca

SEQ ID NO: 20233 - RNA, 27 nt, Human
uugggaggccagggcaggcagaucauc

SEQ ID NO: 20234 - RNA, 21 nt, Human
uccucuuggagccucaguuuc

SEQ ID NO: 20235 - RNA, 25 nt, Human
acucuauauagcugaucaguuuuuu

SEQ ID NO: 20236 - RNA, 24 nt, Human
cucggaggggagcuugaacuaggg

SEQ ID NO: 20237 - RNA, 23 nt, Human
guccuuguauagacuggaacagu

SEQ ID NO: 20238 - RNA, 25 nt, Human
cuguaaguuaacacaaauguuaacu

SEQ ID NO: 20239 - RNA, 21 nt, Human
cuucugaggcucuccuagcca

SEQ ID NO: 20240 - RNA, 22 nt, Human
gcuggccgguuguucuaugcag

SEQ ID NO: 20241 - RNA, 22 nt, Human
cagaggguacaagcuccagaac

SEQ ID NO: 20242 - RNA, 22 nt, Human
ucuaggagucuguuccccuuga

SEQ ID NO: 20243 - RNA, 25 nt, Human
auggcagaaggagaugcucagggcu

SEQ ID NO: 20244 - RNA, 27 nt, Human
aguuaguauagcuuuauacucucucca

SEQ ID NO: 20245 - RNA, 23 nt, Human
ccagagcugaggaacuguggcac

SEQ ID NO: 20246 - RNA, 24 nt, Human
ccaggucuuaaggaccccaaaguc

SEQ ID NO: 20247 - RNA, 22 nt, Human
uccagagagaagggagugggug

SEQ ID NO: 20248 - RNA, 26 nt, Human
ucaccuuucuguuuucacuuuugcca

SEQ ID NO: 20249 - RNA, 21 nt, Human
auuuagaacccaaauuuugga

SEQ ID NO: 20250 - RNA, 21 nt, Human
cugaggcacgagauuccuuga

SEQ ID NO: 20251 - RNA, 27 nt, Human
ucugucgcccaggcuagaguggauugg

SEQ ID NO: 20252 - RNA, 24 nt, Human
ggggcagaaccauggaggaaaagc

SEQ ID NO: 20253 - RNA, 27 nt, Human
uguggguggaggcuggggugucugcac

SEQ ID NO: 20254 - RNA, 20 nt, Human
ucaagcgaauguuggaacac

SEQ ID NO: 20255 - RNA, 25 nt, Human
cagagggagcgagcgggcggccggc

SEQ ID NO: 20256 - RNA, 22 nt, Human
cacauagcccagucuuccuccu

SEQ ID NO: 20257 - RNA, 23 nt, Human
gacuaauuuuuuguguuuuuugu

SEQ ID NO: 20258 - RNA, 21 nt, Human
cagagcccuggcuggguucag

SEQ ID NO: 20259 - RNA, 23 nt, Human
caggcgucuggucaacuuagcac

SEQ ID NO: 20260 - RNA, 22 nt, Human
gguaaagccauguaagaagaga

SEQ ID NO: 20261 - RNA, 20 nt, Human
ccucgccugccugugucucu

SEQ ID NO: 20262 - RNA, 25 nt, Human
agcccucuccagucuccuuuccuag

SEQ ID NO: 20263 - RNA, 26 nt, Human
gaaaccaguuguucccaaucugccgu

SEQ ID NO: 20264 - RNA, 21 nt, Human
ccagccggccaccaaucccgc

SEQ ID NO: 20265 - RNA, 23 nt, Human
ggauuccucucugucuucuugga

SEQ ID NO: 20266 - RNA, 22 nt, Human
accucauuuucuuuugccugcu

SEQ ID NO: 20267 - RNA, 22 nt, Human
acugcaggucuuacaguggagg

SEQ ID NO: 20268 - RNA, 22 nt, Human
cacugcacuccagccuggggac

SEQ ID NO: 20269 - RNA, 22 nt, Human
uuccagagguauuccucucuua

SEQ ID NO: 20270 - RNA, 22 nt, Human
gaaccacccucccuugcugcac

SEQ ID NO: 20271 - RNA, 21 nt, Human
cuucuucucuuauccuuacuu

SEQ ID NO: 20272 - RNA, 20 nt, Human
augauucuuaacacagccuu

SEQ ID NO: 20273 - RNA, 20 nt, Human
acccccagcuaucgccucuu

SEQ ID NO: 20274 - RNA, 22 nt, Human
ccaucauucacccugagugacg

SEQ ID NO: 20275 - RNA, 28 nt, Human
ccugguaaccacuguucuguuaucuccu

SEQ ID NO: 20276 - RNA, 27 nt, Human
cuucaaaugcugugcagccaucuugcc

SEQ ID NO: 20277 - RNA, 20 nt, Human
uccucugccuacagccaggu

SEQ ID NO: 20278 - RNA, 22 nt, Human
uccuccucuccagcugguaguc

SEQ ID NO: 20279 - RNA, 29 nt, Human
ccugccgggcugagggccugcuggaggcc

SEQ ID NO: 20280 - RNA, 22 nt, Human
agccucccaaguagcugggagu

SEQ ID NO: 20281 - RNA, 21 nt, Human
cucuggcccagugcugcccag

SEQ ID NO: 20282 - RNA, 23 nt, Human
acaaaccauugcuuaugcuguua

SEQ ID NO: 20283 - RNA, 24 nt, Human
gggcagggagagaggcuggguugg

SEQ ID NO: 20284 - RNA, 21 nt, Human
uuauucuauguagugguuuua

SEQ ID NO: 20285 - RNA, 22 nt, Human
ccucacugcucucucagucuuc

SEQ ID NO: 20286 - RNA, 24 nt, Human
caaucagaguagagaaguuagagg

SEQ ID NO: 20287 - RNA, 20 nt, Human
uaacauccugcuuugauucc

SEQ ID NO: 20288 - RNA, 23 nt, Human
uuucuuuguuguguguaucuuua

SEQ ID NO: 20289 - RNA, 23 nt, Human
gcaggcucgcuccuuguggggcc

SEQ ID NO: 20290 - RNA, 20 nt, Human
uggaacuaauaaauacauac

SEQ ID NO: 20291 - RNA, 17 nt, Human
uagagggagauggcauc

SEQ ID NO: 20292 - RNA, 17 nt, Human
aaaggagcucacugugg

SEQ ID NO: 20293 - RNA, 22 nt, Human
cugaggcaggagaaucacuuga

SEQ ID NO: 20294 - RNA, 22 nt, Human
cugaggcaagagaaucgcuuga

SEQ ID NO: 20295 - RNA, 22 nt, Human
cugaggcaggaggaucacuuaa

SEQ ID NO: 20296 - RNA, 20 nt, Human
gauuguagacaaugaggggg

SEQ ID NO: 20297 - RNA, 22 nt, Human
uugcccaagcuggagugcaaug

SEQ ID NO: 20298 - RNA, 27 nt, Human
caccaugguuuuucacauugcaaaggg

SEQ ID NO: 20299 - RNA, 21 nt, Human
cccagaaaggaaacugacccu

SEQ ID NO: 20300 - RNA, 19 nt, Human
ccaaguguccauccagaga

SEQ ID NO: 20301 - RNA, 24 nt, Human
ggcugcaccuuuuugcaugauauc

SEQ ID NO: 20302 - RNA, 18 nt, Human
aaguguccuucuugcucc

SEQ ID NO: 20303 - RNA, 21 nt, Human
cagauccuucucucuggagga

SEQ ID NO: 20304 - RNA, 30 nt, Human
ccccaccacccucgagcgggguuccccuca

SEQ ID NO: 20305 - RNA, 23 nt, Human
acugucugucugugucuuuuuuc

SEQ ID NO: 20306 - RNA, 21 nt, Human
gcacugugccuuucaacucca

SEQ ID NO: 20307 - RNA, 22 nt, Human
auaagaaaauucauacugggga

SEQ ID NO: 20308 - RNA, 27 nt, Human
uggggggcgagggugcugaggagcagc

SEQ ID NO: 20309 - RNA, 22 nt, Human
ccugcugagcucugugugauuu

SEQ ID NO: 20310 - RNA, 21 nt, Human
gcagugaguuucuguucuguu

SEQ ID NO: 20311 - RNA, 22 nt, Human
gugccugugaggcaggggcgga

SEQ ID NO: 20312 - RNA, 23 nt, Human
ugggaacaacaaaggcaauggug

SEQ ID NO: 20313 - RNA, 19 nt, Human
uucuaaccucaguaaugca

SEQ ID NO: 20314 - RNA, 27 nt, Human
gucucaaacuccugaccucaagugauc

SEQ ID NO: 20315 - RNA, 23 nt, Human
caauuucuuccuuccacaguuau

SEQ ID NO: 20316 - RNA, 18 nt, Human
uaucagauguaagucauu

SEQ ID NO: 20317 - RNA, 24 nt, Human
gaggguggagggaggccaagcugc

SEQ ID NO: 20318 - RNA, 26 nt, Human
accuccccagcccaggaaaaacugga

SEQ ID NO: 20319 - RNA, 22 nt, Human
cugccuccucagcuuugcuuca

SEQ ID NO: 20320 - RNA, 22 nt, Human
cgcuucuuaacucacccaugug

SEQ ID NO: 20321 - RNA, 26 nt, Human
caugguuggcaucacauaugccugca

SEQ ID NO: 20322 - RNA, 21 nt, Human
ggauuuguuguucugaccugg

SEQ ID NO: 20323 - RNA, 21 nt, Human
ccugggaaggagggagcugcu

SEQ ID NO: 20324 - RNA, 21 nt, Human
cgugguuuggagauggguggg

SEQ ID NO: 20325 - RNA, 22 nt, Human
gaccagccuggccaacguggug

SEQ ID NO: 20326 - RNA, 21 nt, Human
acagucccccagaaacuuagu

SEQ ID NO: 20327 - RNA, 24 nt, Human
aucugugaacugaauucaccacag

SEQ ID NO: 20328 - RNA, 18 nt, Human
ggggccugcaaaugugau

SEQ ID NO: 20329 - RNA, 22 nt, Human
ugcacacaaucugaaaaccacu

SEQ ID NO: 20330 - RNA, 22 nt, Human
uuauaugaacauacaaaugcau

SEQ ID NO: 20331 - RNA, 22 nt, Human
gagaccccggcggcggcggagg

SEQ ID NO: 20332 - RNA, 21 nt, Human
accagccuggccacaugguga

SEQ ID NO: 20333 - RNA, 24 nt, Human
gcuugcccgcucccacagcuuccu

SEQ ID NO: 20334 - RNA, 19 nt, Human
ggagggaggagcaggcuag

SEQ ID NO: 20335 - RNA, 22 nt, Human
ucuaucacccucuucagucacc

SEQ ID NO: 20336 - RNA, 22 nt, Human
uugucagguuggaguguaagug

SEQ ID NO: 20337 - RNA, 26 nt, Human
gucuguaaucucgcagagcacaggca

SEQ ID NO: 20338 - RNA, 23 nt, Human
gggcacuggaugacucuccaggu

SEQ ID NO: 20339 - RNA, 26 nt, Human
gggcagcagggggacugaaggcugga

SEQ ID NO: 20340 - RNA, 22 nt, Human
uguggguggaaugucccaagaa

SEQ ID NO: 20341 - RNA, 24 nt, Human
uccucgggggcgggggagauucug

SEQ ID NO: 20342 - RNA, 22 nt, Human
uugagaccauugcauucuggcu

SEQ ID NO: 20343 - RNA, 23 nt, Human
ccaaguaguuaggacacacaggu

SEQ ID NO: 20344 - RNA, 24 nt, Human
gcccuggacccacuuucucucuca

SEQ ID NO: 20345 - RNA, 23 nt, Human
gagacgggcggaucacgagguca

SEQ ID NO: 20346 - RNA, 22 nt, Human
ccaggagacagaccacuugcca

SEQ ID NO: 20347 - RNA, 22 nt, Human
ugcuuuuaggagaauucacaga

SEQ ID NO: 20348 - RNA, 22 nt, Human
uggccaacauggugaaaccuca

SEQ ID NO: 20349 - RNA, 28 nt, Human
accucugaauuuacuuccuugcaugugg

SEQ ID NO: 20350 - RNA, 20 nt, Human
ucugcucccugccucgccuc

SEQ ID NO: 20351 - RNA, 27 nt, Human
gcugcagcugauccaauacaccaagcc

SEQ ID NO: 20352 - RNA, 23 nt, Human
ugauguucauguuccuggcacua

SEQ ID NO: 20353 - RNA, 26 nt, Human
ccacaccuggcccuguucacggcugu

SEQ ID NO: 20354 - RNA, 22 nt, Human
agagaucuuuuuucacuguaag

SEQ ID NO: 20355 - RNA, 22 nt, Human
aggcugaggcaggcagaucacc

SEQ ID NO: 20356 - RNA, 20 nt, Human
cugcuucuuuccagaaacca

SEQ ID NO: 20357 - RNA, 26 nt, Human
cuggaugaagcucuggccaaccaaag

SEQ ID NO: 20358 - RNA, 24 nt, Human
ugauuccaaagaacuccaccagga

SEQ ID NO: 20359 - RNA, 23 nt, Human
ugaggagagugagcagccuggac

SEQ ID NO: 20360 - RNA, 22 nt, Human
uggggugcgcuuguaaucccag

SEQ ID NO: 20361 - RNA, 20 nt, Human
uucuguacuuccaauuuaua

SEQ ID NO: 20362 - RNA, 24 nt, Human
acauuuuagacuuuguuucucagc

SEQ ID NO: 20363 - RNA, 29 nt, Human
gggggcugagggauggaagggucuaagac

SEQ ID NO: 20364 - RNA, 27 nt, Human
ccacugcacuccagccuaggcaacaga

SEQ ID NO: 20365 - RNA, 24 nt, Human
ggccaagaaauuagaguccucaga

SEQ ID NO: 20366 - RNA, 24 nt, Human
acacuuagugacuaucacagccga

SEQ ID NO: 20367 - RNA, 23 nt, Human
gguuucugauaauguguggaguc

SEQ ID NO: 20368 - RNA, 21 nt, Human
gccaugagcacccauccagga

SEQ ID NO: 20369 - RNA, 26 nt, Human
gagggagggggaagaagagagggugg

SEQ ID NO: 20370 - RNA, 20 nt, Human
uggguaaaacugagacgucc

SEQ ID NO: 20371 - RNA, 27 nt, Human
acucuccuguuuauucaccagacuggg

SEQ ID NO: 20372 - RNA, 22 nt, Human
aggucccaguccaucuccugga

SEQ ID NO: 20373 - RNA, 26 nt, Human
ucaggaggcugaggcaggagaauugc

SEQ ID NO: 20374 - RNA, 26 nt, Human
agacaaguaaucacuaacccguuuua

SEQ ID NO: 20375 - RNA, 22 nt, Human
gcugcuucccacccagcugaga

SEQ ID NO: 20376 - RNA, 25 nt, Human
acaugguccauggugcaacccacag

SEQ ID NO: 20377 - RNA, 23 nt, Human
cuucugccgucucagccugggcg

SEQ ID NO: 20378 - RNA, 26 nt, Human
ggagaauugguugaccuaaauggaac

SEQ ID NO: 20379 - RNA, 26 nt, Human
ggagagaaagggaggcgugccugaga

SEQ ID NO: 20380 - RNA, 24 nt, Human
cucuugggcuggaguaccguggug

SEQ ID NO: 20381 - RNA, 24 nt, Human
uuguacuuaaccauuuucaucuau

SEQ ID NO: 20382 - RNA, 20 nt, Human
cuguccugcucacccuuucc

SEQ ID NO: 20383 - RNA, 22 nt, Human
ugucauugguauuuaaaaauga

SEQ ID NO: 20384 - RNA, 22 nt, Human
cgccuguaaucccagcgcuuug

SEQ ID NO: 20385 - RNA, 26 nt, Human
caagaaugaacuccuuccuggaauac

SEQ ID NO: 20386 - RNA, 26 nt, Human
cucuucagaucccccagcaccggagg

SEQ ID NO: 20387 - RNA, 22 nt, Human
cgccuguagucccagcacuuug

SEQ ID NO: 20388 - RNA, 20 nt, Human
ccagugcuacaccugagguu

SEQ ID NO: 20389 - RNA, 27 nt, Human
cucucucugggaggccauaaaauaagg

SEQ ID NO: 20390 - RNA, 26 nt, Human
gucacccacuccugggugcgugcaga

SEQ ID NO: 20391 - RNA, 22 nt, Human
cucuccccuucuucccucucuc

SEQ ID NO: 20392 - RNA, 25 nt, Human
cacuauggaaaaacaaauauacaaa

SEQ ID NO: 20393 - RNA, 19 nt, Human
guacugccucucaucuaga

SEQ ID NO: 20394 - RNA, 28 nt, Human
uuagguucccaaaccuucaggaaauaua

SEQ ID NO: 20395 - RNA, 24 nt, Human
agugccccaaacagcaauagaaag

SEQ ID NO: 20396 - RNA, 20 nt, Human
gcaaaguuuuaaguuuaccu

SEQ ID NO: 20397 - RNA, 20 nt, Human
gccccugaguccuggcucau

SEQ ID NO: 20398 - RNA, 27 nt, Human
gaccagcuuagccaacauaguaagacc

SEQ ID NO: 20399 - RNA, 22 nt, Human
aacaugauuucaaaaucaguuu

SEQ ID NO: 20400 - RNA, 26 nt, Human
caccuugccccaagcuuuccccucug

SEQ ID NO: 20401 - RNA, 25 nt, Human
ccuccaucuccacccugcugagcca

SEQ ID NO: 20402 - RNA, 20 nt, Human
aaucccauuucugugccucu

SEQ ID NO: 20403 - RNA, 23 nt, Human
aggaccggagacaaguggcagag

SEQ ID NO: 20404 - RNA, 32 nt, Human
uugccuaggcauagcccugccucaagcuaugu

SEQ ID NO: 20405 - RNA, 21 nt, Human
gguccacaccagccugggcaa

SEQ ID NO: 20406 - RNA, 20 nt, Human
auuucugcuuuuuucuaguc

SEQ ID NO: 20407 - RNA, 24 nt, Human
cucuacccucaccuccauccuguc

SEQ ID NO: 20408 - RNA, 19 nt, Human
uguagguccuuggcugguc

SEQ ID NO: 20409 - RNA, 27 nt, Human
cuccaucuucagagccagcugugggua

SEQ ID NO: 20410 - RNA, 22 nt, Human
gggauuacaggccugagccacu

SEQ ID NO: 20411 - RNA, 20 nt, Human
cuggcagccucccuccccac

SEQ ID NO: 20412 - RNA, 26 nt, Human
gggaagccucgcauggccgcuggaag

SEQ ID NO: 20413 - RNA, 28 nt, Human
cugugacuucugaagcuguggauaaauu

SEQ ID NO: 20414 - RNA, 23 nt, Human
gagggggcauggaguaauuugua

SEQ ID NO: 20415 - RNA, 23 nt, Human
cccgcgugacgcuccucucucag

SEQ ID NO: 20416 - RNA, 21 nt, Human
aggucucagcccaggguccuc

SEQ ID NO: 20417 - RNA, 23 nt, Human
uucauucuucucuagcugguggu

SEQ ID NO: 20418 - RNA, 24 nt, Human
ugggaguuuuacagugccauucca

SEQ ID NO: 20419 - RNA, 24 nt, Human
uccggagaagauuucagagcugag

SEQ ID NO: 20420 - RNA, 26 nt, Human
cacccaggcuggagugaucucagcuc

SEQ ID NO: 20421 - RNA, 24 nt, Human
ugggggauuugaggguagaggcag

SEQ ID NO: 20422 - RNA, 21 nt, Human
agcccgggaagcagagguugc

SEQ ID NO: 20423 - RNA, 26 nt, Human
cagggagggggcaggaaagaccaagc

SEQ ID NO: 20424 - RNA, 21 nt, Human
ucaacuuggaaaugacacaga

SEQ ID NO: 20425 - RNA, 26 nt, Human
cuaccaugggcacccaugugcuggca

SEQ ID NO: 20426 - RNA, 27 nt, Human
ggagcagucccagaagggagggcuguc

SEQ ID NO: 20427 - RNA, 25 nt, Human
ccgucuuuuccuguuuccuagcugu

SEQ ID NO: 20428 - RNA, 25 nt, Human
caggcugcuggagugcaguggcaca

SEQ ID NO: 20429 - RNA, 19 nt, Human
agaggguggugaccucugc

SEQ ID NO: 20430 - RNA, 27 nt, Human
cuuuaguuuguuugcugucuggauggc

SEQ ID NO: 20431 - RNA, 25 nt, Human
auuuggcuggguguuuucaaauguc

SEQ ID NO: 20432 - RNA, 22 nt, Human
gaaucucauaggaagagccagg

SEQ ID NO: 20433 - RNA, 23 nt, Human
uugucacaucuucccaagccagg

SEQ ID NO: 20434 - RNA, 27 nt, Human
aacucugcccacccuccuguaccgucg

SEQ ID NO: 20435 - RNA, 29 nt, Human
ggccuauuuucucagcugcccucuugagg

SEQ ID NO: 20436 - RNA, 22 nt, Human
ugaguaauuuuagaagcauuau

SEQ ID NO: 20437 - RNA, 26 nt, Human
guuuuuaauagaagcuuccuccauca

SEQ ID NO: 20438 - RNA, 22 nt, Human
cucggccucccaaagugcuggg

SEQ ID NO: 20439 - RNA, 22 nt, Human
cucagccucccaaagugcuagg

SEQ ID NO: 20440 - RNA, 21 nt, Human
aacuuccuauguucuuucuca

SEQ ID NO: 20441 - RNA, 21 nt, Human
cagaauuacuaugucuuuuga

SEQ ID NO: 20442 - RNA, 24 nt, Human
agcuuuguguagcucgagcuuugu

SEQ ID NO: 20443 - RNA, 22 nt, Human
ugccauugcacuccagccuggg

SEQ ID NO: 20444 - RNA, 22 nt, Human
ugccacugcacucuagccuggg

SEQ ID NO: 20445 - RNA, 22 nt, Human
cgccauuguacuccagccuggg

SEQ ID NO: 20446 - RNA, 22 nt, Human
uuuuaaaauguaaugcuuuuua

SEQ ID NO: 20447 - RNA, 19 nt, Human
uucagcuuuccugagcuga

SEQ ID NO: 20448 - RNA, 22 nt, Human
caggagguuuggcuuggcauga

SEQ ID NO: 20449 - RNA, 26 nt, Human
uacgccaagggcagguuucuggagac

SEQ ID NO: 20450 - RNA, 21 nt, Human
ugucugacacagccagccagu

SEQ ID NO: 20451 - RNA, 19 nt, Human
ccucuuccuucccugcugu

SEQ ID NO: 20452 - RNA, 21 nt, Human
agcuaaauacuuuccucucca

SEQ ID NO: 20453 - RNA, 19 nt, Human
cuacccuuccagugcccua

SEQ ID NO: 20454 - RNA, 22 nt, Human
cguagccgccugcggcgccucc

SEQ ID NO: 20455 - RNA, 24 nt, Human
gaaugauagcauuucacucugcgu

SEQ ID NO: 20456 - RNA, 26 nt, Human
gccuguguccaccuccagucucggcu

SEQ ID NO: 20457 - RNA, 21 nt, Human
guguugauugugccuguugua

SEQ ID NO: 20458 - RNA, 20 nt, Human
cuaaagcagcuucacugguu

SEQ ID NO: 20459 - RNA, 22 nt, Human
gaacuggggaggcagagguugc

SEQ ID NO: 20460 - RNA, 21 nt, Human
uuaagacuuuuauaagacuag

SEQ ID NO: 20461 - RNA, 23 nt, Human
gccuguaauccuagcacuuuugg

SEQ ID NO: 20462 - RNA, 19 nt, Human
caugaucuuacacgaagaa

SEQ ID NO: 20463 - RNA, 21 nt, Human
ccuuggagcuggugugcagug

SEQ ID NO: 20464 - RNA, 26 nt, Human
ucuuucugcuauauuaggccugugug

SEQ ID NO: 20465 - RNA, 26 nt, Human
cagagcccaggcugggcgcccaugcc

SEQ ID NO: 20466 - RNA, 23 nt, Human
gcacaacucccuuaaggucucca

SEQ ID NO: 20467 - RNA, 20 nt, Human
acugauuucuucauucucca

SEQ ID NO: 20468 - RNA, 23 nt, Human
ggugccacaugucucagaucugc

SEQ ID NO: 20469 - RNA, 21 nt, Human
gggggaggagaaagacgcgau

SEQ ID NO: 20470 - RNA, 22 nt, Human
ccuguaaucccagcuacacugg

SEQ ID NO: 20471 - RNA, 20 nt, Human
accaaccuccagugucaggg

SEQ ID NO: 20472 - RNA, 23 nt, Human
uugcccaggcuggaguggagugg

SEQ ID NO: 20473 - RNA, 20 nt, Human
ucuccaucucaccgcuucuu

SEQ ID NO: 20474 - RNA, 26 nt, Human
cuugauacaucacagacucauacaaa

SEQ ID NO: 20475 - RNA, 29 nt, Human
ccucugcaaggagcuuugucccaucgugc

SEQ ID NO: 20476 - RNA, 20 nt, Human
gcagccgcccgcagcugcag

SEQ ID NO: 20477 - RNA, 26 nt, Human
gugccagccacgagacgucaccaaga

SEQ ID NO: 20478 - RNA, 18 nt, Human
ccuugauaagugcauuca

SEQ ID NO: 20479 - RNA, 26 nt, Human
cucugaaaaccaauguucucucuucu

SEQ ID NO: 20480 - RNA, 27 nt, Human
ggagacaccucuucauagacggcaggu

SEQ ID NO: 20481 - RNA, 27 nt, Human
ggguacuucugcucaaguguccaacag

SEQ ID NO: 20482 - RNA, 24 nt, Human
cacuccugcccacgcccacgcagc

SEQ ID NO: 20483 - RNA, 21 nt, Human
uuucuaauguucagcuuucua

SEQ ID NO: 20484 - RNA, 23 nt, Human
acagaaauguuuuuucacuucaa

SEQ ID NO: 20485 - RNA, 28 nt, Human
ugcucuggggcuggaggcuaguaaggaa

SEQ ID NO: 20486 - RNA, 23 nt, Human
agccuccuauccaccacugcuua

SEQ ID NO: 20487 - RNA, 18 nt, Human
uaaaaaccuaggucucca

SEQ ID NO: 20488 - RNA, 24 nt, Human
ggucauuuuuauguaccuuugggu

SEQ ID NO: 20489 - RNA, 23 nt, Human
gagcaagacucugucuaaaaaac

SEQ ID NO: 20490 - RNA, 21 nt, Human
cuucacugcagagccuugccu

SEQ ID NO: 20491 - RNA, 21 nt, Human
acaccgcacaugugucuugag

SEQ ID NO: 20492 - RNA, 20 nt, Human
ucuugccaagccucagucuu

SEQ ID NO: 20493 - RNA, 17 nt, Human
cagcccauuucuccaua

SEQ ID NO: 20494 - RNA, 21 nt, Human
uacugcccugaguugggggga

SEQ ID NO: 20495 - RNA, 24 nt, Human
augccugcugcccugcccucaggc

SEQ ID NO: 20496 - RNA, 19 nt, Human
cugcacccucugcuauguc

SEQ ID NO: 20497 - RNA, 27 nt, Human
uuaguaaauaugauuuuuaaaagcagu

SEQ ID NO: 20498 - RNA, 22 nt, Human
caugucacuagaagcgcaguuu

SEQ ID NO: 20499 - RNA, 27 nt, Human
ccugccuggcaggcugucuggccaggc

SEQ ID NO: 20500 - RNA, 22 nt, Human
gaacuucuguagcagagguugc

SEQ ID NO: 20501 - RNA, 27 nt, Human
uggagagaagggcauuaaccugucugg

SEQ ID NO: 20502 - RNA, 22 nt, Human
ucuguugcccaggcuggagugc

SEQ ID NO: 20503 - RNA, 22 nt, Human
ucugucgcccaggcuggagugu

SEQ ID NO: 20504 - RNA, 26 nt, Human
ccaccucuccuuuuugccauuucacu

SEQ ID NO: 20505 - RNA, 25 nt, Human
ggauucauggcuuaugcuuguuuca

SEQ ID NO: 20506 - RNA, 22 nt, Human
ucuucucagguuaaagcuguau

SEQ ID NO: 20507 - RNA, 19 nt, Human
ugcacccggagagcugugu

SEQ ID NO: 20508 - RNA, 22 nt, Human
uggcacacgccuguaaucccag

SEQ ID NO: 20509 - RNA, 23 nt, Human
cacugugaaaccacuagguucua

SEQ ID NO: 20510 - RNA, 27 nt, Human
ccaggccccaggcaucuuugccugccc

SEQ ID NO: 20511 - RNA, 20 nt, Human
ccccuccagaagaagcaguu

SEQ ID NO: 20512 - RNA, 21 nt, Human
uacagcagcccccuuccucca

SEQ ID NO: 20513 - RNA, 24 nt, Human
ugaccuagaagcagcaucuuccca

SEQ ID NO: 20514 - RNA, 27 nt, Human
ugccauugcuacuauugcuugucggug

SEQ ID NO: 20515 - RNA, 21 nt, Human
gcacccacccccacagcgccc

SEQ ID NO: 20516 - RNA, 23 nt, Human
aaaaaacaaaacaacucuggcuu

SEQ ID NO: 20517 - RNA, 21 nt, Human
ucugucccucuucagccaagc

SEQ ID NO: 20518 - RNA, 26 nt, Human
uuucucucacuguaccccuuucccuc

SEQ ID NO: 20519 - RNA, 22 nt, Human
uuaguuuagggaaagcccuccc

SEQ ID NO: 20520 - RNA, 20 nt, Human
uaucacacacucuuggcuac

SEQ ID NO: 20521 - RNA, 22 nt, Human
ucaccuccccgguucaagcaau

SEQ ID NO: 20522 - RNA, 20 nt, Human
ggcauccuggauggaauuga

SEQ ID NO: 20523 - RNA, 24 nt, Human
ggcaacuuuucaaauguccccaaa

SEQ ID NO: 20524 - RNA, 22 nt, Human
aauggugagaucucggcucacu

SEQ ID NO: 20525 - RNA, 27 nt, Human
cucugauuacaguggccuugagcuuca

SEQ ID NO: 20526 - RNA, 27 nt, Human
ggccagccugcccggccccagcaugcg

SEQ ID NO: 20527 - RNA, 27 nt, Human
ggaggagagucccuucucggaaggccu

SEQ ID NO: 20528 - RNA, 26 nt, Human
aacauaaaagcaccacuguucuguuc

SEQ ID NO: 20529 - RNA, 27 nt, Human
gggaaauucauauccccuguucgucuc

SEQ ID NO: 20530 - RNA, 23 nt, Human
ccuucuggaacuaugggcuugag

SEQ ID NO: 20531 - RNA, 26 nt, Human
ggacagauuuggcaauagcuuuguaa

SEQ ID NO: 20532 - RNA, 20 nt, Human
cccgguuuuuuccucuuguc

SEQ ID NO: 20533 - RNA, 24 nt, Human
cacaggugacagaucauaggaagu

SEQ ID NO: 20534 - RNA, 28 nt, Human
aggccagacuccccugggcagacuugac

SEQ ID NO: 20535 - RNA, 25 nt, Human
gcccaggcuggagugcagaggugcg

SEQ ID NO: 20536 - RNA, 27 nt, Human
gcagccgggaugugacccuccaggguu

SEQ ID NO: 20537 - RNA, 22 nt, Human
uugaggcaggagaauugcuuga

SEQ ID NO: 20538 - RNA, 27 nt, Human
auggaaagauagacagcagccaacccu

SEQ ID NO: 20539 - RNA, 28 nt, Human
uucccuaaaaauuccaccaggauuaauc

SEQ ID NO: 20540 - RNA, 24 nt, Human
uuacugcugaaugauuacauucuc

SEQ ID NO: 20541 - RNA, 18 nt, Human
cagccagccuccugcugc

SEQ ID NO: 20542 - RNA, 27 nt, Human
agagacacccuuuguaacucucuucuc

SEQ ID NO: 20543 - RNA, 21 nt, Human
auaaccuuuccaucagaaggg

SEQ ID NO: 20544 - RNA, 21 nt, Human
cuuggccucccaagugcuggg

SEQ ID NO: 20545 - RNA, 22 nt, Human
caacuccuggauuucucuuaca

SEQ ID NO: 20546 - RNA, 22 nt, Human
gcuccagccuggaaaccugucu

SEQ ID NO: 20547 - RNA, 27 nt, Human
cgccacuggacuccagccugcgugaca

SEQ ID NO: 20548 - RNA, 24 nt, Human
ggucuccucuuccucucccugaag

SEQ ID NO: 20549 - RNA, 26 nt, Human
ggagucugaggcagaggauggcaugu

SEQ ID NO: 20550 - RNA, 21 nt, Human
aacuggcaacuuacuacugaa

SEQ ID NO: 20551 - RNA, 25 nt, Human
cccacccccaaucccagugcuacac

SEQ ID NO: 20552 - RNA, 20 nt, Human
guggcugcucauucuugccu

SEQ ID NO: 20553 - RNA, 22 nt, Human
uggauuuccaguuuuucuuuac

SEQ ID NO: 20554 - RNA, 27 nt, Human
augaacauccuuaccuucacuguggcc

SEQ ID NO: 20555 - RNA, 27 nt, Human
cccagcaccucagccugcacagugucc

SEQ ID NO: 20556 - RNA, 23 nt, Human
uccucugcgucagggagcacuuu

SEQ ID NO: 20557 - RNA, 22 nt, Human
uuuaaacaaaggagguuugaga

SEQ ID NO: 20558 - RNA, 18 nt, Human
uucuugauucugccucag

SEQ ID NO: 20559 - RNA, 22 nt, Human
cucugccaucuucaggauauug

SEQ ID NO: 20560 - RNA, 22 nt, Human
accugaagccuagaaauaucuu

SEQ ID NO: 20561 - RNA, 25 nt, Human
gggaagagagagcaggagcuggggc

SEQ ID NO: 20562 - RNA, 26 nt, Human
ccugguuucuucuucaagacucugaa

SEQ ID NO: 20563 - RNA, 24 nt, Human
aaagaacaacugcugauugaaaca

SEQ ID NO: 20564 - RNA, 22 nt, Human
uaugcuggugggccacuugucg

SEQ ID NO: 20565 - RNA, 25 nt, Human
gagcucucacuaucauuugagagcc

SEQ ID NO: 20566 - RNA, 21 nt, Human
ucgcagccacaccuaggucug

SEQ ID NO: 20567 - RNA, 27 nt, Human
uuuuauucaagaugaguuggacccauu

SEQ ID NO: 20568 - RNA, 27 nt, Human
gcucuccuccagcccugggcacauagc

SEQ ID NO: 20569 - RNA, 20 nt, Human
uucugcucucucuuggcacc

SEQ ID NO: 20570 - RNA, 30 nt, Human
cgcagccgccgccucagcugcucgcucugu

SEQ ID NO: 20571 - RNA, 22 nt, Human
cuaagacauugugaagcacuug

SEQ ID NO: 20572 - RNA, 22 nt, Human
aggcugaggcagaagaauugaa

SEQ ID NO: 20573 - RNA, 23 nt, Human
caacuccccuccgucugugacau

SEQ ID NO: 20574 - RNA, 27 nt, Human
ugcagugagccgagaucgcaccacugc

SEQ ID NO: 20575 - RNA, 27 nt, Human
uguagugagcugagaucgcaccacugc

SEQ ID NO: 20576 - RNA, 27 nt, Human
ggaggcugaggcagagcugcuugaacc

SEQ ID NO: 20577 - RNA, 21 nt, Human
cuagaucacugugcuuauuuu

SEQ ID NO: 20578 - RNA, 21 nt, Human
gaauuaaagucuacacugccu

SEQ ID NO: 20579 - RNA, 21 nt, Human
ggcugggccugucacccuggg

SEQ ID NO: 20580 - RNA, 24 nt, Human
ccugcaguuaauuagcauucuggc

SEQ ID NO: 20581 - RNA, 22 nt, Human
acucuagccugggugacagagu

SEQ ID NO: 20582 - RNA, 26 nt, Human
cgcccaggcuggagcgcagucccgca

SEQ ID NO: 20583 - RNA, 20 nt, Human
cacaugcuuucuacucuucg

SEQ ID NO: 20584 - RNA, 25 nt, Human
cugucacccgagcuggagugcagug

SEQ ID NO: 20585 - RNA, 28 nt, Human
gcaccuccagccacagaaagcaagccgg

SEQ ID NO: 20586 - RNA, 24 nt, Human
agccuugaugggggucaggcagag

SEQ ID NO: 20587 - RNA, 16 nt, Human
ggcaaagcaguacgac

SEQ ID NO: 20588 - RNA, 20 nt, Human
acucuucuuugccaggugug

SEQ ID NO: 20589 - RNA, 20 nt, Human
cauuagcagguguagaaagg

SEQ ID NO: 20590 - RNA, 24 nt, Human
cacccaccgcaaccucauccccuc

SEQ ID NO: 20591 - RNA, 24 nt, Human
cucuaggcaggacugccaugcagu

SEQ ID NO: 20592 - RNA, 25 nt, Human
aauugucagccuucuuaccuggcca

SEQ ID NO: 20593 - RNA, 26 nt, Human
cagaucuucuaucaguagcaguauug

SEQ ID NO: 20594 - RNA, 20 nt, Human
cugagcaaagggaacaguga

SEQ ID NO: 20595 - RNA, 19 nt, Human
ccugccucuucugcagccu

SEQ ID NO: 20596 - RNA, 26 nt, Human
ugguuggguaguagguugcauuauga

SEQ ID NO: 20597 - RNA, 19 nt, Human
uaauuuuuugucuuuugga

SEQ ID NO: 20598 - RNA, 22 nt, Human
aggaagauggaccuggacagac

SEQ ID NO: 20599 - RNA, 19 nt, Human
cuccacccaguccucggcc

SEQ ID NO: 20600 - RNA, 25 nt, Human
uccuggccauggagaggagaucugg

SEQ ID NO: 20601 - RNA, 24 nt, Human
accugccaccaccacccccgccau

SEQ ID NO: 20602 - RNA, 25 nt, Human
aaacugcaugaugaauagcaccuua

SEQ ID NO: 20603 - RNA, 23 nt, Human
guuccaguguucucucuuauucc

SEQ ID NO: 20604 - RNA, 22 nt, Human
cugaguagcugggauuacaggc

SEQ ID NO: 20605 - RNA, 22 nt, Human
cuggguagcugggauuacaagc

SEQ ID NO: 20606 - RNA, 22 nt, Human
cugagcagcugggauuacaggu

SEQ ID NO: 20607 - RNA, 26 nt, Human
guaggagaaagagcacaaaagagguc

SEQ ID NO: 20608 - RNA, 22 nt, Human
agaacuuagggucagggucuca

SEQ ID NO: 20609 - RNA, 19 nt, Human
cccugcaucuugcacuuug

SEQ ID NO: 20610 - RNA, 27 nt, Human
caggucaaacacgcagcccccucccgc

SEQ ID NO: 20611 - RNA, 23 nt, Human
cagacuccaagcccacucuccuc

SEQ ID NO: 20612 - RNA, 23 nt, Human
cgcggcaccuccggccugcgcgu

SEQ ID NO: 20613 - RNA, 23 nt, Human
ugcgcuuguaaucccagcuacuc

SEQ ID NO: 20614 - RNA, 20 nt, Human
ugucccuggacacagcucuu

SEQ ID NO: 20615 - RNA, 27 nt, Human
ugaggggaagagggggucuccgcucuu

SEQ ID NO: 20616 - RNA, 20 nt, Human
auagcuuagaauacugcaaa

SEQ ID NO: 20617 - RNA, 24 nt, Human
ccaccuccugggcucuccagcgau

SEQ ID NO: 20618 - RNA, 22 nt, Human
cuccaccuccucuccaccugcu

SEQ ID NO: 20619 - RNA, 25 nt, Human
ggugguuuuuccugccaguucagga

SEQ ID NO: 20620 - RNA, 23 nt, Human
caggcaaaggagaaacagcucug

SEQ ID NO: 20621 - RNA, 21 nt, Human
ggaaggggcagcaggaggagu

SEQ ID NO: 20622 - RNA, 22 nt, Human
ggaggcugagaugggcagauca

SEQ ID NO: 20623 - RNA, 25 nt, Human
gguccuguuuuugucauguuuauga

SEQ ID NO: 20624 - RNA, 19 nt, Human
cuguucugacucugagcca

SEQ ID NO: 20625 - RNA, 19 nt, Human
ccucuggaccucagguucc

SEQ ID NO: 20626 - RNA, 20 nt, Human
ggcugggcaaggaaaaagaa

SEQ ID NO: 20627 - RNA, 26 nt, Human
cugucauuucucuuucaaaaaggcgg

SEQ ID NO: 20628 - RNA, 24 nt, Human
accacagcucuccuucuaucuaca

SEQ ID NO: 20629 - RNA, 21 nt, Human
uaaaaaagaaaaaggccaggc

SEQ ID NO: 20630 - RNA, 26 nt, Human
acugcacuccuacuguaggcuccugu

SEQ ID NO: 20631 - RNA, 22 nt, Human
aauuuuggaauauuugcuuuau

SEQ ID NO: 20632 - RNA, 22 nt, Human
agucgccagaggagaagggaau

SEQ ID NO: 20633 - RNA, 27 nt, Human
gucucccaggcuggagugcaauggugc

SEQ ID NO: 20634 - RNA, 22 nt, Human
uucagaggcugcugccugcuua

SEQ ID NO: 20635 - RNA, 26 nt, Human
augaaaacugccugucuggccgggcc

SEQ ID NO: 20636 - RNA, 23 nt, Human
uuuccucuucuuugauagugggu

SEQ ID NO: 20637 - RNA, 23 nt, Human
ccccagacaccacacacaugcgc

SEQ ID NO: 20638 - RNA, 25 nt, Human
cucccgcccgaggacuccugcgggc

SEQ ID NO: 20639 - RNA, 20 nt, Human
caaggggugggucaagugca

SEQ ID NO: 20640 - RNA, 23 nt, Human
aaucaaauuucucacaaugcugu

SEQ ID NO: 20641 - RNA, 24 nt, Human
gccccuaaaccccuccugugugcu

SEQ ID NO: 20642 - RNA, 21 nt, Human
ugcagggguucuucugugauu

SEQ ID NO: 20643 - RNA, 21 nt, Human
aaagcugaggcugacaauaau

SEQ ID NO: 20644 - RNA, 22 nt, Human
uugagccucaggcuauacucca

SEQ ID NO: 20645 - RNA, 23 nt, Human
ggagagaaugggggaggaggcgg

SEQ ID NO: 20646 - RNA, 18 nt, Human
cuaacuugcccuguccca

SEQ ID NO: 20647 - RNA, 23 nt, Human
ggagagggggugggggagccagc

SEQ ID NO: 20648 - RNA, 31 nt, Human
ugggagguggaggaggguugcagcucccacc

SEQ ID NO: 20649 - RNA, 22 nt, Human
ggcaggcggcaggcagcaggcu

SEQ ID NO: 20650 - RNA, 18 nt, Human
uguacacacccaucaaau

SEQ ID NO: 20651 - RNA, 22 nt, Human
aggcuaaggcaggagaaucgcu

SEQ ID NO: 20652 - RNA, 27 nt, Human
augcggccaaucucugucuccaaaaac

SEQ ID NO: 20653 - RNA, 22 nt, Human
caaaggagagucaacauaugug

SEQ ID NO: 20654 - RNA, 27 nt, Human
ugcagugaguucaugcaccuucuugcc

SEQ ID NO: 20655 - RNA, 28 nt, Human
cuugcuggaaugaacagugugcucaggg

SEQ ID NO: 20656 - RNA, 23 nt, Human
cagauaaucacaaagaaagcuuu

SEQ ID NO: 20657 - RNA, 24 nt, Human
ggacccuccccgcuuuccugggcc

SEQ ID NO: 20658 - RNA, 22 nt, Human
gguacccaccauucucuucucu

SEQ ID NO: 20659 - RNA, 27 nt, Human
cucagcaggagcccccagcugccaaag

SEQ ID NO: 20660 - RNA, 26 nt, Human
cuucacccucugcggagucaugaggg

SEQ ID NO: 20661 - RNA, 19 nt, Human
ugggggagccagccuccca

SEQ ID NO: 20662 - RNA, 22 nt, Human
uuugaggccgaagcugcuguga

SEQ ID NO: 20663 - RNA, 20 nt, Human
uggucucaugcuuaaucuug

SEQ ID NO: 20664 - RNA, 22 nt, Human
agcauacaucuuaaaucuuuuc

SEQ ID NO: 20665 - RNA, 30 nt, Human
ggaggcagaaccaggcagccucccuggccc

SEQ ID NO: 20666 - RNA, 23 nt, Human
uugcugcagccgucaacgaccua

SEQ ID NO: 20667 - RNA, 20 nt, Human
ucagaaucugggacccaggg

SEQ ID NO: 20668 - RNA, 25 nt, Human
cugcucuguugcaugccugcucuaa

SEQ ID NO: 20669 - RNA, 18 nt, Human
cccugcuccuugugggcg

SEQ ID NO: 20670 - RNA, 25 nt, Human
gagaacaaaagcuugacucugauuc

SEQ ID NO: 20671 - RNA, 19 nt, Human
auggauugggccucaggcc

SEQ ID NO: 20672 - RNA, 24 nt, Human
guggcucagagauaggacccuggu

SEQ ID NO: 20673 - RNA, 20 nt, Human
caguaaacauccagccauuc

SEQ ID NO: 20674 - RNA, 22 nt, Human
uguuguauuuauggaagaaaga

SEQ ID NO: 20675 - RNA, 20 nt, Human
ugacuucuguuuucucaaag

SEQ ID NO: 20676 - RNA, 20 nt, Human
ugcaauuccccucugcugcu

SEQ ID NO: 20677 - RNA, 22 nt, Human
gugugagccaccacauccagcc

SEQ ID NO: 20678 - RNA, 22 nt, Human
gaucuuccacgucuccaucuca

SEQ ID NO: 20679 - RNA, 21 nt, Human
aguacauaucuuaauuuugga

SEQ ID NO: 20680 - RNA, 21 nt, Human
ccagaagcuggaaguuuggga

SEQ ID NO: 20681 - RNA, 19 nt, Human
uccccggaugugugucuca

SEQ ID NO: 20682 - RNA, 20 nt, Human
uuugccucccucccagccuc

SEQ ID NO: 20683 - RNA, 21 nt, Human
cuuaacucccaagugugucgc

SEQ ID NO: 20684 - RNA, 24 nt, Human
cuugcuuugcagacugccugcagc

SEQ ID NO: 20685 - RNA, 22 nt, Human
ccuuagacaccuaugcagucau

SEQ ID NO: 20686 - RNA, 26 nt, Human
uugggagcuuggaguccagugguugg

SEQ ID NO: 20687 - RNA, 19 nt, Human
ggggugaggagacuguugg

SEQ ID NO: 20688 - RNA, 19 nt, Human
gcuuucaugaccauccugc

SEQ ID NO: 20689 - RNA, 27 nt, Human
agaggagucgggaucugcgcugcagcc

SEQ ID NO: 20690 - RNA, 22 nt, Human
caugaggucaggaguuugagac

SEQ ID NO: 20691 - RNA, 20 nt, Human
auggacaguguucugcuuuu

SEQ ID NO: 20692 - RNA, 20 nt, Human
uuuucucuuucuucucugcu

SEQ ID NO: 20693 - RNA, 24 nt, Human
aguuuuacugcauuuucacaacau

SEQ ID NO: 20694 - RNA, 23 nt, Human
auugcaccacugcacuccagucu

SEQ ID NO: 20695 - RNA, 23 nt, Human
auuguaccacugcacuccagccu

SEQ ID NO: 20696 - RNA, 23 nt, Human
auugcaccacuguacuccagccu

SEQ ID NO: 20697 - RNA, 23 nt, Human
gucacccaggcuggaguacaaua

SEQ ID NO: 20698 - RNA, 21 nt, Human
ggcggcaccgccuccuccuca

SEQ ID NO: 20699 - RNA, 21 nt, Human
cacccagcucgaggaucccag

SEQ ID NO: 20700 - RNA, 24 nt, Human
agagccaccuggaucuaucccugc

SEQ ID NO: 20701 - RNA, 32 nt, Human
gcacuuuguccacaaccuucccuucucuuucu

SEQ ID NO: 20702 - RNA, 22 nt, Human
aaauugcugggauuacaggugu

SEQ ID NO: 20703 - RNA, 22 nt, Human
uuuccaaaguuaacagauuuug

SEQ ID NO: 20704 - RNA, 20 nt, Human
ucuaggggcuuccugccuua

SEQ ID NO: 20705 - RNA, 21 nt, Human
gaugcgccaccauggccagcu

SEQ ID NO: 20706 - RNA, 27 nt, Human
uuguauuuuggcugcuagagugcagca

SEQ ID NO: 20707 - RNA, 22 nt, Human
gcugggguuuuaaaugauugau

SEQ ID NO: 20708 - RNA, 27 nt, Human
augggcagaaucugcucucugugacca

SEQ ID NO: 20709 - RNA, 22 nt, Human
ccgagaucacgccacugcacuc

SEQ ID NO: 20710 - RNA, 22 nt, Human
ugcccagguaugccuuccagug

SEQ ID NO: 20711 - RNA, 20 nt, Human
ugguucacccuucauaccag

SEQ ID NO: 20712 - RNA, 19 nt, Human
gcugacugucucagccaaa

SEQ ID NO: 20713 - RNA, 27 nt, Human
ugcugggacucaacuuggcugagaaau

SEQ ID NO: 20714 - RNA, 22 nt, Human
ugagcugacauauacugggugg

SEQ ID NO: 20715 - RNA, 21 nt, Human
guuuuuaaaauauuuagucua

SEQ ID NO: 20716 - RNA, 29 nt, Human
ucccucccaaggcccccaggaaucccuuc

SEQ ID NO: 20717 - RNA, 26 nt, Human
agcccagcuacauuccucagcugcca

SEQ ID NO: 20718 - RNA, 21 nt, Human
gcacuauauucuggccagacu

SEQ ID NO: 20719 - RNA, 22 nt, Human
acuggcugggcagagccugugu

SEQ ID NO: 20720 - RNA, 24 nt, Human
gccuugagcagucagcauugcacc

SEQ ID NO: 20721 - RNA, 22 nt, Human
cauccacaggggaagauaaaga

SEQ ID NO: 20722 - RNA, 20 nt, Human
ucaacuggcuacugagucau

SEQ ID NO: 20723 - RNA, 24 nt, Human
cgcggcggcugcagcuccagggag

SEQ ID NO: 20724 - RNA, 20 nt, Human
cgccuggugugggccugguc

SEQ ID NO: 20725 - RNA, 24 nt, Human
uauuuuguuauaguucauaguugg

SEQ ID NO: 20726 - RNA, 23 nt, Human
cagaugugguggugcacaccugu

SEQ ID NO: 20727 - RNA, 21 nt, Human
uucugagcuugcaaucauauu

SEQ ID NO: 20728 - RNA, 25 nt, Human
ucauacagcuccaaacaacuucaga

SEQ ID NO: 20729 - RNA, 23 nt, Human
cucugucucaaaagcaaagcaaa

SEQ ID NO: 20730 - RNA, 25 nt, Human
agccauggucaucuggugaugaaga

SEQ ID NO: 20731 - RNA, 23 nt, Human
ggcgucuggaacucuauuuuaag

SEQ ID NO: 20732 - RNA, 22 nt, Human
gggaacacuggcagacugugua

SEQ ID NO: 20733 - RNA, 23 nt, Human
uuguuguuuucccaaagagaacu

SEQ ID NO: 20734 - RNA, 27 nt, Human
agcuaucucucucauagcuuuuaugcc

SEQ ID NO: 20735 - RNA, 26 nt, Human
gugacuucacuacuuuuaagcaaaag

SEQ ID NO: 20736 - RNA, 24 nt, Human
ugauccuuagcaaaaguaggaagg

SEQ ID NO: 20737 - RNA, 23 nt, Human
ggggugcugagcuagugaguggu

SEQ ID NO: 20738 - RNA, 23 nt, Human
ggcucacagaaaaagaaaaagaa

SEQ ID NO: 20739 - RNA, 27 nt, Human
cacugugcuccagccugggcaacaaag

SEQ ID NO: 20740 - RNA, 25 nt, Human
ggccugggcuucagccucccggggc

SEQ ID NO: 20741 - RNA, 28 nt, Human
ugccauggguucuucacugaccuuggac

SEQ ID NO: 20742 - RNA, 29 nt, Human
ggaugcuggggcuguaaggcgcgcgcggu

SEQ ID NO: 20743 - RNA, 22 nt, Human
agcaucccgaguagcugggacu

SEQ ID NO: 20744 - RNA, 24 nt, Human
ccuccacucagcacucuggacucc

SEQ ID NO: 20745 - RNA, 27 nt, Human
uccugcucuuuuguuacugagugagau

SEQ ID NO: 20746 - RNA, 22 nt, Human
uuugccucugugugccucagug

SEQ ID NO: 20747 - RNA, 29 nt, Human
cccggcaggaacaccagacaugaacaggu

SEQ ID NO: 20748 - RNA, 26 nt, Human
acucccccuaguaccaccuagacauu

SEQ ID NO: 20749 - RNA, 26 nt, Human
uuuagagugacccugcagagucacuc

SEQ ID NO: 20750 - RNA, 22 nt, Human
gaaauugaauaauaaaaucagg

SEQ ID NO: 20751 - RNA, 18 nt, Human
acaccugccccugcucug

SEQ ID NO: 20752 - RNA, 19 nt, Human
ucugucuuauuuggcagcu

SEQ ID NO: 20753 - RNA, 28 nt, Human
gggaggggaagagagaggccugggugug

SEQ ID NO: 20754 - RNA, 24 nt, Human
uuaucucaauucuuaacugcugug

SEQ ID NO: 20755 - RNA, 22 nt, Human
gugacuucuccgauugugugag

SEQ ID NO: 20756 - RNA, 24 nt, Human
cagcucuguucccuccugcuuugg

SEQ ID NO: 20757 - RNA, 27 nt, Human
ucaggaaucaguguuauccuggaacug

SEQ ID NO: 20758 - RNA, 23 nt, Human
ugagaaacuggcaaagcagaaug

SEQ ID NO: 20759 - RNA, 22 nt, Human
aagugaaauauaauauuuuuca

SEQ ID NO: 20760 - RNA, 24 nt, Human
aucuggucacaaauuuugaugcug

SEQ ID NO: 20761 - RNA, 24 nt, Human
agagacagagcugcccacugugcc

SEQ ID NO: 20762 - RNA, 22 nt, Human
ucagcacugcagcucugauggu

SEQ ID NO: 20763 - RNA, 21 nt, Human
gaggcugaggcaggagaauca

SEQ ID NO: 20764 - RNA, 27 nt, Human
ggucucaaacuccuagguucacuuugg

SEQ ID NO: 20765 - RNA, 22 nt, Human
ugccucuuggguucaagugauu

SEQ ID NO: 20766 - RNA, 22 nt, Human
ucccaggguaggcaccuggggg

SEQ ID NO: 20767 - RNA, 27 nt, Human
uccuggccauccaagccuccucuccag

SEQ ID NO: 20768 - RNA, 23 nt, Human
ugagccaggcugcuaggagccag

SEQ ID NO: 20769 - RNA, 22 nt, Human
gcggccucagaugaaugcggcu

SEQ ID NO: 20770 - RNA, 20 nt, Human
cucuuguuaaaugagcuuaa

SEQ ID NO: 20771 - RNA, 25 nt, Human
ggagagugggaagcaggagcccagc

SEQ ID NO: 20772 - RNA, 22 nt, Human
caugucuuacugaucuaacccu

SEQ ID NO: 20773 - RNA, 24 nt, Human
cggucaucuaccccaccccugccu

SEQ ID NO: 20774 - RNA, 22 nt, Human
gcucaggucgcucuaagcacaa

SEQ ID NO: 20775 - RNA, 25 nt, Human
gcagaagagcaacaugaagcugcac

SEQ ID NO: 20776 - RNA, 22 nt, Human
uacuucagauugucugacagca

SEQ ID NO: 20777 - RNA, 21 nt, Human
uuuccucccuccuucugcacg

SEQ ID NO: 20778 - RNA, 22 nt, Human
cucuggauuuccuuuugcuuca

SEQ ID NO: 20779 - RNA, 23 nt, Human
ccccacuccucugcugaccugcu

SEQ ID NO: 20780 - RNA, 20 nt, Human
ggcagcggagguugcaguga

SEQ ID NO: 20781 - RNA, 19 nt, Human
uaauuuauuuguuucccua

SEQ ID NO: 20782 - RNA, 23 nt, Human
ucugagacugaacacugagggca

SEQ ID NO: 20783 - RNA, 23 nt, Human
gcugcaguucauagcagugagga

SEQ ID NO: 20784 - RNA, 27 nt, Human
gccccgccgcccgccgcgccauggccc

SEQ ID NO: 20785 - RNA, 21 nt, Human
uccuucucauagugaagcacu

SEQ ID NO: 20786 - RNA, 22 nt, Human
ccgugcguucuggcuguggacc

SEQ ID NO: 20787 - RNA, 22 nt, Human
cacaucacuccaaccugggcaa

SEQ ID NO: 20788 - RNA, 25 nt, Human
ccucuuccugugcaaauuccucuag

SEQ ID NO: 20789 - RNA, 22 nt, Human
cuuugcagauauggacagccuu

SEQ ID NO: 20790 - RNA, 26 nt, Human
ccgcagcucgcagccaccccaaaggg

SEQ ID NO: 20791 - RNA, 22 nt, Human
agcggaguggauggcagaggug

SEQ ID NO: 20792 - RNA, 23 nt, Human
cagcacagaguccccuggggcua

SEQ ID NO: 20793 - RNA, 25 nt, Human
agcuccuaccucuucccuccuugcc

SEQ ID NO: 20794 - RNA, 25 nt, Human
caggcaaaucugguacaggagaagc

SEQ ID NO: 20795 - RNA, 22 nt, Human
aauaagaacagagaauugaucu

SEQ ID NO: 20796 - RNA, 24 nt, Human
gcccucuggauucucugggucuau

SEQ ID NO: 20797 - RNA, 22 nt, Human
gcccagugcuggcuggguucgg

SEQ ID NO: 20798 - RNA, 22 nt, Human
ccucagcgggggccuugaagac

SEQ ID NO: 20799 - RNA, 22 nt, Human
ucaccaugugugggcucaggga

SEQ ID NO: 20800 - RNA, 21 nt, Human
cccaucuacugaaacaggguc

SEQ ID NO: 20801 - RNA, 22 nt, Human
ggucuugaacuccuggccucaa

SEQ ID NO: 20802 - RNA, 24 nt, Human
ucugaugagacuagagugacagug

SEQ ID NO: 20803 - RNA, 23 nt, Human
uuaacacuauacucuaaaaugga

SEQ ID NO: 20804 - RNA, 23 nt, Human
cuguggucccuggcagccagucu

SEQ ID NO: 20805 - RNA, 22 nt, Human
uuauaucucuuccuuuuccucc

SEQ ID NO: 20806 - RNA, 22 nt, Human
uucaagugauucuccugccuca

SEQ ID NO: 20807 - RNA, 21 nt, Human
ugucuuuuuuccuccuugcaa

SEQ ID NO: 20808 - RNA, 22 nt, Human
cagccaggcuggaggcggcagg

SEQ ID NO: 20809 - RNA, 21 nt, Human
auuucuccaauguguccugac

SEQ ID NO: 20810 - RNA, 25 nt, Human
uagcuguaugagcaguucaaaggcc

SEQ ID NO: 20811 - RNA, 22 nt, Human
ccuggggaacaggagagcugcu

SEQ ID NO: 20812 - RNA, 22 nt, Human
cggccccauacaugggcugccu

SEQ ID NO: 20813 - RNA, 21 nt, Human
ggauacuuucucucucuuuca

SEQ ID NO: 20814 - RNA, 22 nt, Human
uauaauauucauacaacaaaga

SEQ ID NO: 20815 - RNA, 23 nt, Human
agcucugcucuauuuauuauuau

SEQ ID NO: 20816 - RNA, 22 nt, Human
uugccuuucugggacuuggccu

SEQ ID NO: 20817 - RNA, 23 nt, Human
ugaucaugccagguuugcaccag

SEQ ID NO: 20818 - RNA, 20 nt, Human
gcaggcggaucaugagguca

SEQ ID NO: 20819 - RNA, 23 nt, Human
ccgggaggcagagguaguaguga

SEQ ID NO: 20820 - RNA, 21 nt, Human
aacaaaaacaaaaaacuauag

SEQ ID NO: 20821 - RNA, 21 nt, Human
caggagcacagaccucugcug

SEQ ID NO: 20822 - RNA, 20 nt, Human
gcugcugcaaccauuguucu

SEQ ID NO: 20823 - RNA, 22 nt, Human
aggcugaggcaggaggaucauu

SEQ ID NO: 20824 - RNA, 22 nt, Human
aggccgaggcaggaggaucacu

SEQ ID NO: 20825 - RNA, 27 nt, Human
ugucuaauucauuuacucaccauauuu

SEQ ID NO: 20826 - RNA, 26 nt, Human
gcauccuccagcaucucaacuccguc

SEQ ID NO: 20827 - RNA, 24 nt, Human
aaaaugagcccuguccugccuaag

SEQ ID NO: 20828 - RNA, 23 nt, Human
ccaacuggccccaguacauucau

SEQ ID NO: 20829 - RNA, 23 nt, Human
gcucacuguggugucuguguucc

SEQ ID NO: 20830 - RNA, 21 nt, Human
gacguucacauaucucaggga

SEQ ID NO: 20831 - RNA, 19 nt, Human
ccugcacuccaccugggga

SEQ ID NO: 20832 - RNA, 21 nt, Human
gccuaauuuggugaugcuguu

SEQ ID NO: 20833 - RNA, 21 nt, Human
uacuuuauuuagccaaagcaa

SEQ ID NO: 20834 - RNA, 23 nt, Human
cacaggcagcgcauggcuccgga

SEQ ID NO: 20835 - RNA, 26 nt, Human
ugacaccuucacaagucagcauuaau

SEQ ID NO: 20836 - RNA, 27 nt, Human
ucuuagcaguuuuauaacccuuuuucc

SEQ ID NO: 20837 - RNA, 16 nt, Human
caguagaagugucaca

SEQ ID NO: 20838 - RNA, 32 nt, Human; identical to SEQ ID NO: 7677

SEQ ID NO: 20839 - RNA, 22 nt, Human
aguggcaccaucauagcucacu

SEQ ID NO: 20840 - RNA, 21 nt, Human
caauccugugggugaagagag

SEQ ID NO: 20841 - RNA, 22 nt, Human
guuuuucuccaucuccugggac

SEQ ID NO: 20842 - RNA, 23 nt, Human
cugcuggaaugcaggaaguagaa

SEQ ID NO: 20843 - RNA, 28 nt, Human
ucuuccgacugguacugaacauauauac

SEQ ID NO: 20844 - RNA, 21 nt, Human
gcaggucgcguaccuuccuca

SEQ ID NO: 20845 - RNA, 21 nt, Human
ucucacuccccagccugggcc

SEQ ID NO: 20846 - RNA, 19 nt, Human
cccucucugcuggacgucc

SEQ ID NO: 20847 - RNA, 28 nt, Human
uuuguuuaguuuugcaccaauaaaacug

SEQ ID NO: 20848 - RNA, 21 nt, Human
uuauuaaaaaaguguguucca

SEQ ID NO: 20849 - RNA, 22 nt, Human
ccgggaggagcguguggcgggg

SEQ ID NO: 20850 - RNA, 22 nt, Human
ucuuggauaugaaacugcccag

SEQ ID NO: 20851 - RNA, 22 nt, Human
agaugguaaaccagaucugucu

SEQ ID NO: 20852 - RNA, 23 nt, Human
cgucaauguccuaugcaguauug

SEQ ID NO: 20853 - RNA, 23 nt, Human
agauuugcccuccuccugcucug

SEQ ID NO: 20854 - RNA, 23 nt, Human
ggcucagucucaggagcaugggg

SEQ ID NO: 20855 - RNA, 21 nt, Human
acaaaaagcucuuacacuaca

SEQ ID NO: 20856 - RNA, 24 nt, Human
agugggggagagcaggcuggcagc

SEQ ID NO: 20857 - RNA, 23 nt, Human
ugagaaacaggcugacacuauuc

SEQ ID NO: 20858 - RNA, 23 nt, Human
uuuuuuaaauuaauaucuuucug

SEQ ID NO: 20859 - RNA, 25 nt, Human
gccugggccucugauaacacuuugg

SEQ ID NO: 20860 - RNA, 23 nt, Human
caaugugucuaguuuaagaaagu

SEQ ID NO: 20861 - RNA, 24 nt, Human
ccugagggauuaaaauggcagcuu

SEQ ID NO: 20862 - RNA, 22 nt, Human
augccuggccucugcccaagaa

SEQ ID NO: 20863 - RNA, 22 nt, Human
cauggacucaggaccugcccgg

SEQ ID NO: 20864 - RNA, 18 nt, Human
auggugcauucaagucag

SEQ ID NO: 20865 - RNA, 19 nt, Human
ggcuucacgcgucuugccu

SEQ ID NO: 20866 - RNA, 19 nt, Human
ccgccugcccugccugggc

SEQ ID NO: 20867 - RNA, 22 nt, Human
gaggaggccuccaggggcgcgg

SEQ ID NO: 20868 - RNA, 23 nt, Human
guggggaggggggcgggugacgc

SEQ ID NO: 20869 - RNA, 23 nt, Human
gaguggauaucaaugccucacag

SEQ ID NO: 20870 - RNA, 20 nt, Human
uaucgaacacauucagugau

SEQ ID NO: 20871 - RNA, 21 nt, Human
cucagccagccgugguggggu

SEQ ID NO: 20872 - RNA, 22 nt, Human
ucuuuggucacauaauauuaaa

SEQ ID NO: 20873 - RNA, 25 nt, Human
cuguaguacugacugguucaucaca

SEQ ID NO: 20874 - RNA, 24 nt, Human
auauuuuuauauuugugaucuacc

SEQ ID NO: 20875 - RNA, 22 nt, Human
cuucaucuucacugcaauuuug

SEQ ID NO: 20876 - RNA, 26 nt, Human
gcaacuuggacguuguuuccacgugc

SEQ ID NO: 20877 - RNA, 21 nt, Human
uucucauuccuucuauggcug

SEQ ID NO: 20878 - RNA, 26 nt, Human
ccugcagcuggacuccagcgccugcc

SEQ ID NO: 20879 - RNA, 24 nt, Human
auuguaacuaaaaucuuccucagg

SEQ ID NO: 20880 - RNA, 21 nt, Human
gcuguacguuuucuuuauguu

SEQ ID NO: 20881 - RNA, 24 nt, Human
ggcggccgcggcugggcccugcag

SEQ ID NO: 20882 - RNA, 27 nt, Human
ccagcucccucuauuuauguuugcacu

SEQ ID NO: 20883 - RNA, 24 nt, Human
aucauucuaugcugauuagcuuca

SEQ ID NO: 20884 - RNA, 22 nt, Human
accgcccuuuuuguaugcacca

SEQ ID NO: 20885 - RNA, 26 nt, Human
acugcacuccagccugggcaacauag

SEQ ID NO: 20886 - RNA, 21 nt, Human
uggaagaccuuuggaaaggcc

SEQ ID NO: 20887 - RNA, 26 nt, Human
agaacaauguauaauacauucacauc

SEQ ID NO: 20888 - RNA, 21 nt, Human
agccauggucagacuguacaa

SEQ ID NO: 20889 - RNA, 24 nt, Human
agaaaacaaaauagaacccugagc

SEQ ID NO: 20890 - RNA, 21 nt, Human
aacuacauacugaauauccaa

SEQ ID NO: 20891 - RNA, 22 nt, Human
auggggaaagagauccaggaag

SEQ ID NO: 20892 - RNA, 25 nt, Human
caguuucagcaacuacaagggauac

SEQ ID NO: 20893 - RNA, 24 nt, Human
cccgaguagcugggauuagaggcg

SEQ ID NO: 20894 - RNA, 20 nt, Human
ucagagcuccaggguggcac

SEQ ID NO: 20895 - RNA, 30 nt, Human
cacagaaccugaaugccaggaaaaauuccu

SEQ ID NO: 20896 - RNA, 19 nt, Human
ugcagcucugaagagccac

SEQ ID NO: 20897 - RNA, 22 nt, Human
acccgguuugcugaucgcccca

SEQ ID NO: 20898 - RNA, 26 nt, Human
uguucagcugugcuguguuucuacug

SEQ ID NO: 20899 - RNA, 20 nt, Human
auggagacuucuaauuugua

SEQ ID NO: 20900 - RNA, 19 nt, Human
uuuuaaaauguaauuucua

SEQ ID NO: 20901 - RNA, 25 nt, Human
ccccgggggcagcaaacugacaugg

SEQ ID NO: 20902 - RNA, 22 nt, Human
acuauuccuuugcccggcauca

SEQ ID NO: 20903 - RNA, 17 nt, Human
gccuccugucauuuccc

SEQ ID NO: 20904 - RNA, 26 nt, Human
ggaaacacuggcggcacauauugagg

SEQ ID NO: 20905 - RNA, 21 nt, Human
ucucccccuuugggacauguu

SEQ ID NO: 20906 - RNA, 21 nt, Human
gcaagugaacucagcacucug

SEQ ID NO: 20907 - RNA, 20 nt, Human
gugguucuucucauucucau

SEQ ID NO: 20908 - RNA, 21 nt, Human
uacacucauucuuaacuuuuc

SEQ ID NO: 20909 - RNA, 19 nt, Human
caggagguuugcguccuga

SEQ ID NO: 20910 - RNA, 22 nt, Human
agugccggcuguggagcaaaag

SEQ ID NO: 20911 - RNA, 23 nt, Human
ugucuccuaagcuggagugcagu

SEQ ID NO: 20912 - RNA, 26 nt, Human
ccugcaggucucugucgagcagcgga

SEQ ID NO: 20913 - RNA, 18 nt, Human
acuaccucgucugaagga

SEQ ID NO: 20914 - RNA, 27 nt, Human
uugguuaccuccaccuuccugcacuca

SEQ ID NO: 20915 - RNA, 19 nt, Human
gcgcagcucuccacaugcc

SEQ ID NO: 20916 - RNA, 19 nt, Human
ucgucgcuuucuccauccc

SEQ ID NO: 20917 - RNA, 27 nt, Human
gaugaaugacuccaggaagaaggugug

SEQ ID NO: 20918 - RNA, 22 nt, Human
caccuccccgguucaagcaauu

SEQ ID NO: 20919 - RNA, 17 nt, Human
agacacaccucuugucu

SEQ ID NO: 20920 - RNA, 20 nt, Human
agcgggacguggcagaggag

SEQ ID NO: 20921 - RNA, 22 nt, Human
cggaggaggggagcugagaggu

SEQ ID NO: 20922 - RNA, 26 nt, Human
aggaagaggaucgguggcugggucug

SEQ ID NO: 20923 - RNA, 23 nt, Human
uggucuggugaccucagacacac

SEQ ID NO: 20924 - RNA, 25 nt, Human
cucagaaaccacugcauucugaccu

SEQ ID NO: 20925 - RNA, 23 nt, Human
uccuauuggcauaaaacaaacca

SEQ ID NO: 20926 - RNA, 20 nt, Human
uuucagaaagagaaaaugaa

SEQ ID NO: 20927 - RNA, 22 nt, Human
ccgcccccucauccugccucca

SEQ ID NO: 20928 - RNA, 22 nt, Human
uuucuaaugcuacaagaaugcu

SEQ ID NO: 20929 - RNA, 26 nt, Human
uggcccacguggaggcccaccugccu

SEQ ID NO: 20930 - RNA, 24 nt, Human
cuguugcccaggcaagagugcagu

SEQ ID NO: 20931 - RNA, 21 nt, Human
uucacagucucucuuuuucua

SEQ ID NO: 20932 - RNA, 20 nt, Human
ucagcccuaccaucuugcca

SEQ ID NO: 20933 - RNA, 26 nt, Human
aacauagugguauuuuaacauagcag

SEQ ID NO: 20934 - RNA, 26 nt, Human
aagccgcccgccagcccaggccgcug

SEQ ID NO: 20935 - RNA, 23 nt, Human
gggcugagacguggccaggggaa

SEQ ID NO: 20936 - RNA, 20 nt, Human
ucugaacuccuguuuaagga

SEQ ID NO: 20937 - RNA, 22 nt, Human
caggcuggagugcagugccgca

SEQ ID NO: 20938 - RNA, 25 nt, Human
gacucagucucaaaaagaaaaaaga

SEQ ID NO: 20939 - RNA, 21 nt, Human
ucuauaagaugaaacaucauu

SEQ ID NO: 20940 - RNA, 25 nt, Human
ucugaacuaaguauaagcucauggg

SEQ ID NO: 20941 - RNA, 24 nt, Human
uucuccucucucuaggugcugagc

SEQ ID NO: 20942 - RNA, 20 nt, Human
ccuggcugcccacugccucc

SEQ ID NO: 20943 - RNA, 20 nt, Human
ccaucaggaacagccugccu

SEQ ID NO: 20944 - RNA, 23 nt, Human
gcugggccuguggugccugccga

SEQ ID NO: 20945 - RNA, 22 nt, Human
agguauuuuauaauucugggaa

SEQ ID NO: 20946 - RNA, 24 nt, Human
aggugagaaugaauaagcuaugca

SEQ ID NO: 20947 - RNA, 25 nt, Human
ccagguccugugcuaucacaggguc

SEQ ID NO: 20948 - RNA, 21 nt, Human
uuuaaauuuggugccgauguu

SEQ ID NO: 20949 - RNA, 22 nt, Human
agcagaauaccaggcagacaga

SEQ ID NO: 20950 - RNA, 22 nt, Human
ccuaaaauuuuaaggccacggc

SEQ ID NO: 20951 - RNA, 26 nt, Human
gggaaaggaaggaaccuggggucauu

SEQ ID NO: 20952 - RNA, 21 nt, Human
gggaaacuguuuucacaagcu

SEQ ID NO: 20953 - RNA, 21 nt, Human
aacaaaaauuacagacuuugg

SEQ ID NO: 20954 - RNA, 27 nt, Human
ccuguucaggagccucagauaaguauu

SEQ ID NO: 20955 - RNA, 26 nt, Human
cucaucuucucuuucucuccucaguu

SEQ ID NO: 20956 - RNA, 27 nt, Human
aucucccaccuagcagcaccguucugu

SEQ ID NO: 20957 - RNA, 19 nt, Human
accaacccacuggcacauu

SEQ ID NO: 20958 - RNA, 19 nt, Human
ggcagugggaagaggcaga

SEQ ID NO: 20959 - RNA, 20 nt, Human
cggaaggcaguuuugcuugg

SEQ ID NO: 20960 - RNA, 26 nt, Human
cugggagcuggaguccacuggggugg

SEQ ID NO: 20961 - RNA, 26 nt, Human
gcucaggacucagaagccucuggguc

SEQ ID NO: 20962 - RNA, 24 nt, Human
uaucugagucuucugaaucccacu

SEQ ID NO: 20963 - RNA, 21 nt, Human
cugcuuagcuucucugugcca

SEQ ID NO: 20964 - RNA, 24 nt, Human
auggaagaaagaguggggugggca

SEQ ID NO: 20965 - RNA, 21 nt, Human
agggaccacuccagaccuaca

SEQ ID NO: 20966 - RNA, 21 nt, Human
ugggcagccuggcacgcacac

SEQ ID NO: 20967 - RNA, 20 nt, Human
uccuuccuccucacccugcc

SEQ ID NO: 20968 - RNA, 20 nt, Human
cagcagagcccucuccucag

SEQ ID NO: 20969 - RNA, 25 nt, Human
cccucucccuucugcauguuuccca

SEQ ID NO: 20970 - RNA, 22 nt, Human
cagguccucaccuguguguaca

SEQ ID NO: 20971 - RNA, 21 nt, Human
gggaguuaaagcuuccaguga

SEQ ID NO: 20972 - RNA, 22 nt, Human
aaagugcuaggauuacaggcgu

SEQ ID NO: 20973 - RNA, 22 nt, Human
gaagugcugggauuacaggcgu

SEQ ID NO: 20974 - RNA, 27 nt, Human
ggcgguagccauggagcuguggcgcca

SEQ ID NO: 20975 - RNA, 24 nt, Human
ccucuuugcuuuaccagugguguu

SEQ ID NO: 20976 - RNA, 24 nt, Human
ggaacauagucuuccaucuauacc

SEQ ID NO: 20977 - RNA, 27 nt, Human
uggaaacauuuugcugauuuugugaau

SEQ ID NO: 20978 - RNA, 21 nt, Human
cagagcugggaaggaggcucu

SEQ ID NO: 20979 - RNA, 22 nt, Human
ccucuccagaccccuggaaggg

SEQ ID NO: 20980 - RNA, 23 nt, Human
gccguaguuugucuccugggacu

SEQ ID NO: 20981 - RNA, 21 nt, Human
aagggccggguuucagcuccg

SEQ ID NO: 20982 - RNA, 21 nt, Human
ggccagguggcucccaccugu

SEQ ID NO: 20983 - RNA, 22 nt, Human
cauugucuugaacucugccuua

SEQ ID NO: 20984 - RNA, 19 nt, Human
ggaacgagggagagguuga

SEQ ID NO: 20985 - RNA, 23 nt, Human
ggccccuggaucccaaguccuuu

SEQ ID NO: 20986 - RNA, 22 nt, Human
cugagccuugauuuccucagcu

SEQ ID NO: 20987 - RNA, 30 nt, Human
cagcaucccagccaucacucuuccaccugc

SEQ ID NO: 20988 - RNA, 23 nt, Human
gggugguuccaauugguggagag

SEQ ID NO: 20989 - RNA, 25 nt, Human
agccaucaucucauuaccucuguca

SEQ ID NO: 20990 - RNA, 30 nt, Human
ccugggucuucccucucccugccucagccu

SEQ ID NO: 20991 - RNA, 29 nt, Human
ccggccccuggccccugccugcccucuag

SEQ ID NO: 20992 - RNA, 22 nt, Human
auguuuucauaaaauacugcaa

SEQ ID NO: 20993 - RNA, 23 nt, Human
agagaaacaggaaacaugacuug

SEQ ID NO: 20994 - RNA, 23 nt, Human
gaauuccucucaaauucagcucu

SEQ ID NO: 20995 - RNA, 23 nt, Human
ccgggaagcagagucugcaguga

SEQ ID NO: 20996 - RNA, 26 nt, Human
ugcauguaaaucacaaaaacugugug

SEQ ID NO: 20997 - RNA, 22 nt, Human
cuaucugauauacgguagcagg

SEQ ID NO: 20998 - RNA, 22 nt, Human
gcacggcaacuuuggagaggcg

SEQ ID NO: 20999 - RNA, 22 nt, Human
uuucuuuucuuuacaaaccauu

SEQ ID NO: 21000 - RNA, 21 nt, Human
gugaccaaggcaucaaggaca

SEQ ID NO: 21001 - RNA, 20 nt, Human
cuccaguuuuggugcuguga

SEQ ID NO: 21002 - RNA, 25 nt, Human
ccgguucuacacagauuucacaaau

SEQ ID NO: 21003 - RNA, 21 nt, Human
ccgcccaaacuggagugcagu

SEQ ID NO: 21004 - RNA, 24 nt, Human
ggguguggagcuggaacagagggc

SEQ ID NO: 21005 - RNA, 21 nt, Human
ggagagaggggugugggagga

SEQ ID NO: 21006 - RNA, 24 nt, Human
gucuuacauggguugcuguauuua

SEQ ID NO: 21007 - RNA, 22 nt, Human
gccagccaguggcacaaucuuu

SEQ ID NO: 21008 - RNA, 21 nt, Human
ucuuuguaaugucaccaccuu

SEQ ID NO: 21009 - RNA, 19 nt, Human
acaagcaugaguucuuguu

SEQ ID NO: 21010 - RNA, 27 nt, Human
ccucccucuguuccccgaccucagacc

SEQ ID NO: 21011 - RNA, 22 nt, Human
acaucaugacgaaaccccaucu

SEQ ID NO: 21012 - RNA, 21 nt, Human
gcaaguugcuugucauggcuu

SEQ ID NO: 21013 - RNA, 21 nt, Human
cacagaccacacacagcacua

SEQ ID NO: 21014 - RNA, 20 nt, Human
cuaaucaaaaucuuauauga

SEQ ID NO: 21015 - RNA, 27 nt, Human
ggaagccggaccuggagccggagcagc

SEQ ID NO: 21016 - RNA, 27 nt, Human
cccugcugccaggcuuacaucuuccca

SEQ ID NO: 21017 - RNA, 23 nt, Human
gcuggcagucucagccucccucc

SEQ ID NO: 21018 - RNA, 22 nt, Human
uguuuauggguguuuucuguug

SEQ ID NO: 21019 - RNA, 21 nt, Human
aaccaaaaagcuggguccucu

SEQ ID NO: 21020 - RNA, 21 nt, Human
cauaugaaauaaaaucugcua

SEQ ID NO: 21021 - RNA, 26 nt, Human
ccuaggaaaucacaggcuucugagca

SEQ ID NO: 21022 - RNA, 22 nt, Human
gcccccagguagcaggacacuc

SEQ ID NO: 21023 - RNA, 22 nt, Human
gcccccagacccaugugauuuc

SEQ ID NO: 21024 - RNA, 24 nt, Human
cuucugcuaaguaaugaauacacu

SEQ ID NO: 21025 - RNA, 21 nt, Human
ggugggggcugggugcagugg

SEQ ID NO: 21026 - RNA, 27 nt, Human
cagccuauccccagguaggggacguug

SEQ ID NO: 21027 - RNA, 20 nt, Human
ugccauggccgggugcagug

SEQ ID NO: 21028 - RNA, 22 nt, Human
uuccaaugacagaugagcagcu

SEQ ID NO: 21029 - RNA, 23 nt, Human
aggcuggagguuaauggcaugau

SEQ ID NO: 21030 - RNA, 19 nt, Human
gaugcuuggguaacugggg

SEQ ID NO: 21031 - RNA, 26 nt, Human
ccuagcgcuaucucccugccuccugc

SEQ ID NO: 21032 - RNA, 26 nt, Human
ugugaggaagagcaggcaccagcagc

SEQ ID NO: 21033 - RNA, 21 nt, Human
uaucuagcaugguauauaaca

SEQ ID NO: 21034 - RNA, 23 nt, Human
accaucucucgugccugccaccu

SEQ ID NO: 21035 - RNA, 22 nt, Human
ucacauuuauauuuuugugauu

SEQ ID NO: 21036 - RNA, 20 nt, Human
ccugaagucaguuucagggg

SEQ ID NO: 21037 - RNA, 22 nt, Human
gguuguggcugcagugagcugu

SEQ ID NO: 21038 - RNA, 26 nt, Human
ccuccucugcucuccaucauaacugc

SEQ ID NO: 21039 - RNA, 21 nt, Human
acugcucauacccaggaagag

SEQ ID NO: 21040 - RNA, 20 nt, Human
uugguggagaucagagugcc

SEQ ID NO: 21041 - RNA, 22 nt, Human
ggcugggugguggaggggggag

SEQ ID NO: 21042 - RNA, 22 nt, Human
ucugcuccugcucucucuccuc

SEQ ID NO: 21043 - RNA, 22 nt, Human
ucugcagcugcuuuugcauuuc

SEQ ID NO: 21044 - RNA, 20 nt, Human
uugagacuggcuuguugcug

SEQ ID NO: 21045 - RNA, 15 nt, Human
uggguggagggugag

SEQ ID NO: 21046 - RNA, 19 nt, Human
ccaagccgagcguggaaga

SEQ ID NO: 21047 - RNA, 28 nt, Human
cugcuagccugcucacgcaugcagcccg

SEQ ID NO: 21048 - RNA, 26 nt, Human
uugguggcaggggcauagagugguca

SEQ ID NO: 21049 - RNA, 22 nt, Human
uagucucugcaagauuuuguuc

SEQ ID NO: 21050 - RNA, 21 nt, Human
aaucaacagcuccagcccucu

SEQ ID NO: 21051 - RNA, 21 nt, Human
ugcaaacuugaagucaugcaa

SEQ ID NO: 21052 - RNA, 24 nt, Human
aggaaaggaagaaacacugagaca

SEQ ID NO: 21053 - RNA, 19 nt, Human
gggaggaaucaguguugga

SEQ ID NO: 21054 - RNA, 18 nt, Human
uaacuggagcuuugggac

SEQ ID NO: 21055 - RNA, 24 nt, Human
cagcucuuccaugggaucccccug

SEQ ID NO: 21056 - RNA, 27 nt, Human
gaguagcugggauuccaggcgcccgcc

SEQ ID NO: 21057 - RNA, 31 nt, Human
gguugauauugaacuccuggacucaagcaac

SEQ ID NO: 21058 - RNA, 25 nt, Human
gugaggcauugagggccaauaggag

SEQ ID NO: 21059 - RNA, 20 nt, Human
gccuagcaucccuccuggcc

SEQ ID NO: 21060 - RNA, 20 nt, Human
cauucggguccacagcugag

SEQ ID NO: 21061 - RNA, 20 nt, Human
uaagacuucuggugcugcug

SEQ ID NO: 21062 - RNA, 20 nt, Human
cacagcuuagcugggcacag

SEQ ID NO: 21063 - RNA, 25 nt, Human
aggaaagcguuuggaaaacguauca

SEQ ID NO: 21064 - RNA, 22 nt, Human
ccaggaggaagagguugcagug

SEQ ID NO: 21065 - RNA, 21 nt, Human
ggcuuuaaucccagcacuuug

SEQ ID NO: 21066 - RNA, 20 nt, Human
acuaagcugccuagccacac

SEQ ID NO: 21067 - RNA, 21 nt, Human
agcucacugcagccucgaccu

SEQ ID NO: 21068 - RNA, 19 nt, Human
ccauuucuuucccugcacu

SEQ ID NO: 21069 - RNA, 26 nt, Human
agcccagccgcccgcucccgcggaua

SEQ ID NO: 21070 - RNA, 21 nt, Human
ggacagcuucuuccuagugag

SEQ ID NO: 21071 - RNA, 21 nt, Human
uucuccaaaugaaaccugaau

SEQ ID NO: 21072 - RNA, 21 nt, Human
ggcucacugcaacguccgccu

SEQ ID NO: 21073 - RNA, 28 nt, Human
ccaggagguggagguugcaguaagcuga

SEQ ID NO: 21074 - RNA, 22 nt, Human
cucauccucccaaguagcugga

SEQ ID NO: 21075 - RNA, 21 nt, Human
ggacguggccccugcccacuc

SEQ ID NO: 21076 - RNA, 22 nt, Human
aacugccucugacuucaacuca

SEQ ID NO: 21077 - RNA, 24 nt, Human
gaaaucaaguugucucuguguaca

SEQ ID NO: 21078 - RNA, 27 nt, Human
uauucccucucacaccacccuccgugu

SEQ ID NO: 21079 - RNA, 26 nt, Human
gaaacaaucuaccucaucauuuaaaa

SEQ ID NO: 21080 - RNA, 17 nt, Human
uaaaacaauacuaccua

SEQ ID NO: 21081 - RNA, 26 nt, Human
acugguuugauuucucguucauugua

SEQ ID NO: 21082 - RNA, 22 nt, Human
ccaagaucgcgccauugcacuc

SEQ ID NO: 21083 - RNA, 20 nt, Human
auuucaggcuguuuggcugu

SEQ ID NO: 21084 - RNA, 21 nt, Human
gugggagguggggccuuagug

SEQ ID NO: 21085 - RNA, 27 nt, Human
acaagaggcagaaacaagacaggcuag

SEQ ID NO: 21086 - RNA, 21 nt, Human
aauggagaaacuggaaaagac

SEQ ID NO: 21087 - RNA, 25 nt, Human
aucucucuccccaucuucgcauauu

SEQ ID NO: 21088 - RNA, 22 nt, Human
ucuucuuucuuccucauccuac

SEQ ID NO: 21089 - RNA, 21 nt, Human
gcauucccuuagagaugagga

SEQ ID NO: 21090 - RNA, 27 nt, Human
cccugcucuuccaagguggggacagug

SEQ ID NO: 21091 - RNA, 21 nt, Human
uaguaucuuuuucucuucuau

SEQ ID NO: 21092 - RNA, 21 nt, Human
aauccauugcgcccaggcugg

SEQ ID NO: 21093 - RNA, 24 nt, Human
gacguggugcuucucacacuggag

SEQ ID NO: 21094 - RNA, 20 nt, Human
uuccccaaaauugaaucugu

SEQ ID NO: 21095 - RNA, 24 nt, Human
gccaggcuggagugcaguggugca

SEQ ID NO: 21096 - RNA, 20 nt, Human
cagaaauggacauuuucaua

SEQ ID NO: 21097 - RNA, 22 nt, Human
aacacaaaagauuuuaucugua

SEQ ID NO: 21098 - RNA, 30 nt, Human
agccuuuuauacugauuauucuuuuauauu

SEQ ID NO: 21099 - RNA, 22 nt, Human
gcaguggcuccccugcccagcc

SEQ ID NO: 21100 - RNA, 22 nt, Human
gcaccuugcaaaaaugguccug

SEQ ID NO: 21101 - RNA, 24 nt, Human
ugucuguagcuccucaacucaccu

SEQ ID NO: 21102 - RNA, 27 nt, Human
ccugguuugauucgaaggaugaagacg

SEQ ID NO: 21103 - RNA, 22 nt, Human
ugcagugagcugagaucgugcu

SEQ ID NO: 21104 - RNA, 24 nt, Human
auuaauuugcuuaauucugagcca

SEQ ID NO: 21105 - RNA, 20 nt, Human
cgggcgcagccaucuugccg

SEQ ID NO: 21106 - RNA, 23 nt, Human
uggaccucaguuuccucagugag

SEQ ID NO: 21107 - RNA, 21 nt, Human
gccucuuccucccucauucca

SEQ ID NO: 21108 - RNA, 20 nt, Human
aucuuuuaaaaaggcaguag

SEQ ID NO: 21109 - RNA, 25 nt, Human
ccuccugccaccugcugcugcugcu

SEQ ID NO: 21110 - RNA, 27 nt, Human
ccccagcgccuccucuggaugcggucg

SEQ ID NO: 21111 - RNA, 22 nt, Human
gccacucaaagagcgcaugcgu

SEQ ID NO: 21112 - RNA, 22 nt, Human
gcugaucuugaacuccugggcu

SEQ ID NO: 21113 - RNA, 27 nt, Human
ggcaagcaaggagccuuccuguccucg

SEQ ID NO: 21114 - RNA, 19 nt, Human
gaucucguaucucaggaac

SEQ ID NO: 21115 - RNA, 23 nt, Human
uuggaugucaccaucagagacga

SEQ ID NO: 21116 - RNA, 27 nt, Human
aaucccuuagcaucagcuccucccuca

SEQ ID NO: 21117 - RNA, 24 nt, Human
cagguucuuauaaauacagcuugu

SEQ ID NO: 21118 - RNA, 25 nt, Human
ugagcccaggcaguuggagaccagu

SEQ ID NO: 21119 - RNA, 24 nt, Human
ucaucuugauuagauuagauuaga

SEQ ID NO: 21120 - RNA, 22 nt, Human
ucuuacuucccugcucucaccu

SEQ ID NO: 21121 - RNA, 26 nt, Human
ugaugaagccccaggcguggaagcau

SEQ ID NO: 21122 - RNA, 21 nt, Human
ugugcauuuuauugacugggc

SEQ ID NO: 21123 - RNA, 21 nt, Human
gacacccaggcuggagugcag

SEQ ID NO: 21124 - RNA, 21 nt, Human
ccuuucugcuguucaccacca

SEQ ID NO: 21125 - RNA, 26 nt, Human
acacuaugguuauaaacuguguuuaa

SEQ ID NO: 21126 - RNA, 22 nt, Human
aucgcuugagccugggaggcag

SEQ ID NO: 21127 - RNA, 27 nt, Human
ggaaaaggaagaaagccagagcugucu

SEQ ID NO: 21128 - RNA, 19 nt, Human
uucaauccggauucuucca

SEQ ID NO: 21129 - RNA, 22 nt, Human
uugcagguccuccuggggccag

SEQ ID NO: 21130 - RNA, 25 nt, Human
gcaguccuccugccuuggccuccua

SEQ ID NO: 21131 - RNA, 21 nt, Human
agcucacugcaaccuucgcca

SEQ ID NO: 21132 - RNA, 25 nt, Human
cuguaaggcaggcccauucagagcu

SEQ ID NO: 21133 - RNA, 22 nt, Human
agugcuggugcguuuucugucu

SEQ ID NO: 21134 - RNA, 27 nt, Human
ggugcagcagugacagcagugagaguc

SEQ ID NO: 21135 - RNA, 27 nt, Human
cugggaggugucucuggggguggggug

SEQ ID NO: 21136 - RNA, 26 nt, Human
aguccgggacccgggcggcaucuggg

SEQ ID NO: 21137 - RNA, 27 nt, Human
uugcucuuguuguccaggcuggagugc

SEQ ID NO: 21138 - RNA, 27 nt, Human
ucugucucaucaguucuucacagugag

SEQ ID NO: 21139 - RNA, 24 nt, Human
uugggacagcauccggaaguuuuc

SEQ ID NO: 21140 - RNA, 22 nt, Human
uuucaauaaaacauuguguagu

SEQ ID NO: 21141 - RNA, 23 nt, Human
uggaccaauccuuuuugcaccaa

SEQ ID NO: 21142 - RNA, 25 nt, Human
auguuggccaggauggucucgaguc

SEQ ID NO: 21143 - RNA, 26 nt, Human
gcccccaggcagccaccaguggaccu

SEQ ID NO: 21144 - RNA, 27 nt, Human
uuaaaagcauacauuuucagcaaccag

SEQ ID NO: 21145 - RNA, 22 nt, Human
uggaggaaugugggcaguuuga

SEQ ID NO: 21146 - RNA, 22 nt, Human
aucuggggcagccaccuugcua

SEQ ID NO: 21147 - RNA, 27 nt, Human
ccaggcaaaauauagcaaucugccaca

SEQ ID NO: 21148 - RNA, 23 nt, Human
uuuggacuaauuuaaaaaagaau

SEQ ID NO: 21149 - RNA, 22 nt, Human
ucuagagaagaaacaauacaug

SEQ ID NO: 21150 - RNA, 21 nt, Human
ccuacuuccguuacccugaga

SEQ ID NO: 21151 - RNA, 19 nt, Human
gcucaccuuauguaauacu

SEQ ID NO: 21152 - RNA, 20 nt, Human
cuguacccagcugguuggga

SEQ ID NO: 21153 - RNA, 22 nt, Human
cccuucauccugaacgugacca

SEQ ID NO: 21154 - RNA, 22 nt, Human
cuuaaaguauaucucuuaucua

SEQ ID NO: 21155 - RNA, 26 nt, Human
uugagacagagucuuguuuugcagcc

SEQ ID NO: 21156 - RNA, 21 nt, Human
guuauaucagcagacacucca

SEQ ID NO: 21157 - RNA, 21 nt, Human
gcagcccaggccgggguggag

SEQ ID NO: 21158 - RNA, 25 nt, Human
uuguccuccuccuccuggcucggcc

SEQ ID NO: 21159 - RNA, 20 nt, Human
caucuccagguuuucugcca

SEQ ID NO: 21160 - RNA, 20 nt, Human
cucagaggaucagcaagugg

SEQ ID NO: 21161 - RNA, 21 nt, Human
ugagacaagcagguuuuguug

SEQ ID NO: 21162 - RNA, 23 nt, Human
ucuccagccggccaccucaggcc

SEQ ID NO: 21163 - RNA, 22 nt, Human
ucaccaggcugcaagaacagug

SEQ ID NO: 21164 - RNA, 20 nt, Human
cccgaccucagacccugggc

SEQ ID NO: 21165 - RNA, 22 nt, Human
guugggacuuaggugggccaga

SEQ ID NO: 21166 - RNA, 27 nt, Human
gggccuuugcuucucuagcacaauuau

SEQ ID NO: 21167 - RNA, 25 nt, Human
ccuaucccucuuuguucuguuguua

SEQ ID NO: 21168 - RNA, 22 nt, Human
ccucaucucagcccacucugaa

SEQ ID NO: 21169 - RNA, 23 nt, Human
cagcccgccuuggcuuucucccu

SEQ ID NO: 21170 - RNA, 23 nt, Human
uugcccagggauuaggagcagcu

SEQ ID NO: 21171 - RNA, 24 nt, Human
ggccaggaaguccuccaauuuccu

SEQ ID NO: 21172 - RNA, 22 nt, Human
aggcugaggcagaagaaucgcu

SEQ ID NO: 21173 - RNA, 22 nt, Human
aaagucccaggcccagugcagu

SEQ ID NO: 21174 - RNA, 19 nt, Human
agccagcagagagggguga

SEQ ID NO: 21175 - RNA, 22 nt, Human
aaauguauggcauuaagaaaua

SEQ ID NO: 21176 - RNA, 22 nt, Human
gccccugguuugaggaggaggg

SEQ ID NO: 21177 - RNA, 27 nt, Human
cuucuuuaucuuuuccuuucuucagac

SEQ ID NO: 21178 - RNA, 23 nt, Human
gaaagcaaagggcgucucaggga

SEQ ID NO: 21179 - RNA, 27 nt, Human
gggguugggacagggaggguguuuugg

SEQ ID NO: 21180 - RNA, 21 nt, Human
gaggacacaucucccaccauu

SEQ ID NO: 21181 - RNA, 28 nt, Human
gccaggugagcuauggugcugcaccuac

SEQ ID NO: 21182 - RNA, 25 nt, Human
ccgugugccagcacuagccuaggag

SEQ ID NO: 21183 - RNA, 21 nt, Human
acuuccuugggcuuauccugg

SEQ ID NO: 21184 - RNA, 21 nt, Human
gcuagcgucccuacugccucc

SEQ ID NO: 21185 - RNA, 26 nt, Human
gugccacccucucuggcauucaugca

SEQ ID NO: 21186 - RNA, 25 nt, Human
ugcauucacauuuagaaaagugaau

SEQ ID NO: 21187 - RNA, 21 nt, Human
ccaggcucccauccauggccc

SEQ ID NO: 21188 - RNA, 27 nt, Human
uccaaaguagagagcaagucgcccaca

SEQ ID NO: 21189 - RNA, 24 nt, Human
acugaauuuuggaggcaaaggagg

SEQ ID NO: 21190 - RNA, 21 nt, Human
agaaaacaccgaauucugcuu

SEQ ID NO: 21191 - RNA, 22 nt, Human
acucacugcggccucaaccuuc

SEQ ID NO: 21192 - RNA, 22 nt, Human
ggaggcugaggugggaggaucg

SEQ ID NO: 21193 - RNA, 23 nt, Human
gugaucauguuucaggaaggaau

SEQ ID NO: 21194 - RNA, 23 nt, Human
cuucgccuuaccuccuggagcug

SEQ ID NO: 21195 - RNA, 22 nt, Human
ccauccuuugcauuucucugcg

SEQ ID NO: 21196 - RNA, 22 nt, Human
gacacaaaaguccacugaugca

SEQ ID NO: 21197 - RNA, 22 nt, Human
aaucacauuugugccuggugac

SEQ ID NO: 21198 - RNA, 15 nt, Human
caggaauagaucuga

SEQ ID NO: 21199 - RNA, 27 nt, Human
ggcaccacacaguggugcaggcacauu

SEQ ID NO: 21200 - RNA, 21 nt, Human
ugaagcuucgauuucccacug

SEQ ID NO: 21201 - RNA, 24 nt, Human
aggugcuuggcagaaccgcagagu

SEQ ID NO: 21202 - RNA, 20 nt, Human
cucuuucuggcucugccucu

SEQ ID NO: 21203 - RNA, 27 nt, Human
uucauggcuuacuuguuccauaacucc

SEQ ID NO: 21204 - RNA, 24 nt, Human
uuaaacacagguccacguuguguc

SEQ ID NO: 21205 - RNA, 27 nt, Human
auugucaugggauucuuaagugaaccu

SEQ ID NO: 21206 - RNA, 27 nt, Human
cuagugcgcuccagccugggcaacaga

SEQ ID NO: 21207 - RNA, 21 nt, Human
gcucacugcaaccucugccuc

SEQ ID NO: 21208 - RNA, 23 nt, Human
ugacgcacaggcuggagugcagu

SEQ ID NO: 21209 - RNA, 23 nt, Human
gagguggcagcggguaccgagug

SEQ ID NO: 21210 - RNA, 22 nt, Human
ggacgcugcagcccccuccuca

SEQ ID NO: 21211 - RNA, 25 nt, Human
cuuucccugcugaggggcucaggga

SEQ ID NO: 21212 - RNA, 24 nt, Human
aaugacaugaucuccguucacugc

SEQ ID NO: 21213 - RNA, 23 nt, Human
ugcagauucuuggcuggguuuag

SEQ ID NO: 21214 - RNA, 22 nt, Human
gcugugagggccccagcuccac

SEQ ID NO: 21215 - RNA, 28 nt, Human
gaagccaguuccaaaagggaugaaaagg

SEQ ID NO: 21216 - RNA, 23 nt, Human
agagugaacuugggccacuguga

SEQ ID NO: 21217 - RNA, 27 nt, Human
cugggaggagagaagggggcagagucu

SEQ ID NO: 21218 - RNA, 25 nt, Human
gcaugcuugucuuucugcaucucca

SEQ ID NO: 21219 - RNA, 22 nt, Human
uggucucacauacuuguaauca

SEQ ID NO: 21220 - RNA, 22 nt, Human
uguugcccaggauggagugcag

SEQ ID NO: 21221 - RNA, 22 nt, Human
aucucuucaucuguauccucug

SEQ ID NO: 21222 - RNA, 22 nt, Human
gcaacccccucggagccugugu

SEQ ID NO: 21223 - RNA, 27 nt, Human
ccggggucucuggggggcuggagaagc

SEQ ID NO: 21224 - RNA, 23 nt, Human
uggguaggccacugcauucucuu

SEQ ID NO: 21225 - RNA, 22 nt, Human
cuuccaucuggucugaccgcaa

SEQ ID NO: 21226 - RNA, 22 nt, Human
ccugcuuccuguuaccugucuu

SEQ ID NO: 21227 - RNA, 26 nt, Human
uugcucuaucgcccaggcuggagugc

SEQ ID NO: 21228 - RNA, 22 nt, Human
guacuuuucugguuccaaacca

SEQ ID NO: 21229 - RNA, 21 nt, Human
aguuuaguuuuccuccuugcc

SEQ ID NO: 21230 - RNA, 20 nt, Human
agagaggcugccucagccag

SEQ ID NO: 21231 - RNA, 22 nt, Human
auuuauuuaucuaucugucuac

SEQ ID NO: 21232 - RNA, 23 nt, Human
ugcugccucuucuaccccuaugu

SEQ ID NO: 21233 - RNA, 22 nt, Human
uuuugaguuacuucauggaacu

SEQ ID NO: 21234 - RNA, 21 nt, Human
ccgggcauggugacacaugcc

SEQ ID NO: 21235 - RNA, 19 nt, Human
ugagcagucuuccauucca

SEQ ID NO: 21236 - RNA, 19 nt, Human
ccagcacucugccugcucc

SEQ ID NO: 21237 - RNA, 21 nt, Human
gguccagccuguucacacugc

SEQ ID NO: 21238 - RNA, 21 nt, Human
auggagagaaaaauaagcaga

SEQ ID NO: 21239 - RNA, 24 nt, Human
ccgauauuugccauucuuccuaua

SEQ ID NO: 21240 - RNA, 23 nt, Human
ccugaagaaagugaucaagauca

SEQ ID NO: 21241 - RNA, 21 nt, Human
ucaugcaaccuuuccuuagga

SEQ ID NO: 21242 - RNA, 26 nt, Human
gucaccagacugggugcccuccgaug

SEQ ID NO: 21243 - RNA, 27 nt, Human
uggugcacaccuguagucccaacuauu

SEQ ID NO: 21244 - RNA, 27 nt, Human
gcucuaucgcccaggcuggagugcagu

SEQ ID NO: 21245 - RNA, 19 nt, Human
gggggcccccugcccgcac

SEQ ID NO: 21246 - RNA, 27 nt, Human
gaaagagaaucgggccacugccagaaa

SEQ ID NO: 21247 - RNA, 21 nt, Human
gccagccucuggcuuuucugc

SEQ ID NO: 21248 - RNA, 21 nt, Human
uugacuccucuucaucuuagc

SEQ ID NO: 21249 - RNA, 27 nt, Human
uggacaagauuuuccaaccuugcuggc

SEQ ID NO: 21250 - RNA, 22 nt, Human
ucacucaggcuggaauguagug

SEQ ID NO: 21251 - RNA, 20 nt, Human
uugcagaagcacaagccaua

SEQ ID NO: 21252 - RNA, 22 nt, Human
gcccagcguccccuccuuggcu

SEQ ID NO: 21253 - RNA, 19 nt, Human
auucuuuccacaccuguca

SEQ ID NO: 21254 - RNA, 23 nt, Human
ugcuuccggccuccugucccuca

SEQ ID NO: 21255 - RNA, 24 nt, Human
cgcacuugcagaggagcccagugg

SEQ ID NO: 21256 - RNA, 26 nt, Human
guucuguugaucccacuucacuguga

SEQ ID NO: 21257 - RNA, 25 nt, Human
ggcaggguggggcaucaccaccuca

SEQ ID NO: 21258 - RNA, 19 nt, Human
cggaguccaggagaaggug

SEQ ID NO: 21259 - RNA, 27 nt, Human
gccagugcacuccggccugggugacag

SEQ ID NO: 21260 - RNA, 17 nt, Human
accaggcaaaugccuua

SEQ ID NO: 21261 - RNA, 21 nt, Human
cccucugcuuguuuugggacc

SEQ ID NO: 21262 - RNA, 21 nt, Human
aaguuggcuauaauuucucua

SEQ ID NO: 21263 - RNA, 23 nt, Human
aagcaacagaaaccuauccucac

SEQ ID NO: 21264 - RNA, 18 nt, Human
cugcagcugcuggucgcc

SEQ ID NO: 21265 - RNA, 21 nt, Human
cucuaccuugcuccuacuuuu

SEQ ID NO: 21266 - RNA, 22 nt, Human
ugugaccuaggcuggacaucag

SEQ ID NO: 21267 - RNA, 19 nt, Human
ccauugauuccacucugga

SEQ ID NO: 21268 - RNA, 24 nt, Human
guuccuuaaaaacagcaucugagg

SEQ ID NO: 21269 - RNA, 22 nt, Human
ggagaggccuucccggggcccc

SEQ ID NO: 21270 - RNA, 23 nt, Human
uguugcccaagcuggagugaagu

SEQ ID NO: 21271 - RNA, 24 nt, Human
acagcaauaagcacguccuccucc

SEQ ID NO: 21272 - RNA, 27 nt, Human
gaccagccugaccaacauggagaagcc

SEQ ID NO: 21273 - RNA, 27 nt, Human
gaccagccugaccaacguggagaaacc

SEQ ID NO: 21274 - RNA, 23 nt, Human
guagugacaccuaccugcgguca

SEQ ID NO: 21275 - RNA, 21 nt, Human
ucacauggggccuuuucugag

SEQ ID NO: 21276 - RNA, 27 nt, Human
agggugagaaaugaccaaacugcccgu

SEQ ID NO: 21277 - RNA, 20 nt, Human
aaguuaauauaaauguguac

SEQ ID NO: 21278 - RNA, 26 nt, Human
cuccaccccugccuuucagcguugug

SEQ ID NO: 21279 - RNA, 23 nt, Human
agcaggaggaucacuugagccug

SEQ ID NO: 21280 - RNA, 21 nt, Human
auuccaaacagccucuaccuu

SEQ ID NO: 21281 - RNA, 21 nt, Human
gggcugcaccuucccccagga

SEQ ID NO: 21282 - RNA, 19 nt, Human
aacuucugccucccaugcu

SEQ ID NO: 21283 - RNA, 28 nt, Human
gcgagauugggccuccucucccugcacc

SEQ ID NO: 21284 - RNA, 25 nt, Human
uaagaacucauggccacuguggaaa

SEQ ID NO: 21285 - RNA, 28 nt, Human
aaacugagccuucuuuuuaauauauucc

SEQ ID NO: 21286 - RNA, 22 nt, Human
agggcccugcaugccaggucgu

SEQ ID NO: 21287 - RNA, 22 nt, Human
ccugcucccuccuggaaugugc

SEQ ID NO: 21288 - RNA, 23 nt, Human
cgggcagcagcugugugcgggcc

SEQ ID NO: 21289 - RNA, 19 nt, Human
ccagccgccgcgcucccag

SEQ ID NO: 21290 - RNA, 22 nt, Human
ucaacauggugaaaccccgucu

SEQ ID NO: 21291 - RNA, 22 nt, Human
agaccagccugaccaacguggu

SEQ ID NO: 21292 - RNA, 22 nt, Human
aaaccagccuggccaacauagu

SEQ ID NO: 21293 - RNA, 23 nt, Human
uauuucuuagaacuauuuccaaa

SEQ ID NO: 21294 - RNA, 21 nt, Human
aaggaggaggagucugcagcc

SEQ ID NO: 21295 - RNA, 22 nt, Human
ugggacaucgagggcucugcug

SEQ ID NO: 21296 - RNA, 27 nt, Human
ugggagccacugggcaauugccagggc

SEQ ID NO: 21297 - RNA, 28 nt, Human
uuucucuggagacaaggcugugucucuc

SEQ ID NO: 21298 - RNA, 25 nt, Human
gggaaaggccaagagagggucccag

SEQ ID NO: 21299 - RNA, 27 nt, Human
guuguccaggcuggagugcaauggcag

SEQ ID NO: 21300 - RNA, 22 nt, Human
gcuugcccuccaaauguccuuu

SEQ ID NO: 21301 - RNA, 19 nt, Human
aaacauuuuaacuuaaugg

SEQ ID NO: 21302 - RNA, 27 nt, Human
uugcccaggcuggucuugaacuccuag

SEQ ID NO: 21303 - RNA, 24 nt, Human
cuucaucuauucaaauggauuguc

SEQ ID NO: 21304 - RNA, 21 nt, Human
ucagcacuggcuuucuguuuu

SEQ ID NO: 21305 - RNA, 22 nt, Human
uacuagcacuguucuguccuca

SEQ ID NO: 21306 - RNA, 23 nt, Human
uugcccaggaucaagggugcggu

SEQ ID NO: 21307 - RNA, 24 nt, Human
ggcaaagcagcaacuauucacaaa

SEQ ID NO: 21308 - RNA, 27 nt, Human
uuuccccucaagaugucugagucagcu

SEQ ID NO: 21309 - RNA, 24 nt, Human
gugauucuguuuuugaggugcaaa

SEQ ID NO: 21310 - RNA, 23 nt, Human
cuagaugaggugcuuuacgcauc

SEQ ID NO: 21311 - RNA, 24 nt, Human
ucucccucucugcaccugucucau

SEQ ID NO: 21312 - RNA, 23 nt, Human
cuaaaccagaauauuuuggucaa

SEQ ID NO: 21313 - RNA, 27 nt, Human
cuccaucuuaaagaucauuuaucagag

SEQ ID NO: 21314 - RNA, 23 nt, Human
uggaugaauuccaaauucugcuu

SEQ ID NO: 21315 - RNA, 22 nt, Human
ggcuucagaaaaggaguggcca

SEQ ID NO: 21316 - RNA, 22 nt, Human
gcaacguucuucuguuauuccc

SEQ ID NO: 21317 - RNA, 24 nt, Human
uccucccuauacagugcccugccc

SEQ ID NO: 21318 - RNA, 19 nt, Human
gcugggcugccugggcugu

SEQ ID NO: 21319 - RNA, 20 nt, Human
aguacuggagugaaauaaau

SEQ ID NO: 21320 - RNA, 21 nt, Human
uucagucaggcucucuucuau

SEQ ID NO: 21321 - RNA, 25 nt, Human
aucgagccacugcacuccugggcaa

SEQ ID NO: 21322 - RNA, 19 nt, Human
gcagccgcccaacuccugg

SEQ ID NO: 21323 - RNA, 19 nt, Human
cucucgagggcagggacca

SEQ ID NO: 21324 - RNA, 22 nt, Human
caccuccagcccgcgaccuccu

SEQ ID NO: 21325 - RNA, 25 nt, Human
uugcuuuggcuugaaguaugguugg

SEQ ID NO: 21326 - RNA, 24 nt, Human
cucccaaaauguacaguaauucca

SEQ ID NO: 21327 - RNA, 21 nt, Human
uguggggaggggagugacagg

SEQ ID NO: 21328 - RNA, 21 nt, Human
acuuggagauccaaacagcca

SEQ ID NO: 21329 - RNA, 22 nt, Human
aaacuauuccucaggaauucca

SEQ ID NO: 21330 - RNA, 26 nt, Human
aagcaguuuuguaaagggcaaggagg

SEQ ID NO: 21331 - RNA, 20 nt, Human
cuugcagaggaccugucccc

SEQ ID NO: 21332 - RNA, 21 nt, Human
ccaaacacuugggcaaaaaga

SEQ ID NO: 21333 - RNA, 22 nt, Human
ggcucagaaucuuuaccaagga

SEQ ID NO: 21334 - RNA, 23 nt, Human
aaaguuucugggauuggggacgu

SEQ ID NO: 21335 - RNA, 25 nt, Human
aggaauagcccgaggaccgggcugg

SEQ ID NO: 21336 - RNA, 20 nt, Human
ggagaaggaauuggagcagc

SEQ ID NO: 21337 - RNA, 22 nt, Human
ucaguagcgacugaaucugcca

SEQ ID NO: 21338 - RNA, 19 nt, Human
gucaacccaugcugcccuc

SEQ ID NO: 21339 - RNA, 26 nt, Human
acugacacaaaggaagugcccccucc

SEQ ID NO: 21340 - RNA, 22 nt, Human
uugcccuuuuaaaaaauauacc

SEQ ID NO: 21341 - RNA, 20 nt, Human
uuccuugccaaguuuuccua

SEQ ID NO: 21342 - RNA, 21 nt, Human
ggggaguacauucaucuggag

SEQ ID NO: 21343 - RNA, 26 nt, Human
caagagggacuguauuucuguggaaa

SEQ ID NO: 21344 - RNA, 19 nt, Human
gcguaaucucggcucagug

SEQ ID NO: 21345 - RNA, 19 nt, Human
gcgggcucgcguguguaca

SEQ ID NO: 21346 - RNA, 27 nt, Human
gggcuuggggaccagagcugccaccug

SEQ ID NO: 21347 - RNA, 21 nt, Human
aaaucuucuccugugcauuuu

SEQ ID NO: 21348 - RNA, 24 nt, Human
uucauucuguuucauucaguuaua

SEQ ID NO: 21349 - RNA, 26 nt, Human
ugcuaccuuauuaacucacagcaggc

SEQ ID NO: 21350 - RNA, 19 nt, Human
ggaguuagagggaaguuga

SEQ ID NO: 21351 - RNA, 18 nt, Human
cgcacacuccaucccagu

SEQ ID NO: 21352 - RNA, 22 nt, Human
aaccaggguaagggccugggga

SEQ ID NO: 21353 - RNA, 22 nt, Human
acuggaggcggagguugcagug

SEQ ID NO: 21354 - RNA, 20 nt, Human
cacagcagcugccuggguga

SEQ ID NO: 21355 - RNA, 26 nt, Human
gccuuucuuccgccccggugggagcc

SEQ ID NO: 21356 - RNA, 21 nt, Human
gccagcucaucagaaaaacau

SEQ ID NO: 21357 - RNA, 27 nt, Human
ucacauggaucacaguauaaauuucua

SEQ ID NO: 21358 - RNA, 26 nt, Human
cuauucagcaaaaguuaauauucaga

SEQ ID NO: 21359 - RNA, 20 nt, Human
uggaaacaccacugcuaggg

SEQ ID NO: 21360 - RNA, 24 nt, Human
cacuacccugauucuugauuccug

SEQ ID NO: 21361 - RNA, 26 nt, Human
agggaccuguugaacucucucagcug

SEQ ID NO: 21362 - RNA, 21 nt, Human
uuugguuuguuuuaauuuuuu

SEQ ID NO: 21363 - RNA, 20 nt, Human
ugcaccuauguagcucugca

SEQ ID NO: 21364 - RNA, 22 nt, Human
gcccaggcuggagugcaguggc

SEQ ID NO: 21365 - RNA, 22 nt, Human
gcccaggcuagagugcaauggc

SEQ ID NO: 21366 - RNA, 22 nt, Human
acccaggcuggagugcgguggc

SEQ ID NO: 21367 - RNA, 23 nt, Human
guaacaaaagggcuuauucuucc

SEQ ID NO: 21368 - RNA, 19 nt, Human
cucuggauccucacaguca

SEQ ID NO: 21369 - RNA, 19 nt, Human
accaucucagugaggggca

SEQ ID NO: 21370 - RNA, 23 nt, Human
gcccagcaaggucagguuaucug

SEQ ID NO: 21371 - RNA, 25 nt, Human
agcaggagcaugcgcuuccuuccuc

SEQ ID NO: 21372 - RNA, 17 nt, Human
aauaaaaugcauuucag

SEQ ID NO: 21373 - RNA, 28 nt, Human
agaggauggcagcagguauuggguccuc

SEQ ID NO: 21374 - RNA, 22 nt, Human
ugaggcagaaggaaggguaagg

SEQ ID NO: 21375 - RNA, 23 nt, Human
uagacccugguauccucaucaug

SEQ ID NO: 21376 - RNA, 20 nt, Human
uccaggcuggagugcagugg

SEQ ID NO: 21377 - RNA, 27 nt, Human
uguuuuuauaauuuccucacugguaua

SEQ ID NO: 21378 - RNA, 27 nt, Human
gaaagagauugugucucuuucauugcu

SEQ ID NO: 21379 - RNA, 22 nt, Human
aauggcaugaucucagcucacu

SEQ ID NO: 21380 - RNA, 20 nt, Human
gcucacugcauuugguuuuc

SEQ ID NO: 21381 - RNA, 22 nt, Human
uccuucgcagaacaugaguuua

SEQ ID NO: 21382 - RNA, 22 nt, Human
uccguaauuccaggcuuguggc

SEQ ID NO: 21383 - RNA, 26 nt, Human
cugccucuuguccuguauagcaaccu

SEQ ID NO: 21384 - RNA, 25 nt, Human
ugccaggcuggauuguacgggcccc

SEQ ID NO: 21385 - RNA, 21 nt, Human
cuaauuucaaauuuaccucuu

SEQ ID NO: 21386 - RNA, 20 nt, Human
ccccaaaauauucccaucuu

SEQ ID NO: 21387 - RNA, 21 nt, Human
gcgggucaggcccacagccuu

SEQ ID NO: 21388 - RNA, 23 nt, Human
gucgcccaggcuggagugcagug

SEQ ID NO: 21389 - RNA, 23 nt, Human
gucacccaggcuggagugcggug

SEQ ID NO: 21390 - RNA, 23 nt, Human
guugcccaggcuggaguguagug

SEQ ID NO: 21391 - RNA, 22 nt, Human
ccccaauccagcuccuggagga

SEQ ID NO: 21392 - RNA, 28 nt, Human
ucgggcggcaaggaggagcuugcuggag

SEQ ID NO: 21393 - RNA, 20 nt, Human
gagcccaacugcuuggacgc

SEQ ID NO: 21394 - RNA, 23 nt, Human
ucuugcuauguugcccaggcugg

SEQ ID NO: 21395 - RNA, 29 nt, Human
uccaaaaggagcugcaauuuuaagucuuc

SEQ ID NO: 21396 - RNA, 20 nt, Human
gcgggcagaggagagggagg

SEQ ID NO: 21397 - RNA, 22 nt, Human
aggcugagacaggaggaucggu

SEQ ID NO: 21398 - RNA, 20 nt, Human
ucuagcaaauagguucagug

SEQ ID NO: 21399 - RNA, 22 nt, Human
gggauuacaggugcccgccacc

SEQ ID NO: 21400 - RNA, 27 nt, Human
auucauagcuggucuuauuuguaaagc

SEQ ID NO: 21401 - RNA, 22 nt, Human
ucacucaggcuggaguacagug

SEQ ID NO: 21402 - RNA, 21 nt, Human
aguguucucucauuuaaugca

SEQ ID NO: 21403 - RNA, 27 nt, Human
cuucccaaggaagcccccacccucugc

SEQ ID NO: 21404 - RNA, 21 nt, Human
cuucccagcacccaccugcca

SEQ ID NO: 21405 - RNA, 22 nt, Human
cgccuguaauuccagugcuuug

SEQ ID NO: 21406 - RNA, 23 nt, Human
aacucuggcuccuucuccauaaa

SEQ ID NO: 21407 - RNA, 22 nt, Human
guucaagaaccuccuguacuua

SEQ ID NO: 21408 - RNA, 24 nt, Human
ggagagaaagggcucccaccugca

SEQ ID NO: 21409 - RNA, 19 nt, Human
uccaggcuagagugcagug

SEQ ID NO: 21410 - RNA, 24 nt, Human
ccaguuaagcagagacuucacuga

SEQ ID NO: 21411 - RNA, 23 nt, Human
aauacuucaaauguuugaugauu

SEQ ID NO: 21412 - RNA, 23 nt, Human
ccauagcugguaggagagggaag

SEQ ID NO: 21413 - RNA, 21 nt, Human
uagacuucucauuuauuuuca

SEQ ID NO: 21414 - RNA, 26 nt, Human
augcugaugaccuuaucagcuuccug

SEQ ID NO: 21415 - RNA, 21 nt, Human
uucucaguggagucaggauuu

SEQ ID NO: 21416 - RNA, 27 nt, Human
ccacuguacuccagcccggcacuccag

SEQ ID NO: 21417 - RNA, 22 nt, Human
uaccuccgagguucaagagauu

SEQ ID NO: 21418 - RNA, 21 nt, Human
augagguggagguugcgguga

SEQ ID NO: 21419 - RNA, 21 nt, Human
gggagguggagguugcauuga

SEQ ID NO: 21420 - RNA, 27 nt, Human
ggucucgaucuccugaccucgugaucc

SEQ ID NO: 21421 - RNA, 27 nt, Human
ugaaacuauucauuuugcuucuaguuu

SEQ ID NO: 21422 - RNA, 20 nt, Human
uauauguauguauguguaug

SEQ ID NO: 21423 - RNA, 22 nt, Human
ucuuauccucuuugauauuuua

SEQ ID NO: 21424 - RNA, 26 nt, Human
gcucugucgccaaguuggagugcaau

SEQ ID NO: 21425 - RNA, 27 nt, Human
ggugaagcccggcgggguugcccacca

SEQ ID NO: 21426 - RNA, 24 nt, Human
ggagauugagaaggagagaaagug

SEQ ID NO: 21427 - RNA, 21 nt, Human
accacagucuguaaucccagg

SEQ ID NO: 21428 - RNA, 19 nt, Human
cagcuagcaaaagcaaaga

SEQ ID NO: 21429 - RNA, 18 nt, Human
agagcucuguuacagccc

SEQ ID NO: 21430 - RNA, 26 nt, Human
ccucucgggggcgggcucccggcgcu

SEQ ID NO: 21431 - RNA, 22 nt, Human
uucaguccugugugcuuucaga

SEQ ID NO: 21432 - RNA, 28 nt, Human
gcaaaagcuggggagaugccagugacaa

SEQ ID NO: 21433 - RNA, 18 nt, Human
agaccaggugaggggaua

SEQ ID NO: 21434 - RNA, 25 nt, Human
gggggcacggccuggcauuucacgc

SEQ ID NO: 21435 - RNA, 27 nt, Human
aaagugcuaggauuacaggcccgugcc

SEQ ID NO: 21436 - RNA, 22 nt, Human
uccauugcugaauucgauagga

SEQ ID NO: 21437 - RNA, 27 nt, Human
acugcaaccucugccuccugaguucac

SEQ ID NO: 21438 - RNA, 21 nt, Human
ucaauuucucaauaguucuua

SEQ ID NO: 21439 - RNA, 27 nt, Human
gcacagcccgccuccuuccgcggcgcc

SEQ ID NO: 21440 - RNA, 27 nt, Human
gacgagcccucacacaccuggucucca

SEQ ID NO: 21441 - RNA, 22 nt, Human
ugugccugugguuaacaucuca

SEQ ID NO: 21442 - RNA, 21 nt, Human
ucaucaggaacgaaugcagga

SEQ ID NO: 21443 - RNA, 27 nt, Human
gaguagcugggauuauagguacaugcc

SEQ ID NO: 21444 - RNA, 22 nt, Human
cucuccggccaacuguccugaa

SEQ ID NO: 21445 - RNA, 22 nt, Human
uaaugcugcccucacugccucu

SEQ ID NO: 21446 - RNA, 21 nt, Human
caaugugguggagaaagggaa

SEQ ID NO: 21447 - RNA, 23 nt, Human
cagacagagcagcacagugagca

SEQ ID NO: 21448 - RNA, 26 nt, Human
ggagaagagaaggaaaagcacacgca

SEQ ID NO: 21449 - RNA, 20 nt, Human
ccucccccagcuccagggcu

SEQ ID NO: 21450 - RNA, 26 nt, Human
gggcagggagagauccggggaggagu

SEQ ID NO: 21451 - RNA, 21 nt, Human
ggaaggcaugcuuguggauga

SEQ ID NO: 21452 - RNA, 25 nt, Human
gcccaggcuggggugcaguggcgcg

SEQ ID NO: 21453 - RNA, 22 nt, Human
guggcugucaaugggaccugug

SEQ ID NO: 21454 - RNA, 18 nt, Human
uccgaaugcauacaggag

SEQ ID NO: 21455 - RNA, 27 nt, Human
cccaaguagcuaggauuacagacaccc

SEQ ID NO: 21456 - RNA, 22 nt, Human
ccugcucugcccucuccccacc

SEQ ID NO: 21457 - RNA, 25 nt, Human
gucacccagccagaaggaaugcaca

SEQ ID NO: 21458 - RNA, 22 nt, Human
gcugaccuugcuuuagaaauag

SEQ ID NO: 21459 - RNA, 22 nt, Human
ucugggcacugcuggccagucc

SEQ ID NO: 21460 - RNA, 14 nt, Human
acccuugcuuagga

SEQ ID NO: 21461 - RNA, 24 nt, Human
cuugccugccuuccucgccaguag

SEQ ID NO: 21462 - RNA, 21 nt, Human
uuuaaccggcauuugcugcua

SEQ ID NO: 21463 - RNA, 22 nt, Human
ccccgucagcgugugcuggucc

SEQ ID NO: 21464 - RNA, 24 nt, Human
aauuuuaugcauguaucuacugca

SEQ ID NO: 21465 - RNA, 25 nt, Human
caggaggccagggaaagcaucucug

SEQ ID NO: 21466 - RNA, 31 nt, Human
augcgcaggcuggcccugcccugguuuccug

SEQ ID NO: 21467 - RNA, 30 nt, Human
ugggguucguggaaagggugcugcuucccu

SEQ ID NO: 21468 - RNA, 20 nt, Human
cagcccagccgcguuccgaa

SEQ ID NO: 21469 - RNA, 26 nt, Human
ucccuaguggguuuucccggggacuc

SEQ ID NO: 21470 - RNA, 21 nt, Human
auagauguuuccuugccuugu

SEQ ID NO: 21471 - RNA, 20 nt, Human
cuacuguguggcaagaaggu

SEQ ID NO: 21472 - RNA, 20 nt, Human
aggaggaggaaugagaguga

SEQ ID NO: 21473 - RNA, 21 nt, Human
cagaauuaaaccuguuuuaua

SEQ ID NO: 21474 - RNA, 19 nt, Human
uucuucaacaaauuuuggg

SEQ ID NO: 21475 - RNA, 21 nt, Human
guuucuucaucuuauauugug

SEQ ID NO: 21476 - RNA, 24 nt, Human
auccuccuccuccuccacuugcag

SEQ ID NO: 21477 - RNA, 19 nt, Human
cuguaugccgaucaucuca

SEQ ID NO: 21478 - RNA, 23 nt, Human
uucaaggaauucucccugccuca

SEQ ID NO: 21479 - RNA, 26 nt, Human
cuuuucucuuaauuuuuauuguguuu

SEQ ID NO: 21480 - RNA, 20 nt, Human
ggugggcaggucccaccuug

SEQ ID NO: 21481 - RNA, 22 nt, Human
agcuuugacauucaaauuaugu

SEQ ID NO: 21482 - RNA, 27 nt, Human
ucugggagccacugggccaggggcccc

SEQ ID NO: 21483 - RNA, 20 nt, Human
aucuucagaaaaccuaagca

SEQ ID NO: 21484 - RNA, 22 nt, Human
guuuuaaaagaaauggauucua

SEQ ID NO: 21485 - RNA, 21 nt, Human
agcuaaaaauauuacucuagu

SEQ ID NO: 21486 - RNA, 21 nt, Human
auccaggccccaucagcaucc

SEQ ID NO: 21487 - RNA, 22 nt, Human
cccucuaccuccuccaggcugg

SEQ ID NO: 21488 - RNA, 20 nt, Human
ggcagggcccggcagaggaa

SEQ ID NO: 21489 - RNA, 21 nt, Human
gauaccacucucucagccaca

SEQ ID NO: 21490 - RNA, 24 nt, Human
agccauuuaccucaaaggacccag

SEQ ID NO: 21491 - RNA, 21 nt, Human
guuuuucuguguaugggccug

SEQ ID NO: 21492 - RNA, 25 nt, Human
ggcugccucaugacuuuaaucagcu

SEQ ID NO: 21493 - RNA, 21 nt, Human
ccauuuuuccuccccaagaau

SEQ ID NO: 21494 - RNA, 26 nt, Human
gguccccaucagccuggagcagcccu

SEQ ID NO: 21495 - RNA, 26 nt, Human
ccaugaucucacuuaaccaccccaau

SEQ ID NO: 21496 - RNA, 21 nt, Human
gguggcaccuccagacacccu

SEQ ID NO: 21497 - RNA, 26 nt, Human
agucucucuuuccggauucugccucc

SEQ ID NO: 21498 - RNA, 22 nt, Human
cuagaggcggaguuugcaguga

SEQ ID NO: 21499 - RNA, 21 nt, Human
cagugucucugggcuuugugc

SEQ ID NO: 21500 - RNA, 25 nt, Human
cucuaguauccuuugcuugcuucuu

SEQ ID NO: 21501 - RNA, 27 nt, Human
aucagagaauucacugacguguggcuu

SEQ ID NO: 21502 - RNA, 26 nt, Human
ggcuauacugaaaucuguuauuuuag

SEQ ID NO: 21503 - RNA, 22 nt, Human
ugaacacaggcuuguuaauguc

SEQ ID NO: 21504 - RNA, 22 nt, Human
caucugucugauucuugugucu

SEQ ID NO: 21505 - RNA, 19 nt, Human
aucauuauagcauguaaua

SEQ ID NO: 21506 - RNA, 26 nt, Human
acuggugacuacagacguucucaggc

SEQ ID NO: 21507 - RNA, 21 nt, Human
aaaacccuucaucaugauauc

SEQ ID NO: 21508 - RNA, 27 nt, Human
uuuucuuucuugucccauucugggaug

SEQ ID NO: 21509 - RNA, 29 nt, Human
uggcgcgcagagugcaccuuccugagcuc

SEQ ID NO: 21510 - RNA, 30 nt, Human
cagacaccuggcagcccugccucauaucaa

SEQ ID NO: 21511 - RNA, 26 nt, Human
uccugccucuccccaaacauuaauca

SEQ ID NO: 21512 - RNA, 24 nt, Human
gcaggucuuuauuucuucuguaaa

SEQ ID NO: 21513 - RNA, 22 nt, Human
accgaggcuggagugcaguggc

SEQ ID NO: 21514 - RNA, 22 nt, Human
uuuaucugccaaaacaaggaca

SEQ ID NO: 21515 - RNA, 26 nt, Human
gguggcuucagugggguggagagugg

SEQ ID NO: 21516 - RNA, 25 nt, Human
ggagagaaggggaggaggacuccag

SEQ ID NO: 21517 - RNA, 22 nt, Human
ccaggaggugagauggcagcug

SEQ ID NO: 21518 - RNA, 20 nt, Human
ucugcugcucgccgcucuuc

SEQ ID NO: 21519 - RNA, 22 nt, Human
caaccccaaacaauuccaucuc

SEQ ID NO: 21520 - RNA, 21 nt, Human
cuugccuggcccuccuccccc

SEQ ID NO: 21521 - RNA, 25 nt, Human
gaggaaggagacccuggacaguaag

SEQ ID NO: 21522 - RNA, 22 nt, Human
ccaaguagcugggacugcaagu

SEQ ID NO: 21523 - RNA, 23 nt, Human
cccugcuccuugugggcgcucac

SEQ ID NO: 21524 - RNA, 22 nt, Human
guccuguccugucccacucagg

SEQ ID NO: 21525 - RNA, 27 nt, Human
ccugaaaaaugccucauuaccuugugc

SEQ ID NO: 21526 - RNA, 22 nt, Human
ccuaaaguacugggauuacagg

SEQ ID NO: 21527 - RNA, 23 nt, Human
caucccccuucuuccuccccuca

SEQ ID NO: 21528 - RNA, 27 nt, Human
ugggagguggaggaggguugcagcucc

SEQ ID NO: 21529 - RNA, 23 nt, Human
ggaacuccugccuuauuuauccu

SEQ ID NO: 21530 - RNA, 21 nt, Human
cuguuccccucugcuacuagc

SEQ ID NO: 21531 - RNA, 21 nt, Human
aaagaacauagaaaaggcaau

SEQ ID NO: 21532 - RNA, 19 nt, Human
gacuacaggcaugagccac

SEQ ID NO: 21533 - RNA, 22 nt, Human
uggaucauaguaaagaguaguc

SEQ ID NO: 21534 - RNA, 27 nt, Human
ggcaggcaguggggccucuucaucagc

SEQ ID NO: 21535 - RNA, 20 nt, Human
cggagcacaggucucugcug

SEQ ID NO: 21536 - RNA, 26 nt, Human
agauucucauugauguucuguauuca

SEQ ID NO: 21537 - RNA, 23 nt, Human
gagggcuggagucaggggacuuc

SEQ ID NO: 21538 - RNA, 23 nt, Human
gggcucucugggcagcugauguc

SEQ ID NO: 21539 - RNA, 21 nt, Human
ucuuguucugcccuccagaga

SEQ ID NO: 21540 - RNA, 22 nt, Human
uagccuuuugccuguggagagu

SEQ ID NO: 21541 - RNA, 23 nt, Human
ccgggcggcggagauugcaguga

SEQ ID NO: 21542 - RNA, 23 nt, Human
ccgggaggcggagcuugcaguga

SEQ ID NO: 21543 - RNA, 22 nt, Human
uacuggcuucguauuuuauuua

SEQ ID NO: 21544 - RNA, 23 nt, Human
ggcagaggucucuuugcuucauu

SEQ ID NO: 21545 - RNA, 23 nt, Human
uuuuguuauuaggagaaggugag

SEQ ID NO: 21546 - RNA, 22 nt, Human
cuuuuugucgucauugcuggug

SEQ ID NO: 21547 - RNA, 22 nt, Human
aaaugccaaaccaagcaaauua

SEQ ID NO: 21548 - RNA, 21 nt, Human
aggcuggagugcaguggcgaa

SEQ ID NO: 21549 - RNA, 22 nt, Human
guuuucagcucuggagcacaga

SEQ ID NO: 21550 - RNA, 23 nt, Human
caauauuuuuggacuggcagacu

SEQ ID NO: 21551 - RNA, 19 nt, Human
ucuggggugaggccagccu

SEQ ID NO: 21552 - RNA, 22 nt, Human
cugucuccuggacucuccuggg

SEQ ID NO: 21553 - RNA, 27 nt, Human
gaggaagaggguaucccuuuaggaugg

SEQ ID NO: 21554 - RNA, 21 nt, Human
gaucccgggacaggauggggg

SEQ ID NO: 21555 - RNA, 21 nt, Human
uuaugaaguuuaaaaauagcu

SEQ ID NO: 21556 - RNA, 25 nt, Human
aaccaaaaaacugcuccuucacccu

SEQ ID NO: 21557 - RNA, 25 nt, Human
ggggugaggagagcagccagaggaa

SEQ ID NO: 21558 - RNA, 23 nt, Human
gaucaaauaauugcuucagauga

SEQ ID NO: 21559 - RNA, 23 nt, Human
cccgcugacugccccagagccug

SEQ ID NO: 21560 - RNA, 25 nt, Human
aaacuccccuccacccuccucucuc

SEQ ID NO: 21561 - RNA, 27 nt, Human
aggaugcugggaaucugcagggggaga

SEQ ID NO: 21562 - RNA, 21 nt, Human
uggggacaggggcaggaggaa

SEQ ID NO: 21563 - RNA, 20 nt, Human
cccagucuggagugcagugg

SEQ ID NO: 21564 - RNA, 21 nt, Human
cuuaaacaccaauuccugaua

SEQ ID NO: 21565 - RNA, 19 nt, Human
cccuacuccugucauuaca

SEQ ID NO: 21566 - RNA, 22 nt, Human
cggaagccugcguaacuuucuc

SEQ ID NO: 21567 - RNA, 21 nt, Human
cagcugaaggcaguggcaggg

SEQ ID NO: 21568 - RNA, 26 nt, Human
ccuguaaucccagcacuuugauaggc

SEQ ID NO: 21569 - RNA, 25 nt, Human
uuccuguuacaauauuuagcauuau

SEQ ID NO: 21570 - RNA, 26 nt, Human
gggaggcagcaucugggggcagugga

SEQ ID NO: 21571 - RNA, 28 nt, Human
ccugguucugcuauccuuagucauaacu

SEQ ID NO: 21572 - RNA, 23 nt, Human
gggaugcucauuaguaaaucuaa

SEQ ID NO: 21573 - RNA, 26 nt, Human
gggcuguagccugacaaaggguuucc

SEQ ID NO: 21574 - RNA, 22 nt, Human
aaacugaagcuguucucaggau

SEQ ID NO: 21575 - RNA, 22 nt, Human
uucugccagacugagggugcuu

SEQ ID NO: 21576 - RNA, 20 nt, Human
aauauagccaccuguuaaca

SEQ ID NO: 21577 - RNA, 18 nt, Human
cuucugaaaauugcagug

SEQ ID NO: 21578 - RNA, 27 nt, Human
uaccacugccuucccuucuagcccagg

SEQ ID NO: 21579 - RNA, 27 nt, Human
gccucccccacuuucuuucuuucuuua

SEQ ID NO: 21580 - RNA, 21 nt, Human
cccugaggaggggauggaggg

SEQ ID NO: 21581 - RNA, 20 nt, Human
guugcaggcaucacccacgc

SEQ ID NO: 21582 - RNA, 23 nt, Human
ccaggaaguggagacugcaguga

SEQ ID NO: 21583 - RNA, 21 nt, Human
uaggaggcggaggugggggug

SEQ ID NO: 21584 - RNA, 31 nt, Human
uucuuuauuguagcaacauacacucucaaug

SEQ ID NO: 21585 - RNA, 21 nt, Human
uuaguaaaggggcccagaaau

SEQ ID NO: 21586 - RNA, 24 nt, Human
ucuuaauauuucuccaucauggcc

SEQ ID NO: 21587 - RNA, 27 nt, Human
ccaacuuggaauauuuauaaaacucca

SEQ ID NO: 21588 - RNA, 24 nt, Human
gccugucccugucuccuagcgccc

SEQ ID NO: 21589 - RNA, 24 nt, Human
ggcacuuugccacuguguggcagu

SEQ ID NO: 21590 - RNA, 20 nt, Human
uuuguacugcuuuaugguca

SEQ ID NO: 21591 - RNA, 23 nt, Human
ucugcugcugugacaucucccuc

SEQ ID NO: 21592 - RNA, 20 nt, Human
gggagcacuggagugcaggg

SEQ ID NO: 21593 - RNA, 23 nt, Human
uagccgcacccugcaccugcugc

SEQ ID NO: 21594 - RNA, 23 nt, Human
ucacauaaagaaaugcguugaag

SEQ ID NO: 21595 - RNA, 26 nt, Human
cggggccgccucccucuucucuccag

SEQ ID NO: 21596 - RNA, 22 nt, Human
cuguucuggagcugcuguucca

SEQ ID NO: 21597 - RNA, 18 nt, Human
uccuaaccugccgggguc

SEQ ID NO: 21598 - RNA, 23 nt, Human
ucucgucgcccaggcuggaaugc

SEQ ID NO: 21599 - RNA, 22 nt, Human
gugauuccuggcuucauuuuuu

SEQ ID NO: 21600 - RNA, 24 nt, Human
ugucacacaggcuggagugcagug

SEQ ID NO: 21601 - RNA, 21 nt, Human
ccugaaaccaaaaagcuccug

SEQ ID NO: 21602 - RNA, 20 nt, Human
acagcagugaugacacuguc

SEQ ID NO: 21603 - RNA, 24 nt, Human
uuuugcagaggauuuguguguccu

SEQ ID NO: 21604 - RNA, 21 nt, Human
auuguccaggcuggucucgaa

SEQ ID NO: 21605 - RNA, 26 nt, Human
uuaagacugaccuaacgcuggauuau

SEQ ID NO: 21606 - RNA, 22 nt, Human
accauggucccaggauuccauc

SEQ ID NO: 21607 - RNA, 21 nt, Human
uaguucuguagaaaugguugu

SEQ ID NO: 21608 - RNA, 25 nt, Human
ucugucacucaggcuggaguacagu

SEQ ID NO: 21609 - RNA, 22 nt, Human
gaauucaggaggcggagguugc

SEQ ID NO: 21610 - RNA, 24 nt, Human
gugccuggcagcugccugcauuuc

SEQ ID NO: 21611 - RNA, 24 nt, Human
agggaaagcacuggggugggggag

SEQ ID NO: 21612 - RNA, 25 nt, Human
guggauguggguagggcugggagga

SEQ ID NO: 21613 - RNA, 22 nt, Human
gcaacucuccuuaauuuuguuu

SEQ ID NO: 21614 - RNA, 26 nt, Human
gcaggcaaggauggaugugguugaca

SEQ ID NO: 21615 - RNA, 22 nt, Human
ggcucacugcaaccuccgacuc

SEQ ID NO: 21616 - RNA, 26 nt, Human
aacugcacuaguguuuauaccagcaa

SEQ ID NO: 21617 - RNA, 22 nt, Human
cacacacacccuuccccacucc

SEQ ID NO: 21618 - RNA, 19 nt, Human
uaugguggaagcuggguga

SEQ ID NO: 21619 - RNA, 20 nt, Human
caguuauuuccagcaugcua

SEQ ID NO: 21620 - RNA, 27 nt, Human
cgggcagcaggcaggcggcgggcgcuc

SEQ ID NO: 21621 - RNA, 20 nt, Human
cagcggugggaaggaaaggc

SEQ ID NO: 21622 - RNA, 18 nt, Human
gugcaguguacauuucca

SEQ ID NO: 21623 - RNA, 24 nt, Human
gggcauauaggcaccagagcuuua

SEQ ID NO: 21624 - RNA, 20 nt, Human
gcugcagugucauagcaaua

SEQ ID NO: 21625 - RNA, 26 nt, Human
uaucuucugccuuucacuugcaucca

SEQ ID NO: 21626 - RNA, 21 nt, Human
gcaugggcugcauuaucuaca

SEQ ID NO: 21627 - RNA, 20 nt, Human
agcccauaauguuacuguaa

SEQ ID NO: 21628 - RNA, 22 nt, Human
ucuuagcagugauuuuuaucca

SEQ ID NO: 21629 - RNA, 27 nt, Human
uugccugucaaaggcuggagggcagga

SEQ ID NO: 21630 - RNA, 20 nt, Human
aacacacagagccaaaaagc

SEQ ID NO: 21631 - RNA, 20 nt, Human
ucucacugcagucuuauuuc

SEQ ID NO: 21632 - RNA, 21 nt, Human
ccuauuugucaguggugcaaa

SEQ ID NO: 21633 - RNA, 27 nt, Human
gagaucugagaccgugagcagggaaga

SEQ ID NO: 21634 - RNA, 24 nt, Human
ggugucccugucguggagcugggg

SEQ ID NO: 21635 - RNA, 25 nt, Human
cuggcugcauuaauauugaaacuac

SEQ ID NO: 21636 - RNA, 22 nt, Human
caaaacugaucaguuuugagag

SEQ ID NO: 21637 - RNA, 20 nt, Human
ccucuucucuucccugcgcc

SEQ ID NO: 21638 - RNA, 21 nt, Human
ucugcugucuguaguucugug

SEQ ID NO: 21639 - RNA, 25 nt, Human
caaugagaggccagaacacucugga

SEQ ID NO: 21640 - RNA, 27 nt, Human
cacugccucucccuggcccucaguuuc

SEQ ID NO: 21641 - RNA, 23 nt, Human
ugcagugacuuugggcagagggu

SEQ ID NO: 21642 - RNA, 23 nt, Human
guugcccaggcugaagugcagug

SEQ ID NO: 21643 - RNA, 23 nt, Human
augagugugugugcgugugaacg

SEQ ID NO: 21644 - RNA, 27 nt, Human
cccugcaggaaaaauauggcucaggag

SEQ ID NO: 21645 - RNA, 25 nt, Human
cccaccccaccggcagcguccaggu

SEQ ID NO: 21646 - RNA, 26 nt, Human
uguagaaggaaagggagcugaaauag

SEQ ID NO: 21647 - RNA, 23 nt, Human
gucugccacacuggugcaccuug

SEQ ID NO: 21648 - RNA, 24 nt, Human
agcauuugacaaauuuuaugcuua

SEQ ID NO: 21649 - RNA, 24 nt, Human
aaaugucuaucucauuugcugccu

SEQ ID NO: 21650 - RNA, 23 nt, Human
aucacccagccucugagagcagu

SEQ ID NO: 21651 - RNA, 21 nt, Human
auuuccucaaauuugccucaa

SEQ ID NO: 21652 - RNA, 19 nt, Human
uagggaggccaggaggagc

SEQ ID NO: 21653 - RNA, 22 nt, Human
ccuguaaucccagcuacucugg

SEQ ID NO: 21654 - RNA, 28 nt, Human
agauugcaccacugcacuccagccgggg

SEQ ID NO: 21655 - RNA, 20 nt, Human
ucauucuuugugguaguaca

SEQ ID NO: 21656 - RNA, 19 nt, Human
agccuggucccugcccuua

SEQ ID NO: 21657 - RNA, 27 nt, Human
ggguacaccccucugcccacagccuca

SEQ ID NO: 21658 - RNA, 18 nt, Human
ucugcucuacagugcagu

SEQ ID NO: 21659 - RNA, 27 nt, Human
agguaccccuucuuaucagcgguaaaa

SEQ ID NO: 21660 - RNA, 26 nt, Human
ccccacuggggagagaccugugauuu

SEQ ID NO: 21661 - RNA, 20 nt, Human
gcaggugcggggaagggaag

SEQ ID NO: 21662 - RNA, 22 nt, Human
gagcgucaguuucaccucccca

SEQ ID NO: 21663 - RNA, 21 nt, Human
cucgacucauccauccaggcc

SEQ ID NO: 21664 - RNA, 18 nt, Human
uggucagcaaaaccaaga

SEQ ID NO: 21665 - RNA, 24 nt, Human
ggaaaacugccuuuuaucugccca

SEQ ID NO: 21666 - RNA, 26 nt, Human
gggagggagaaagaagucgggggccg

SEQ ID NO: 21667 - RNA, 23 nt, Human
aacucacaccugccucuucugca

SEQ ID NO: 21668 - RNA, 20 nt, Human
gugaggaggaggcugagggc

SEQ ID NO: 21669 - RNA, 27 nt, Human
ggucaggcauuauuauuacuaaccuua

SEQ ID NO: 21670 - RNA, 21 nt, Human
ggcaccugcauuuuaaagcgc

SEQ ID NO: 21671 - RNA, 21 nt, Human
aggugggauuuguaaagcuuu

SEQ ID NO: 21672 - RNA, 19 nt, Human
ggaaggcagggcgcagugg

SEQ ID NO: 21673 - RNA, 21 nt, Human
ugguguggcacugggagcugc

SEQ ID NO: 21674 - RNA, 22 nt, Human
ugcaaccuccgccucccugguu

SEQ ID NO: 21675 - RNA, 25 nt, Human
ccuccugcccugggcacugccucca

SEQ ID NO: 21676 - RNA, 26 nt, Human
aggcugggguggacucagaugccagg

SEQ ID NO: 21677 - RNA, 22 nt, Human
acuuucucuuacuugcuguacu

SEQ ID NO: 21678 - RNA, 22 nt, Human
agaaagauggagccugggucuc

SEQ ID NO: 21679 - RNA, 21 nt, Human
uugcccagggcuacagccucu

SEQ ID NO: 21680 - RNA, 27 nt, Human
ggucucaaacuccugaccucaggcaau

SEQ ID NO: 21681 - RNA, 21 nt, Human
ggucacugagggccucuguca

SEQ ID NO: 21682 - RNA, 23 nt, Human
agcucuugauaggacuuccuuaa

SEQ ID NO: 21683 - RNA, 21 nt, Human
agcgguuuugccucagcugcu

SEQ ID NO: 21684 - RNA, 25 nt, Human
ucacccaggcgggaguggugcaaug

SEQ ID NO: 21685 - RNA, 17 nt, Human
ccaacuccaccaaaaag

SEQ ID NO: 21686 - RNA, 21 nt, Human
uggaaaggaugcuucugcuca

SEQ ID NO: 21687 - RNA, 22 nt, Human
gccggucugggucuccaggaag

SEQ ID NO: 21688 - RNA, 19 nt, Human
ugcccucccugccucuuug

SEQ ID NO: 21689 - RNA, 27 nt, Human
caucugugugugucugucagugucucu

SEQ ID NO: 21690 - RNA, 27 nt, Human
agcgcugggcuggugugcaguggugcg

SEQ ID NO: 21691 - RNA, 20 nt, Human
uccccuuuccaaggcugcuu

SEQ ID NO: 21692 - RNA, 22 nt, Human
gggccuaguguucccagcacug

SEQ ID NO: 21693 - RNA, 29 nt, Human
cccuuccguucccucccugucagggcgua

SEQ ID NO: 21694 - RNA, 21 nt, Human
uauauuuguaucacaccaguu

SEQ ID NO: 21695 - RNA, 18 nt, Human
gcaggaggcagacuugca

SEQ ID NO: 21696 - RNA, 24 nt, Human
aguuucagaucuguguacaguuuc

SEQ ID NO: 21697 - RNA, 20 nt, Human
agcggaugccuccucaggaa

SEQ ID NO: 21698 - RNA, 25 nt, Human
cucuuugccucugcuuugucaugcc

SEQ ID NO: 21699 - RNA, 31 nt, Human
cuguaguccauuauuacuugggucuuuacuu

SEQ ID NO: 21700 - RNA, 22 nt, Human
augagacagacuauuaccgcaa

SEQ ID NO: 21701 - RNA, 23 nt, Human
cgcacagucugccuguccugagg

SEQ ID NO: 21702 - RNA, 21 nt, Human
aguguagaaacccacgucugu

SEQ ID NO: 21703 - RNA, 22 nt, Human
ccuucaguuccucacccaucag

SEQ ID NO: 21704 - RNA, 22 nt, Human
cuuggcuggucccuauccugcc

SEQ ID NO: 21705 - RNA, 26 nt, Human
aagaauugggaacugggauauaaguc

SEQ ID NO: 21706 - RNA, 24 nt, Human
uugcucuuauaccacaaauacauu

SEQ ID NO: 21707 - RNA, 19 nt, Human
uuucaucuguuuacacucu

SEQ ID NO: 21708 - RNA, 26 nt, Human
ucgccuaaauaucugugccuuugccu

SEQ ID NO: 21709 - RNA, 27 nt, Human
ucacucuugucgcucaggcuggagugc

SEQ ID NO: 21710 - RNA, 18 nt, Human
gccuuucuccaccaggcc

SEQ ID NO: 21711 - RNA, 21 nt, Human
agaagugugggaaugaugggu

SEQ ID NO: 21712 - RNA, 22 nt, Human
cagggcgggggccuggagcagc

SEQ ID NO: 21713 - RNA, 24 nt, Human
uucaguuuuuguaucuuggggcaa

SEQ ID NO: 21714 - RNA, 23 nt, Human
cccugcucacucuaggugccucc

SEQ ID NO: 21715 - RNA, 22 nt, Human
uuuuuuaugucaaaauguuaca

SEQ ID NO: 21716 - RNA, 18 nt, Human
cugcccccagcuucugcc

SEQ ID NO: 21717 - RNA, 27 nt, Human
cuccucuuggaaccaaaggacugcagc

SEQ ID NO: 21718 - RNA, 24 nt, Human
gucacccaggcugggaauugcagu

SEQ ID NO: 21719 - RNA, 21 nt, Human
ggaggcugggcacagagguca

SEQ ID NO: 21720 - RNA, 26 nt, Human
uagcucuuuacagaaaaugcaccuuu

SEQ ID NO: 21721 - RNA, 22 nt, Human
ccgggaggcagaaguugcagug

SEQ ID NO: 21722 - RNA, 20 nt, Human
uuuaagaguauguugcuuuu

SEQ ID NO: 21723 - RNA, 24 nt, Human
ccugcaaguugcucugaccuccuc

SEQ ID NO: 21724 - RNA, 25 nt, Human
ggaaugacacucagguucacugugg

SEQ ID NO: 21725 - RNA, 23 nt, Human
aggcuucucuccacaguguugug

SEQ ID NO: 21726 - RNA, 23 nt, Human
cuggugcccccacacccaccuac

SEQ ID NO: 21727 - RNA, 22 nt, Human
uggugaaauccuaucucuacca

SEQ ID NO: 21728 - RNA, 21 nt, Human
agguguggcaaggaucuuauc

SEQ ID NO: 21729 - RNA, 22 nt, Human
ggugucaaacuccugggcucag

SEQ ID NO: 21730 - RNA, 25 nt, Human
uuuuugggggccuaacccacgcagu

SEQ ID NO: 21731 - RNA, 22 nt, Human
acauuuugggugccauauugug

SEQ ID NO: 21732 - RNA, 24 nt, Human
ugcuaguacaggaaucguuuauug

SEQ ID NO: 21733 - RNA, 27 nt, Human
uuuuuucugauacaaugcacgauucuc

SEQ ID NO: 21734 - RNA, 22 nt, Human
ggaggcugggccccugggaugg

SEQ ID NO: 21735 - RNA, 22 nt, Human
ccaccucccggguucaagcaau

SEQ ID NO: 21736 - RNA, 24 nt, Human
cagcccugcccugucuuuuauuug

SEQ ID NO: 21737 - RNA, 29 nt, Human
aggcuaugagcuggcacaccagcggcaug

SEQ ID NO: 21738 - RNA, 21 nt, Human
cgugagccaccacgccuggcc

SEQ ID NO: 21739 - RNA, 22 nt, Human
aaaauucaacacccaccaggcu

SEQ ID NO: 21740 - RNA, 27 nt, Human
ggucucaaacuccugggcucaagcaau

SEQ ID NO: 21741 - RNA, 27 nt, Human
ugccuauaaucccagcacuuuuggagg

SEQ ID NO: 21742 - RNA, 23 nt, Human
ugccuguaaucccagcuacacug

SEQ ID NO: 21743 - RNA, 22 nt, Human
ugguguaauuuccuaugcugaa

SEQ ID NO: 21744 - RNA, 23 nt, Human
guccaggccacuggugagugucg

SEQ ID NO: 21745 - RNA, 23 nt, Human
gcaaaguuugaguaacuaaucuu

SEQ ID NO: 21746 - RNA, 26 nt, Human
gcagucuccccuuccuggcacauugc

SEQ ID NO: 21747 - RNA, 21 nt, Human
gucagggcccccugugcuuga

SEQ ID NO: 21748 - RNA, 21 nt, Human
gcacauacauaaugacuuucu

SEQ ID NO: 21749 - RNA, 22 nt, Human
aaguacaggguuuuauagugua

SEQ ID NO: 21750 - RNA, 25 nt, Human
gcagaguuuuccuacacuuuuccug

SEQ ID NO: 21751 - RNA, 25 nt, Human
ugcuguacuuuucuucaguccuccu

SEQ ID NO: 21752 - RNA, 22 nt, Human
caagaagaaugggagcugcaaa

SEQ ID NO: 21753 - RNA, 26 nt, Human
caugcaucucccacuuuuggcuuucc

SEQ ID NO: 21754 - RNA, 20 nt, Human
gggacugaggguggagcagc

SEQ ID NO: 21755 - RNA, 18 nt, Human
ccuccuggcuccugggcu

SEQ ID NO: 21756 - RNA, 18 nt, Human
uuaugcuguuacuaguga

SEQ ID NO: 21757 - RNA, 21 nt, Human
cauuccccucuguccccuugg

SEQ ID NO: 21758 - RNA, 30 nt, Human
gaggggaggaagaagaguguuuacaaaguc

SEQ ID NO: 21759 - RNA, 25 nt, Human
uccaggcauuugagaccagccuggg

SEQ ID NO: 21760 - RNA, 23 nt, Human
uuugcuaaaggcacagucacugg

SEQ ID NO: 21761 - RNA, 22 nt, Human
uuugaugaaaaagagugccagu

SEQ ID NO: 21762 - RNA, 23 nt, Human
cagagacaggggaaggcagccug

SEQ ID NO: 21763 - RNA, 22 nt, Human
ccuccacuccuacgcccacucc

SEQ ID NO: 21764 - RNA, 22 nt, Human
gcucaugccuguaaucucagca

SEQ ID NO: 21765 - RNA, 22 nt, Human
gcucaugcuuguaaucccagca

SEQ ID NO: 21766 - RNA, 26 nt, Human
ggaugagggggagggagccaacgccu

SEQ ID NO: 21767 - RNA, 28 nt, Human
uggguuccccccuccccccaccuuuuuu

SEQ ID NO: 21768 - RNA, 23 nt, Human
uguccucccucugauuuuucaua

SEQ ID NO: 21769 - RNA, 23 nt, Human
ucuuucguuugacagcaguuugg

SEQ ID NO: 21770 - RNA, 24 nt, Human
acugucucuaaccacuccugggcu

SEQ ID NO: 21771 - RNA, 26 nt, Human
caggcagcgcauggggggcugggcga

SEQ ID NO: 21772 - RNA, 23 nt, Human
gacagcaacaaaaucauggcuua

SEQ ID NO: 21773 - RNA, 27 nt, Human
ucagcacuuaacuacuuuguuggcauu

SEQ ID NO: 21774 - RNA, 21 nt, Human
uuuugucaugcuaagcacuuu

SEQ ID NO: 21775 - RNA, 27 nt, Human
ggcauuuucacaacaaucucuccccag

SEQ ID NO: 21776 - RNA, 25 nt, Human
gcauguccagaagcauuuccuuccu

SEQ ID NO: 21777 - RNA, 23 nt, Human
cugggcuccgggguggcagugag

SEQ ID NO: 21778 - RNA, 22 nt, Human
gugggaggccccacccuucucc

SEQ ID NO: 21779 - RNA, 24 nt, Human
ucaacgcaguaauucccaucugcc

SEQ ID NO: 21780 - RNA, 20 nt, Human
ugagcuucuuucaagggcua

SEQ ID NO: 21781 - RNA, 26 nt, Human
gcauuuuccucuguucuugagcccag

SEQ ID NO: 21782 - RNA, 19 nt, Human
ugucgugcugucaccagaa

SEQ ID NO: 21783 - RNA, 19 nt, Human
cucuuuguagccauccugu

SEQ ID NO: 21784 - RNA, 26 nt, Human
ccagcugaggugggagauauuuuucu

SEQ ID NO: 21785 - RNA, 26 nt, Human
gucagccuguggaacuugcgcaggug

SEQ ID NO: 21786 - RNA, 22 nt, Human
aaagugcagggauuacaggcau

SEQ ID NO: 21787 - RNA, 20 nt, Human
caggcagcccucugcagcag

SEQ ID NO: 21788 - RNA, 20 nt, Human
augagcugaggucagccugg

SEQ ID NO: 21789 - RNA, 21 nt, Human
ugucaagcugaccuugcugau

SEQ ID NO: 21790 - RNA, 21 nt, Human
gagggagagaggggaggcaaa

SEQ ID NO: 21791 - RNA, 23 nt, Human
gggcagcaacuuugagccugugg

SEQ ID NO: 21792 - RNA, 26 nt, Human
uuggaagcagaaaugcuuuguaccag

SEQ ID NO: 21793 - RNA, 26 nt, Human
gacccugcaguccuacuacagucugg

SEQ ID NO: 21794 - RNA, 20 nt, Human
auuuaugauuccugccagau

SEQ ID NO: 21795 - RNA, 26 nt, Human
ggucucaacuccugggcucaagcgau

SEQ ID NO: 21796 - RNA, 22 nt, Human
ggguaaauguggagggagccac

SEQ ID NO: 21797 - RNA, 27 nt, Human
gacacccgauuccugcccaaacagcug

SEQ ID NO: 21798 - RNA, 31 nt, Human
ucuuuaacuuuucuuuuccuuuuucaucggg

SEQ ID NO: 21799 - RNA, 18 nt, Human
cacaggcauuauguuuga

SEQ ID NO: 21800 - RNA, 24 nt, Human
auugcucacuccagguuacugcaa

SEQ ID NO: 21801 - RNA, 22 nt, Human
gacuccuguuuucucucucaca

SEQ ID NO: 21802 - RNA, 19 nt, Human
cuggcaggcaggcaaagcu

SEQ ID NO: 21803 - RNA, 20 nt, Human
uuaggauaaguuagaugugu

SEQ ID NO: 21804 - RNA, 22 nt, Human
agcccuagaacucagcguugcc

SEQ ID NO: 21805 - RNA, 30 nt, Human
guuuugcuguaaaaaauguuuccaacuccg

SEQ ID NO: 21806 - RNA, 21 nt, Human
cccacccccauacugguacug

SEQ ID NO: 21807 - RNA, 24 nt, Human
aggagacugacagaggaauuccag

SEQ ID NO: 21808 - RNA, 27 nt, Human
ccaagcccugucuuaaggcccaggggg

SEQ ID NO: 21809 - RNA, 24 nt, Human
ucugccauaaucuccaucuguguu

SEQ ID NO: 21810 - RNA, 21 nt, Human
gcuuccugguucucaguccca

SEQ ID NO: 21811 - RNA, 22 nt, Human
uucaagcaguccuccugccuca

SEQ ID NO: 21812 - RNA, 27 nt, Human
cccagcuguuagcacguuaguaauacu

SEQ ID NO: 21813 - RNA, 26 nt, Human
uuuuggauagaugauugacuggugag

SEQ ID NO: 21814 - RNA, 23 nt, Human
guggccuucuggagcagguggcu

SEQ ID NO: 21815 - RNA, 19 nt, Human
gggauccuuagcacccaac

SEQ ID NO: 21816 - RNA, 22 nt, Human
gcucacugcaaccuccaccucg

SEQ ID NO: 21817 - RNA, 23 nt, Human
uauggcuuaagacccagggccag

SEQ ID NO: 21818 - RNA, 22 nt, Human
gaccaguguggccaacauggug

SEQ ID NO: 21819 - RNA, 20 nt, Human
cagcucuucacaguccugga

SEQ ID NO: 21820 - RNA, 23 nt, Human
ccaacauguuguaaaccccgucu

SEQ ID NO: 21821 - RNA, 21 nt, Human
cugcuguggcuuuucaguuaa

SEQ ID NO: 21822 - RNA, 26 nt, Human
ugguagcaccuguaacccuguguacu

SEQ ID NO: 21823 - RNA, 25 nt, Human
ugcuuguuugaucuguuuucuguaa

SEQ ID NO: 21824 - RNA, 23 nt, Human
cacucugucccuucgccugcugc

SEQ ID NO: 21825 - RNA, 22 nt, Human
ccaaguaguaaaguuuucaggg

SEQ ID NO: 21826 - RNA, 21 nt, Human
ugugagccaccacaccuggcc

SEQ ID NO: 21827 - RNA, 22 nt, Human
gcaggggcaggggcagcucucc

SEQ ID NO: 21828 - RNA, 22 nt, Human
cucuucuguguuuauauucaug

SEQ ID NO: 21829 - RNA, 24 nt, Human
ccucgugcccaccgcaccugccga

SEQ ID NO: 21830 - RNA, 23 nt, Human
ggcaggagaauggugugaaccug

SEQ ID NO: 21831 - RNA, 22 nt, Human
gauagcucuauagaugcugaaa

SEQ ID NO: 21832 - RNA, 24 nt, Human
accagcacgagaccccuuucuauc

SEQ ID NO: 21833 - RNA, 21 nt, Human
ucauuucuuauaucuuauuca

SEQ ID NO: 21834 - RNA, 20 nt, Human
gacauuucaggcaagccaca

SEQ ID NO: 21835 - RNA, 20 nt, Human
gcaugccaaguacuaaagca

SEQ ID NO: 21836 - RNA, 25 nt, Human
uucuugcuucugucuguucuuaauu

SEQ ID NO: 21837 - RNA, 24 nt, Human
cugacauccuucaugacguuuucc

SEQ ID NO: 21838 - RNA, 21 nt, Human
agcgucccucaccagaggccu

SEQ ID NO: 21839 - RNA, 28 nt, Human
gccuuugcauccgcuccugggcaccgag

SEQ ID NO: 21840 - RNA, 26 nt, Human
cugccccagaggaaggagcuguagug

SEQ ID NO: 21841 - RNA, 26 nt, Human
cugccucuuggaguuugguagcuacu

SEQ ID NO: 21842 - RNA, 26 nt, Human
gacugauucugucguguucaccagag

SEQ ID NO: 21843 - RNA, 20 nt, Human
gccuauaucccagcacuuug

SEQ ID NO: 21844 - RNA, 20 nt, Human
ggugcuccugaacagaagau

SEQ ID NO: 21845 - RNA, 20 nt, Human
ggggccaccugccugcgucu

SEQ ID NO: 21846 - RNA, 19 nt, Human
uacauguaaugacacuucu

SEQ ID NO: 21847 - RNA, 21 nt, Human
ggauaacauuuggaggaaggu

SEQ ID NO: 21848 - RNA, 27 nt, Human
cucauuucuuauaauacccugauccca

SEQ ID NO: 21849 - RNA, 26 nt, Human
uagaugaaacugcaaaguguucucag

SEQ ID NO: 21850 - RNA, 22 nt, Human
uugauguuguauuuuacacucu

SEQ ID NO: 21851 - RNA, 21 nt, Human
uggaaccuggucuugagcuga

SEQ ID NO: 21852 - RNA, 22 nt, Human
uaggccuguaaucguagcgcuu

SEQ ID NO: 21853 - RNA, 22 nt, Human
acugauucccagccuguggcag

SEQ ID NO: 21854 - RNA, 21 nt, Human
ggaaaguugggauuugcaaau

SEQ ID NO: 21855 - RNA, 20 nt, Human
cuuccaauuaguauucuuuu

SEQ ID NO: 21856 - RNA, 22 nt, Human
cuacagccugacuuucucucca

SEQ ID NO: 21857 - RNA, 22 nt, Human
gcuccuccuaugucucuuuuca

SEQ ID NO: 21858 - RNA, 21 nt, Human
gguuuuguuauauagcauuuu

SEQ ID NO: 21859 - RNA, 22 nt, Human
uguuggugcuggcccuugggga

SEQ ID NO: 21860 - RNA, 20 nt, Human
acauugcuucuaguuggcag

SEQ ID NO: 21861 - RNA, 21 nt, Human
ucuccaccccuccccugaacc

SEQ ID NO: 21862 - RNA, 23 nt, Human
ucauaaaaauguguucuuuacaa

SEQ ID NO: 21863 - RNA, 24 nt, Human
ugaaaagaagaaagucuaugcuua

SEQ ID NO: 21864 - RNA, 21 nt, Human
ccugcagccucaucauuuccc

SEQ ID NO: 21865 - RNA, 24 nt, Human
gcugcacuccagccugcgggacag

SEQ ID NO: 21866 - RNA, 26 nt, Human
gucaucucugggugccaccaucgguc

SEQ ID NO: 21867 - RNA, 22 nt, Human
ucugccgcccaggcuggacugc

SEQ ID NO: 21868 - RNA, 21 nt, Human
ucuagacaccaucaaagcaua

SEQ ID NO: 21869 - RNA, 25 nt, Human
ugggcagacagugaccucucuaggu

SEQ ID NO: 21870 - RNA, 25 nt, Human
ccgccugccucugucuagcaacgca

SEQ ID NO: 21871 - RNA, 24 nt, Human
uucuccucuuccuuuuacccuagu

SEQ ID NO: 21872 - RNA, 21 nt, Human
gccucucuguacuuacagccc

SEQ ID NO: 21873 - RNA, 22 nt, Human
ucauccaggcuggagugcggug

SEQ ID NO: 21874 - RNA, 22 nt, Human
ucguccaggcuggagugcagug

SEQ ID NO: 21875 - RNA, 26 nt, Human
agcaauaaucaguggugcuuuuguac

SEQ ID NO: 21876 - RNA, 26 nt, Human
caacagcauccaacauaucugucuug

SEQ ID NO: 21877 - RNA, 22 nt, Human
ucagauggggggaaccccaccc

SEQ ID NO: 21878 - RNA, 26 nt, Human
ucgggaggccaaggcaggagaauugc

SEQ ID NO: 21879 - RNA, 26 nt, Human
ucaggaggccgaggcaggagaauugc

SEQ ID NO: 21880 - RNA, 23 nt, Human
uugguggcagguuacagaguucu

SEQ ID NO: 21881 - RNA, 26 nt, Human
aggggcugaaagaacauggacuugua

SEQ ID NO: 21882 - RNA, 22 nt, Human
cagacaucagagcuuaaaccca

SEQ ID NO: 21883 - RNA, 22 nt, Human
ggcucccgggggccccaccucg

SEQ ID NO: 21884 - RNA, 19 nt, Human
acugcccagggggugcaaa

SEQ ID NO: 21885 - RNA, 25 nt, Human
guggggacggaggggaaagggaagc

SEQ ID NO: 21886 - RNA, 25 nt, Human
acugagagcugccuccuggaagcuu

SEQ ID NO: 21887 - RNA, 22 nt, Human
gcucacgcuuguaaucccagca

SEQ ID NO: 21888 - RNA, 22 nt, Human
gcucacgccuguaaucucagca

SEQ ID NO: 21889 - RNA, 23 nt, Human
aggcuuugggcacagccugcugu

SEQ ID NO: 21890 - RNA, 19 nt, Human
ggaggcugugaaugcugag

SEQ ID NO: 21891 - RNA, 26 nt, Human
gcagccgccgccccacucaccuccgg

SEQ ID NO: 21892 - RNA, 24 nt, Human
ccugucaugacaagccucugugau

SEQ ID NO: 21893 - RNA, 24 nt, Human
uugucccaggcuuucuggugugug

SEQ ID NO: 21894 - RNA, 22 nt, Human
cucggccucccaaaguguuggg

SEQ ID NO: 21895 - RNA, 24 nt, Human
cugcucuccccuggcuacugggag

SEQ ID NO: 21896 - RNA, 21 nt, Human
cugggggcugggcaggggcag

SEQ ID NO: 21897 - RNA, 19 nt, Human
uagggugugugggggagga

SEQ ID NO: 21898 - RNA, 21 nt, Human
uuaccuuucuguuccuugcag

SEQ ID NO: 21899 - RNA, 28 nt, Human
ccaggaggcggagguugcaguaagccaa

SEQ ID NO: 21900 - RNA, 25 nt, Human
cuuuccccucugcacuuuuugcaag

SEQ ID NO: 21901 - RNA, 22 nt, Human
ugcagugagucgagaucaugcc

SEQ ID NO: 21902 - RNA, 21 nt, Human
uuuccagggucugagugcaag

SEQ ID NO: 21903 - RNA, 21 nt, Human
caccaaaccuuacauguugca

SEQ ID NO: 21904 - RNA, 24 nt, Human
ucugcaggauacaguucaauauga

SEQ ID NO: 21905 - RNA, 24 nt, Human
guuuccccgaggcaucacagggcu

SEQ ID NO: 21906 - RNA, 27 nt, Human
uuccaauaacccagcuugcguccugca

SEQ ID NO: 21907 - RNA, 26 nt, Human
uauccuuaugguugaguuuccauaua

SEQ ID NO: 21908 - RNA, 20 nt, Human
ggagggaggggccaggcagc

SEQ ID NO: 21909 - RNA, 20 nt, Human
gggcggguggggagcugucc

SEQ ID NO: 21910 - RNA, 24 nt, Human
ccucagaagaaaacaaaguucuau

SEQ ID NO: 21911 - RNA, 27 nt, Human
auugcaggucucuguacaggccaguuu

SEQ ID NO: 21912 - RNA, 21 nt, Human
aaaaagauuuauuaauuaaac

SEQ ID NO: 21913 - RNA, 22 nt, Human
ccuguggcugugaugugggguu

SEQ ID NO: 21914 - RNA, 22 nt, Human
cuuagcuuccucagucucucca

SEQ ID NO: 21915 - RNA, 23 nt, Human
ggccucgugccaugaucuguauu

SEQ ID NO: 21916 - RNA, 21 nt, Human
gcuaucuagcuaauuuuuuaa

SEQ ID NO: 21917 - RNA, 24 nt, Human
agaaaugucugucuggaaacagga

SEQ ID NO: 21918 - RNA, 19 nt, Human
cacacucagccacugcggg

SEQ ID NO: 21919 - RNA, 20 nt, Human
aaaugaacauguuuauugca

SEQ ID NO: 21920 - RNA, 21 nt, Human
uagccuggccuuuuucugugu

SEQ ID NO: 21921 - RNA, 26 nt, Human
ucagugcuuuaacagcauaucguaug

SEQ ID NO: 21922 - RNA, 21 nt, Human
ggccguccccaccccaccucg

SEQ ID NO: 21923 - RNA, 20 nt, Human
ucucuacugauuaucuugcu

SEQ ID NO: 21924 - RNA, 22 nt, Human
cauacuccugggcucaagcaau

SEQ ID NO: 21925 - RNA, 25 nt, Human
gaacaaugcuuaacauacuaaccuu

SEQ ID NO: 21926 - RNA, 22 nt, Human
uuuaaggagcucccaaaaugug

SEQ ID NO: 21927 - RNA, 25 nt, Human
cugccuggucagucccaggugaggc

SEQ ID NO: 21928 - RNA, 17 nt, Human
cuuacaacagguauuug

SEQ ID NO: 21929 - RNA, 24 nt, Human
gaggcaggccagaggaccuaagug

SEQ ID NO: 21930 - RNA, 21 nt, Human
uucagccaagccuccuccucu

SEQ ID NO: 21931 - RNA, 21 nt, Human
gcuauugcacuccagccuggg

SEQ ID NO: 21932 - RNA, 25 nt, Human
ccaucucuacuaaaaauagaaaaau

SEQ ID NO: 21933 - RNA, 23 nt, Human
uugcccagggagaggcugcggcu

SEQ ID NO: 21934 - RNA, 27 nt, Human
uguucuguuuuuuagcacagccauuua

SEQ ID NO: 21935 - RNA, 27 nt, Human
ggaggcuggaagcagagaggagguacc

SEQ ID NO: 21936 - RNA, 24 nt, Human
ccaauacaacagccaucacuagca

SEQ ID NO: 21937 - RNA, 19 nt, Human
uugaggaaaaccacaaaaa

SEQ ID NO: 21938 - RNA, 22 nt, Human
uccugcacugacccuuuggagg

SEQ ID NO: 21939 - RNA, 20 nt, Human
gcaggggucccugagcuguu

SEQ ID NO: 21940 - RNA, 23 nt, Human
aggcuggagugcaauggcacgau

SEQ ID NO: 21941 - RNA, 27 nt, Human
caggcaagagugcagugguaugaucuc

SEQ ID NO: 21942 - RNA, 23 nt, Human
aucggccaggcuggagugcagug

SEQ ID NO: 21943 - RNA, 27 nt, Human
uuuucuucugcugaaguuuuaagugag

SEQ ID NO: 21944 - RNA, 26 nt, Human
ugcugggacugugcaaggagguagga

SEQ ID NO: 21945 - RNA, 23 nt, Human
ccacacccacaggcuucacauuc

SEQ ID NO: 21946 - RNA, 21 nt, Human
cagggugaagacagucacuca

SEQ ID NO: 21947 - RNA, 22 nt, Human
ggccuuuccugugccaaccuga

SEQ ID NO: 21948 - RNA, 23 nt, Human
uuuucccagccgcauccugccug

SEQ ID NO: 21949 - RNA, 28 nt, Human
ggcuaguugcaaagacuaugcuaauagc

SEQ ID NO: 21950 - RNA, 21 nt, Human
ugcuccugcuccucagcucuc

SEQ ID NO: 21951 - RNA, 24 nt, Human
auacuuaaggcacuauggcacuua

SEQ ID NO: 21952 - RNA, 26 nt, Human
cccuuuuuaauuggaacuucugcuua

SEQ ID NO: 21953 - RNA, 26 nt, Human
gccugacagaaaccacggccacauuu

SEQ ID NO: 21954 - RNA, 22 nt, Human
caaccucccuggcucaagcgau

SEQ ID NO: 21955 - RNA, 25 nt, Human
cacucacuguuguagcuucuguugu

SEQ ID NO: 21956 - RNA, 20 nt, Human
ucuauuucucuuccugucac

SEQ ID NO: 21957 - RNA, 21 nt, Human
guuugacaccagccugggcaa

SEQ ID NO: 21958 - RNA, 27 nt, Human
aaguagcugggauaacaggcgcccacc

SEQ ID NO: 21959 - RNA, 24 nt, Human
gcccaccugcaggaagagauuugg

SEQ ID NO: 21960 - RNA, 24 nt, Human
uucauuucucaggaugcuucuuac

SEQ ID NO: 21961 - RNA, 24 nt, Human
aguugagaaacuguggcacaaggc

SEQ ID NO: 21962 - RNA, 27 nt, Human
agaagcagcagcaaacauuugcuaguc

SEQ ID NO: 21963 - RNA, 18 nt, Human
aacaggauuaacugugaa

SEQ ID NO: 21964 - RNA, 25 nt, Human
gaucacaugugcccucugccagggc

SEQ ID NO: 21965 - RNA, 25 nt, Human
cagaaauugguucuauuucuucuua

SEQ ID NO: 21966 - RNA, 22 nt, Human
uuuuguuuugcuugcuguuuua

SEQ ID NO: 21967 - RNA, 25 nt, Human
uuucaagccuacuuaccuuuauaaa

SEQ ID NO: 21968 - RNA, 21 nt, Human
cuagccuggccaacauguugu

SEQ ID NO: 21969 - RNA, 27 nt, Human
uugggaggcggaggcaggaggaucgcu

SEQ ID NO: 21970 - RNA, 25 nt, Human
auuacuuaaacuuucuuuccaguca

SEQ ID NO: 21971 - RNA, 21 nt, Human
ccauuauguuuacuaaucaca

SEQ ID NO: 21972 - RNA, 19 nt, Human
cacugcaacuucugccucc

SEQ ID NO: 21973 - RNA, 19 nt, Human
cacugcaaccucugccuuc

SEQ ID NO: 21974 - RNA, 22 nt, Human
ccggaucccagccucuccccug

SEQ ID NO: 21975 - RNA, 25 nt, Human
uccgugggagccagcgagccucucu

SEQ ID NO: 21976 - RNA, 22 nt, Human
acuuuucagaagaaaauaaaca

SEQ ID NO: 21977 - RNA, 21 nt, Human
ugacuggcaaauucgcuuugg

SEQ ID NO: 21978 - RNA, 22 nt, Human
aauaaagcucauggcccaccag

SEQ ID NO: 21979 - RNA, 27 nt, Human
cccuuuacuuaauuauauuguagugug

SEQ ID NO: 21980 - RNA, 19 nt, Human
gacucacugguuucuuuuc

SEQ ID NO: 21981 - RNA, 27 nt, Human
gggaauaaucuuuuauguuucauuuac

SEQ ID NO: 21982 - RNA, 25 nt, Human
cugccacccaggcuggaguacagug

SEQ ID NO: 21983 - RNA, 20 nt, Human
ggagcugcagggcgagcccg

SEQ ID NO: 21984 - RNA, 23 nt, Human
uacaacacugacucaucauaaau

SEQ ID NO: 21985 - RNA, 23 nt, Human
ugcacacacaaugauuacgggaa

SEQ ID NO: 21986 - RNA, 20 nt, Human
ccugcagccgccgccguccc

SEQ ID NO: 21987 - RNA, 27 nt, Human
acucuuguguccaggcuggagugcagu

SEQ ID NO: 21988 - RNA, 26 nt, Human
gcccggccccccacacccacagcuug

SEQ ID NO: 21989 - RNA, 25 nt, Human
auugcccagugcugccagagugagu

SEQ ID NO: 21990 - RNA, 23 nt, Human
uuuaugauuuauuugaagccaca

SEQ ID NO: 21991 - RNA, 23 nt, Human
cauuuuucucuuaauccauaucu

SEQ ID NO: 21992 - RNA, 19 nt, Human
gcacccaggucgggcggug

SEQ ID NO: 21993 - RNA, 27 nt, Human
gcacugucccccaggcuggagugcagu

SEQ ID NO: 21994 - RNA, 20 nt, Human
uauaaaacauguagauccuu

SEQ ID NO: 21995 - RNA, 21 nt, Human
uggaaaagagaagaugaaggg

SEQ ID NO: 21996 - RNA, 20 nt, Human
uccagccugcagcaugagcg

SEQ ID NO: 21997 - RNA, 27 nt, Human
cuugcacagcauggcucugccucacaa

SEQ ID NO: 21998 - RNA, 20 nt, Human
gacauacauuuaauauuucu

SEQ ID NO: 21999 - RNA, 26 nt, Human
agggaaagaaaccuagaccagagaag

SEQ ID NO: 22000 - RNA, 20 nt, Human
ugugagaccuccuggaacac

SEQ ID NO: 22001 - RNA, 26 nt, Human
uggacaaacaauuuagguggagcucc

SEQ ID NO: 22002 - RNA, 22 nt, Human
uuugcuugaaccugggaggcag

SEQ ID NO: 22003 - RNA, 20 nt, Human
ggucagaugugcagaccauu

SEQ ID NO: 22004 - RNA, 21 nt, Human
caaaggcaaacagaucugcca

SEQ ID NO: 22005 - RNA, 22 nt, Human
aguuuccuagcucugugcucag

SEQ ID NO: 22006 - RNA, 27 nt, Human
guacucuuaggugccagucugguaacu

SEQ ID NO: 22007 - RNA, 25 nt, Human
ugcuauguuacuaucaucaucuucc

SEQ ID NO: 22008 - RNA, 22 nt, Human
ccacagccaugaacagacguug

SEQ ID NO: 22009 - RNA, 22 nt, Human
cugaaaugacgccauugcacuc

SEQ ID NO: 22010 - RNA, 20 nt, Human
ucuaaauauacaacuuguaa

SEQ ID NO: 22011 - RNA, 20 nt, Human
gagcugcagccagggccacu

SEQ ID NO: 22012 - RNA, 21 nt, Human
uggcuucuuugagaauguaag

SEQ ID NO: 22013 - RNA, 22 nt, Human
gcgagacuccaucucaaacaaa

SEQ ID NO: 22014 - RNA, 25 nt, Human
cacaaacuuucagagacagcagagc

SEQ ID NO: 22015 - RNA, 25 nt, Human
aagcugccccacaaagggcuaugcc

SEQ ID NO: 22016 - RNA, 19 nt, Human
uucugagcuccugaccuag

SEQ ID NO: 22017 - RNA, 20 nt, Human
uuauacagcaaaagucaggu

SEQ ID NO: 22018 - RNA, 22 nt, Human
cagugugcuccagauggugcua

SEQ ID NO: 22019 - RNA, 19 nt, Human
uguuucuguuuugcuuuau

SEQ ID NO: 22020 - RNA, 22 nt, Human
cacuaaaaaguccuugcaagaa

SEQ ID NO: 22021 - RNA, 24 nt, Human
guugaagagggagccaaaagagga

SEQ ID NO: 22022 - RNA, 21 nt, Human
agggcagccucuccagcucuc

SEQ ID NO: 22023 - RNA, 27 nt, Human
cccuccaggaagaugcugacauccagg

SEQ ID NO: 22024 - RNA, 24 nt, Human
cagugcccucauccuuaugccugu

SEQ ID NO: 22025 - RNA, 27 nt, Human
agggcacucgccuucugccuucugguu

SEQ ID NO: 22026 - RNA, 32 nt, Human
caccaaugaaacuucgcuuuaucagcacucac

SEQ ID NO: 22027 - RNA, 27 nt, Human
agugcuaagucauuuggcaccuccuua

SEQ ID NO: 22028 - RNA, 23 nt, Human
cugauuuuuuaaaugauagcacc

SEQ ID NO: 22029 - RNA, 26 nt, Human
gauacugauggacauugugugggcca

SEQ ID NO: 22030 - RNA, 22 nt, Human
cagggucuugcucugucgccca

SEQ ID NO: 22031 - RNA, 27 nt, Human
acucuucugugcacuagccauagcugg

SEQ ID NO: 22032 - RNA, 25 nt, Human
uugucucugaagacaaauaauuaaa

SEQ ID NO: 22033 - RNA, 24 nt, Human
ucugcagcuugaguccucugguuu

SEQ ID NO: 22034 - RNA, 27 nt, Human
uuugaauaacauaggugcucuuccuca

SEQ ID NO: 22035 - RNA, 26 nt, Human
cgagagggagaugugugggcgagagc

SEQ ID NO: 22036 - RNA, 22 nt, Human
guccaggcugguaucucagggc

SEQ ID NO: 22037 - RNA, 21 nt, Human
aacagcaauagugaaugaaug

SEQ ID NO: 22038 - RNA, 23 nt, Human
agaucuccaacagugccuuggac

SEQ ID NO: 22039 - RNA, 22 nt, Human
uguuucugacaugaaugugguu

SEQ ID NO: 22040 - RNA, 19 nt, Human
ucauggcugacuuccucac

SEQ ID NO: 22041 - RNA, 25 nt, Human
ucuccugauccguccgaggcugcuu

SEQ ID NO: 22042 - RNA, 24 nt, Human
gaucuuccaaagugagcaguuuau

SEQ ID NO: 22043 - RNA, 22 nt, Human
cgucugagggaucugcuccuua

SEQ ID NO: 22044 - RNA, 16 nt, Human
ugcacauccuguggga

SEQ ID NO: 22045 - RNA, 26 nt, Human
uggcagcugcugccucacccacagcu

SEQ ID NO: 22046 - RNA, 22 nt, Human
ggauauauauccaggcacucuc

SEQ ID NO: 22047 - RNA, 21 nt, Human
gccccaggcaggcugugcgcu

SEQ ID NO: 22048 - RNA, 27 nt, Human
ucagggcgacuuccacagcagcagaac

SEQ ID NO: 22049 - RNA, 27 nt, Human
cccaucauuuuccauauccuggugccc

SEQ ID NO: 22050 - RNA, 24 nt, Human
gcucugggcacugggaaugcuggg

SEQ ID NO: 22051 - RNA, 23 nt, Human
ggccuggagcugcaggaucccag

SEQ ID NO: 22052 - RNA, 23 nt, Human
ggcuccacucuguucucuugcca

SEQ ID NO: 22053 - RNA, 22 nt, Human
gaguggucacuggucagggcag

SEQ ID NO: 22054 - RNA, 27 nt, Human
cugaagguguauauacaaacugagaug

SEQ ID NO: 22055 - RNA, 32 nt, Human
ucuauguucagacauaguacauucaucacugu

SEQ ID NO: 22056 - RNA, 24 nt, Human
gauauguauauuuuugaucuuuga

SEQ ID NO: 22057 - RNA, 28 nt, Human
gcgagcgccggacccaggaggcccaagg

SEQ ID NO: 22058 - RNA, 23 nt, Human
uggauaaucagugaaacuacuua

SEQ ID NO: 22059 - RNA, 24 nt, Human
cugagacugaaugcgggagguuca

SEQ ID NO: 22060 - RNA, 27 nt, Human
gguuuggacucuaaaaucucagcacug

SEQ ID NO: 22061 - RNA, 22 nt, Human
ccucuuaggaaaacaguucuug

SEQ ID NO: 22062 - RNA, 27 nt, Human
gcuuguacaguaaacugucuucuguac

SEQ ID NO: 22063 - RNA, 26 nt, Human
uccaucucagagaauuuacgagcagg

SEQ ID NO: 22064 - RNA, 23 nt, Human
ugcuggcaacgugaauucucuca

SEQ ID NO: 22065 - RNA, 21 nt, Human
cugaauuucuauaccucucug

SEQ ID NO: 22066 - RNA, 21 nt, Human
gugccuccccucugcccagcc

SEQ ID NO: 22067 - RNA, 19 nt, Human
cugccgagcugccugcugu

SEQ ID NO: 22068 - RNA, 18 nt, Human
ccucuagcuucaggcugg

SEQ ID NO: 22069 - RNA, 20 nt, Human
aagucuaaauguuaaccuca

SEQ ID NO: 22070 - RNA, 23 nt, Human
ugugugcagccuccugugccuca

SEQ ID NO: 22071 - RNA, 25 nt, Human
cucucucucgggccaggguggagca

SEQ ID NO: 22072 - RNA, 28 nt, Human
ugcucaaaaguucugaauucauacagaa

SEQ ID NO: 22073 - RNA, 26 nt, Human
agucacuguuuucuuuauuucuuuaa

SEQ ID NO: 22074 - RNA, 21 nt, Human
aauuccuucagggugaugcca

SEQ ID NO: 22075 - RNA, 23 nt, Human
guguacauucuuaugcaauuuua

SEQ ID NO: 22076 - RNA, 26 nt, Human
cuuuucucccauauuggcauggauuu

SEQ ID NO: 22077 - RNA, 21 nt, Human
uaagccaagaucacgccacug

SEQ ID NO: 22078 - RNA, 21 nt, Human
uuugugggucgcacacauguu

SEQ ID NO: 22079 - RNA, 27 nt, Human
ccauugcacuccagccuaggcaauaag

SEQ ID NO: 22080 - RNA, 22 nt, Human
cugaggcugggggauugcuuga

SEQ ID NO: 22081 - RNA, 23 nt, Human
ugcacaucuuuuggugaucgggg

SEQ ID NO: 22082 - RNA, 22 nt, Human
uucagaauuuaacauccauucc

SEQ ID NO: 22083 - RNA, 23 nt, Human
cugaaauacugucacuaguggua

SEQ ID NO: 22084 - RNA, 21 nt, Human
uuuuauuaugaagaaggugaa

SEQ ID NO: 22085 - RNA, 21 nt, Human
guggaggguccugggagauag

SEQ ID NO: 22086 - RNA, 22 nt, Human
uuuccagccgaucacuggagcu

SEQ ID NO: 22087 - RNA, 24 nt, Human
gagcagaguagaaauggaagaggc

SEQ ID NO: 22088 - RNA, 24 nt, Human
gcaucaggagcugcucaggcuugg

SEQ ID NO: 22089 - RNA, 22 nt, Human
cuaugcaaccucuguucuugua

SEQ ID NO: 22090 - RNA, 25 nt, Human
ccacccgccacccgacucuggagcu

SEQ ID NO: 22091 - RNA, 26 nt, Human
ugaugcugggauuuacacuugaggcu

SEQ ID NO: 22092 - RNA, 22 nt, Human
gaaagccccaaacaacagaaag

SEQ ID NO: 22093 - RNA, 22 nt, Human
gaugccagcucuggaguucucg

SEQ ID NO: 22094 - RNA, 21 nt, Human
accauuuaauuucauguaaua

SEQ ID NO: 22095 - RNA, 23 nt, Human
uccaagcccaagccuccugcucc

SEQ ID NO: 22096 - RNA, 22 nt, Human
gaacccaggagauggaaguugc

SEQ ID NO: 22097 - RNA, 22 nt, Human
ggccucggcggcaccugcguca

SEQ ID NO: 22098 - RNA, 27 nt, Human
ccccuggccccucccuggcacugaggc

SEQ ID NO: 22099 - RNA, 22 nt, Human
cagagggaguggcgagcccagc

SEQ ID NO: 22100 - RNA, 27 nt, Human
uugagccugggacauugaggcugcagu

SEQ ID NO: 22101 - RNA, 26 nt, Human
acaagguugcuguugugcagugugcc

SEQ ID NO: 22102 - RNA, 21 nt, Human
agacagcauucuugcacuucu

SEQ ID NO: 22103 - RNA, 27 nt, Human
cccagcacacggaauggauuucugaga

SEQ ID NO: 22104 - RNA, 27 nt, Human
agggaaagacuggcaagaaaagaguua

SEQ ID NO: 22105 - RNA, 27 nt, Human
ggccacgucccaccccaccucuuguuu

SEQ ID NO: 22106 - RNA, 26 nt, Human
guuggcagacuggagugcaaucaugg

SEQ ID NO: 22107 - RNA, 27 nt, Human
cagccagagcaugcgucucagcagagc

SEQ ID NO: 22108 - RNA, 20 nt, Human
uuucuagcccuaauuuguga

SEQ ID NO: 22109 - RNA, 22 nt, Human
ccugguggccccacuggggcug

SEQ ID NO: 22110 - RNA, 22 nt, Human
aguuuggguuuguauuuuuucc

SEQ ID NO: 22111 - RNA, 21 nt, Human
guccuuccccuucuuaacaca

SEQ ID NO: 22112 - RNA, 22 nt, Human
aucuuacuuggcaucaacuugg

SEQ ID NO: 22113 - RNA, 27 nt, Human
cccuccuggcacaugggggcuggccac

SEQ ID NO: 22114 - RNA, 24 nt, Human
accuuaaagacuucugucauuuua

SEQ ID NO: 22115 - RNA, 22 nt, Human
uucauuucugaccuccaauucc

SEQ ID NO: 22116 - RNA, 17 nt, Human
caguuucauuauucuca

SEQ ID NO: 22117 - RNA, 25 nt, Human
ugcuaaggacugcgggaaugaggga

SEQ ID NO: 22118 - RNA, 28 nt, Human
ccuccagggugccuccaccugcacaacc

SEQ ID NO: 22119 - RNA, 26 nt, Human
ccacagccuucauuucuaggagugcu

SEQ ID NO: 22120 - RNA, 19 nt, Human
cuuuuggugagacagacuu

SEQ ID NO: 22121 - RNA, 18 nt, Human
uugcuagaucauaguaga

SEQ ID NO: 22122 - RNA, 18 nt, Human
gaccagucuggccaacau

SEQ ID NO: 22123 - RNA, 25 nt, Human
ccuuccaggaaaugggcuuuucagg

SEQ ID NO: 22124 - RNA, 21 nt, Human
cuuuggccauugucucagccu

SEQ ID NO: 22125 - RNA, 19 nt, Human
uuuuccuuaccuauuuccu

SEQ ID NO: 22126 - RNA, 25 nt, Human
ugggaaguaaacgcuuccagaggaa

SEQ ID NO: 22127 - RNA, 22 nt, Human
ugggagcccccagggaggggcu

SEQ ID NO: 22128 - RNA, 21 nt, Human
uggguuuuguuuuuucuuuaa

SEQ ID NO: 22129 - RNA, 22 nt, Human
cuguuucccaaugaaguuuuca

SEQ ID NO: 22130 - RNA, 23 nt, Human
cucggacugcagggagccagucu

SEQ ID NO: 22131 - RNA, 22 nt, Human
ucaccccggcuggagucaugug

SEQ ID NO: 22132 - RNA, 22 nt, Human
ccaaagugcuaagauuacaggc

SEQ ID NO: 22133 - RNA, 22 nt, Human
cgcccaaacuggagugcagugg

SEQ ID NO: 22134 - RNA, 27 nt, Human
cccuggaaccuuucccuuguguguacc

SEQ ID NO: 22135 - RNA, 26 nt, Human
aauguaugccauagcuuucuuugcua

SEQ ID NO: 22136 - RNA, 27 nt, Human
ugcaggcucugggucagguucugcucc

SEQ ID NO: 22137 - RNA, 24 nt, Human
ugccuucuucauccuuccuuacga

SEQ ID NO: 22138 - RNA, 23 nt, Human
cgaguccuggcccugcugcuugc

SEQ ID NO: 22139 - RNA, 22 nt, Human
gccaugaaaagguuauguaaua

SEQ ID NO: 22140 - RNA, 22 nt, Human
accacaccuggcuaauuuuugu

SEQ ID NO: 22141 - RNA, 21 nt, Human
uucugaaguuguguguugcug

SEQ ID NO: 22142 - RNA, 21 nt, Human
ccucacugcaacgccugccuc

SEQ ID NO: 22143 - RNA, 21 nt, Human
ccauuccgugcugcggggaca

SEQ ID NO: 22144 - RNA, 28 nt, Human
gggaggaagcgagagggaagccgcuugg

SEQ ID NO: 22145 - RNA, 22 nt, Human
aggacugaagaaaauccuucag

SEQ ID NO: 22146 - RNA, 22 nt, Human
aggcccuuaccuggaaggacca

SEQ ID NO: 22147 - RNA, 22 nt, Human
cuggaguaggaaaaaaguuuaa

SEQ ID NO: 22148 - RNA, 22 nt, Human
cgucucucggguucaagcaauu

SEQ ID NO: 22149 - RNA, 23 nt, Human
auugugccacugcauaccagccu

SEQ ID NO: 22150 - RNA, 27 nt, Human
uuugcccauccugcucuccuccagccg

SEQ ID NO: 22151 - RNA, 32 nt, Human
gagggugggagggcccagggagggcuuucgua

SEQ ID NO: 22152 - RNA, 26 nt, Human
cucuuccgguuaccuuuucccagcgc

SEQ ID NO: 22153 - RNA, 28 nt, Human
gguggaaggagggagggagccgcaggcg

SEQ ID NO: 22154 - RNA, 25 nt, Human
acgguuuguugugucuauuucagau

SEQ ID NO: 22155 - RNA, 30 nt, Human
ggagaagaaagagagagggggauuuauuca

SEQ ID NO: 22156 - RNA, 18 nt, Human
ugcaaguuggaagcacaa

SEQ ID NO: 22157 - RNA, 26 nt, Human
aaaugauuugcacuuuuucacugcau

SEQ ID NO: 22158 - RNA, 20 nt, Human
ccuguauuguuauuuuguuc

SEQ ID NO: 22159 - RNA, 25 nt, Human
ucugucucccaggcugaagugcagu

SEQ ID NO: 22160 - RNA, 22 nt, Human
agccuccuaaagugcugggauu

SEQ ID NO: 22161 - RNA, 22 nt, Human
guugcccagugugggaguuggu

SEQ ID NO: 22162 - RNA, 25 nt, Human
cagccaccacuuuccugugcauuuu

SEQ ID NO: 22163 - RNA, 25 nt, Human
ccugcugcucccauccccaccccag

SEQ ID NO: 22164 - RNA, 21 nt, Human
acuaacaacagaaucuaaucu

SEQ ID NO: 22165 - RNA, 22 nt, Human
ggcagaggacccggugccugcc

SEQ ID NO: 22166 - RNA, 27 nt, Human
guccagccugguuuagccuggauguug

SEQ ID NO: 22167 - RNA, 24 nt, Human
cccagcaccuugcagauuuucuua

SEQ ID NO: 22168 - RNA, 15 nt, Human
ggguccugccuucca

SEQ ID NO: 22169 - RNA, 21 nt, Human
agugguaaagaaucuaccuca

SEQ ID NO: 22170 - RNA, 23 nt, Human
ccucugcugcuggauuucauguc

SEQ ID NO: 22171 - RNA, 22 nt, Human
cuucccuuguaaacagaagcaa

SEQ ID NO: 22172 - RNA, 23 nt, Human
ccacagaaaauucuucuccacuu

SEQ ID NO: 22173 - RNA, 20 nt, Human
cugucuuggcuuucucaucc

SEQ ID NO: 22174 - RNA, 27 nt, Human
augccaggcugacggguccagugcggg

SEQ ID NO: 22175 - RNA, 26 nt, Human
ggagaggccgcccauuggccggccag

SEQ ID NO: 22176 - RNA, 18 nt, Human
ccauccacacaguuucca

SEQ ID NO: 22177 - RNA, 25 nt, Human
gggaagaccugaaagagaggacugg

SEQ ID NO: 22178 - RNA, 20 nt, Human
aggccccaggcagggccaac

SEQ ID NO: 22179 - RNA, 20 nt, Human
aucagccaugugaagauucg

SEQ ID NO: 22180 - RNA, 23 nt, Human
uucaggacauggguucucuucuc

SEQ ID NO: 22181 - RNA, 25 nt, Human
aucucuucauauucuuuauucccua

SEQ ID NO: 22182 - RNA, 27 nt, Human
gcuuaucucccugaggcuguuuccucg

SEQ ID NO: 22183 - RNA, 17 nt, Human
cuggaccugccugcugc

SEQ ID NO: 22184 - RNA, 22 nt, Human
agcagcaccuacccccuccucc

SEQ ID NO: 22185 - RNA, 20 nt, Human
cgcuccugccggcagcucca

SEQ ID NO: 22186 - RNA, 27 nt, Human
cggagacccaggcggggcugggcccag

SEQ ID NO: 22187 - RNA, 19 nt, Human
caacuggccacuggguggu

SEQ ID NO: 22188 - RNA, 26 nt, Human
cuccacccgccucuuccuucccagcc

SEQ ID NO: 22189 - RNA, 24 nt, Human
guccugaacuccuggcuuuccagg

SEQ ID NO: 22190 - RNA, 27 nt, Human
gugguggcguuauggcagcccggcugc

SEQ ID NO: 22191 - RNA, 24 nt, Human
uauccuguagaugugaagcacuuu

SEQ ID NO: 22192 - RNA, 20 nt, Human
agacggcaagacuccaucuc

SEQ ID NO: 22193 - RNA, 23 nt, Human
gggugugagggauggggagcagc

SEQ ID NO: 22194 - RNA, 22 nt, Human
uggaugucauacuugacaauac

SEQ ID NO: 22195 - RNA, 18 nt, Human
aaaaagcuccaugugccu

SEQ ID NO: 22196 - RNA, 27 nt, Human
cagcuuuggcucuggcugcuuuuuaga

SEQ ID NO: 22197 - RNA, 23 nt, Human
guaggaagaaauaaauguuuuca

SEQ ID NO: 22198 - RNA, 21 nt, Human
guuuuuauacuuauguauuua

SEQ ID NO: 22199 - RNA, 30 nt, Human
guacaguuugcuuauuuauaaauucauuaa

SEQ ID NO: 22200 - RNA, 22 nt, Human
uguuuguccuucucugccuguu

SEQ ID NO: 22201 - RNA, 22 nt, Human
gcuguuauuuugggccugaugu

SEQ ID NO: 22202 - RNA, 20 nt, Human
cgggaggcuccuggggccgg

SEQ ID NO: 22203 - RNA, 24 nt, Human
uuuuagaaaggucauuaguuucuu

SEQ ID NO: 22204 - RNA, 25 nt, Human
uucaacaacacacaguuggauaaac

SEQ ID NO: 22205 - RNA, 23 nt, Human
aggggaggggccuagggagccgc

SEQ ID NO: 22206 - RNA, 24 nt, Human
ucugcccuccaccucuaccacucc

SEQ ID NO: 22207 - RNA, 25 nt, Human
auuccugccuuccucccuuuuccca

SEQ ID NO: 22208 - RNA, 22 nt, Human
uacucccggccagggccugucc

SEQ ID NO: 22209 - RNA, 22 nt, Human
cacugcacaccggccuggguga

SEQ ID NO: 22210 - RNA, 21 nt, Human
uuugggaaaagccuucuugga

SEQ ID NO: 22211 - RNA, 21 nt, Human
gcgauggggaugcgggagcac

SEQ ID NO: 22212 - RNA, 22 nt, Human
uauacucuuaagacuaauuuug

SEQ ID NO: 22213 - RNA, 21 nt, Human
uggcuggcuaacuggaagcau

SEQ ID NO: 22214 - RNA, 25 nt, Human
ucugaaaaccucacaucaggcugca

SEQ ID NO: 22215 - RNA, 28 nt, Human
aggacaagagaauagcugugguuugcgu

SEQ ID NO: 22216 - RNA, 20 nt, Human
ccaccuugccagcaggcucu

SEQ ID NO: 22217 - RNA, 24 nt, Human
ccagccuggccgggacccggcugu

SEQ ID NO: 22218 - RNA, 21 nt, Human
aauauuucccugucuuacccc

SEQ ID NO: 22219 - RNA, 27 nt, Human
cccaucaugcacccuguacaguugcca

SEQ ID NO: 22220 - RNA, 23 nt, Human
aagugacucagcacccugccuca

SEQ ID NO: 22221 - RNA, 27 nt, Human
cuguaccugucacccuccuugucuccu

SEQ ID NO: 22222 - RNA, 24 nt, Human
ggacuccuccuuuuuccaugcccu

SEQ ID NO: 22223 - RNA, 27 nt, Human
cugauuccaagcaaaaaccaggcucca

SEQ ID NO: 22224 - RNA, 21 nt, Human
guuacauauucuuucacuugu

SEQ ID NO: 22225 - RNA, 26 nt, Human
guauuuucacagagugcuuuguagca

SEQ ID NO: 22226 - RNA, 23 nt, Human
ucuccaccaacgccuucugggcu

SEQ ID NO: 22227 - RNA, 21 nt, Human
aaaggauccaacagaucagua

SEQ ID NO: 22228 - RNA, 20 nt, Human
ccugggagaagagaugcugg

SEQ ID NO: 22229 - RNA, 25 nt, Human
ucuggguggagagcugacccaggaa

SEQ ID NO: 22230 - RNA, 22 nt, Human
ccgcucaccugacauguggacc

SEQ ID NO: 22231 - RNA, 20 nt, Human
cuucugcugcccaggccaca

SEQ ID NO: 22232 - RNA, 23 nt, Human
gucgcccaggcuggagggcagug

SEQ ID NO: 22233 - RNA, 23 nt, Human
gucgcccaugcuggagugcagug

SEQ ID NO: 22234 - RNA, 19 nt, Human
cagaacugagcgcuguggg

SEQ ID NO: 22235 - RNA, 16 nt, Human
uccuuuugcuaauaaa

SEQ ID NO: 22236 - RNA, 21 nt, Human
ggacagucuggccacugucaa

SEQ ID NO: 22237 - RNA, 23 nt, Human
auguaaacuaugacugcugagug

SEQ ID NO: 22238 - RNA, 28 nt, Human
cccuguugaggguccucaguccacugcu

SEQ ID NO: 22239 - RNA, 23 nt, Human
gagguagauacuaacuuccucca

SEQ ID NO: 22240 - RNA, 22 nt, Human
accagccugaccaacguggcga

SEQ ID NO: 22241 - RNA, 27 nt, Human
cgccuacacccccagcuauuugcacuc

SEQ ID NO: 22242 - RNA, 27 nt, Human
ggagcaagaacagaaacagggagccag

SEQ ID NO: 22243 - RNA, 26 nt, Human
aaaguauugugaacauuauucucagg

SEQ ID NO: 22244 - RNA, 24 nt, Human
gaucccucuuugcacagcaugagg

SEQ ID NO: 22245 - RNA, 22 nt, Human
uuacccaggguggagugcagug

SEQ ID NO: 22246 - RNA, 23 nt, Human
ccucggaccccauacucuaccuc

SEQ ID NO: 22247 - RNA, 24 nt, Human
gguuuccugccuccuucccgaggc

SEQ ID NO: 22248 - RNA, 22 nt, Human
aucagcuguuuugccuguugcu

SEQ ID NO: 22249 - RNA, 22 nt, Human
aagcccagaaggcagagguugu

SEQ ID NO: 22250 - RNA, 24 nt, Human
ccuuucucuucugacugguauacc

SEQ ID NO: 22251 - RNA, 29 nt, Human
ccgucuuuuccuguuuccuagcuguguga

SEQ ID NO: 22252 - RNA, 23 nt, Human
gagugaagaagauuauaggcuua

SEQ ID NO: 22253 - RNA, 23 nt, Human
gugggcggaucaccuugagguca

SEQ ID NO: 22254 - RNA, 21 nt, Human
gagggcuguaacagugaccuc

SEQ ID NO: 22255 - RNA, 20 nt, Human
gcucuuguagcccaggcugg

SEQ ID NO: 22256 - RNA, 20 nt, Human
ggggugugggcuggaagcac

SEQ ID NO: 22257 - RNA, 24 nt, Human
gcgacggagagagacugugccagu

SEQ ID NO: 22258 - RNA, 21 nt, Human
augugguuucuuuuguacaca

SEQ ID NO: 22259 - RNA, 25 nt, Human
cagggguguugugaggauuaauaaa

SEQ ID NO: 22260 - RNA, 23 nt, Human
ucuaaguauuuuauucccccaaa

SEQ ID NO: 22261 - RNA, 23 nt, Human
uugcuuugggagguucuuguugg

SEQ ID NO: 22262 - RNA, 21 nt, Human
cauaggaaccaggaggacaaa

SEQ ID NO: 22263 - RNA, 19 nt, Human
uguggcugccaucauuccu

SEQ ID NO: 22264 - RNA, 19 nt, Human
cuccugcucucucuccucc

SEQ ID NO: 22265 - RNA, 21 nt, Human
uggcauggagucccaacuggg

SEQ ID NO: 22266 - RNA, 24 nt, Human
uuguacaagacaaaccaagucgga

SEQ ID NO: 22267 - RNA, 22 nt, Human
auugccauucccugccuggggc

SEQ ID NO: 22268 - RNA, 21 nt, Human
gaaggcuguaggaaaagggag

SEQ ID NO: 22269 - RNA, 27 nt, Human
ccaacagcaacagcagcuccuccuccg

SEQ ID NO: 22270 - RNA, 20 nt, Human
gggacacuggcagcugugga

SEQ ID NO: 22271 - RNA, 22 nt, Human
cuguuucuccuccuuuacgccc

SEQ ID NO: 22272 - RNA, 22 nt, Human
cacacaguuacaguguccuaag

SEQ ID NO: 22273 - RNA, 27 nt, Human
gggagcaaggcccugcagcuccacgag

SEQ ID NO: 22274 - RNA, 27 nt, Human
gcucugucacccaggcuggagugcaau

SEQ ID NO: 22275 - RNA, 27 nt, Human
gcucugucucccaggcuggagugcuau

SEQ ID NO: 22276 - RNA, 17 nt, Human
gggugagguaggggugg

SEQ ID NO: 22277 - RNA, 27 nt, Human
uugcuaccucucuucugcacacauauc

SEQ ID NO: 22278 - RNA, 25 nt, Human
uccccacucuucauagacacauuug

SEQ ID NO: 22279 - RNA, 24 nt, Human
ugccagcucuguggcuucugcccu

SEQ ID NO: 22280 - RNA, 27 nt, Human
gacaagcauuuucucuguagagcagcc

SEQ ID NO: 22281 - RNA, 27 nt, Human
uggagaaaugugucaccucccccaacc

SEQ ID NO: 22282 - RNA, 23 nt, Human
ugcagugagcugauaucaugccc

SEQ ID NO: 22283 - RNA, 27 nt, Human
guuuccucuccauccauuuccuugcug

SEQ ID NO: 22284 - RNA, 20 nt, Human
uccccacccucaccgaagcc

SEQ ID NO: 22285 - RNA, 21 nt, Human
ucaccuugccuuccuccccca

SEQ ID NO: 22286 - RNA, 21 nt, Human
agucacuguugacucuauucu

SEQ ID NO: 22287 - RNA, 26 nt, Human
gccacuguacuccagccugaagagcg

SEQ ID NO: 22288 - RNA, 26 nt, Human
uacauacuuuguuuuacaacuguguu

SEQ ID NO: 22289 - RNA, 21 nt, Human
gggaggcggugguagagagag

SEQ ID NO: 22290 - RNA, 19 nt, Human
cucuuccucagccagcaca

SEQ ID NO: 22291 - RNA, 27 nt, Human
gucaccgaggcuggagugcaaugacau

SEQ ID NO: 22292 - RNA, 20 nt, Human
ucuuuagcuaaugaauugcc

SEQ ID NO: 22293 - RNA, 20 nt, Human
uuuaacauuuuaaugugcca

SEQ ID NO: 22294 - RNA, 26 nt, Human
uggcugggggcugccagccaggcuag

SEQ ID NO: 22295 - RNA, 23 nt, Human
uggggccagggcgucaagggagg

SEQ ID NO: 22296 - RNA, 18 nt, Human
agccuugaacccaccucc

SEQ ID NO: 22297 - RNA, 24 nt, Human
cugaccugcccauguccagaggga

SEQ ID NO: 22298 - RNA, 28 nt, Human
accagcagccccacaccagggccagccu

SEQ ID NO: 22299 - RNA, 19 nt, Human
caggccugcagccccacug

SEQ ID NO: 22300 - RNA, 22 nt, Human
uucaguacugauuauucuucuu

SEQ ID NO: 22301 - RNA, 22 nt, Human
uuccauauuauuuugugcacau

SEQ ID NO: 22302 - RNA, 23 nt, Human
agcccuaguuacugcauggggaa

SEQ ID NO: 22303 - RNA, 24 nt, Human
ugugaucacagcucacugcagccu

SEQ ID NO: 22304 - RNA, 24 nt, Human
uaugaucacggcucacugcagccu

SEQ ID NO: 22305 - RNA, 22 nt, Human
ccaaaauuuuucaaccccaccc

SEQ ID NO: 22306 - RNA, 23 nt, Human
uugaacaaaaauugagagcuuua

SEQ ID NO: 22307 - RNA, 22 nt, Human
caucauugcacuccagccuggg

SEQ ID NO: 22308 - RNA, 16 nt, Human
auggccaggugcagug

SEQ ID NO: 22309 - RNA, 19 nt, Human
gcugcaggaacuuaauuua

SEQ ID NO: 22310 - RNA, 22 nt, Human
gcccaggcuggagggcaauggu

SEQ ID NO: 22311 - RNA, 21 nt, Human
cuggagccuggagggagacca

SEQ ID NO: 22312 - RNA, 23 nt, Human
ggcugcugcuucccuugugcacu

SEQ ID NO: 22313 - RNA, 22 nt, Human
ccaaguagcugggacuacaggc

SEQ ID NO: 22314 - RNA, 22 nt, Human
ccaaguagcugagacuacaagc

SEQ ID NO: 22315 - RNA, 22 nt, Human
ccacaucagccaacuguggcuc

SEQ ID NO: 22316 - RNA, 27 nt, Human
uggcuguaaggcucuagaucauaaggc

SEQ ID NO: 22317 - RNA, 22 nt, Human
ucuuuagagaguuagcuucaua

SEQ ID NO: 22318 - RNA, 26 nt, Human
ucuuagcacucuagcugcccacucca

SEQ ID NO: 22319 - RNA, 22 nt, Human
uucuccaaaucuaaacaagauu

SEQ ID NO: 22320 - RNA, 24 nt, Human
cugccugggcccugcuaggccugc

SEQ ID NO: 22321 - RNA, 21 nt, Human
cuauaugccgcuacaaaaagg

SEQ ID NO: 22322 - RNA, 20 nt, Human
ccccugccuuggccaaugcg

SEQ ID NO: 22323 - RNA, 22 nt, Human
ucaagccacauggugacuuuug

SEQ ID NO: 22324 - RNA, 18 nt, Human
aaccuugccaacuucugg

SEQ ID NO: 22325 - RNA, 26 nt, Human
aguagcugggauugcaggcacucacc

SEQ ID NO: 22326 - RNA, 27 nt, Human
ggggugagucagacaggucugauuugg

SEQ ID NO: 22327 - RNA, 23 nt, Human
ccugcccggcucuggaguaccgu

SEQ ID NO: 22328 - RNA, 27 nt, Human
ucuuccuccccacaacugugcucaggc

SEQ ID NO: 22329 - RNA, 26 nt, Human
uaauuggaacgcacacugccguccaa

SEQ ID NO: 22330 - RNA, 26 nt, Human
auacccuucagugcaguguaccaggg

SEQ ID NO: 22331 - RNA, 26 nt, Human
uuccugggcaaccuuuuugauuucuu

SEQ ID NO: 22332 - RNA, 23 nt, Human
gcagggcuggccagggggaagag

SEQ ID NO: 22333 - RNA, 26 nt, Human
aaauguagccauuugagaaacuuacu

SEQ ID NO: 22334 - RNA, 22 nt, Human
cccaccgcaggcugaaggcauu

SEQ ID NO: 22335 - RNA, 22 nt, Human
gaccccuggccggaaacugagc

SEQ ID NO: 22336 - RNA, 30 nt, Human
ccauagcagguggaaaccagaucuagagca

SEQ ID NO: 22337 - RNA, 21 nt, Human
gcuccucugccugcccccuca

SEQ ID NO: 22338 - RNA, 22 nt, Human
ggccuguaaucccagcauuuug

SEQ ID NO: 22339 - RNA, 22 nt, Human
uaauauucauacaacaaagagg

SEQ ID NO: 22340 - RNA, 22 nt, Human
cuaccugcagcuuugagucuug

SEQ ID NO: 22341 - RNA, 22 nt, Human
ggaaaggggaaaugcggcccgc

SEQ ID NO: 22342 - RNA, 21 nt, Human
ugugguggugaggacuaggcc

SEQ ID NO: 22343 - RNA, 21 nt, Human
augcuuuguugccucugagaa

SEQ ID NO: 22344 - RNA, 19 nt, Human
aagcucucuuuccuucucu

SEQ ID NO: 22345 - RNA, 22 nt, Human
ccaucauccugauuagcauguu

SEQ ID NO: 22346 - RNA, 26 nt, Human
agccuccuccuuucccaaccuugcuu

SEQ ID NO: 22347 - RNA, 24 nt, Human
ccucccacucucccugccccucgg

SEQ ID NO: 22348 - RNA, 21 nt, Human
uccaauugcagagaacucgcu

SEQ ID NO: 22349 - RNA, 22 nt, Human
aaaggcugagucuagguggaga

SEQ ID NO: 22350 - RNA, 21 nt, Human
gcauuguugucagucuggacc

SEQ ID NO: 22351 - RNA, 23 nt, Human
caggcagcaggagucucggcuga

SEQ ID NO: 22352 - RNA, 31 nt, Human
gccauccaggcugggaggggaagagugcucu

SEQ ID NO: 22353 - RNA, 26 nt, Human
cccugccucuccaucucucaccaagg

SEQ ID NO: 22354 - RNA, 23 nt, Human
guuguuccucuguuaucaugccu

SEQ ID NO: 22355 - RNA, 22 nt, Human
ccuaacgcagccuccugccucc

SEQ ID NO: 22356 - RNA, 24 nt, Human
guggagcgagagaaaggccagcgu

SEQ ID NO: 22357 - RNA, 30 nt, Human
uauguuaccugcuccacugcagacuagaga

SEQ ID NO: 22358 - RNA, 23 nt, Human
uaaaccaaagucacuuguuugaa

SEQ ID NO: 22359 - RNA, 21 nt, Human
cugucucuugucguuuucccc

SEQ ID NO: 22360 - RNA, 22 nt, Human
cagugcagccacccagccuuua

SEQ ID NO: 22361 - RNA, 24 nt, Human
uuuauucuuccaaguucauucaua

SEQ ID NO: 22362 - RNA, 23 nt, Human
gucucccaggcuggagugcagug

SEQ ID NO: 22363 - RNA, 19 nt, Human
ugaaaacugagaugcugaa

SEQ ID NO: 22364 - RNA, 26 nt, Human
ugccaacaccuucuuggcuucuggga

SEQ ID NO: 22365 - RNA, 24 nt, Human
ccuaacuugcuuaaaguguaauua

SEQ ID NO: 22366 - RNA, 27 nt, Human
acugccucccacccugugucugcuucc

SEQ ID NO: 22367 - RNA, 27 nt, Human
ccugccugccucccucccccugcuaga

SEQ ID NO: 22368 - RNA, 22 nt, Human
uaaauuguugacauacugcaaa

SEQ ID NO: 22369 - RNA, 26 nt, Human
cuuagcaagcucuuuuauaugcuaaa

SEQ ID NO: 22370 - RNA, 27 nt, Human
uggagagaagcccacuguggucacugu

SEQ ID NO: 22371 - RNA, 24 nt, Human
cucugcuugaccgaugaccaauaa

SEQ ID NO: 22372 - RNA, 27 nt, Human
ggaggcugcagugagccaagaucgcac

SEQ ID NO: 22373 - RNA, 23 nt, Human
accaugccgaccacaaagguguc

SEQ ID NO: 22374 - RNA, 24 nt, Human
aggcuggagugcagugcugcgauc

SEQ ID NO: 22375 - RNA, 23 nt, Human
gccuccaggccccuccuggcugg

SEQ ID NO: 22376 - RNA, 23 nt, Human
ucugggcauauggauuuaucuau

SEQ ID NO: 22377 - RNA, 21 nt, Human
uuaauggucaggggaguacag

SEQ ID NO: 22378 - RNA, 27 nt, Human
uguuuucaaacuauauaacugaccuua

SEQ ID NO: 22379 - RNA, 22 nt, Human
ugucgccuaggcuggagugcag

SEQ ID NO: 22380 - RNA, 26 nt, Human
ccuugcaggaaaccagucucaguguc

SEQ ID NO: 22381 - RNA, 22 nt, Human
uaccagugugaaaaaugucauu

SEQ ID NO: 22382 - RNA, 23 nt, Human
cuugcccaggcuggagugcaaug

SEQ ID NO: 22383 - RNA, 27 nt, Human
gaggaagacaaggaucccgccacgagc

SEQ ID NO: 22384 - RNA, 22 nt, Human
cuuugcagaaccuuuaauugga

SEQ ID NO: 22385 - RNA, 20 nt, Human
gcuggugggaaaugggagcc

SEQ ID NO: 22386 - RNA, 19 nt, Human
ccuccucugugaagcauuc

SEQ ID NO: 22387 - RNA, 25 nt, Human
ccgcggcugcgugaggacagcaggg

SEQ ID NO: 22388 - RNA, 22 nt, Human
agguugaagucaagaugacaga

SEQ ID NO: 22389 - RNA, 26 nt, Human
ggcucacaccuguaauuccagcacuu

SEQ ID NO: 22390 - RNA, 19 nt, Human
uuguugguuuugugcugcu

SEQ ID NO: 22391 - RNA, 24 nt, Human
gcccaggcuggagcgcagucccgc

SEQ ID NO: 22392 - RNA, 22 nt, Human
ucuaugcuaggcacugugcuag

SEQ ID NO: 22393 - RNA, 25 nt, Human
gucuuguuucucucucugugcuacc

SEQ ID NO: 22394 - RNA, 25 nt, Human
guuucagaaacaaaagacaaugcug

SEQ ID NO: 22395 - RNA, 17 nt, Human
cuucccuuacucuaccu

SEQ ID NO: 22396 - RNA, 22 nt, Human
uugccuaggcuggagugcagug

SEQ ID NO: 22397 - RNA, 23 nt, Human
uucauucuauuugauuuauucua

SEQ ID NO: 22398 - RNA, 21 nt, Human
agcuaaaauaauggcuucacu

SEQ ID NO: 22399 - RNA, 21 nt, Human
ccuaagugcugggauuauagg

SEQ ID NO: 22400 - RNA, 26 nt, Human
ccaccacccucuccuugcuuucagcc

SEQ ID NO: 22401 - RNA, 20 nt, Human
uccucaagcucuucugcuag

SEQ ID NO: 22402 - RNA, 15 nt, Human
aaccuguuaugcuuu

SEQ ID NO: 22403 - RNA, 28 nt, Human
ugaugccacagagaauaagcugaacuug

SEQ ID NO: 22404 - RNA, 21 nt, Human
ucugggucaugcacugagguc

SEQ ID NO: 22405 - RNA, 20 nt, Human
aucucucugcucaucaugcc

SEQ ID NO: 22406 - RNA, 20 nt, Human
gcuuagaaacuggaaauacu

SEQ ID NO: 22407 - RNA, 21 nt, Human
uuucuucaucccuugcuuaag

SEQ ID NO: 22408 - RNA, 24 nt, Human
ggcuuucuaucauuuuuauguuuu

SEQ ID NO: 22409 - RNA, 25 nt, Human
agcucacuguauuccuuacuaaccu

SEQ ID NO: 22410 - RNA, 20 nt, Human
ccucuugcacuguugucuug

SEQ ID NO: 22411 - RNA, 25 nt, Human
ccuuucucagccgcuucugacugcu

SEQ ID NO: 22412 - RNA, 21 nt, Human
uucuucauguucaauuauuuc

SEQ ID NO: 22413 - RNA, 22 nt, Human
uccccaggcuggccugaggaug

SEQ ID NO: 22414 - RNA, 19 nt, Human
ucacacagccucugcagau

SEQ ID NO: 22415 - RNA, 20 nt, Human
gucaaugaaaguuguuuugu

SEQ ID NO: 22416 - RNA, 26 nt, Human
uaggagaccucaguguuuugggucua

SEQ ID NO: 22417 - RNA, 23 nt, Human
cauccaggcuggacaguucagug

SEQ ID NO: 22418 - RNA, 20 nt, Human
guuucccuguuucaaaggga

SEQ ID NO: 22419 - RNA, 22 nt, Human
cucuucacuguggucauccugc

SEQ ID NO: 22420 - RNA, 25 nt, Human
uucagaggcugcauuugccuucuuc

SEQ ID NO: 22421 - RNA, 25 nt, Human
gcgcccggccuugcucaacgcccag

SEQ ID NO: 22422 - RNA, 27 nt, Human
cacugcacuccagccuaggcaacagag

SEQ ID NO: 22423 - RNA, 27 nt, Human
gcauccacucucccuuguccuccuggg

SEQ ID NO: 22424 - RNA, 22 nt, Human
ugucacccaggcuagagugcag

SEQ ID NO: 22425 - RNA, 22 nt, Human
ugucacccaggcuggagugcaa

SEQ ID NO: 22426 - RNA, 22 nt, Human
ugucucccaggcuggagugcua

SEQ ID NO: 22427 - RNA, 22 nt, Human
cacacaacuguggauaaauuuu

SEQ ID NO: 22428 - RNA, 27 nt, Human
uuugcccaggcuucucaccacggugua

SEQ ID NO: 22429 - RNA, 22 nt, Human
uugccaucauauggucaauauu

SEQ ID NO: 22430 - RNA, 26 nt, Human
ccuucgcggaacucccggcaguguua

SEQ ID NO: 22431 - RNA, 19 nt, Human
gauugcugagcucaagggu

SEQ ID NO: 22432 - RNA, 26 nt, Human
uagcuccauguuccuccuccucucuc

SEQ ID NO: 22433 - RNA, 20 nt, Human
uggaaagaacaacuggcagg

SEQ ID NO: 22434 - RNA, 25 nt, Human
aaauguacaccugauuugagaagcu

SEQ ID NO: 22435 - RNA, 24 nt, Human
uucagauaauaaaauucucuuuca

SEQ ID NO: 22436 - RNA, 25 nt, Human
ggggcaaugccugccuguucaccac

SEQ ID NO: 22437 - RNA, 21 nt, Human
acuucacugccgcagcucuuu

SEQ ID NO: 22438 - RNA, 28 nt, Human
gugccuaaaacccaguugcugaucccug

SEQ ID NO: 22439 - RNA, 21 nt, Human
aaaggccgugccugguggggc

SEQ ID NO: 22440 - RNA, 20 nt, Human
cgcgccuggcccugagcugu

SEQ ID NO: 22441 - RNA, 24 nt, Human
ggugguggagagauggaagggcau

SEQ ID NO: 22442 - RNA, 23 nt, Human
augcccuucaccaaagcugccuc

SEQ ID NO: 22443 - RNA, 26 nt, Human
cccugcagcuguaguacagugcugug

SEQ ID NO: 22444 - RNA, 26 nt, Human
cgcggggcuccagucuccaggacguu

SEQ ID NO: 22445 - RNA, 20 nt, Human
cugggaggagggggagggug

SEQ ID NO: 22446 - RNA, 19 nt, Human
agaaaugcuauauuuugug

SEQ ID NO: 22447 - RNA, 23 nt, Human
ccaaaacaccggguuccagcacc

SEQ ID NO: 22448 - RNA, 26 nt, Human
uucaaaccauuucagccaaacuguag

SEQ ID NO: 22449 - RNA, 21 nt, Human
gcuggucucuaacuccugggc

SEQ ID NO: 22450 - RNA, 20 nt, Human
cuuccuggcucugcuaaauu

SEQ ID NO: 22451 - RNA, 22 nt, Human
cuguaggacugagguucccaag

SEQ ID NO: 22452 - RNA, 21 nt, Human
ucugcuccuuuccccuuccuu

SEQ ID NO: 22453 - RNA, 27 nt, Human
gaggaagaggacgaggccuuguuggca

SEQ ID NO: 22454 - RNA, 23 nt, Human
gagugaggggacaaggggcaggu

SEQ ID NO: 22455 - RNA, 23 nt, Human
acugccucuggccugcagcugac

SEQ ID NO: 22456 - RNA, 20 nt, Human
uucuccaggagccuggcacu

SEQ ID NO: 22457 - RNA, 23 nt, Human
ggaguaguuuucucuagcaaaga

SEQ ID NO: 22458 - RNA, 18 nt, Human
cccuauaggaaacuuacu

SEQ ID NO: 22459 - RNA, 26 nt, Human
gagcauuucagccagaggacuuugga

SEQ ID NO: 22460 - RNA, 23 nt, Human
ggggagaggaaggggcagaggga

SEQ ID NO: 22461 - RNA, 25 nt, Human
ccuaucucuagcaaccuccugggcc

SEQ ID NO: 22462 - RNA, 24 nt, Human
agggucugggaucuguuuucugga

SEQ ID NO: 22463 - RNA, 21 nt, Human
ugcccucucugaaccucaguu

SEQ ID NO: 22464 - RNA, 26 nt, Human
ucucauugacuuccuuacuaagcaua

SEQ ID NO: 22465 - RNA, 26 nt, Human
cuggaaggcagguugcgagaaggaga

SEQ ID NO: 22466 - RNA, 23 nt, Human
gcugucauuauuuccucuuauca

SEQ ID NO: 22467 - RNA, 19 nt, Human
uucagccaggcuggagcaa

SEQ ID NO: 22468 - RNA, 25 nt, Human
cacccccucccacuggagugcgggg

SEQ ID NO: 22469 - RNA, 21 nt, Human
auggguggagaggaugaugaa

SEQ ID NO: 22470 - RNA, 22 nt, Human
gcuaagugcggggguggcggug

SEQ ID NO: 22471 - RNA, 27 nt, Human
cauugcauuccagccugggcaacagag

SEQ ID NO: 22472 - RNA, 22 nt, Human
auguuaccuaaaacugcugaac

SEQ ID NO: 22473 - RNA, 20 nt, Human
acgccucuguucaacuugug

SEQ ID NO: 22474 - RNA, 27 nt, Human
cccaaagugcugggauuacaaguguga

SEQ ID NO: 22475 - RNA, 27 nt, Human
ggcacagugccugggacuggcagggug

SEQ ID NO: 22476 - RNA, 22 nt, Human
aaaggagaccugaauuuuugga

SEQ ID NO: 22477 - RNA, 26 nt, Human
cccacauuuagucucuuuauuccuag

SEQ ID NO: 22478 - RNA, 25 nt, Human
uguugcccaggcuggaguucagcgg

SEQ ID NO: 22479 - RNA, 21 nt, Human
gaacuccauuuuggauuuuga

SEQ ID NO: 22480 - RNA, 15 nt, Human
uacucauacuacaca

SEQ ID NO: 22481 - RNA, 22 nt, Human
aggcagugaggagcuuuugauu

SEQ ID NO: 22482 - RNA, 21 nt, Human
gacacuuccugccuaagggag

SEQ ID NO: 22483 - RNA, 20 nt, Human
uugaacaaacaggugcucca

SEQ ID NO: 22484 - RNA, 22 nt, Human
gcucccgggguaggugagggaa

SEQ ID NO: 22485 - RNA, 24 nt, Human
ucugagugaaucugaugcucugcu

SEQ ID NO: 22486 - RNA, 24 nt, Human
cugucccagaagauggaauggggg

SEQ ID NO: 22487 - RNA, 27 nt, Human
ggcuguaauccuacgccaggcacaagg

SEQ ID NO: 22488 - RNA, 26 nt, Human
ggcgguggagacuucccugugcggug

SEQ ID NO: 22489 - RNA, 22 nt, Human
ugggacuacaggcaugagccac

SEQ ID NO: 22490 - RNA, 22 nt, Human
ugggauuacaggcaugagccau

SEQ ID NO: 22491 - RNA, 28 nt, Human
uuucagcuuaauuauaaacaaaggaaca

SEQ ID NO: 22492 - RNA, 27 nt, Human
gcagauaaauaauggagcaugcaguga

SEQ ID NO: 22493 - RNA, 25 nt, Human
cuccuaaaaccaaaaacaacaguga

SEQ ID NO: 22494 - RNA, 21 nt, Human
ggugcucaccucuuguggaac

SEQ ID NO: 22495 - RNA, 22 nt, Human
uuggcuuucaagaucuucuuuc

SEQ ID NO: 22496 - RNA, 27 nt, Human
ugggauagaaguauuuguguaccugga

SEQ ID NO: 22497 - RNA, 26 nt, Human
cagcuucccucacuguguacagaacg

SEQ ID NO: 22498 - RNA, 21 nt, Human
guggauuuaaaauacuccuuu

SEQ ID NO: 22499 - RNA, 24 nt, Human
uauuuuuuguauuguaaaauaaca

SEQ ID NO: 22500 - RNA, 23 nt, Human
uaucccaaagcaccaauuacugc

SEQ ID NO: 22501 - RNA, 27 nt, Human
gccgggccccugggcuuggccugcugu

SEQ ID NO: 22502 - RNA, 27 nt, Human
uuuguauuuguucuuuaaaaacauuuu

SEQ ID NO: 22503 - RNA, 22 nt, Human
acuauacauuuuaugauuuuuc

SEQ ID NO: 22504 - RNA, 22 nt, Human
uucagauuauuuguuacauaua

SEQ ID NO: 22505 - RNA, 21 nt, Human
aaggacugagcacccucugga

SEQ ID NO: 22506 - RNA, 25 nt, Human
gggacucauaacugcaacuucacag

SEQ ID NO: 22507 - RNA, 21 nt, Human
gggagcuguguagugagggau

SEQ ID NO: 22508 - RNA, 24 nt, Human
agcaguccacaaagugcugggauu

SEQ ID NO: 22509 - RNA, 24 nt, Human
ggggcagagcggggcaggaaaggu

SEQ ID NO: 22510 - RNA, 17 nt, Human
uguagguggcuugggga

SEQ ID NO: 22511 - RNA, 27 nt, Human
gccagugcagugagaacagcagcccca

SEQ ID NO: 22512 - RNA, 28 nt, Human
cuccugaaugccugaggcacgaucugga

SEQ ID NO: 22513 - RNA, 20 nt, Human
ggguauaccuggggcugguc

SEQ ID NO: 22514 - RNA, 21 nt, Human
uagaaucugauuucaccucuc

SEQ ID NO: 22515 - RNA, 20 nt, Human
gcugcucugccuuccuucua

SEQ ID NO: 22516 - RNA, 24 nt, Human
uucaauuuucuucacacuaucaac

SEQ ID NO: 22517 - RNA, 22 nt, Human
uuucaccccuuaccccaaagag

SEQ ID NO: 22518 - RNA, 23 nt, Human
aacuccauuuccugucugucuua

SEQ ID NO: 22519 - RNA, 24 nt, Human
ucuuaggacaccauuugggcuagu

SEQ ID NO: 22520 - RNA, 22 nt, Human
ugggaggcggagcuugcaguga

SEQ ID NO: 22521 - RNA, 27 nt, Human
ggaggcugaggugggaggauuguuuga

SEQ ID NO: 22522 - RNA, 21 nt, Human
uuaucaggaugugagcacucg

SEQ ID NO: 22523 - RNA, 27 nt, Human
ggaggcugaggcaggagaauugcuuga

SEQ ID NO: 22524 - RNA, 22 nt, Human
uguuauucaccaacuaagggaa

SEQ ID NO: 22525 - RNA, 24 nt, Human
gacaaggucaccugggcugugaug

SEQ ID NO: 22526 - RNA, 22 nt, Human
aggcugaggcgggcggaucaug

SEQ ID NO: 22527 - RNA, 21 nt, Human
uugccucucuugccccuuguc

SEQ ID NO: 22528 - RNA, 22 nt, Human
accagccuggccagcaugguga

SEQ ID NO: 22529 - RNA, 22 nt, Human
uugccaaggcuggagugcaggc

SEQ ID NO: 22530 - RNA, 23 nt, Human
uccauccacagagcagugcagug

SEQ ID NO: 22531 - RNA, 20 nt, Human
augcagcucuuacagauauu

SEQ ID NO: 22532 - RNA, 22 nt, Human
aguuugaacuagcuggaauagu

SEQ ID NO: 22533 - RNA, 22 nt, Human
cagcagcaguaccuacagcccu

SEQ ID NO: 22534 - RNA, 26 nt, Human
uccaguguugcggagaggcaagagca

SEQ ID NO: 22535 - RNA, 22 nt, Human
caguuuucaccauuuguccuca

SEQ ID NO: 22536 - RNA, 26 nt, Human
ccagccuggcugcacuuggguucccg

SEQ ID NO: 22537 - RNA, 27 nt, Human
cucucuaagcuuucucuuccucccuua

SEQ ID NO: 22538 - RNA, 26 nt, Human
uggguauuuaauaagaaacaugaugu

SEQ ID NO: 22539 - RNA, 23 nt, Human
caagcagacgugagugugacuuu

SEQ ID NO: 22540 - RNA, 21 nt, Human
aggaggcggagguuguaguga

SEQ ID NO: 22541 - RNA, 22 nt, Human
cuaaguagcuggguuuacaggc

SEQ ID NO: 22542 - RNA, 23 nt, Human
cucuucugguccccacagacuca

SEQ ID NO: 22543 - RNA, 21 nt, Human
uggagucccuuggagugccuu

SEQ ID NO: 22544 - RNA, 20 nt, Human
cagcugcagagguggcagug

SEQ ID NO: 22545 - RNA, 21 nt, Human
aucuaacugugaaagaaucuu

SEQ ID NO: 22546 - RNA, 22 nt, Human
ucuucuuccucaaaaucuggug

SEQ ID NO: 22547 - RNA, 27 nt, Human
gggcggccagugcagugaugccuggcg

SEQ ID NO: 22548 - RNA, 14 nt, Human
auucccuuaggccu

SEQ ID NO: 22549 - RNA, 29 nt, Human
gagggccucaguuucaagaguguguuggg

SEQ ID NO: 22550 - RNA, 18 nt, Human
aacccuaugaaugugaug

SEQ ID NO: 22551 - RNA, 22 nt, Human
ucuaauguuuuguacagugccu

SEQ ID NO: 22552 - RNA, 26 nt, Human
gcccagccucugcaacagcucugccu

SEQ ID NO: 22553 - RNA, 21 nt, Human
acauguacugagacaaaaagg

SEQ ID NO: 22554 - RNA, 27 nt, Human
cuuugggccuccuuggucagccuuccc

SEQ ID NO: 22555 - RNA, 21 nt, Human
caguuugucuaaguccuggcu

SEQ ID NO: 22556 - RNA, 22 nt, Human
accauaaaacacuaucugaugc

SEQ ID NO: 22557 - RNA, 22 nt, Human
cacucgcuggcgaccugcucca

SEQ ID NO: 22558 - RNA, 27 nt, Human
gcaguguccugugcuuucugcaugcuu

SEQ ID NO: 22559 - RNA, 22 nt, Human
aaagucacccagggacacucca

SEQ ID NO: 22560 - RNA, 24 nt, Human
ccuacccucgccucgcauccucug

SEQ ID NO: 22561 - RNA, 22 nt, Human
uacugcugcugccgcugcuuuu

SEQ ID NO: 22562 - RNA, 23 nt, Human
cgcuccucccagauggcuucgga

SEQ ID NO: 22563 - RNA, 25 nt, Human
gggagggagaauaagucagucaugc

SEQ ID NO: 22564 - RNA, 22 nt, Human
gugccaauauuucugauauaac

SEQ ID NO: 22565 - RNA, 24 nt, Human
gggugagggcuggugguuggugaa

SEQ ID NO: 22566 - RNA, 22 nt, Human
ugccgcccaaacuggagugcag

SEQ ID NO: 22567 - RNA, 22 nt, Human
cuccagccucgcucuccgccgc

SEQ ID NO: 22568 - RNA, 21 nt, Human
ggauacuuucuacuuuuucua

SEQ ID NO: 22569 - RNA, 23 nt, Human
agguuggagcaaggcuuuucacu

SEQ ID NO: 22570 - RNA, 22 nt, Human
ugcaaggguucccugguuguga

SEQ ID NO: 22571 - RNA, 21 nt, Human
ccacauuugacauuuaugccg

SEQ ID NO: 22572 - RNA, 24 nt, Human
ucaacaacaaggaagucugcucug

SEQ ID NO: 22573 - RNA, 22 nt, Human
aauugaagagagaaaugacagg

SEQ ID NO: 22574 - RNA, 22 nt, Human
uacuacugcauuuccuguuuuc

SEQ ID NO: 22575 - RNA, 24 nt, Human
auauccaagagcucagggccaguu

SEQ ID NO: 22576 - RNA, 24 nt, Human
gagagacacgaacaaaccaaggaa

SEQ ID NO: 22577 - RNA, 25 nt, Human
guagggaggggagaguaugaggagg

SEQ ID NO: 22578 - RNA, 17 nt, Human
ugcagccccagcccagc

SEQ ID NO: 22579 - RNA, 22 nt, Human
uccugccucuuuucuaagcaua

SEQ ID NO: 22580 - RNA, 20 nt, Human
gaaauguuugccugucugaa

SEQ ID NO: 22581 - RNA, 26 nt, Human
uacaaugucauaaauauccuuauaua

SEQ ID NO: 22582 - RNA, 22 nt, Human
acaaucacggcucacugcagcc

SEQ ID NO: 22583 - RNA, 22 nt, Human
gcaaucacagcucacugcagcc

SEQ ID NO: 22584 - RNA, 21 nt, Human
ucuccacugcauccgaucuca

SEQ ID NO: 22585 - RNA, 25 nt, Human
aggaggcggcgagagaggacugccu

SEQ ID NO: 22586 - RNA, 18 nt, Human
aggggguucaagggucau

SEQ ID NO: 22587 - RNA, 22 nt, Human
gcugucuugacaucucuugccu

SEQ ID NO: 22588 - RNA, 24 nt, Human
acccagucaccuuuacuaguccuu

SEQ ID NO: 22589 - RNA, 26 nt, Human
ccuccagggaaucagaaaggcacuaa

SEQ ID NO: 22590 - RNA, 21 nt, Human
gaacacuugcucuucugugau

SEQ ID NO: 22591 - RNA, 24 nt, Human
agggaaaauccuaagacagaggaa

SEQ ID NO: 22592 - RNA, 25 nt, Human
auuguccuccuccuccuggcucggc

SEQ ID NO: 22593 - RNA, 27 nt, Human
ggggugagugcauugaagaaguagguu

SEQ ID NO: 22594 - RNA, 22 nt, Human
aaacauccuaucuuucuucuuc

SEQ ID NO: 22595 - RNA, 26 nt, Human
uucguggaagaaaugucagcaggaag

SEQ ID NO: 22596 - RNA, 22 nt, Human
uuuuccucucuuugauguacuu

SEQ ID NO: 22597 - RNA, 22 nt, Human
aggcuggaaugcaguggcacaa

SEQ ID NO: 22598 - RNA, 19 nt, Human
ccugcagcugggugcugcc

SEQ ID NO: 22599 - RNA, 26 nt, Human
gaugcaugucugucuguucuaucuag

SEQ ID NO: 22600 - RNA, 20 nt, Human
ucauaccacguuuugcucaa

SEQ ID NO: 22601 - RNA, 22 nt, Human
ccucgggacuucccaccaccuu

SEQ ID NO: 22602 - RNA, 20 nt, Human
uguaaucccaguaaucccca

SEQ ID NO: 22603 - RNA, 25 nt, Human
augccuggcuaauuuuguguuuuua

SEQ ID NO: 22604 - RNA, 21 nt, Human
cagagaggcccagauggaggc

SEQ ID NO: 22605 - RNA, 27 nt, Human
ggucucaaacuccugaccucaaguaau

SEQ ID NO: 22606 - RNA, 27 nt, Human
agucucaaacuccugaccucaagugau

SEQ ID NO: 22607 - RNA, 26 nt, Human
aaaacaauggaaugagaauuuaagcc

SEQ ID NO: 22608 - RNA, 21 nt, Human
cucaaauaauugaacuaccug

SEQ ID NO: 22609 - RNA, 22 nt, Human
gucucagugcauuuuguuuucc

SEQ ID NO: 22610 - RNA, 20 nt, Human
ucuguuaaaugaaugucaua

SEQ ID NO: 22611 - RNA, 20 nt, Human
ggcucggccugacugcucca

SEQ ID NO: 22612 - RNA, 27 nt, Human
uucucucucaguucuacacugauacac

SEQ ID NO: 22613 - RNA, 24 nt, Human
acggacgccaugagggcucugcug

SEQ ID NO: 22614 - RNA, 25 nt, Human
ggaggaggaaagggagccugcucuc

SEQ ID NO: 22615 - RNA, 25 nt, Human
cuauuugaguuauuaaauguuaauc

SEQ ID NO: 22616 - RNA, 27 nt, Human
gguucacugcaaccguucagagguccc

SEQ ID NO: 22617 - RNA, 23 nt, Human
ugggaaauuuucaugcacgcuua

SEQ ID NO: 22618 - RNA, 23 nt, Human
ugcuucuuuggcccagcugggac

SEQ ID NO: 22619 - RNA, 24 nt, Human
gcacagccugucacugcucugccu

SEQ ID NO: 22620 - RNA, 24 nt, Human
ucaacccacggaagcuccgggaau

SEQ ID NO: 22621 - RNA, 27 nt, Human
uggcucacgccuguaauuccaucauuu

SEQ ID NO: 22622 - RNA, 23 nt, Human
gccauggggacgcccucagucua

SEQ ID NO: 22623 - RNA, 27 nt, Human
cgcagccgccagcgccggcacaucccg

SEQ ID NO: 22624 - RNA, 23 nt, Human
uucauuguguguuagcagcagug

SEQ ID NO: 22625 - RNA, 27 nt, Human
gcaccuugcugcaguguccagaagcgg

SEQ ID NO: 22626 - RNA, 32 nt, Human
cagguuguuugagcccaggaauuugagaacag

SEQ ID NO: 22627 - RNA, 27 nt, Human
uggguucaagcgauucuccugccucag

SEQ ID NO: 22628 - RNA, 26 nt, Human
ucuuuccuagauuagcuucugaaauc

SEQ ID NO: 22629 - RNA, 22 nt, Human
cuuuuaccaaaaugauuuaaua

SEQ ID NO: 22630 - RNA, 21 nt, Human
cuccacugacuuccuaggccc

SEQ ID NO: 22631 - RNA, 23 nt, Human
ggcaucugcaguacaccaagcac

SEQ ID NO: 22632 - RNA, 25 nt, Human
ccaguuucccuucuaugcaguauug

SEQ ID NO: 22633 - RNA, 28 nt, Human
ccucgccuggccugaggucucgcugaug

SEQ ID NO: 22634 - RNA, 27 nt, Human
gucacugagagacagaggcagcaucug

SEQ ID NO: 22635 - RNA, 25 nt, Human
aacauuagagcuggaguggggcugg

SEQ ID NO: 22636 - RNA, 25 nt, Human
aucacacacagggcuauuccuuucc

SEQ ID NO: 22637 - RNA, 23 nt, Human
cuuuguuacuuaaaugcauuaua

SEQ ID NO: 22638 - RNA, 20 nt, Human
ugcuucgggcuuccaccuca

SEQ ID NO: 22639 - RNA, 22 nt, Human
acaaaaacacaaaaacucugag

SEQ ID NO: 22640 - RNA, 27 nt, Human
cccugcaggccucaucuuucccaaaac

SEQ ID NO: 22641 - RNA, 22 nt, Human
agccucccaagcaacugggauu

SEQ ID NO: 22642 - RNA, 23 nt, Human
cuccgugguucuuaaugccucag

SEQ ID NO: 22643 - RNA, 31 nt, Human
cagguaccuagcagaggcugucaguccuugg

SEQ ID NO: 22644 - RNA, 20 nt, Human
cggcaggcccgagcccaggg

SEQ ID NO: 22645 - RNA, 21 nt, Human
agugggaugggacagggaggc

SEQ ID NO: 22646 - RNA, 24 nt, Human
ccagcuugaagccaaaucuuucca

SEQ ID NO: 22647 - RNA, 25 nt, Human
cugccugggucuuagcauugaucag

SEQ ID NO: 22648 - RNA, 23 nt, Human
ggcucacagcaaccucucugccu

SEQ ID NO: 22649 - RNA, 27 nt, Human
caggcuggagugcaguggccugaucuc

SEQ ID NO: 22650 - RNA, 26 nt, Human
ggcuccugccacugcccucccauuac

SEQ ID NO: 22651 - RNA, 27 nt, Human
ccggaugcucugucagucuccuccucu

SEQ ID NO: 22652 - RNA, 20 nt, Human
aacaaauucuuucacaaggu

SEQ ID NO: 22653 - RNA, 26 nt, Human
ucuggaaaaucuuucuuucucuucuc

SEQ ID NO: 22654 - RNA, 24 nt, Human
ccagccccucacaccacagccagg

SEQ ID NO: 22655 - RNA, 21 nt, Human
gccuguaaucccagcacuggg

SEQ ID NO: 22656 - RNA, 21 nt, Human
ccuguaaucccaacauuuugg

SEQ ID NO: 22657 - RNA, 24 nt, Human
gcucuuuuuaaaaaacagcuucaa

SEQ ID NO: 22658 - RNA, 22 nt, Human
guugcccaggguggagugcagu

SEQ ID NO: 22659 - RNA, 22 nt, Human
guugcccaggcuggaguggagu

SEQ ID NO: 22660 - RNA, 20 nt, Human
ggcacacccuucacgguugc

SEQ ID NO: 22661 - RNA, 21 nt, Human
auauauuuggcuuauauucua

SEQ ID NO: 22662 - RNA, 21 nt, Human
gaacuaaauaucauauaguua

SEQ ID NO: 22663 - RNA, 21 nt, Human
acuguauuuggagacaggguc

SEQ ID NO: 22664 - RNA, 30 nt, Human
uguucgcuggcugaucauugcaguaucaga

SEQ ID NO: 22665 - RNA, 23 nt, Human
ccugcuugaacacugaagggcag

SEQ ID NO: 22666 - RNA, 17 nt, Human
guggccuucaaaggaaa

SEQ ID NO: 22667 - RNA, 22 nt, Human
ugcucacugcaagcuccgccuc

SEQ ID NO: 22668 - RNA, 29 nt, Human
guuuccuauuccauacuguucauuucuaa

SEQ ID NO: 22669 - RNA, 24 nt, Human
caccucauuacaccgaagccuggg

SEQ ID NO: 22670 - RNA, 22 nt, Human
aggugcuguuacucaacucagu

SEQ ID NO: 22671 - RNA, 22 nt, Human
cauggcagcauggaggaggcaa

SEQ ID NO: 22672 - RNA, 23 nt, Human
cccucauucggggucgggaacca

SEQ ID NO: 22673 - RNA, 25 nt, Human
cuucugcuggaaagugggacccucu

SEQ ID NO: 22674 - RNA, 20 nt, Human
uaccuacucuuggcuccugu

SEQ ID NO: 22675 - RNA, 28 nt, Human
cucauuuaauccucucaaccaccuuuca

SEQ ID NO: 22676 - RNA, 21 nt, Human
cggggccugguggcgagccca

SEQ ID NO: 22677 - RNA, 21 nt, Human
cuggccaagguguccaagcca

SEQ ID NO: 22678 - RNA, 20 nt, Human
uuauuguauagcuagcaaua

SEQ ID NO: 22679 - RNA, 23 nt, Human
ggcuccaggagcccacaggcugg

SEQ ID NO: 22680 - RNA, 27 nt, Human
gggccuggccucuguaagccuguguau

SEQ ID NO: 22681 - RNA, 22 nt, Human
cugaggcaagcuaacugcuuga

SEQ ID NO: 22682 - RNA, 25 nt, Human
uugucauuuuuugcagaagucauau

SEQ ID NO: 22683 - RNA, 22 nt, Human
accgcccuggcuaacaugguga

SEQ ID NO: 22684 - RNA, 22 nt, Human
ucaaguagcugggauuacaagc

SEQ ID NO: 22685 - RNA, 20 nt, Human
cugcccggcgccugcccugc

SEQ ID NO: 22686 - RNA, 24 nt, Human
cguguuuucaucuuuguucacuug

SEQ ID NO: 22687 - RNA, 22 nt, Human
caaacucuugggcucaagccau

SEQ ID NO: 22688 - RNA, 24 nt, Human
acucguuccguuuccaaacagcca

SEQ ID NO: 22689 - RNA, 26 nt, Human
gacuaaaaaucacaacuuaacuagca

SEQ ID NO: 22690 - RNA, 18 nt, Human
gauuuuucacacaccuca

SEQ ID NO: 22691 - RNA, 20 nt, Human
accccuucuggggucacucc

SEQ ID NO: 22692 - RNA, 21 nt, Human
aacaucuuaaucugcaccuuu

SEQ ID NO: 22693 - RNA, 22 nt, Human
uguugcccaagcuggagugcaa

SEQ ID NO: 22694 - RNA, 22 nt, Human
uauugcccaggcuggagugcaa

SEQ ID NO: 22695 - RNA, 23 nt, Human
agccugucucuguaccucuaacu

SEQ ID NO: 22696 - RNA, 24 nt, Human
auugauacccugggccuuuagugu

SEQ ID NO: 22697 - RNA, 21 nt, Human
cugcaucuucuggaaucuaga

SEQ ID NO: 22698 - RNA, 32 nt, Human
ugagacucucuuaggagcagagcucugccgca

SEQ ID NO: 22699 - RNA, 27 nt, Human
uccucaccccucaauuccuaggggcuu

SEQ ID NO: 22700 - RNA, 24 nt, Human
ucagaaucacugggaaauuuaagu

SEQ ID NO: 22701 - RNA, 22 nt, Human
acuguccuggcagugaugggga

SEQ ID NO: 22702 - RNA, 28 nt, Human
cugcuccuuuccccuuccuuuuaaguaa

SEQ ID NO: 22703 - RNA, 28 nt, Human
uuggcaugacugucugugcaccgagaag

SEQ ID NO: 22704 - RNA, 32 nt, Human
cuagggcaggaugaacuggcucugagcacccu

SEQ ID NO: 22705 - RNA, 17 nt, Human
uacauauacaacuaugg

SEQ ID NO: 22706 - RNA, 21 nt, Human
cacuucccaggaucugcucca

SEQ ID NO: 22707 - RNA, 20 nt, Human
ggugugggagagcaaguugc

SEQ ID NO: 22708 - RNA, 23 nt, Human
guuucaggcuuuuaugaggaaag

SEQ ID NO: 22709 - RNA, 22 nt, Human
ggcuugaacuuggccucuaccc

SEQ ID NO: 22710 - RNA, 27 nt, Human
cugaguauucucauaggagacugcguc

SEQ ID NO: 22711 - RNA, 25 nt, Human
gaaugaggcuggauacggugcagug

SEQ ID NO: 22712 - RNA, 22 nt, Human
gaaagagauugccacgacgugu

SEQ ID NO: 22713 - RNA, 18 nt, Human
aagacaccuucuacccca

SEQ ID NO: 22714 - RNA, 23 nt, Human
gaagcucuucgaggcucaggaga

SEQ ID NO: 22715 - RNA, 20 nt, Human
uaauggucaggggaguacag

SEQ ID NO: 22716 - RNA, 21 nt, Human
gcagcaacacagaauguaaua

SEQ ID NO: 22717 - RNA, 20 nt, Human
cuuuaaaacaaaacaaaaca

SEQ ID NO: 22718 - RNA, 22 nt, Human
gccuguggucucagcacuuugg

SEQ ID NO: 22719 - RNA, 20 nt, Human
cccaacaacagcacugcucu

SEQ ID NO: 22720 - RNA, 20 nt, Human
uuuuaauaccacagcacuua

SEQ ID NO: 22721 - RNA, 22 nt, Human
ccugugcauaggagcaauuagg

SEQ ID NO: 22722 - RNA, 25 nt, Human
ccgggacagaguuuucccagaccug

SEQ ID NO: 22723 - RNA, 27 nt, Human
cgccacuguacuccagccuggacaaca

SEQ ID NO: 22724 - RNA, 22 nt, Human
ugaaccccaggcuggagugcag

SEQ ID NO: 22725 - RNA, 27 nt, Human
cucaaugcuuaauaaauauaauucaug

SEQ ID NO: 22726 - RNA, 15 nt, Human
uuucccuuauugccu

SEQ ID NO: 22727 - RNA, 22 nt, Human
gcccccagcccccgucuguccc

SEQ ID NO: 22728 - RNA, 26 nt, Human
aaugcacauguagaugguuagcaugu

SEQ ID NO: 22729 - RNA, 23 nt, Human
aggacucugaggcucuuucuggg

SEQ ID NO: 22730 - RNA, 20 nt, Human
acucacuguuucuaagccuc

SEQ ID NO: 22731 - RNA, 24 nt, Human
agauacuaugauuaaaaaagcuuu

SEQ ID NO: 22732 - RNA, 21 nt, Human
ccugaagcagacugcugagga

SEQ ID NO: 22733 - RNA, 31 nt, Human
gugggaggagugcuugaggccaggaguucaa

SEQ ID NO: 22734 - RNA, 24 nt, Human
cuggggagggguccgggaagaagg

SEQ ID NO: 22735 - RNA, 21 nt, Human
gcugcuugccauucucuugca

SEQ ID NO: 22736 - RNA, 17 nt, Human
agagaaacguguaccca

SEQ ID NO: 22737 - RNA, 18 nt, Human
agccaucauauuacuugg

SEQ ID NO: 22738 - RNA, 21 nt, Human
uaauccaagacuggaauugua

SEQ ID NO: 22739 - RNA, 25 nt, Human
ucuugcacggugaccccuuuuaguc

SEQ ID NO: 22740 - RNA, 26 nt, Human
gggagggagagcggagaaacugggau

SEQ ID NO: 22741 - RNA, 21 nt, Human
cacuuaaauuuguucuuuguu

SEQ ID NO: 22742 - RNA, 21 nt, Human
uuuugcagacaacccuguccu

SEQ ID NO: 22743 - RNA, 26 nt, Human
aucugccaacaauaagcucuuuacuu

SEQ ID NO: 22744 - RNA, 22 nt, Human
gagccaaaugaagacucaaaac

SEQ ID NO: 22745 - RNA, 21 nt, Human
aaauacaucauucuucauaua

SEQ ID NO: 22746 - RNA, 20 nt, Human
gaaggaaaugaauuucucua

SEQ ID NO: 22747 - RNA, 22 nt, Human
ggggaauggggcaaaggggugg

SEQ ID NO: 22748 - RNA, 24 nt, Human
aagagagagcuucuguugcugccu

SEQ ID NO: 22749 - RNA, 21 nt, Human
aggggcuggcuucaggaggga

SEQ ID NO: 22750 - RNA, 22 nt, Human
aguaagcugcugaaugcauuca

SEQ ID NO: 22751 - RNA, 24 nt, Human
guccucucccaucgcccacaaaag

SEQ ID NO: 22752 - RNA, 27 nt, Human
cauuucuuuguacaucuguacauuuug

SEQ ID NO: 22753 - RNA, 22 nt, Human
ccuggaaguggagguugcagug

SEQ ID NO: 22754 - RNA, 22 nt, Human
uaguucugccaggagacagguu

SEQ ID NO: 22755 - RNA, 20 nt, Human
ugaaucuucagacaaacuuc

SEQ ID NO: 22756 - RNA, 23 nt, Human
ggcauuuggcauauuuuguggac

SEQ ID NO: 22757 - RNA, 23 nt, Human
augaacauccuuaccuucacugu

SEQ ID NO: 22758 - RNA, 22 nt, Human
ugcauucucuccagcugcaaac

SEQ ID NO: 22759 - RNA, 22 nt, Human
cccagggcccacccccaggaag

SEQ ID NO: 22760 - RNA, 21 nt, Human
cugggucugauuuucucacug

SEQ ID NO: 22761 - RNA, 23 nt, Human
ccguggagguggugucugcugug

SEQ ID NO: 22762 - RNA, 21 nt, Human
aguggccuugaacaacugguu

SEQ ID NO: 22763 - RNA, 26 nt, Human
agaggaagaagggaacugggauuugg

SEQ ID NO: 22764 - RNA, 27 nt, Human
gcggcgagcgcagccaugccccaggcc

SEQ ID NO: 22765 - RNA, 25 nt, Human
ugggcagcagggguagggguaggga

SEQ ID NO: 22766 - RNA, 28 nt, Human
gcucugccucugcagcccacugccugcc

SEQ ID NO: 22767 - RNA, 16 nt, Human
cuucccuuucgaguaa

SEQ ID NO: 22768 - RNA, 16 nt, Human
gcaguaccucuguggu

SEQ ID NO: 22769 - RNA, 20 nt, Human
ucugucuggcugaggauuuc

SEQ ID NO: 22770 - RNA, 22 nt, Human
acccagguuggagugcaguggu

SEQ ID NO: 22771 - RNA, 22 nt, Human
agugcuguuucucccacauauu

SEQ ID NO: 22772 - RNA, 23 nt, Human
aggaucagagcagaguugggagu

SEQ ID NO: 22773 - RNA, 19 nt, Human
guguacuguccugccugug

SEQ ID NO: 22774 - RNA, 20 nt, Human
uggagcucucaguggggagc

SEQ ID NO: 22775 - RNA, 19 nt, Human
acaggcaaggaggcuuuga

SEQ ID NO: 22776 - RNA, 22 nt, Human
ugagagaagcucugaacgaggg

SEQ ID NO: 22777 - RNA, 30 nt, Human
gggcgcaagggugggagggagccgcccccg

SEQ ID NO: 22778 - RNA, 21 nt, Human
cucaccuaguaugugagcagu

SEQ ID NO: 22779 - RNA, 19 nt, Human
uuacuccgccccacacccu

SEQ ID NO: 22780 - RNA, 25 nt, Human
cugcagccuccuccaccucaccucc

SEQ ID NO: 22781 - RNA, 21 nt, Human
uauuccuccuccauccuucau

SEQ ID NO: 22782 - RNA, 24 nt, Human
ccugagguuucccugcaucccugc

SEQ ID NO: 22783 - RNA, 22 nt, Human
aagcaguucagaaggaauaagc

SEQ ID NO: 22784 - RNA, 26 nt, Human
ggcuccugccuugaugaagcccgugu

SEQ ID NO: 22785 - RNA, 22 nt, Human
caagugcuggaauuacaggcgu

SEQ ID NO: 22786 - RNA, 21 nt, Human
ucucugcagccuugaccucug

SEQ ID NO: 22787 - RNA, 27 nt, Human
gcaggugccugagacacagaccccuuu

SEQ ID NO: 22788 - RNA, 22 nt, Human
aauccuguaucuuucugacugu

SEQ ID NO: 22789 - RNA, 22 nt, Human
guguugcccccuaucuccuggg

SEQ ID NO: 22790 - RNA, 23 nt, Human
aagaaagcucuauaaauauaaau

SEQ ID NO: 22791 - RNA, 23 nt, Human
agguuagaaagaggcgagcgugg

SEQ ID NO: 22792 - RNA, 27 nt, Human
aggcgucugaggccugcccacuaagga

SEQ ID NO: 22793 - RNA, 29 nt, Human
ccagagagagaaagagagcgagagagagc

SEQ ID NO: 22794 - RNA, 22 nt, Human
caaacuuguggccucaagcaau

SEQ ID NO: 22795 - RNA, 16 nt, Human
aguccuccccaccuca

SEQ ID NO: 22796 - RNA, 23 nt, Human
ggucaucugauaauuucacagau

SEQ ID NO: 22797 - RNA, 21 nt, Human
uuuccaaaucauuccuagcca

SEQ ID NO: 22798 - RNA, 21 nt, Human
agcauuuuuucaacuaaccau

SEQ ID NO: 22799 - RNA, 25 nt, Human
ucuucugccagcccauuuugaggcc

SEQ ID NO: 22800 - RNA, 25 nt, Human
gugggcuaggguggucagaggaagc

SEQ ID NO: 22801 - RNA, 22 nt, Human
aggcugagguaggagaaucacu

SEQ ID NO: 22802 - RNA, 19 nt, Human
gaagggcugguaaaaugaa

SEQ ID NO: 22803 - RNA, 27 nt, Human
aacacccuccucccagggaggguccuc

SEQ ID NO: 22804 - RNA, 23 nt, Human
uugggaggugggguuuugccaug

SEQ ID NO: 22805 - RNA, 22 nt, Human
guugcccaggcugcagugcagu

SEQ ID NO: 22806 - RNA, 25 nt, Human
cagugguuuccaaauuuggcugcac

SEQ ID NO: 22807 - RNA, 22 nt, Human
ggaggcugagaugggaggauca

SEQ ID NO: 22808 - RNA, 27 nt, Human
agguaggggcaggcaagagagaggauu

SEQ ID NO: 22809 - RNA, 22 nt, Human
gacuacaggugcaugccaccac

SEQ ID NO: 22810 - RNA, 22 nt, Human
gguccagcaaaagucaguaggg

SEQ ID NO: 22811 - RNA, 26 nt, Human
gguggaggcaacagggccaugugcug

SEQ ID NO: 22812 - RNA, 22 nt, Human
gucugcaaucccagcgauuugg

SEQ ID NO: 22813 - RNA, 22 nt, Human
acaaacuuucagagacagcaga

SEQ ID NO: 22814 - RNA, 22 nt, Human
aaucagcacacaccauauuuca

SEQ ID NO: 22815 - RNA, 23 nt, Human
ugugccuguaaucccagcuacuu

SEQ ID NO: 22816 - RNA, 27 nt, Human
ccugccuggggccucaccugcuggagu

SEQ ID NO: 22817 - RNA, 26 nt, Human
gggguuucaccguguugcccaggcug

SEQ ID NO: 22818 - RNA, 21 nt, Human
uggggucggggacagagcagu

SEQ ID NO: 22819 - RNA, 22 nt, Human
gguuuggguuugaauucugccu

SEQ ID NO: 22820 - RNA, 23 nt, Human
cacaggcugguguguagguggua

SEQ ID NO: 22821 - RNA, 19 nt, Human
ccuccuugcaccugcgccu

SEQ ID NO: 22822 - RNA, 25 nt, Human
ggggcugagcuggaggcagcgaggc

SEQ ID NO: 22823 - RNA, 21 nt, Human
cugauuauuuuaggccaguuu

SEQ ID NO: 22824 - RNA, 23 nt, Human
ucccaucuugagcucuuccugaa

SEQ ID NO: 22825 - RNA, 27 nt, Human
cgggagguggccaagguacagcccgca

SEQ ID NO: 22826 - RNA, 25 nt, Human
cuuccucuuuuccuucccaaagcaa

SEQ ID NO: 22827 - RNA, 25 nt, Human
auuucagguuugccaaguacuacag

SEQ ID NO: 22828 - RNA, 23 nt, Human
uguuuuuaagagaauguuucuua

SEQ ID NO: 22829 - RNA, 22 nt, Human
aggccaucucacuagaauagga

SEQ ID NO: 22830 - RNA, 23 nt, Human
ugaguggaccaagaucucaggau

SEQ ID NO: 22831 - RNA, 27 nt, Human
auaguaugcucugaguagcuuuacacu

SEQ ID NO: 22832 - RNA, 26 nt, Human
uaaagugccuucagccaagaccaucu

SEQ ID NO: 22833 - RNA, 22 nt, Human
ggaucauaggagcggauuuccc

SEQ ID NO: 22834 - RNA, 23 nt, Human
auaucaaaaucauguaguuugua

SEQ ID NO: 22835 - RNA, 22 nt, Human
acaugugcagaagaauaaggca

SEQ ID NO: 22836 - RNA, 20 nt, Human
uucucuuucucucucacucu

SEQ ID NO: 22837 - RNA, 26 nt, Human
ggagagggggaccugggaccugcggc

SEQ ID NO: 22838 - RNA, 26 nt, Human
ccuaccuggccccucgccuguggagc

SEQ ID NO: 22839 - RNA, 22 nt, Human
uuugucccugcuccucccaacc

SEQ ID NO: 22840 - RNA, 19 nt, Human
agugugggaccugccccca

SEQ ID NO: 22841 - RNA, 20 nt, Human
ugucugaauguuuugcagug

SEQ ID NO: 22842 - RNA, 21 nt, Human
cuuacauuccuucuucccaua

SEQ ID NO: 22843 - RNA, 26 nt, Human
guuaugugugccaggcuggcuggcag

SEQ ID NO: 22844 - RNA, 21 nt, Human
ccugccugccccacccacccc

SEQ ID NO: 22845 - RNA, 23 nt, Human
ccugugcggggcacacccccagg

SEQ ID NO: 22846 - RNA, 22 nt, Human
uuuuaacuacauugauacuuua

SEQ ID NO: 22847 - RNA, 27 nt, Human
gggaaauuaauuuguucuccuacacac

SEQ ID NO: 22848 - RNA, 21 nt, Human
ccauccccaccacccagccau

SEQ ID NO: 22849 - RNA, 24 nt, Human
ggcuuuucaaaaucauuuagucua

SEQ ID NO: 22850 - RNA, 20 nt, Human
ucugcugucacccucuacuc

SEQ ID NO: 22851 - RNA, 22 nt, Human
cacuuuccagccuauagcagaa

SEQ ID NO: 22852 - RNA, 22 nt, Human
ggagugagagcccagggacagg

SEQ ID NO: 22853 - RNA, 24 nt, Human
gggccuuugcucccacacucucau

SEQ ID NO: 22854 - RNA, 21 nt, Human
cagacaccuuuaauaucuuua

SEQ ID NO: 22855 - RNA, 22 nt, Human
auggacagaacuacauucuuuc

SEQ ID NO: 22856 - RNA, 20 nt, Human
cuuggaccccaggucuggag

SEQ ID NO: 22857 - RNA, 24 nt, Human
gcucugagagagucugagucuugc

SEQ ID NO: 22858 - RNA, 22 nt, Human
ggcccugugcuggggguggggg

SEQ ID NO: 22859 - RNA, 24 nt, Human
gagggaggggcgggggcuggaggc

SEQ ID NO: 22860 - RNA, 23 nt, Human
uccugcagcagucugccuccucu

SEQ ID NO: 22861 - RNA, 23 nt, Human
agcauuucuagaacaauuacaug

SEQ ID NO: 22862 - RNA, 20 nt, Human
cgccucgcacccccaccucu

SEQ ID NO: 22863 - RNA, 23 nt, Human
agccaguuucagauuuacucuga

SEQ ID NO: 22864 - RNA, 22 nt, Human
ccacugcauuucagccuggggg

SEQ ID NO: 22865 - RNA, 27 nt, Human
guuucuccaaccgcaaucggcuccgcu

SEQ ID NO: 22866 - RNA, 21 nt, Human
agggcugaggccgaggaugga

SEQ ID NO: 22867 - RNA, 23 nt, Human
aaggaagaggaagaccuccagca

SEQ ID NO: 22868 - RNA, 21 nt, Human
cagcccuccguccugcugaaa

SEQ ID NO: 22869 - RNA, 22 nt, Human
cggagucucagucugucaccca

SEQ ID NO: 22870 - RNA, 21 nt, Human
agcuucauuucaggcuccugu

SEQ ID NO: 22871 - RNA, 26 nt, Human
ucacagucacaugcccauucacacca

SEQ ID NO: 22872 - RNA, 27 nt, Human
gugagccagcaauaccgcugcccccug

SEQ ID NO: 22873 - RNA, 24 nt, Human
acaauggcuaaugauaauuuagcu

SEQ ID NO: 22874 - RNA, 23 nt, Human
uguuacagguuaccguugagaac

SEQ ID NO: 22875 - RNA, 20 nt, Human
ggugccuaggccugggcagu

SEQ ID NO: 22876 - RNA, 29 nt, Human
ccucucagccucugccgccgggcaccccc

SEQ ID NO: 22877 - RNA, 21 nt, Human
uccggagucauuaaccaggaa

SEQ ID NO: 22878 - RNA, 21 nt, Human
agcuugcugcuccugccucau

SEQ ID NO: 22879 - RNA, 26 nt, Human
ucccucucucugcuccuccauucgca

SEQ ID NO: 22880 - RNA, 24 nt, Human
ucccggcugaagugcaguggcacg

SEQ ID NO: 22881 - RNA, 23 nt, Human
guugcgccacugcacuccagccu

SEQ ID NO: 22882 - RNA, 20 nt, Human
accaggaggccagagcgguu

SEQ ID NO: 22883 - RNA, 20 nt, Human
ugugugacucugcugaguga

SEQ ID NO: 22884 - RNA, 22 nt, Human
ggccauucccacccccacacac

SEQ ID NO: 22885 - RNA, 20 nt, Human
ugcucuccuaccccaccuca

SEQ ID NO: 22886 - RNA, 26 nt, Human
ucuuuugaggauggcuuuguccuguu

SEQ ID NO: 22887 - RNA, 24 nt, Human
gcugcccucuccugggcauggccu

SEQ ID NO: 22888 - RNA, 19 nt, Human
uaucucuccaucccucugu

SEQ ID NO: 22889 - RNA, 27 nt, Human
acuggcaaugcuucuguccucgugucu

SEQ ID NO: 22890 - RNA, 27 nt, Human
uugcccaggcuucucaccacgguguac

SEQ ID NO: 22891 - RNA, 22 nt, Human
gggccaucaggcaccagaagga

SEQ ID NO: 22892 - RNA, 19 nt, Human
cagauuccccacucagccu

SEQ ID NO: 22893 - RNA, 26 nt, Human
gccagacccacucgcugccgggaccc

SEQ ID NO: 22894 - RNA, 27 nt, Human
uucuccuccuauucaguucccagaauc

SEQ ID NO: 22895 - RNA, 27 nt, Human
uucaguuacacauacaccuguuauaag

SEQ ID NO: 22896 - RNA, 25 nt, Human
gaccaguucugaggugaagcugggc

SEQ ID NO: 22897 - RNA, 21 nt, Human
gcucauccugaggacccaggg

SEQ ID NO: 22898 - RNA, 25 nt, Human
uucuuccggagagggugggguggag

SEQ ID NO: 22899 - RNA, 22 nt, Human
aucaugguuuucaacaagugcu

SEQ ID NO: 22900 - RNA, 21 nt, Human
aacuggcccuccugucccuca

SEQ ID NO: 22901 - RNA, 22 nt, Human
aaggaaaucuuauaaauaacac

SEQ ID NO: 22902 - RNA, 22 nt, Human
ggcaggcacuggcuggcucagc

SEQ ID NO: 22903 - RNA, 24 nt, Human
aggaaaaauagcagagauguucac

SEQ ID NO: 22904 - RNA, 20 nt, Human
agagauguuuuucccaccug

SEQ ID NO: 22905 - RNA, 22 nt, Human
uggguuaucccuguaauuccag

SEQ ID NO: 22906 - RNA, 23 nt, Human
uguugcccaggcuggagugcagu

SEQ ID NO: 22907 - RNA, 23 nt, Human
ugucgcccaggcuggaguguagu

SEQ ID NO: 22908 - RNA, 22 nt, Human
ccaacauggagaaaccccgucu

SEQ ID NO: 22909 - RNA, 25 nt, Human
aggguucuggcugccccaaccugcu

SEQ ID NO: 22910 - RNA, 27 nt, Human
uggucucaggcuugcgcuggaccuggu

SEQ ID NO: 22911 - RNA, 21 nt, Human
ucacuucagucagccaucuca

SEQ ID NO: 22912 - RNA, 22 nt, Human
cucgaggucaggaguuccagac

SEQ ID NO: 22913 - RNA, 19 nt, Human
ccagccgccccucgcccgg

SEQ ID NO: 22914 - RNA, 21 nt, Human
aagacugaaacaauugggaga

SEQ ID NO: 22915 - RNA, 18 nt, Human
guugauuucaaucggcua

SEQ ID NO: 22916 - RNA, 22 nt, Human
uggggaaugauauuuuuugaaa

SEQ ID NO: 22917 - RNA, 24 nt, Human
aucguauuauccaaauuuuguugc

SEQ ID NO: 22918 - RNA, 22 nt, Human
uacugcucacucccaaccuuuu

SEQ ID NO: 22919 - RNA, 21 nt, Human
agauuucucacuugcucuuca

SEQ ID NO: 22920 - RNA, 22 nt, Human
aggcugcaucaucccaugaaca

SEQ ID NO: 22921 - RNA, 22 nt, Human
uauacaguggggcacagaaaac

SEQ ID NO: 22922 - RNA, 20 nt, Human
aucuuaugaauaagcacuug

SEQ ID NO: 22923 - RNA, 20 nt, Human
cuuacuuccuguuccuccuc

SEQ ID NO: 22924 - RNA, 23 nt, Human
ggagggacgcggaggaggaagag

SEQ ID NO: 22925 - RNA, 26 nt, Human
gaacaacauaaaacaaauuuaauuuu

SEQ ID NO: 22926 - RNA, 21 nt, Human
aauaaagccuucaaacucccu

SEQ ID NO: 22927 - RNA, 23 nt, Human
ccggagcugauguguacugugug

SEQ ID NO: 22928 - RNA, 26 nt, Human
caguggcugggccucuguguuggcua

SEQ ID NO: 22929 - RNA, 27 nt, Human
cugggagggagggguccuccagcagaa

SEQ ID NO: 22930 - RNA, 27 nt, Human
cuaucagaaucuacauucuaaaacaga

SEQ ID NO: 22931 - RNA, 22 nt, Human
caugccccuggcugggacgugg

SEQ ID NO: 22932 - RNA, 23 nt, Human
ugcuuuuuaacagcugauacugu

SEQ ID NO: 22933 - RNA, 21 nt, Human
aaggagacggugguguggaaa

SEQ ID NO: 22934 - RNA, 24 nt, Human
ugggguggggauccuugggaagaa

SEQ ID NO: 22935 - RNA, 21 nt, Human
ucuugguuugccuuccagaaa

SEQ ID NO: 22936 - RNA, 20 nt, Human
gggcucugcguucugcucug

SEQ ID NO: 22937 - RNA, 26 nt, Human
ucugucgcucaggcuggagugcagug

SEQ ID NO: 22938 - RNA, 23 nt, Human
auuuuugaauauuccuauuacuu

SEQ ID NO: 22939 - RNA, 27 nt, Human
aaucucagugcuuuccuccuucacugu

SEQ ID NO: 22940 - RNA, 24 nt, Human
cagcaaugcccugccuugcugccu

SEQ ID NO: 22941 - RNA, 27 nt, Human
uuugcuugcugugugaauugacaagca

SEQ ID NO: 22942 - RNA, 25 nt, Human
ucaagguaagagaaaauaagcucau

SEQ ID NO: 22943 - RNA, 27 nt, Human
ugugaguggaccaagaucucaggaucc

SEQ ID NO: 22944 - RNA, 20 nt, Human
uuguucuuucuuucucuuca

SEQ ID NO: 22945 - RNA, 26 nt, Human
uucuccagugucuaccuuccuccuca

SEQ ID NO: 22946 - RNA, 30 nt, Human
ugccuguaaagcucucagcauuggcuuggc

SEQ ID NO: 22947 - RNA, 22 nt, Human
ccuucagcacaggaauucucaa

SEQ ID NO: 22948 - RNA, 26 nt, Human
gcuuuaauuucuaauugcaaagaugu

SEQ ID NO: 22949 - RNA, 29 nt, Human
ccagagcuaaaucuggaaaacacauuugg

SEQ ID NO: 22950 - RNA, 22 nt, Human
ugcuucaaggucuuuucuagcu

SEQ ID NO: 22951 - RNA, 28 nt, Human
ugcuaauuagugugaaccaaaagaguaa

SEQ ID NO: 22952 - RNA, 20 nt, Human
gugguccuccugaaagucac

SEQ ID NO: 22953 - RNA, 21 nt, Human
uuccaauauauuuuuguuuua

SEQ ID NO: 22954 - RNA, 28 nt, Human
gcuugcuuccuuccuccuggcugcacag

SEQ ID NO: 22955 - RNA, 22 nt, Human
cuugccugagcucuuccucaaa

SEQ ID NO: 22956 - RNA, 22 nt, Human
cagggggccgggacagggaggu

SEQ ID NO: 22957 - RNA, 27 nt, Human
ucuccagggacucucaggcuaaccuuu

SEQ ID NO: 22958 - RNA, 21 nt, Human
ggcugccuaagacauguaacg

SEQ ID NO: 22959 - RNA, 22 nt, Human
uggaacuccacaugcuggugca

SEQ ID NO: 22960 - RNA, 22 nt, Human
gaggaugaagcccagccugcac

SEQ ID NO: 22961 - RNA, 27 nt, Human
uagcccagcuccuguuccugugccuuc

SEQ ID NO: 22962 - RNA, 23 nt, Human
gcaggccuguucccugaggaccu

SEQ ID NO: 22963 - RNA, 21 nt, Human
cccgccggcccugccuguaga

SEQ ID NO: 22964 - RNA, 22 nt, Human
acuuggagccccagugccaagc

SEQ ID NO: 22965 - RNA, 24 nt, Human
uuuuagagugauugugaggcauuc

SEQ ID NO: 22966 - RNA, 22 nt, Human
agaaagcuugagucucaagggu

SEQ ID NO: 22967 - RNA, 22 nt, Human
ggguccuggaggugggguugau

SEQ ID NO: 22968 - RNA, 23 nt, Human
caggcucuuuccuuccugguccu

SEQ ID NO: 22969 - RNA, 20 nt, Human
gaggagcagaggacagguga

SEQ ID NO: 22970 - RNA, 21 nt, Human
aacacugucugaauuaaacaa

SEQ ID NO: 22971 - RNA, 24 nt, Human
ugguggcggcgccuguaaucccag

SEQ ID NO: 22972 - RNA, 23 nt, Human
auccugcuccccaccuccgggcg

SEQ ID NO: 22973 - RNA, 22 nt, Human
auugccugagcccaggaggugg

SEQ ID NO: 22974 - RNA, 19 nt, Human
guucuaauuuucauuagca

SEQ ID NO: 22975 - RNA, 22 nt, Human
cagacuucacagcgucugcuca

SEQ ID NO: 22976 - RNA, 24 nt, Human
cagccccucagcagagggcagcac

SEQ ID NO: 22977 - RNA, 20 nt, Human
uuucuuuuccuucauucaua

SEQ ID NO: 22978 - RNA, 21 nt, Human
ggggugcaccuguccaauagg

SEQ ID NO: 22979 - RNA, 21 nt, Human
ggagcucuggguacagggcag

SEQ ID NO: 22980 - RNA, 25 nt, Human
ggcucacugcaaccuccgacucccu

SEQ ID NO: 22981 - RNA, 27 nt, Human
ggcuaccacucuuccccagagcagcag

SEQ ID NO: 22982 - RNA, 26 nt, Human
gggggagggagagggagcuuuguguu

SEQ ID NO: 22983 - RNA, 21 nt, Human
cacccuggcuggaggaacugg

SEQ ID NO: 22984 - RNA, 23 nt, Human
cugcucacuuuccacccucucuc

SEQ ID NO: 22985 - RNA, 18 nt, Human
uggugaagccaccaagcu

SEQ ID NO: 22986 - RNA, 23 nt, Human
acccagccaaacaccacagccuu

SEQ ID NO: 22987 - RNA, 27 nt, Human
caguucuggccaggagcuggaggagca

SEQ ID NO: 22988 - RNA, 23 nt, Human
uugcccagcucuugaguacagug

SEQ ID NO: 22989 - RNA, 21 nt, Human
aauaaggggaggaagauuccc

SEQ ID NO: 22990 - RNA, 25 nt, Human
uucaacacugaaaaaauacuaccua

SEQ ID NO: 22991 - RNA, 22 nt, Human
uguguugccauuuugucuggcu

SEQ ID NO: 22992 - RNA, 22 nt, Human
caugcuccaagacuuuaguuac

SEQ ID NO: 22993 - RNA, 27 nt, Human
gucacccagacuggagugcaggggggc

SEQ ID NO: 22994 - RNA, 27 nt, Human
ggugcuguuauccauggggaagggaua

SEQ ID NO: 22995 - RNA, 24 nt, Human
ggagcuuaguccagcugguacaau

SEQ ID NO: 22996 - RNA, 22 nt, Human
gagaaggagauguaaugacaga

SEQ ID NO: 22997 - RNA, 18 nt, Human
accacagaacaggcccca

SEQ ID NO: 22998 - RNA, 18 nt, Human
gcccaguccuuugcugcu

SEQ ID NO: 22999 - RNA, 21 nt, Human
acaggcacacacuacugugcc

SEQ ID NO: 23000 - RNA, 21 nt, Human
cuuguuccuguucauucucau

SEQ ID NO: 23001 - RNA, 25 nt, Human
uuuuggagacuggagcuuucuguuc

SEQ ID NO: 23002 - RNA, 23 nt, Human
cuggggcagcccaagggcucgag

SEQ ID NO: 23003 - RNA, 23 nt, Human
cacucauuuaaauaauacaauca

SEQ ID NO: 23004 - RNA, 23 nt, Human
cuccagccuccggcucagccggc

SEQ ID NO: 23005 - RNA, 25 nt, Human
ugggggaggggcgacaguagugagc

SEQ ID NO: 23006 - RNA, 19 nt, Human
acugaucaucauaacucug

SEQ ID NO: 23007 - RNA, 26 nt, Human
gucagccugugugcguguggugcagg

SEQ ID NO: 23008 - RNA, 21 nt, Human
gggaggcagccuucauguaca

SEQ ID NO: 23009 - RNA, 21 nt, Human
guuucuugauucccacuccug

SEQ ID NO: 23010 - RNA, 20 nt, Human
acaagggccaggcuccauuc

SEQ ID NO: 23011 - RNA, 21 nt, Human
accaauaacauaaaacaaucg

SEQ ID NO: 23012 - RNA, 23 nt, Human
gccuuccaguccaaaaaucccgc

SEQ ID NO: 23013 - RNA, 28 nt, Human
uuuauucugagccugagcucagauaaua

SEQ ID NO: 23014 - RNA, 27 nt, Human
uggagagaaaggguacugaggcacucu

SEQ ID NO: 23015 - RNA, 26 nt, Human
ucauuucuauauuccuccagcuggga

SEQ ID NO: 23016 - RNA, 22 nt, Human
ccuaggagguugaggcugcagu

SEQ ID NO: 23017 - RNA, 23 nt, Human
cugucacacaaggcuugagaagc

SEQ ID NO: 23018 - RNA, 27 nt, Human
cacugcacuuagcacuuucaggcucca

SEQ ID NO: 23019 - RNA, 23 nt, Human
accaagauauuuuuaucccaaga

SEQ ID NO: 23020 - RNA, 25 nt, Human
caugcugcugagccucuauuuucuu

SEQ ID NO: 23021 - RNA, 22 nt, Human
uagaagcccuucuaccuuccug

SEQ ID NO: 23022 - RNA, 23 nt, Human
aggaggagggaggcugucaggau

SEQ ID NO: 23023 - RNA, 27 nt, Human
guccugguaugauggugugagcuuccu

SEQ ID NO: 23024 - RNA, 19 nt, Human
augggcaugaguagcuuga

SEQ ID NO: 23025 - RNA, 26 nt, Human
ccuuguuccaaauacugcuuagcauu

SEQ ID NO: 23026 - RNA, 21 nt, Human
uccagugaggcuucaguguac

SEQ ID NO: 23027 - RNA, 23 nt, Human
ucuccuuuggcugaggagagugu

SEQ ID NO: 23028 - RNA, 22 nt, Human
cgccaccuggguuccagcaauu

SEQ ID NO: 23029 - RNA, 22 nt, Human
gaccacaggcgugcaccaccau

SEQ ID NO: 23030 - RNA, 19 nt, Human
ccauauauuucacacugga

SEQ ID NO: 23031 - RNA, 22 nt, Human
auugcuugaguccaggaauuug

SEQ ID NO: 23032 - RNA, 17 nt, Human
cugcugggaaaaguucc

SEQ ID NO: 23033 - RNA, 23 nt, Human
ucauuaaaaaggaucagagacca

SEQ ID NO: 23034 - RNA, 22 nt, Human
uggggcaagcaaggagccuucc

SEQ ID NO: 23035 - RNA, 25 nt, Human
guacaagugccugggguguaaugag

SEQ ID NO: 23036 - RNA, 22 nt, Human
uucaguuacuuagauggucuca

SEQ ID NO: 23037 - RNA, 27 nt, Human
gucucaaacuccuagguucacuuuggc

SEQ ID NO: 23038 - RNA, 23 nt, Human
aaauaccacaugauuuuacucau

SEQ ID NO: 23039 - RNA, 22 nt, Human
uuuccugugaacuugugucucc

SEQ ID NO: 23040 - RNA, 22 nt, Human
aagcaagcccaucucugaguag

SEQ ID NO: 23041 - RNA, 22 nt, Human
gacccccucccccaaccccucu

SEQ ID NO: 23042 - RNA, 28 nt, Human
ucuccuccauccguaccuugccuagccu

SEQ ID NO: 23043 - RNA, 24 nt, Human
gcaaaagcagcccagucccccuca

SEQ ID NO: 23044 - RNA, 23 nt, Human
ggaggucugaaaagaggagccag

SEQ ID NO: 23045 - RNA, 21 nt, Human
ccuuuucucacgacucuuguc

SEQ ID NO: 23046 - RNA, 19 nt, Human
aacuccgccccaaaaagga

SEQ ID NO: 23047 - RNA, 22 nt, Human
uaccauucucguuuuggaggaa

SEQ ID NO: 23048 - RNA, 25 nt, Human
guuuauguuuucgaaauauauuuca

SEQ ID NO: 23049 - RNA, 20 nt, Human
uuacagaaaauauggugcug

SEQ ID NO: 23050 - RNA, 16 nt, Human
acuacccuuuucucca

SEQ ID NO: 23051 - RNA, 23 nt, Human
ccgggaagcagagguugcaguga

SEQ ID NO: 23052 - RNA, 19 nt, Human
gggaggggaaauguaauac

SEQ ID NO: 23053 - RNA, 25 nt, Human
aacaaggaaaaauggauguuucgcu

SEQ ID NO: 23054 - RNA, 23 nt, Human
gaaaugcacagaacauaucuuca

SEQ ID NO: 23055 - RNA, 27 nt, Human
gcucugucauccaggcuggagugcagu

SEQ ID NO: 23056 - RNA, 21 nt, Human
aaauguaccuucuuucacucu

SEQ ID NO: 23057 - RNA, 27 nt, Human
agcuagauuuguguccacacuaccagu

SEQ ID NO: 23058 - RNA, 26 nt, Human
ugcucuccccucuucucaagugccuu

SEQ ID NO: 23059 - RNA, 26 nt, Human
ccagcauucccuacagccuagggcag

SEQ ID NO: 23060 - RNA, 22 nt, Human
ggcccaggcuggagugcagugg

SEQ ID NO: 23061 - RNA, 26 nt, Human
uugcuuuaauguagacucauaguuga

SEQ ID NO: 23062 - RNA, 18 nt, Human
ggcuccugugugagccca

SEQ ID NO: 23063 - RNA, 24 nt, Human
ggaggagaccggcagcaacucuga

SEQ ID NO: 23064 - RNA, 21 nt, Human
cagggaggagugguacuuaag

SEQ ID NO: 23065 - RNA, 22 nt, Human
uuccagucguucuuaagccauc

SEQ ID NO: 23066 - RNA, 22 nt, Human
agacuaaugacauuuaucuuca

SEQ ID NO: 23067 - RNA, 18 nt, Human
gagauggauuaagaaugc

SEQ ID NO: 23068 - RNA, 23 nt, Human
auugguggugagauaucgcuuga

SEQ ID NO: 23069 - RNA, 24 nt, Human
uacauuguuuacuacuuuacuaau

SEQ ID NO: 23070 - RNA, 22 nt, Human
gcugccuggcgaacccuggugu

SEQ ID NO: 23071 - RNA, 26 nt, Human
gcacaauaucuucacacugugcugua

SEQ ID NO: 23072 - RNA, 22 nt, Human
agcuauacuccuaccaaagcaa

SEQ ID NO: 23073 - RNA, 26 nt, Human
uugcucugucacccaggcuggagugc

SEQ ID NO: 23074 - RNA, 22 nt, Human
gggagagagccccggcccccag

SEQ ID NO: 23075 - RNA, 25 nt, Human
uggaacuauugguucuaagauauaa

SEQ ID NO: 23076 - RNA, 20 nt, Human
aaagugugggauuaaaguac

SEQ ID NO: 23077 - RNA, 22 nt, Human
gacauguacugccucucaucua

SEQ ID NO: 23078 - RNA, 20 nt, Human
ugacccuucugucuguaaga

SEQ ID NO: 23079 - RNA, 31 nt, Human
uucuguaggguauuuuuaauuuugucagaaa

SEQ ID NO: 23080 - RNA, 22 nt, Human
accacagccauccugucccuca

SEQ ID NO: 23081 - RNA, 26 nt, Human
gcagcccgccuuggcuuucucccuca

SEQ ID NO: 23082 - RNA, 21 nt, Human
agugcagcugcccacccugcc

SEQ ID NO: 23083 - RNA, 25 nt, Human
agucuguccuggaaccaggcuugcc

SEQ ID NO: 23084 - RNA, 23 nt, Human
gcuugcucccccugccuuguccc

SEQ ID NO: 23085 - RNA, 16 nt, Human
cuucccuuuccugcug

SEQ ID NO: 23086 - RNA, 23 nt, Human
agacuccugucuuuuacccuccc

SEQ ID NO: 23087 - RNA, 27 nt, Human
uggagagaggacucaacugggacccac

SEQ ID NO: 23088 - RNA, 20 nt, Human
cuggggugaggaaacugcga

SEQ ID NO: 23089 - RNA, 21 nt, Human
ggaggcggagguugcagugag

SEQ ID NO: 23090 - RNA, 25 nt, Human
gcuagaucucucccucccuucgucu

SEQ ID NO: 23091 - RNA, 22 nt, Human
uucugaaacucccuuguguucc

SEQ ID NO: 23092 - RNA, 19 nt, Human
uugguggccugcuucccuc

SEQ ID NO: 23093 - RNA, 24 nt, Human
cacaggcacuuucaagaacuuugg

SEQ ID NO: 23094 - RNA, 22 nt, Human
uguaugugucugaccucaggcc

SEQ ID NO: 23095 - RNA, 22 nt, Human
cugaguagcugggcugacaggc

SEQ ID NO: 23096 - RNA, 22 nt, Human
ugcuggagaaaaaugaaggaaa

SEQ ID NO: 23097 - RNA, 24 nt, Human
cccucaugaacacagggauugggg

SEQ ID NO: 23098 - RNA, 22 nt, Human
cuggugccugauuggggugggg

SEQ ID NO: 23099 - RNA, 20 nt, Human
guucugcuucucuucauaua

SEQ ID NO: 23100 - RNA, 23 nt, Human
uauuuggaugcagaguucaggga

SEQ ID NO: 23101 - RNA, 21 nt, Human
ccccugcccucagcacacaca

SEQ ID NO: 23102 - RNA, 19 nt, Human
acccaaguuggagugcagu

SEQ ID NO: 23103 - RNA, 22 nt, Human
gaacagcucugagauccuggag

SEQ ID NO: 23104 - RNA, 24 nt, Human
acugcuguuuuccauuaaugagga

SEQ ID NO: 23105 - RNA, 21 nt, Human
ggcccuuuacagaaaaaguuu

SEQ ID NO: 23106 - RNA, 21 nt, Human
cggccugucacccugcuuucc

SEQ ID NO: 23107 - RNA, 22 nt, Human
cguguccggaggcaugggugag

SEQ ID NO: 23108 - RNA, 26 nt, Human
gccuauucccucuucucacuuugggg

SEQ ID NO: 23109 - RNA, 27 nt, Human
cccagcauaauuccuccaguuggauga

SEQ ID NO: 23110 - RNA, 21 nt, Human
aacugcacgugccuucuguca

SEQ ID NO: 23111 - RNA, 21 nt, Human
guccugagagagaugaagcag

SEQ ID NO: 23112 - RNA, 22 nt, Human
acauagacacacacaugaacac

SEQ ID NO: 23113 - RNA, 25 nt, Human
uguggaggugggguuuauugggaug

SEQ ID NO: 23114 - RNA, 25 nt, Human
accucucccuccucagcuccagggc

SEQ ID NO: 23115 - RNA, 27 nt, Human
gugggaggcaugggaaacagugcagug

SEQ ID NO: 23116 - RNA, 21 nt, Human
acugucuucuaugauccugcc

SEQ ID NO: 23117 - RNA, 22 nt, Human
ggcugagacacagcccagagac

SEQ ID NO: 23118 - RNA, 23 nt, Human
aaaacucaaccagagucacccag

SEQ ID NO: 23119 - RNA, 21 nt, Human
cuuggcccucuccugucugcc

SEQ ID NO: 23120 - RNA, 23 nt, Human
accacgccuggcuaauuuuuugu

SEQ ID NO: 23121 - RNA, 24 nt, Human
ccagcccaggaguuugaggcugca

SEQ ID NO: 23122 - RNA, 27 nt, Human
ugcuguugucugucuggcagggacuga

SEQ ID NO: 23123 - RNA, 23 nt, Human
ucucauguucuaugaagaacauu

SEQ ID NO: 23124 - RNA, 22 nt, Human
uccaugguccugucuguccuuc

SEQ ID NO: 23125 - RNA, 20 nt, Human
gcagggucucacucuguuga

SEQ ID NO: 23126 - RNA, 22 nt, Human
ccaaaguguugggauuacaggu

SEQ ID NO: 23127 - RNA, 25 nt, Human
uacaggcaugcaccaccacgcccag

SEQ ID NO: 23128 - RNA, 25 nt, Human
aguccacugcuccauuuauaacccc

SEQ ID NO: 23129 - RNA, 21 nt, Human
cuguguacccgggcugugugg

SEQ ID NO: 23130 - RNA, 28 nt, Human
cagagcagcagaacggguucaguuuuag

SEQ ID NO: 23131 - RNA, 24 nt, Human
cucucugccugcuuccuggaccgg

SEQ ID NO: 23132 - RNA, 22 nt, Human
ccaucaaagaugccuucaaggg

SEQ ID NO: 23133 - RNA, 26 nt, Human
aauuuauucaacuacuaaaagucuca

SEQ ID NO: 23134 - RNA, 21 nt, Human
caucaguuccagccuucucuc

SEQ ID NO: 23135 - RNA, 17 nt, Human
gacauaguggcuugcag

SEQ ID NO: 23136 - RNA, 17 nt, Human
gacgcaaaagacuugca

SEQ ID NO: 23137 - RNA, 22 nt, Human
auuccuccugcgcagggccaag

SEQ ID NO: 23138 - RNA, 20 nt, Human
cuucuuguuucuccugccca

SEQ ID NO: 23139 - RNA, 27 nt, Human
cucaaagcucugacgaucuaagauaca

SEQ ID NO: 23140 - RNA, 20 nt, Human
cacccagucuggagugcagu

SEQ ID NO: 23141 - RNA, 23 nt, Human
uaaagugcugggauuacaugagc

SEQ ID NO: 23142 - RNA, 26 nt, Human
agaggguggucgucugugcauuccag

SEQ ID NO: 23143 - RNA, 21 nt, Human
ccuggguggacauuugaagaa

SEQ ID NO: 23144 - RNA, 18 nt, Human
agccuccuccuccugcag

SEQ ID NO: 23145 - RNA, 22 nt, Human
aggggcagaggcccacauugga

SEQ ID NO: 23146 - RNA, 21 nt, Human
guuuuucugaagacagucuuu

SEQ ID NO: 23147 - RNA, 22 nt, Human
uggcucacgcauguaaucccag

SEQ ID NO: 23148 - RNA, 22 nt, Human
uguugacgucugacgucugaca

SEQ ID NO: 23149 - RNA, 25 nt, Human
cucaucgccagccuccuccuggacc

SEQ ID NO: 23150 - RNA, 24 nt, Human
gcagccugcccugccucucucaca

SEQ ID NO: 23151 - RNA, 32 nt, Human
cgguagccauggcggaggcggcggcugcagcg

SEQ ID NO: 23152 - RNA, 28 nt, Human
ggcccgggccuggcucucuagcggccgc

SEQ ID NO: 23153 - RNA, 23 nt, Human
cugggacucuacacccaucuuaa

SEQ ID NO: 23154 - RNA, 26 nt, Human
cagcaguucugcagaggacgggaggc

SEQ ID NO: 23155 - RNA, 25 nt, Human
cagugguguuuuauguuacuuuauu

SEQ ID NO: 23156 - RNA, 24 nt, Human
cucuggacuggagaauaaugaaga

SEQ ID NO: 23157 - RNA, 22 nt, Human
uuaaaaugucgggagccucagu

SEQ ID NO: 23158 - RNA, 22 nt, Human
gcauuugagacugaauuucuaa

SEQ ID NO: 23159 - RNA, 25 nt, Human
caggcaccugugaucccagcuacuu

SEQ ID NO: 23160 - RNA, 24 nt, Human
ugggcacagagggguccacucucc

SEQ ID NO: 23161 - RNA, 23 nt, Human
uaucucagccauaggugcaguuu

SEQ ID NO: 23162 - RNA, 20 nt, Human
ccucuaaccagcauucccag

SEQ ID NO: 23163 - RNA, 26 nt, Human
agcaaaccacgcagguccuucuugau

SEQ ID NO: 23164 - RNA, 25 nt, Human
ggaguucgagagcagccugggcaac

SEQ ID NO: 23165 - RNA, 22 nt, Human
cuuugcagauggccagugucac

SEQ ID NO: 23166 - RNA, 22 nt, Human
ggccgcgcgcgcuccacacaac

SEQ ID NO: 23167 - RNA, 22 nt, Human
guagcaagaccucaauucuucc

SEQ ID NO: 23168 - RNA, 21 nt, Human
gcccaggcuggagugcagggg

SEQ ID NO: 23169 - RNA, 21 nt, Human
gucaaaguaucucaaaccuga

SEQ ID NO: 23170 - RNA, 22 nt, Human
uacccuuuaagauauccaucuu

SEQ ID NO: 23171 - RNA, 24 nt, Human
uuuucucuaccuuucuuccuuguu

SEQ ID NO: 23172 - RNA, 32 nt, Human
aggugccguggagcagcaggcuggcuuuggua

SEQ ID NO: 23173 - RNA, 20 nt, Human
aaguugagaagagaaccccu

SEQ ID NO: 23174 - RNA, 22 nt, Human
agcauuuuuauaaacccacuca

SEQ ID NO: 23175 - RNA, 22 nt, Human
auaaugcaauaaauagaaaaau

SEQ ID NO: 23176 - RNA, 27 nt, Human
gcuuuuaaacuggagaggcuaaccuca

SEQ ID NO: 23177 - RNA, 23 nt, Human
gccugucaguuuaugauauugug

SEQ ID NO: 23178 - RNA, 25 nt, Human
gucacccaggcuggaguacacuggc

SEQ ID NO: 23179 - RNA, 24 nt, Human
uuguuauauuucccaaaaacgucu

SEQ ID NO: 23180 - RNA, 27 nt, Human
ggcugaccgugucucucuaguugaacc

SEQ ID NO: 23181 - RNA, 20 nt, Human
ucauuuaucuuaaagaaaga

SEQ ID NO: 23182 - RNA, 23 nt, Human
gagcccagggagcgcagcauccg

SEQ ID NO: 23183 - RNA, 24 nt, Human
ugaguauggguuagaaaucauuga

SEQ ID NO: 23184 - RNA, 24 nt, Human
ggcucguccugcggugcccgagaa

SEQ ID NO: 23185 - RNA, 24 nt, Human
gcccaccgucccuguccaugcccc

SEQ ID NO: 23186 - RNA, 21 nt, Human
uaaacuauaggagaaagaagu

SEQ ID NO: 23187 - RNA, 23 nt, Human
aaauguccuuucucagaggggcc

SEQ ID NO: 23188 - RNA, 21 nt, Human
cuacagcaacagccagaggug

SEQ ID NO: 23189 - RNA, 17 nt, Human
cagcuugaaaccuucac

SEQ ID NO: 23190 - RNA, 23 nt, Human
acaguagguguuaaaaacucaua

SEQ ID NO: 23191 - RNA, 24 nt, Human
uauauuuucuuucucuuccuccuu

SEQ ID NO: 23192 - RNA, 20 nt, Human
ugaugccaccuccaagcuug

SEQ ID NO: 23193 - RNA, 23 nt, Human
gcucacugccagcugcggccugg

SEQ ID NO: 23194 - RNA, 27 nt, Human
ccugaccucaucguccaccugccucgg

SEQ ID NO: 23195 - RNA, 23 nt, Human
acccugugaagccccuucccucc

SEQ ID NO: 23196 - RNA, 21 nt, Human
ccgguguccuguuccugccac

SEQ ID NO: 23197 - RNA, 18 nt, Human
cggcagccacacacagcc

SEQ ID NO: 23198 - RNA, 27 nt, Human
gaggaugaaguaauguguguucuugua

SEQ ID NO: 23199 - RNA, 24 nt, Human
cauuaaauguaaccuuuugcuuuc

SEQ ID NO: 23200 - RNA, 19 nt, Human
auguuuucacacauauuca

SEQ ID NO: 23201 - RNA, 22 nt, Human
ggagaggggccucaaaugcacc

SEQ ID NO: 23202 - RNA, 25 nt, Human
agacagagaaccugcccacagcucu

SEQ ID NO: 23203 - RNA, 21 nt, Human
gaggugcaggaauggaagaac

SEQ ID NO: 23204 - RNA, 21 nt, Human
ggugagcuggcgggggccggg

SEQ ID NO: 23205 - RNA, 27 nt, Human
gugccuugcagagagaggaguagcuug

SEQ ID NO: 23206 - RNA, 23 nt, Human
cuccgcguuguucauggcugagg

SEQ ID NO: 23207 - RNA, 27 nt, Human
uggccagagcucuaccucuuugccucc

SEQ ID NO: 23208 - RNA, 27 nt, Human
gacacagccagccccuuccugcugcca

SEQ ID NO: 23209 - RNA, 20 nt, Human
ucucuguagcuuccucuuca

SEQ ID NO: 23210 - RNA, 22 nt, Human
cuggaaccucuccugaggggga

SEQ ID NO: 23211 - RNA, 22 nt, Human
cugagccucacagcagugagac

SEQ ID NO: 23212 - RNA, 23 nt, Human
acaaguauuuuaacucucagucc

SEQ ID NO: 23213 - RNA, 22 nt, Human
aaaaauaagaaaaauuagcugg

SEQ ID NO: 23214 - RNA, 17 nt, Human
ggucagaaaggaaagaa

SEQ ID NO: 23215 - RNA, 22 nt, Human
gaccuucugaacaugaguguca

SEQ ID NO: 23216 - RNA, 26 nt, Human
cauuacccuauuuuauuucuccauca

SEQ ID NO: 23217 - RNA, 20 nt, Human
cuuaggccuuccucucucca

SEQ ID NO: 23218 - RNA, 22 nt, Human
auagcaaacauuucuaacucua

SEQ ID NO: 23219 - RNA, 19 nt, Human
ggccucuggagcugggauu

SEQ ID NO: 23220 - RNA, 27 nt, Human
gugccuggaccaucgcugccugccagc

SEQ ID NO: 23221 - RNA, 20 nt, Human
acugucucccccuugucacc

SEQ ID NO: 23222 - RNA, 21 nt, Human
cuucucccucccuugccucag

SEQ ID NO: 23223 - RNA, 21 nt, Human
ugaucucaacaagagcuguau

SEQ ID NO: 23224 - RNA, 27 nt, Human
cgcauuguacacuaucuaucugccuuu

SEQ ID NO: 23225 - RNA, 23 nt, Human
uuucucucuuagguaccaccuca

SEQ ID NO: 23226 - RNA, 22 nt, Human
uggggaggggcauguacuucuu

SEQ ID NO: 23227 - RNA, 27 nt, Human
cccucauuucucucugcaaucugcaaa

SEQ ID NO: 23228 - RNA, 22 nt, Human
acuuguaaucccagcaauuugg

SEQ ID NO: 23229 - RNA, 22 nt, Human
cccuguaaucucagcacuuugg

SEQ ID NO: 23230 - RNA, 23 nt, Human
ugugaugcagaauuaugcacuga

SEQ ID NO: 23231 - RNA, 24 nt, Human
uucagaucuuccuuccucccaagu

SEQ ID NO: 23232 - RNA, 22 nt, Human
ggaaggugugugcacagagggu

SEQ ID NO: 23233 - RNA, 21 nt, Human
ccucuuccuccuccccugcca

SEQ ID NO: 23234 - RNA, 20 nt, Human
cgcuagauacaugcuuuuua

SEQ ID NO: 23235 - RNA, 22 nt, Human
gcugggguuacaggugugagcc

SEQ ID NO: 23236 - RNA, 21 nt, Human
agccauuugcagugcuggugu

SEQ ID NO: 23237 - RNA, 20 nt, Human
ggcucuucugcugaccucag

SEQ ID NO: 23238 - RNA, 25 nt, Human
cacucuucagccucuguuugaccau

SEQ ID NO: 23239 - RNA, 23 nt, Human
ugccaggcugggguguuuucggu

SEQ ID NO: 23240 - RNA, 21 nt, Human
uuuaggaaaccauuucauucu

SEQ ID NO: 23241 - RNA, 24 nt, Human
caucuaccugccaggccucaggcc

SEQ ID NO: 23242 - RNA, 24 nt, Human
gccugagccaagcucaucuucauu

SEQ ID NO: 23243 - RNA, 23 nt, Human
cucuaaaacaugaacuuuuccua

SEQ ID NO: 23244 - RNA, 26 nt, Human
ccugcacuccagccugggcuucagag

SEQ ID NO: 23245 - RNA, 19 nt, Human
agaguauuuuaagaagaca

SEQ ID NO: 23246 - RNA, 23 nt, Human
cccuuuaggaagccuccgcucuc

SEQ ID NO: 23247 - RNA, 24 nt, Human
cggucuggaggcguaguuuugaaa

SEQ ID NO: 23248 - RNA, 25 nt, Human
cucugugucugcucucauccauucc

SEQ ID NO: 23249 - RNA, 20 nt, Human
gaucuuggguucuucacugc

SEQ ID NO: 23250 - RNA, 23 nt, Human
cagauuaaauuacagcuuuuaug

SEQ ID NO: 23251 - RNA, 22 nt, Human
ucacugagacagccacuugguu

SEQ ID NO: 23252 - RNA, 24 nt, Human
cucaugaagaccaaucucuugaau

SEQ ID NO: 23253 - RNA, 25 nt, Human
uggauucuuugagagccaggguaga

SEQ ID NO: 23254 - RNA, 23 nt, Human
aggcuggagugcaguggugagau

SEQ ID NO: 23255 - RNA, 22 nt, Human
agcucccuccgcggucggauuc

SEQ ID NO: 23256 - RNA, 27 nt, Human
caugccuuacgaaccaugccuuccuca

SEQ ID NO: 23257 - RNA, 27 nt, Human
ucccuccagagacucgaguccccauga

SEQ ID NO: 23258 - RNA, 26 nt, Human
ucugcugcaggccuccucccugcugc

SEQ ID NO: 23259 - RNA, 22 nt, Human
uuucaugucaaaggaaaucagc

SEQ ID NO: 23260 - RNA, 22 nt, Human
uuauauuuacaccagcuuuuca

SEQ ID NO: 23261 - RNA, 22 nt, Human
uuccuuucauccauucuuuuua

SEQ ID NO: 23262 - RNA, 22 nt, Human
cagauguuuuucauccauuccu

SEQ ID NO: 23263 - RNA, 21 nt, Human
guuacccaggguggagugcag

SEQ ID NO: 23264 - RNA, 22 nt, Human
caaggaaagcggaccacaaaag

SEQ ID NO: 23265 - RNA, 21 nt, Human
ccaugucucccccacccugcc

SEQ ID NO: 23266 - RNA, 22 nt, Human
ugauggugcuucuauuuuuucu

SEQ ID NO: 23267 - RNA, 23 nt, Human
caugcaccuuauauuucugugua

SEQ ID NO: 23268 - RNA, 22 nt, Human
uacacuauuuauaaauacguau

SEQ ID NO: 23269 - RNA, 23 nt, Human
aaaaacacaagaaggcauuuugc

SEQ ID NO: 23270 - RNA, 24 nt, Human
gccacucagucugacagcuugcga

SEQ ID NO: 23271 - RNA, 21 nt, Human
gcaagcuccgccuccuggguu

SEQ ID NO: 23272 - RNA, 22 nt, Human
aucacuugaacccgggaggugg

SEQ ID NO: 23273 - RNA, 25 nt, Human
ggucuauaugcugggugcugagaca

SEQ ID NO: 23274 - RNA, 26 nt, Human
ugggcaaaugccagacccaggguuag

SEQ ID NO: 23275 - RNA, 23 nt, Human
uaaagcagccaggaaggacaggc

SEQ ID NO: 23276 - RNA, 30 nt, Human
gcauuacuggccuuuucacugacaaguuac

SEQ ID NO: 23277 - RNA, 19 nt, Human
gaucuagauccugcuuuca

SEQ ID NO: 23278 - RNA, 25 nt, Human
ugaaacacaguaaaaccaacugggu

SEQ ID NO: 23279 - RNA, 21 nt, Human
cuccuaguucuucaucccacu

SEQ ID NO: 23280 - RNA, 19 nt, Human
cacuccugcucuuucucca

SEQ ID NO: 23281 - RNA, 22 nt, Human
ggcaaagcggagccaaaauaac

SEQ ID NO: 23282 - RNA, 19 nt, Human
ccaccuccaccaccuccgc

SEQ ID NO: 23283 - RNA, 23 nt, Human
cucagcauuccucaaaaagacca

SEQ ID NO: 23284 - RNA, 31 nt, Human
uuggugaugcaugaaacaaaauagcaagaga

SEQ ID NO: 23285 - RNA, 23 nt, Human
gcugauguuaucagaaaaauccu

SEQ ID NO: 23286 - RNA, 20 nt, Human
aggccccaagcccacugggg

SEQ ID NO: 23287 - RNA, 25 nt, Human
ccagcacuccugggucucggggucg

SEQ ID NO: 23288 - RNA, 19 nt, Human
uguaaccucaaagugccuu

SEQ ID NO: 23289 - RNA, 27 nt, Human
ggccuuagccaugaucugcaggggucu

SEQ ID NO: 23290 - RNA, 23 nt, Human
agagaggccccugugacgcccgg

SEQ ID NO: 23291 - RNA, 26 nt, Human
acugcccagccccugccuggcugccc

SEQ ID NO: 23292 - RNA, 20 nt, Human
ggggaagagaauacauggga

SEQ ID NO: 23293 - RNA, 22 nt, Human
cuuuuuuggccaucugcuccug

SEQ ID NO: 23294 - RNA, 20 nt, Human
cuggcagagacaggagaggu

SEQ ID NO: 23295 - RNA, 21 nt, Human
uccagcucucccuaaucgacu

SEQ ID NO: 23296 - RNA, 19 nt, Human
uuguccuccuccuccuggc

SEQ ID NO: 23297 - RNA, 23 nt, Human
uggugggacacugggcagcaagg

SEQ ID NO: 23298 - RNA, 23 nt, Human
auugcccagggauuaggagcagc

SEQ ID NO: 23299 - RNA, 27 nt, Human
uugcuggcagaguccucuuguacuuca

SEQ ID NO: 23300 - RNA, 24 nt, Human
ugguauaacaggcuuaauaaauuc

SEQ ID NO: 23301 - RNA, 23 nt, Human
augcuugucuccauauauacuau

SEQ ID NO: 23302 - RNA, 16 nt, Human
agcaggaccagagggg

SEQ ID NO: 23303 - RNA, 18 nt, Human
cucauuucaauuucuuua

SEQ ID NO: 23304 - RNA, 26 nt, Human
uuucugcugggauccuugggcccauc

SEQ ID NO: 23305 - RNA, 22 nt, Human
gcgccccuuguccuccuucguu

SEQ ID NO: 23306 - RNA, 26 nt, Human
cuuggggcuuccuaacugcuacaaau

SEQ ID NO: 23307 - RNA, 24 nt, Human
gcuuucuagaaaacagcauuucau

SEQ ID NO: 23308 - RNA, 28 nt, Human
uugccccacucugccugccugcuguugg

SEQ ID NO: 23309 - RNA, 25 nt, Human
ugcuccuguggccuuccacagcaga

SEQ ID NO: 23310 - RNA, 23 nt, Human
uguuuggccucuucccucccaaa

SEQ ID NO: 23311 - RNA, 22 nt, Human
acuugcccaucuagcacuuugg

SEQ ID NO: 23312 - RNA, 20 nt, Human
agguaacucccucccuagcu

SEQ ID NO: 23313 - RNA, 21 nt, Human
uaacaauuuuagaugauucag

SEQ ID NO: 23314 - RNA, 27 nt, Human
gagagugagcgggucugggcggcugcu

SEQ ID NO: 23315 - RNA, 24 nt, Human
gccucucuuuuauuguaaugugcu

SEQ ID NO: 23316 - RNA, 21 nt, Human
uggccaggcuggagugcagua

SEQ ID NO: 23317 - RNA, 22 nt, Human
cgcgaaggcaggcguucaagga

SEQ ID NO: 23318 - RNA, 19 nt, Human
uauccuuuucuaacacugu

SEQ ID NO: 23319 - RNA, 28 nt, Human
agagucaacauggaucauuucacaguga

SEQ ID NO: 23320 - RNA, 22 nt, Human
auccuccuuucaguucguuggu

SEQ ID NO: 23321 - RNA, 23 nt, Human
agaauagcugggauuacaggcgu

SEQ ID NO: 23322 - RNA, 23 nt, Human
uggaucauggcugacuuccucac

SEQ ID NO: 23323 - RNA, 26 nt, Human
cggguugugagggguuguugcaauga

SEQ ID NO: 23324 - RNA, 18 nt, Human
ggguaguuguuuuacaau

SEQ ID NO: 23325 - RNA, 17 nt, Human
ucuucuccuccucucca

SEQ ID NO: 23326 - RNA, 19 nt, Human
cccaggcuagagugcagug

SEQ ID NO: 23327 - RNA, 26 nt, Human
gcgcacacacagauaugcacacacau

SEQ ID NO: 23328 - RNA, 18 nt, Human
ugccccggagggcggaga

SEQ ID NO: 23329 - RNA, 21 nt, Human
uuucugcccuuuuccucucca

SEQ ID NO: 23330 - RNA, 27 nt, Human
auaacaagccaaacauucuuauuuuag

SEQ ID NO: 23331 - RNA, 27 nt, Human
acaggcccuauucucucagcccucggc

SEQ ID NO: 23332 - RNA, 22 nt, Human
cugucacugaaaacuuggugaa

SEQ ID NO: 23333 - RNA, 27 nt, Human
gcuggcuacaacugcuccauccgugcc

SEQ ID NO: 23334 - RNA, 20 nt, Human
cccagcauguagaucaugug

SEQ ID NO: 23335 - RNA, 22 nt, Human
ccugucuccagcugccugggcc

SEQ ID NO: 23336 - RNA, 22 nt, Human
aaagugcugggauuacagguac

SEQ ID NO: 23337 - RNA, 19 nt, Human
uauacauguacacauacac

SEQ ID NO: 23338 - RNA, 22 nt, Human
ggaagugaccugcugugacacu

SEQ ID NO: 23339 - RNA, 25 nt, Human
gcugacucugcugccccaaccuuuc

SEQ ID NO: 23340 - RNA, 20 nt, Human
cauucucugcccacucuggg

SEQ ID NO: 23341 - RNA, 22 nt, Human
ugcccaggacugggcccagaua

SEQ ID NO: 23342 - RNA, 21 nt, Human
ucagcauuuguucuuugccag

SEQ ID NO: 23343 - RNA, 19 nt, Human
aagaaaaauauuaaaaaag

SEQ ID NO: 23344 - RNA, 20 nt, Human
augccugacuggaagcccga

SEQ ID NO: 23345 - RNA, 26 nt, Human
gggaaaggcagaaugauaucacagca

SEQ ID NO: 23346 - RNA, 21 nt, Human
ccucugaggagaaaagcccau

SEQ ID NO: 23347 - RNA, 21 nt, Human
accggccucagcuccaacaca

SEQ ID NO: 23348 - RNA, 27 nt, Human
ggcucacugccuccugcccuucucucc

SEQ ID NO: 23349 - RNA, 20 nt, Human
cauuacucaaaagcaaaaga

SEQ ID NO: 23350 - RNA, 27 nt, Human
cugggccagaccagacaugccugcugc

SEQ ID NO: 23351 - RNA, 22 nt, Human
cuucaaaaacuguuuuggguag

SEQ ID NO: 23352 - RNA, 22 nt, Human
gugcaaccccguuggugcucug

SEQ ID NO: 23353 - RNA, 26 nt, Human
gugggugggauggggacauuugaaca

SEQ ID NO: 23354 - RNA, 22 nt, Human
accuaugcccaaagaacaaaua

SEQ ID NO: 23355 - RNA, 19 nt, Human
cacuuucccuucauccugc

SEQ ID NO: 23356 - RNA, 20 nt, Human
augcuccugcuccucuuguu

SEQ ID NO: 23357 - RNA, 21 nt, Human
agcugagacacuucuguauuu

SEQ ID NO: 23358 - RNA, 26 nt, Human
acuggccauuaucuuguaugugcaca

SEQ ID NO: 23359 - RNA, 21 nt, Human
auacuuuuuauugagcacuuu

SEQ ID NO: 23360 - RNA, 26 nt, Human
gcuuuauauucuuaaaauggcaaaaa

SEQ ID NO: 23361 - RNA, 23 nt, Human
uugggaggggcaggagguggggu

SEQ ID NO: 23362 - RNA, 27 nt, Human
auccucuccacgccgcugccgcugccg

SEQ ID NO: 23363 - RNA, 22 nt, Human
ggacagggcuggaaccugggag

SEQ ID NO: 23364 - RNA, 20 nt, Human
gcuaagcuggcuauggugac

SEQ ID NO: 23365 - RNA, 21 nt, Human
cuucugacugcugauucuccc

SEQ ID NO: 23366 - RNA, 22 nt, Human
auuccugagcacauggcugugu

SEQ ID NO: 23367 - RNA, 20 nt, Human
ugggugucugaaaccucaga

SEQ ID NO: 23368 - RNA, 25 nt, Human
accuucaauccaugaccauccucgc

SEQ ID NO: 23369 - RNA, 23 nt, Human
gggaggaccagggcagggccagg

SEQ ID NO: 23370 - RNA, 22 nt, Human
acacaggcuggagugcaguggu

SEQ ID NO: 23371 - RNA, 21 nt, Human
gcagugcuucucuacagacuu

SEQ ID NO: 23372 - RNA, 17 nt, Human
cacaggugcagcuucga

SEQ ID NO: 23373 - RNA, 24 nt, Human
gggcgacguggcgugggggcaggg

SEQ ID NO: 23374 - RNA, 27 nt, Human
gggagagacuaaaggagcucuggggcu

SEQ ID NO: 23375 - RNA, 27 nt, Human
accagccugggcaacauagcaagaccc

SEQ ID NO: 23376 - RNA, 22 nt, Human
cugaggcaggagaauagccuga

SEQ ID NO: 23377 - RNA, 21 nt, Human
auuucuauugaauuacaacag

SEQ ID NO: 23378 - RNA, 22 nt, Human
gucuagugccccuauuauuaac

SEQ ID NO: 23379 - RNA, 22 nt, Human
ggcugguccuccuucugcuuuu

SEQ ID NO: 23380 - RNA, 26 nt, Human
gcuguacaacuuaauuguuuuaaaaa

SEQ ID NO: 23381 - RNA, 20 nt, Human
uggauugcagcauucugcuc

SEQ ID NO: 23382 - RNA, 22 nt, Human
gccgccucccccucccagaccc

SEQ ID NO: 23383 - RNA, 27 nt, Human
ugaccaacauggggauaccccgucucu

SEQ ID NO: 23384 - RNA, 22 nt, Human
auggcucugcugggaguugugu

SEQ ID NO: 23385 - RNA, 26 nt, Human
ugucugugucuucuccuuaaacacuc

SEQ ID NO: 23386 - RNA, 23 nt, Human
ccugcucccaccaccagugagac

SEQ ID NO: 23387 - RNA, 21 nt, Human
ugaagagaagcaauuuugggg

SEQ ID NO: 23388 - RNA, 17 nt, Human
uucacauucauacauuu

SEQ ID NO: 23389 - RNA, 24 nt, Human
ccggucccagccugggcuccucug

SEQ ID NO: 23390 - RNA, 22 nt, Human
ugggagguggagcuugcaguga

SEQ ID NO: 23391 - RNA, 24 nt, Human
cacccagguugcugucggcaggcu

SEQ ID NO: 23392 - RNA, 22 nt, Human
agggucagggaacuagauuuua

SEQ ID NO: 23393 - RNA, 21 nt, Human
augaauaaguuaaauacaugc

SEQ ID NO: 23394 - RNA, 26 nt, Human
cccaaguagcugggagccugggcaug

SEQ ID NO: 23395 - RNA, 25 nt, Human
agaaaacaacuccaguucucugccu

SEQ ID NO: 23396 - RNA, 23 nt, Human
ucggcucgaggccucucugugag

SEQ ID NO: 23397 - RNA, 21 nt, Human
uguuuaaucuucucgauguag

SEQ ID NO: 23398 - RNA, 27 nt, Human
uucccauugccucucccccuuuccucg

SEQ ID NO: 23399 - RNA, 22 nt, Human
aggcugagagcugggcacaggc

SEQ ID NO: 23400 - RNA, 20 nt, Human
aaagggagcuuggugagagc

SEQ ID NO: 23401 - RNA, 23 nt, Human
ccccaaaccccugcaucccugua

SEQ ID NO: 23402 - RNA, 25 nt, Human
caaaucaacgggaaacagcccaggg

SEQ ID NO: 23403 - RNA, 21 nt, Human
guguuggugagauuaagggaa

SEQ ID NO: 23404 - RNA, 22 nt, Human
gugaucugcaaccucugccccc

SEQ ID NO: 23405 - RNA, 20 nt, Human
ccuccugcaaccucucaccc

SEQ ID NO: 23406 - RNA, 25 nt, Human
gauaacuacauuaccuguucuugcc

SEQ ID NO: 23407 - RNA, 22 nt, Human
aacugauuucaaaaguacuaca

SEQ ID NO: 23408 - RNA, 23 nt, Human
cuccugagcugccuucccgccug

SEQ ID NO: 23409 - RNA, 22 nt, Human
gaggggcccugaccacugugag

SEQ ID NO: 23410 - RNA, 27 nt, Human
ggucucgaauuccuggacucaagcagu

SEQ ID NO: 23411 - RNA, 23 nt, Human
agagaauaauuuacaaaaaucaa

SEQ ID NO: 23412 - RNA, 26 nt, Human
cuucuuuccauuucucucuccagucu

SEQ ID NO: 23413 - RNA, 25 nt, Human
ggagggaagccaggggauuuugaag

SEQ ID NO: 23414 - RNA, 21 nt, Human
agauguucuucccuggguguu

SEQ ID NO: 23415 - RNA, 22 nt, Human
caccuugaguuaggcugagcca

SEQ ID NO: 23416 - RNA, 24 nt, Human
agguuucagggauuggcagagggg

SEQ ID NO: 23417 - RNA, 22 nt, Human
gaccaaaggacgaaugagggag

SEQ ID NO: 23418 - RNA, 20 nt, Human
ccagaacugagcccagugag

SEQ ID NO: 23419 - RNA, 22 nt, Human
gcaccauagaagaacagcagau

SEQ ID NO: 23420 - RNA, 27 nt, Human
ugaguuagacuauuucccacauguucu

SEQ ID NO: 23421 - RNA, 23 nt, Human
uucuucuucuuggaaauaguccu

SEQ ID NO: 23422 - RNA, 19 nt, Human
uucauucuuacuaguuuca

SEQ ID NO: 23423 - RNA, 23 nt, Human
cccaccccucccucuguccacca

SEQ ID NO: 23424 - RNA, 22 nt, Human
ucaacgacuucuuccucgacau

SEQ ID NO: 23425 - RNA, 22 nt, Human
cuaaguuuuaggccaaaaugag

SEQ ID NO: 23426 - RNA, 22 nt, Human
ccucccauccuuccugccuccu

SEQ ID NO: 23427 - RNA, 27 nt, Human
gaguagcugggauuacaggcuccugcc

SEQ ID NO: 23428 - RNA, 21 nt, Human
ccggacacggcuucacugacc

SEQ ID NO: 23429 - RNA, 27 nt, Human
ucugaucuauuuuuccucaucuguaaa

SEQ ID NO: 23430 - RNA, 25 nt, Human
gacacaaaauauuggaagaguggca

SEQ ID NO: 23431 - RNA, 22 nt, Human
ccaaaguguugggauuacaggc

SEQ ID NO: 23432 - RNA, 22 nt, Human
cgcugcuacggcggccuagcaa

SEQ ID NO: 23433 - RNA, 28 nt, Human
gcggguguaucccucacagcaccucacg

SEQ ID NO: 23434 - RNA, 17 nt, Human
ccuuuguuuugcacuga

SEQ ID NO: 23435 - RNA, 15 nt, Human
gcauccuuaccucca

SEQ ID NO: 23436 - RNA, 27 nt, Human
cccuccaguaugggcccuggcuguggc

SEQ ID NO: 23437 - RNA, 27 nt, Human
gguauuuuuaaauuguuuuuaauccuu

SEQ ID NO: 23438 - RNA, 28 nt, Human
ccaggucccaggggagagguuggggcug

SEQ ID NO: 23439 - RNA, 27 nt, Human
aagaaaagaggugguucucugcaguga

SEQ ID NO: 23440 - RNA, 22 nt, Human
auugacaccuccaguccggcca

SEQ ID NO: 23441 - RNA, 19 nt, Human
uuugaacagcuugcugcua

SEQ ID NO: 23442 - RNA, 25 nt, Human
caaugcauuuuuugaaaaagaaaga

SEQ ID NO: 23443 - RNA, 22 nt, Human
ccaacauggggauaccccgucu

SEQ ID NO: 23444 - RNA, 28 nt, Human
uuuguugcuucucuuugcuauucuuuca

SEQ ID NO: 23445 - RNA, 26 nt, Human
ucaccuaggugagcgcauugagccag

SEQ ID NO: 23446 - RNA, 19 nt, Human
caguuuguuuccuggaaac

SEQ ID NO: 23447 - RNA, 21 nt, Human
cccagccagcugcacugcagg

SEQ ID NO: 23448 - RNA, 21 nt, Human
ggaugccaaccagagaagcug

SEQ ID NO: 23449 - RNA, 27 nt, Human
ccgugacaacaggccaccacauaccuc

SEQ ID NO: 23450 - RNA, 21 nt, Human
uugauauuucagaauguguua

SEQ ID NO: 23451 - RNA, 26 nt, Human
guggaaauaaagagaacugagaugga

SEQ ID NO: 23452 - RNA, 23 nt, Human
gcaaccccaaaccacauuagaag

SEQ ID NO: 23453 - RNA, 21 nt, Human
uugucacccaggcuggagugc

SEQ ID NO: 23454 - RNA, 19 nt, Human
ccauaacaacagcugcuca

SEQ ID NO: 23455 - RNA, 26 nt, Human
gggaaccauggugucaauacauauca

SEQ ID NO: 23456 - RNA, 23 nt, Human
acauuucuaucuggacaguguga

SEQ ID NO: 23457 - RNA, 19 nt, Human
uucucucucacugccauca

SEQ ID NO: 23458 - RNA, 22 nt, Human
uggcucacaccuacgaucacag

SEQ ID NO: 23459 - RNA, 24 nt, Human
uugagucuaacacaccacuuucug

SEQ ID NO: 23460 - RNA, 27 nt, Human
gggcuucugaguuucauuuccagucac

SEQ ID NO: 23461 - RNA, 21 nt, Human
acguauguuuuccuacuucuc

SEQ ID NO: 23462 - RNA, 21 nt, Human
agcauucccacgucaccagag

SEQ ID NO: 23463 - RNA, 20 nt, Human
ggaguggccugugccuccca

SEQ ID NO: 23464 - RNA, 26 nt, Human
gugaagccuugagggcuggcagaagg

SEQ ID NO: 23465 - RNA, 19 nt, Human
cugcagccucagcuccagc

SEQ ID NO: 23466 - RNA, 24 nt, Human
ucucuagcuaaugugugguuucuc

SEQ ID NO: 23467 - RNA, 25 nt, Human
ggugcuggugccuugggaccugggg

SEQ ID NO: 23468 - RNA, 27 nt, Human
uuaucuguuuuucuggugagggucaaa

SEQ ID NO: 23469 - RNA, 20 nt, Human
uacuuaagcagagggagaga

SEQ ID NO: 23470 - RNA, 23 nt, Human
ccugcagccuccuccaccucacc

SEQ ID NO: 23471 - RNA, 22 nt, Human
uccucauaaaacucaguacuau

SEQ ID NO: 23472 - RNA, 21 nt, Human
cucugcccuccuccagcccgg

SEQ ID NO: 23473 - RNA, 20 nt, Human
ucuguugacccccaccuucc

SEQ ID NO: 23474 - RNA, 21 nt, Human
uuuccaaauaaugcacauuua

SEQ ID NO: 23475 - RNA, 24 nt, Human
ggcagagucuucuuugugccugag

SEQ ID NO: 23476 - RNA, 21 nt, Human
ggucucaauccauugcgccca

SEQ ID NO: 23477 - RNA, 23 nt, Human
agcaggaguaggccuccugcuuu

SEQ ID NO: 23478 - RNA, 23 nt, Human
ggauggccaagggugggugguag

SEQ ID NO: 23479 - RNA, 22 nt, Human
ggcuucaggcugggggcagugg

SEQ ID NO: 23480 - RNA, 26 nt, Human
agagugagcuuggcagggccaggcgg

SEQ ID NO: 23481 - RNA, 22 nt, Human
cuguugaaaugcucaagacuua

SEQ ID NO: 23482 - RNA, 21 nt, Human
agcucacugcaaccucugccu

SEQ ID NO: 23483 - RNA, 21 nt, Human
ggcucacuacaaccucugccu

SEQ ID NO: 23484 - RNA, 24 nt, Human
agcaaggauaucagagcugggaaa

SEQ ID NO: 23485 - RNA, 21 nt, Human
agcaagcggagguugcaguga

SEQ ID NO: 23486 - RNA, 26 nt, Human
gccagccugggcaacagagcaagacu

SEQ ID NO: 23487 - RNA, 27 nt, Human
ccuacuucaaacaggcuucucuucuga

SEQ ID NO: 23488 - RNA, 19 nt, Human
ucuucaggcuucaguaaau

SEQ ID NO: 23489 - RNA, 24 nt, Human
ugcacuuauaagaaagaucaaaga

SEQ ID NO: 23490 - RNA, 23 nt, Human
ggcuagaccuuggacugucuaca

SEQ ID NO: 23491 - RNA, 22 nt, Human
ucaguguuaaccuuuacuggga

SEQ ID NO: 23492 - RNA, 22 nt, Human
cuuuuuuccuguuuuuuguuuu

SEQ ID NO: 23493 - RNA, 24 nt, Human
guccucugggauucaagguacagg

SEQ ID NO: 23494 - RNA, 22 nt, Human
ggcuaauuuuuguauuauuagu

SEQ ID NO: 23495 - RNA, 21 nt, Human
guagauggcuuccuggaauca

SEQ ID NO: 23496 - RNA, 21 nt, Human
gcagugagcugagaucacguc

SEQ ID NO: 23497 - RNA, 21 nt, Human
gcagugagcuaagaucacauc

SEQ ID NO: 23498 - RNA, 21 nt, Human
ucauuggugaagucagcagau

SEQ ID NO: 23499 - RNA, 19 nt, Human
caguaacuacaguuuucac

SEQ ID NO: 23500 - RNA, 19 nt, Human
accaagagugguagaagga

SEQ ID NO: 23501 - RNA, 19 nt, Human
gucggaggggacgggacgc

SEQ ID NO: 23502 - RNA, 21 nt, Human
ggacacauguuggcccccuca

SEQ ID NO: 23503 - RNA, 26 nt, Human
agagaaagagacagagacuggcauuu

SEQ ID NO: 23504 - RNA, 20 nt, Human
ccuaggaaagaggcagcagu

SEQ ID NO: 23505 - RNA, 18 nt, Human
caaaguugguuucuguuu

SEQ ID NO: 23506 - RNA, 17 nt, Human
agccuugguaauuuuga

SEQ ID NO: 23507 - RNA, 22 nt, Human
cuguaaucccagcuacuuggga

SEQ ID NO: 23508 - RNA, 22 nt, Human
gggagcuugauucucagcacuu

SEQ ID NO: 23509 - RNA, 24 nt, Human
uuggguccugggagggugggugaa

SEQ ID NO: 23510 - RNA, 24 nt, Human
auuuaacaucaugauuaccaccuu

SEQ ID NO: 23511 - RNA, 24 nt, Human
auugcaaacaaaaucaucuuuaau

SEQ ID NO: 23512 - RNA, 27 nt, Human
ugcugccugcaggcagacgaggccuuu

SEQ ID NO: 23513 - RNA, 26 nt, Human
auuguuugaacccgaaauaaggguuc

SEQ ID NO: 23514 - RNA, 23 nt, Human
gaagaucauauugcuguaacuuc

SEQ ID NO: 23515 - RNA, 27 nt, Human
auaaaguguuuaugacaaauuuagcca

SEQ ID NO: 23516 - RNA, 22 nt, Human
gucaccuauucacuagugcagg

SEQ ID NO: 23517 - RNA, 22 nt, Human
gacuguaaaugucacagcagug

SEQ ID NO: 23518 - RNA, 22 nt, Human
ugccccacucaccaccucugcu

SEQ ID NO: 23519 - RNA, 23 nt, Human
caggaauagaacuuaaggggugg

SEQ ID NO: 23520 - RNA, 23 nt, Human
ugguuaauugacucacaccagcu

SEQ ID NO: 23521 - RNA, 22 nt, Human
gccagccacagguacagagcca

SEQ ID NO: 23522 - RNA, 26 nt, Human
gccaaaguuaugcaagggacugugug

SEQ ID NO: 23523 - RNA, 21 nt, Human
ugguucuccccauccccacaa

SEQ ID NO: 23524 - RNA, 20 nt, Human
aacuaguggcucucaguuaa

SEQ ID NO: 23525 - RNA, 24 nt, Human
acuccuguuuguggccugccucuc

SEQ ID NO: 23526 - RNA, 22 nt, Human
gccucauucuuuucugugaccc

SEQ ID NO: 23527 - RNA, 22 nt, Human
cccaggcaguggugaucuuuga

SEQ ID NO: 23528 - RNA, 22 nt, Human
ccagccugacuagaccccaccc

SEQ ID NO: 23529 - RNA, 23 nt, Human
uagcauguguccaaguggacaua

SEQ ID NO: 23530 - RNA, 25 nt, Human
cuaagagacuuaagaggucgugguu

SEQ ID NO: 23531 - RNA, 24 nt, Human
ccgcugcucucccaggugaaaucc

SEQ ID NO: 23532 - RNA, 22 nt, Human
gccuggguggcagggggugggu

SEQ ID NO: 23533 - RNA, 28 nt, Human
gccagucccucccccuagaccccgcgcc

SEQ ID NO: 23534 - RNA, 27 nt, Human
ugggaggcugaggcaagagaaucgcuu

SEQ ID NO: 23535 - RNA, 19 nt, Human
auuuaauaacauuaccuua

SEQ ID NO: 23536 - RNA, 25 nt, Human
ugcugaucugagucugccugcagca

SEQ ID NO: 23537 - RNA, 22 nt, Human
cauggccgcuguguccgccgca

SEQ ID NO: 23538 - RNA, 21 nt, Human
gccgacguugggacaaaggau

SEQ ID NO: 23539 - RNA, 23 nt, Human
gcagagcugcuguuuuaaugccu

SEQ ID NO: 23540 - RNA, 22 nt, Human
uacucaggcauugaucuuuuca

SEQ ID NO: 23541 - RNA, 24 nt, Human
cgccuuccccucaguuguuucuaa

SEQ ID NO: 23542 - RNA, 27 nt, Human
ggaccuccagccaggcuucauuuaugc

SEQ ID NO: 23543 - RNA, 27 nt, Human
uuagaagcagcugugggggucccagug

SEQ ID NO: 23544 - RNA, 16 nt, Human
aaacaacagaaacuuc

SEQ ID NO: 23545 - RNA, 21 nt, Human
uuuaggacaguugcaaacgug

SEQ ID NO: 23546 - RNA, 20 nt, Human
ugaaaagcagugucuuugau

SEQ ID NO: 23547 - RNA, 27 nt, Human
uuugagaccaucccuguguuuggagug

SEQ ID NO: 23548 - RNA, 20 nt, Human
ugcugccagaaccuugggga

SEQ ID NO: 23549 - RNA, 24 nt, Human
gggacgaggacaaauauggaugag

SEQ ID NO: 23550 - RNA, 19 nt, Human
cuuuguccuagcaucuuuc

SEQ ID NO: 23551 - RNA, 22 nt, Human
ccaucauggugaaacccugucu

SEQ ID NO: 23552 - RNA, 23 nt, Human
cuuggauuggcccuggcugcugc

SEQ ID NO: 23553 - RNA, 22 nt, Human
cugccuaccugccugagccaug

SEQ ID NO: 23554 - RNA, 23 nt, Human
ugcuucuguuccuggaagaccca

SEQ ID NO: 23555 - RNA, 19 nt, Human
ccuccucugcaccaugacu

SEQ ID NO: 23556 - RNA, 28 nt, Human
ugacauaaacucaugacuaaucuuugug

SEQ ID NO: 23557 - RNA, 22 nt, Human
caaaugcugggauuacagacau

SEQ ID NO: 23558 - RNA, 27 nt, Human
aaguagcugggauuacaagcaccagcc

SEQ ID NO: 23559 - RNA, 21 nt, Human
uaacuucuaaaggaagcagaa

SEQ ID NO: 23560 - RNA, 22 nt, Human
uuccuguaacucccugccuccu

SEQ ID NO: 23561 - RNA, 18 nt, Human
cuccagggagagagcagc

SEQ ID NO: 23562 - RNA, 24 nt, Human
gucagcaaacuacugccugugggc

SEQ ID NO: 23563 - RNA, 22 nt, Human
aguugagaguuugacugugaau

SEQ ID NO: 23564 - RNA, 21 nt, Human
agacccauaaaccaccuccca

SEQ ID NO: 23565 - RNA, 24 nt, Human
uugggaguagggugucccaguggg

SEQ ID NO: 23566 - RNA, 20 nt, Human
ucaaagagaagucaagcaga

SEQ ID NO: 23567 - RNA, 21 nt, Human
gcagggcugcugugaauuugu

SEQ ID NO: 23568 - RNA, 23 nt, Human
auccagagcuggagugcagcggc

SEQ ID NO: 23569 - RNA, 20 nt, Human
gggagguggcugcgcggugg

SEQ ID NO: 23570 - RNA, 26 nt, Human
ccucaccuucuuuuccuggcccuguc

SEQ ID NO: 23571 - RNA, 27 nt, Human
cauuuauaucugaauuauuaccuccau

SEQ ID NO: 23572 - RNA, 21 nt, Human
ccucugccuuugcaccacggg

SEQ ID NO: 23573 - RNA, 25 nt, Human
gguccaagccucucccggguggcca

SEQ ID NO: 23574 - RNA, 19 nt, Human
ggcucacugcaauuugcgu

SEQ ID NO: 23575 - RNA, 23 nt, Human
caccaggagucuggagugcaaug

SEQ ID NO: 23576 - RNA, 22 nt, Human
ugccuccugacuucaagcaauu

SEQ ID NO: 23577 - RNA, 22 nt, Human
uuugucacccaggcuggagugc

SEQ ID NO: 23578 - RNA, 20 nt, Human
aggacuuggagguggcagga

SEQ ID NO: 23579 - RNA, 22 nt, Human
caggaguuuaaggcugcaguga

SEQ ID NO: 23580 - RNA, 23 nt, Human
agaccgagugaaccuaccuucau

SEQ ID NO: 23581 - RNA, 20 nt, Human
cuggggcagggcagguggag

SEQ ID NO: 23582 - RNA, 20 nt, Human
uccuucuagaacacagaauc

SEQ ID NO: 23583 - RNA, 23 nt, Human
ccgagagcgcggaggucgcgcag

SEQ ID NO: 23584 - RNA, 25 nt, Human
acucacugcagagcugcugccugcc

SEQ ID NO: 23585 - RNA, 23 nt, Human
gugccuuccucagggcugugggg

SEQ ID NO: 23586 - RNA, 24 nt, Human
acccuacccagccugcugccucag

SEQ ID NO: 23587 - RNA, 22 nt, Human
uucuuuucucaccuugacugca

SEQ ID NO: 23588 - RNA, 25 nt, Human
cagcagucaugaaccccuucaccuc

SEQ ID NO: 23589 - RNA, 22 nt, Human
ugaauaugggacaaagcauuau

SEQ ID NO: 23590 - RNA, 28 nt, Human
cagacccagccacuguuucugccacccu

SEQ ID NO: 23591 - RNA, 21 nt, Human
ugguuccaauaaagcauuuua

SEQ ID NO: 23592 - RNA, 22 nt, Human
gcuuucucauauugagagcucu

SEQ ID NO: 23593 - RNA, 21 nt, Human
ggguuguucucaauugugcug

SEQ ID NO: 23594 - RNA, 21 nt, Human
gccccuucaggguuuggagga

SEQ ID NO: 23595 - RNA, 24 nt, Human
uucuuuucccaacauaugcccuca

SEQ ID NO: 23596 - RNA, 23 nt, Human
uacuacuguugauuuugcccucg

SEQ ID NO: 23597 - RNA, 21 nt, Human
uuaaucuuugccauccuuaga

SEQ ID NO: 23598 - RNA, 25 nt, Human
gccaccacucugcucccugcuugcc

SEQ ID NO: 23599 - RNA, 26 nt, Human
uuccugcaacuaaacacgagccuggg

SEQ ID NO: 23600 - RNA, 22 nt, Human
ggaaagggaggcugauucccuu

SEQ ID NO: 23601 - RNA, 23 nt, Human
gcacauuuuaaggaacaagaauu

SEQ ID NO: 23602 - RNA, 23 nt, Human
auggaacauuugcaccugaguug

SEQ ID NO: 23603 - RNA, 24 nt, Human
gggauucugggagcuuucugggaa

SEQ ID NO: 23604 - RNA, 28 nt, Human
cagccagcugaucccucugugccaccac

SEQ ID NO: 23605 - RNA, 22 nt, Human
gcagaggcagaagaugaaggac

SEQ ID NO: 23606 - RNA, 21 nt, Human
ggcaucaugaccucuuggccu

SEQ ID NO: 23607 - RNA, 27 nt, Human
uauuuugcuauauauaaagacaacaaa

SEQ ID NO: 23608 - RNA, 24 nt, Human
ccaugaucuugaguccauuugggg

SEQ ID NO: 23609 - RNA, 19 nt, Human
guccaucucuccaucuguc

SEQ ID NO: 23610 - RNA, 24 nt, Human
uucauauugaguaaaugaaugaaa

SEQ ID NO: 23611 - RNA, 18 nt, Human
gccugacagcauaccuca

SEQ ID NO: 23612 - RNA, 21 nt, Human
ugauuucagacaaaugcugug

SEQ ID NO: 23613 - RNA, 23 nt, Human
cucucaccucuccccugugcacc

SEQ ID NO: 23614 - RNA, 20 nt, Human
uuuuccccaugacuuugguu

SEQ ID NO: 23615 - RNA, 23 nt, Human
gccccgccucagccccagcugcc

SEQ ID NO: 23616 - RNA, 19 nt, Human
aaaaauagagaaaugagug

SEQ ID NO: 23617 - RNA, 24 nt, Human
ucucuggaggucaaugguggaggg

SEQ ID NO: 23618 - RNA, 23 nt, Human
gacucuggcugcgccauaagcca

SEQ ID NO: 23619 - RNA, 20 nt, Human
acuuuguguucuacugagua

SEQ ID NO: 23620 - RNA, 19 nt, Human
uccauagcagagaaugaaa

SEQ ID NO: 23621 - RNA, 27 nt, Human
ggaggcugaggcaggauugcuugagcc

SEQ ID NO: 23622 - RNA, 22 nt, Human
uaaaaguuugaggaauauuuca

SEQ ID NO: 23623 - RNA, 22 nt, Human
cccugcucccacccaccugacu

SEQ ID NO: 23624 - RNA, 20 nt, Human
gugcagcugccgaaagugcc

SEQ ID NO: 23625 - RNA, 24 nt, Human
aacuauacccccaccucuguuuuc

SEQ ID NO: 23626 - RNA, 22 nt, Human
cuuaggaaugaacagugucuca

SEQ ID NO: 23627 - RNA, 19 nt, Human
uucuuaacuuauuaccuca

SEQ ID NO: 23628 - RNA, 25 nt, Human
ccauccgaccaaggucuccugugcu

SEQ ID NO: 23629 - RNA, 23 nt, Human
uggccauuuggggaaaacugcag

SEQ ID NO: 23630 - RNA, 22 nt, Human
ccuucccagccacuccugcugc

SEQ ID NO: 23631 - RNA, 21 nt, Human
cauguuuuucauuugauacuu

SEQ ID NO: 23632 - RNA, 30 nt, Human
ucaggggugcguagagguugggggcccugg

SEQ ID NO: 23633 - RNA, 22 nt, Human
ccgucaccaccaccccuaccac

SEQ ID NO: 23634 - RNA, 21 nt, Human
ugggaggcagagcggcaagga

SEQ ID NO: 23635 - RNA, 25 nt, Human
uguagugugugucugauuauuuaca

SEQ ID NO: 23636 - RNA, 23 nt, Human
gaguacuggaggagagaauguac

SEQ ID NO: 23637 - RNA, 21 nt, Human
gggcaugccuuucuguaacca

SEQ ID NO: 23638 - RNA, 20 nt, Human
auacaauaacuacuacagua

SEQ ID NO: 23639 - RNA, 19 nt, Human
aggaagagagugcauggca

SEQ ID NO: 23640 - RNA, 24 nt, Human
gcugugcucuccccuccuuggggc

SEQ ID NO: 23641 - RNA, 21 nt, Human
agggaaagucauucaguggau

SEQ ID NO: 23642 - RNA, 27 nt, Human
aaguagcuggaauuacaggcacauacc

SEQ ID NO: 23643 - RNA, 27 nt, Human
gcccccauucacguugguccucaggga

SEQ ID NO: 23644 - RNA, 22 nt, Human
ggaugaaaacacuucacagucu

SEQ ID NO: 23645 - RNA, 22 nt, Human
uccagccgccuccuccgcgcag

SEQ ID NO: 23646 - RNA, 25 nt, Human
cccacuuccuguuuccaucugcuug

SEQ ID NO: 23647 - RNA, 23 nt, Human
cuggucaucuccgccgcgcucgg

SEQ ID NO: 23648 - RNA, 22 nt, Human
gcaggcagaucaccugaggucg

SEQ ID NO: 23649 - RNA, 22 nt, Human
aggcugaggcgggcagaucacu

SEQ ID NO: 23650 - RNA, 20 nt, Human
ucccuguaaaggagugcugu

SEQ ID NO: 23651 - RNA, 21 nt, Human
cagagugcuggaagccugugg

SEQ ID NO: 23652 - RNA, 20 nt, Human
uaccugggcaugguggugca

SEQ ID NO: 23653 - RNA, 20 nt, Human
aacucuuaaucuguguguau

SEQ ID NO: 23654 - RNA, 23 nt, Human
cugagcaaauauuaaaauuguua

SEQ ID NO: 23655 - RNA, 24 nt, Human
acacacacucucacacacauacau

SEQ ID NO: 23656 - RNA, 20 nt, Human
uucaguucccuccugcccag

SEQ ID NO: 23657 - RNA, 21 nt, Human
ugagaacacagaaugagccag

SEQ ID NO: 23658 - RNA, 23 nt, Human
gacaguuugcucauuuauugcaa

SEQ ID NO: 23659 - RNA, 23 nt, Human
caagcaggccuccuggugaccgg

SEQ ID NO: 23660 - RNA, 23 nt, Human
aaguccccagcagugagcugugu

SEQ ID NO: 23661 - RNA, 29 nt, Human
gcuguacuccaauuuucuuugcaaggccu

SEQ ID NO: 23662 - RNA, 20 nt, Human
gccccacuccagccugggga

SEQ ID NO: 23663 - RNA, 21 nt, Human
ccacccccaaacuuuaaggua

SEQ ID NO: 23664 - RNA, 21 nt, Human
ggggaguuggaacaaaugucu

SEQ ID NO: 23665 - RNA, 28 nt, Human
gcuuggguccuccacuguccucugucaa

SEQ ID NO: 23666 - RNA, 23 nt, Human
ugcgaagugccuuaugcuaugag

SEQ ID NO: 23667 - RNA, 27 nt, Human
cccaccccugacauaccuacugucacc

SEQ ID NO: 23668 - RNA, 22 nt, Human
uugcccaacaggauaagcugga

SEQ ID NO: 23669 - RNA, 26 nt, Human
cucugaaucuguacauguucuuguca

SEQ ID NO: 23670 - RNA, 27 nt, Human
cacugcacuccaggcuggguaacagaa

SEQ ID NO: 23671 - RNA, 28 nt, Human
ggagcagguuugcaggcacaguggagag

SEQ ID NO: 23672 - RNA, 25 nt, Human
uguccccacucacaggcccacgcag

SEQ ID NO: 23673 - RNA, 24 nt, Human
uggucacagaguucaugucacacc

SEQ ID NO: 23674 - RNA, 24 nt, Human
guguuagccaggauggucuugauc

SEQ ID NO: 23675 - RNA, 26 nt, Human
ccucuagccucauacccgugcccuca

SEQ ID NO: 23676 - RNA, 21 nt, Human
ucaugccagcuacuuccuccu

SEQ ID NO: 23677 - RNA, 25 nt, Human
ucuucuuuuauauuuuuuggaaacc

SEQ ID NO: 23678 - RNA, 20 nt, Human
ccggacuguucccgacccgg

SEQ ID NO: 23679 - RNA, 30 nt, Human
ggcugaagcugccugugcacguuucuucuc

SEQ ID NO: 23680 - RNA, 21 nt, Human
cagacuucugaaauagaccca

SEQ ID NO: 23681 - RNA, 27 nt, Human
agaacuccagucccaaacuaaucuguc

SEQ ID NO: 23682 - RNA, 21 nt, Human
gcaucagagcaugcaucaggg

SEQ ID NO: 23683 - RNA, 23 nt, Human
cuguguugcccaggcuggagugc

SEQ ID NO: 23684 - RNA, 20 nt, Human
aacuauuugcuuucucuuca

SEQ ID NO: 23685 - RNA, 26 nt, Human
uguuuuuaaaacuguuuuauaucuua

SEQ ID NO: 23686 - RNA, 26 nt, Human
uagaaaacaguauaaacuuucagagg

SEQ ID NO: 23687 - RNA, 27 nt, Human
ucugcuugauuuuugccucuuccaguc

SEQ ID NO: 23688 - RNA, 23 nt, Human
cucugucucaaaaauaaaugaau

SEQ ID NO: 23689 - RNA, 20 nt, Human
gacuucucuuugugcagaga

SEQ ID NO: 23690 - RNA, 22 nt, Human
cccaggaggcagccggugagcg

SEQ ID NO: 23691 - RNA, 22 nt, Human
caguuguucucaaaguguggua

SEQ ID NO: 23692 - RNA, 27 nt, Human
cacugugccaauaaacaaaaacaacug

SEQ ID NO: 23693 - RNA, 21 nt, Human
augggagguggagggacaggc

SEQ ID NO: 23694 - RNA, 22 nt, Human
agccucucagagugcugggauc

SEQ ID NO: 23695 - RNA, 22 nt, Human
ggaaggaaccaucucacugugu

SEQ ID NO: 23696 - RNA, 22 nt, Human
cguggccucaggugccaggguu

SEQ ID NO: 23697 - RNA, 22 nt, Human
aucgcuugaaccagggagucag

SEQ ID NO: 23698 - RNA, 23 nt, Human
ggcagacucuuuaauaaauugcu

SEQ ID NO: 23699 - RNA, 21 nt, Human
aauaucucccuggcagggucc

SEQ ID NO: 23700 - RNA, 21 nt, Human
uuccuuuugcuucucauagcc

SEQ ID NO: 23701 - RNA, 22 nt, Human
cuuauaaauacauuuuugucag

SEQ ID NO: 23702 - RNA, 20 nt, Human
cagggcuggcagucaucgac

SEQ ID NO: 23703 - RNA, 21 nt, Human
uauuauccucugaaugcaguu

SEQ ID NO: 23704 - RNA, 22 nt, Human
guccuuacagucccacucugga

SEQ ID NO: 23705 - RNA, 20 nt, Human
gccucccucccccugcagcc

SEQ ID NO: 23706 - RNA, 21 nt, Human
uggguggggagaagaggcaga

SEQ ID NO: 23707 - RNA, 20 nt, Human
cugauuucaguuuuucauuu

SEQ ID NO: 23708 - RNA, 21 nt, Human
uggugcgcuccagccgggcag

SEQ ID NO: 23709 - RNA, 21 nt, Human
gccuguaaucccaguacuuug

SEQ ID NO: 23710 - RNA, 25 nt, Human
guguccauucuggcagugguuuuga

SEQ ID NO: 23711 - RNA, 22 nt, Human
cgcccaggcuggggugcagugg

SEQ ID NO: 23712 - RNA, 23 nt, Human
gggauuuuguuaaucaaauuuau

SEQ ID NO: 23713 - RNA, 18 nt, Human
aaaugguggcacucugaa

SEQ ID NO: 23714 - RNA, 22 nt, Human
ugugaggaagagguugcaguga

SEQ ID NO: 23715 - RNA, 21 nt, Human
ccagugccaggaaaaggccaa

SEQ ID NO: 23716 - RNA, 22 nt, Human
cucuggcacuuccauugguucu

SEQ ID NO: 23717 - RNA, 18 nt, Human
gguuccucugccuguguc

SEQ ID NO: 23718 - RNA, 27 nt, Human
gagguacugugccuuguucauaccugu

SEQ ID NO: 23719 - RNA, 22 nt, Human
cgccaaguuggagcuugcagug

SEQ ID NO: 23720 - RNA, 26 nt, Human
cuaacagcaccaaaucaaaaucucuc

SEQ ID NO: 23721 - RNA, 27 nt, Human
gugcuguacuugaugacagacacuucu

SEQ ID NO: 23722 - RNA, 18 nt, Human
gguuuccaucccaccacu

SEQ ID NO: 23723 - RNA, 21 nt, Human
cgggccccccucagccccugc

SEQ ID NO: 23724 - RNA, 20 nt, Human
acacauugcugaccuuggcc

SEQ ID NO: 23725 - RNA, 27 nt, Human
ccccacccuccccuucccagggcaaua

SEQ ID NO: 23726 - RNA, 22 nt, Human
cucagcaggcuggagcuugggg

SEQ ID NO: 23727 - RNA, 21 nt, Human
ucacccacgcuggagugcugu

SEQ ID NO: 23728 - RNA, 22 nt, Human
gauuacaggcgugagucaccgu

SEQ ID NO: 23729 - RNA, 25 nt, Human
ccaggcugcagggggcuggagaagc

SEQ ID NO: 23730 - RNA, 19 nt, Human
ggagagggagcuggggcgc

SEQ ID NO: 23731 - RNA, 27 nt, Human
gagcaugugugggugggagucagcaca

SEQ ID NO: 23732 - RNA, 24 nt, Human
uaauauugaaacuacucugccuuu

SEQ ID NO: 23733 - RNA, 25 nt, Human
gcacagcccugcaguaaggagccca

SEQ ID NO: 23734 - RNA, 22 nt, Human
uucucagaagaaaaagauaugu

SEQ ID NO: 23735 - RNA, 26 nt, Human
ggaaggcaggaggcagaaagacgggu

SEQ ID NO: 23736 - RNA, 21 nt, Human
cccggcacuccagccuggcga

SEQ ID NO: 23737 - RNA, 24 nt, Human
agggcuguugucauuuguaaacgc

SEQ ID NO: 23738 - RNA, 20 nt, Human
cucuugggaagcagcuuccu

SEQ ID NO: 23739 - RNA, 32 nt, Human
aauuuguuacuucacugaauuucuucaaaacc

SEQ ID NO: 23740 - RNA, 22 nt, Human
gaggaggccuugggcucugcug

SEQ ID NO: 23741 - RNA, 22 nt, Human
gcuacuccaguuuccucagccu

SEQ ID NO: 23742 - RNA, 22 nt, Human
cuguuccuggguuuaugcaguu

SEQ ID NO: 23743 - RNA, 24 nt, Human
agcacauaacauugugauggggaa

SEQ ID NO: 23744 - RNA, 22 nt, Human
ccauugcacugcagccuggaug

SEQ ID NO: 23745 - RNA, 24 nt, Human
gcggggagggggauaggaagacgc

SEQ ID NO: 23746 - RNA, 20 nt, Human
ucauuuaaccuaucuuccag

SEQ ID NO: 23747 - RNA, 23 nt, Human
gggcaggugucacaaagaagagg

SEQ ID NO: 23748 - RNA, 22 nt, Human
uugcccaggauggagugcagug

SEQ ID NO: 23749 - RNA, 26 nt, Human
uucagaccucagcuccugggggccgg

SEQ ID NO: 23750 - RNA, 23 nt, Human
ggccccucgggaaagcgcagucg

SEQ ID NO: 23751 - RNA, 22 nt, Human
caaaucuccucccaccucucuc

SEQ ID NO: 23752 - RNA, 22 nt, Human
ggucucgaacucuugacuucag

SEQ ID NO: 23753 - RNA, 22 nt, Human
aaacuccugacucgaagugauc

SEQ ID NO: 23754 - RNA, 24 nt, Human
ugaagggcuaucucuggcaccucu

SEQ ID NO: 23755 - RNA, 27 nt, Human
agggucugggggcagcuguccugaacc

SEQ ID NO: 23756 - RNA, 19 nt, Human
agagcaccuccaaacugca

SEQ ID NO: 23757 - RNA, 21 nt, Human
aauacugcuacagcaauuucu

SEQ ID NO: 23758 - RNA, 18 nt, Human
aaaacagccacaaaaaga

SEQ ID NO: 23759 - RNA, 25 nt, Human
ucagucuucccaucuguacaaugac

SEQ ID NO: 23760 - RNA, 21 nt, Human
uuuguuuucauuguuuacuua

SEQ ID NO: 23761 - RNA, 21 nt, Human
guggcuucucccugcgaggag

SEQ ID NO: 23762 - RNA, 20 nt, Human
aggcuggagggcgggcggac

SEQ ID NO: 23763 - RNA, 25 nt, Human
ccacugugugaaacuguaucugcca

SEQ ID NO: 23764 - RNA, 22 nt, Human
gucuuaaacuccuaaccucagg

SEQ ID NO: 23765 - RNA, 22 nt, Human
gucuugaacuccugaccucagg

SEQ ID NO: 23766 - RNA, 22 nt, Human
gcagccugggcaaaccggguga

SEQ ID NO: 23767 - RNA, 24 nt, Human
ggcugucaugaauguguacgugcu

SEQ ID NO: 23768 - RNA, 21 nt, Human
ggaggggagggggcgcccagg

SEQ ID NO: 23769 - RNA, 22 nt, Human
cggaagacuuaaagggccaggc

SEQ ID NO: 23770 - RNA, 23 nt, Human
ucuuagaccucucccaucaugcc

SEQ ID NO: 23771 - RNA, 21 nt, Human
ugaaccaagaucacgccacug

SEQ ID NO: 23772 - RNA, 26 nt, Human
cugggagccgcgggucggacgagccg

SEQ ID NO: 23773 - RNA, 21 nt, Human
gaggaagaguugagucugucu

SEQ ID NO: 23774 - RNA, 20 nt, Human
cugcccugcccaaccugcuc

SEQ ID NO: 23775 - RNA, 21 nt, Human
ggcugagaacauggacugagc

SEQ ID NO: 23776 - RNA, 21 nt, Human
cuggggcccucagcuccuggg

SEQ ID NO: 23777 - RNA, 22 nt, Human
ggguuuggcugcaguggcagug

SEQ ID NO: 23778 - RNA, 23 nt, Human
ggagggcagaagcacaguuccca

SEQ ID NO: 23779 - RNA, 21 nt, Human
guucccacucugggcaaagcc

SEQ ID NO: 23780 - RNA, 31 nt, Human
gggggugcggagagacaggcggaggggcggg

SEQ ID NO: 23781 - RNA, 21 nt, Human
cagcucuucgccgaccaccuu

SEQ ID NO: 23782 - RNA, 20 nt, Human
agcaaagugccuuaggauag

SEQ ID NO: 23783 - RNA, 21 nt, Human
gacaaauauaaagaugaggac

SEQ ID NO: 23784 - RNA, 20 nt, Human
uuugacacaguccucugcug

SEQ ID NO: 23785 - RNA, 27 nt, Human
ggaugggaggauagggagccccucaug

SEQ ID NO: 23786 - RNA, 22 nt, Human
guucugaagaaaauggaugugc

SEQ ID NO: 23787 - RNA, 25 nt, Human
cuugcagauaucugcaugugucaug

SEQ ID NO: 23788 - RNA, 21 nt, Human
auacaggaauugacacugauu

SEQ ID NO: 23789 - RNA, 24 nt, Human
ugauuccacugaaaccucuguucu

SEQ ID NO: 23790 - RNA, 25 nt, Human
cgcagccgccgccuggggcgcuugg

SEQ ID NO: 23791 - RNA, 23 nt, Human
cuccaccuucccuagucaccagc

SEQ ID NO: 23792 - RNA, 24 nt, Human
agugaauguguuuggaauauggcc

SEQ ID NO: 23793 - RNA, 21 nt, Human
caaucagcucugacacuuguu

SEQ ID NO: 23794 - RNA, 17 nt, Human
ugcauuuauuuacuucu

SEQ ID NO: 23795 - RNA, 22 nt, Human
uauuauauguuuggacaauuag

SEQ ID NO: 23796 - RNA, 16 nt, Human
gauuuucuuuacuacc

SEQ ID NO: 23797 - RNA, 21 nt, Human
gaguacuggcugugcguggca

SEQ ID NO: 23798 - RNA, 20 nt, Human
uucagcucagcugggcaugg

SEQ ID NO: 23799 - RNA, 28 nt, Human
ccacuccaggaacuugaacugcaggggc

SEQ ID NO: 23800 - RNA, 22 nt, Human
auuuucuucaguugguguguuu

SEQ ID NO: 23801 - RNA, 27 nt, Human
aggaaggcagaccuccugggagaccca

SEQ ID NO: 23802 - RNA, 26 nt, Human
ucuucggguuucaccuccuaguacuc

SEQ ID NO: 23803 - RNA, 22 nt, Human
ccagccuccccgugccaaaaau

SEQ ID NO: 23804 - RNA, 25 nt, Human
gccagccacaguccccgccaggccg

SEQ ID NO: 23805 - RNA, 21 nt, Human
agcucacaccuguaaucccag

SEQ ID NO: 23806 - RNA, 20 nt, Human
gcaucccagcaccugccucc

SEQ ID NO: 23807 - RNA, 27 nt, Human
guguucauuuauuuccaccacagcaga

SEQ ID NO: 23808 - RNA, 19 nt, Human
uuucagagagaaacagcag

SEQ ID NO: 23809 - RNA, 26 nt, Human
ggagagaagcaaggccacuaaaagag

SEQ ID NO: 23810 - RNA, 27 nt, Human
gaacaccuggcuaccauuuuguuuucu

SEQ ID NO: 23811 - RNA, 26 nt, Human
ucauaucuacucaccuaacagcaaca

SEQ ID NO: 23812 - RNA, 20 nt, Human
ccucugaagaggaagccugu

SEQ ID NO: 23813 - RNA, 23 nt, Human
cucauuucuuaccauuuuauucc

SEQ ID NO: 23814 - RNA, 24 nt, Human
cuucucucuguuugccugccucca

SEQ ID NO: 23815 - RNA, 22 nt, Human
gccauguggaacugagaagaac

SEQ ID NO: 23816 - RNA, 22 nt, Human
gcuguugcuuaagcuuuugccu

SEQ ID NO: 23817 - RNA, 27 nt, Human
cccaagagguccaaggcugcagugagc

SEQ ID NO: 23818 - RNA, 23 nt, Human
gucacccaggcuggaguacagug

SEQ ID NO: 23819 - RNA, 23 nt, Human
gucacccagacuggagugcagug

SEQ ID NO: 23820 - RNA, 22 nt, Human
uggucaacaugguguaacccca

SEQ ID NO: 23821 - RNA, 20 nt, Human
aguauugaaauaaucaaaga

SEQ ID NO: 23822 - RNA, 21 nt, Human
aauuuccucuccacugcugga

SEQ ID NO: 23823 - RNA, 23 nt, Human
gccacugcugggaccuuguguuc

SEQ ID NO: 23824 - RNA, 20 nt, Human
gaccugccuuaugcaccuua

SEQ ID NO: 23825 - RNA, 22 nt, Human
cagucuggagugcaguggugug

SEQ ID NO: 23826 - RNA, 20 nt, Human
uauuuagaagcagauuuucc

SEQ ID NO: 23827 - RNA, 23 nt, Human
gucauuuucuuucccagaagcgc

SEQ ID NO: 23828 - RNA, 27 nt, Human
cuaguaaauuguaaaugaaguaauacu

SEQ ID NO: 23829 - RNA, 24 nt, Human
ccugauccuggcccuuucuucuuc

SEQ ID NO: 23830 - RNA, 23 nt, Human
ggggagggagagaacuauguuuc

SEQ ID NO: 23831 - RNA, 26 nt, Human
uugggaggaugaggcaggagaaucgc

SEQ ID NO: 23832 - RNA, 21 nt, Human
ugaacuuugaugaaguacagu

SEQ ID NO: 23833 - RNA, 21 nt, Human
gcucugcugcccccuccuggg

SEQ ID NO: 23834 - RNA, 20 nt, Human
uacagugauauacuuacuca

SEQ ID NO: 23835 - RNA, 25 nt, Human
gguggaggccgugcagggaggcggg

SEQ ID NO: 23836 - RNA, 27 nt, Human
ggugcagcaucuggaagagcuaggcag

SEQ ID NO: 23837 - RNA, 31 nt, Human
ccugcggguccuugugucccugccgcugaag

SEQ ID NO: 23838 - RNA, 22 nt, Human
uucaagcugucuuugcacuagc

SEQ ID NO: 23839 - RNA, 24 nt, Human
guguaaacuuggggauggcugagg

SEQ ID NO: 23840 - RNA, 14 nt, Human
guucccuuaggcug

SEQ ID NO: 23841 - RNA, 22 nt, Human
cuccagaugacuucagcagugg

SEQ ID NO: 23842 - RNA, 23 nt, Human
aacacagccuuccuucugcuccc

SEQ ID NO: 23843 - RNA, 22 nt, Human
aaaaacacaagaaggaaaaggc

SEQ ID NO: 23844 - RNA, 20 nt, Human
ccaauccucacguccuucac

SEQ ID NO: 23845 - RNA, 22 nt, Human
uuagcuguuaaugcucugugag

SEQ ID NO: 23846 - RNA, 27 nt, Human
uucauucuuucaguaaauauuuauuga

SEQ ID NO: 23847 - RNA, 22 nt, Human
ccacugcacuccauccugggug

SEQ ID NO: 23848 - RNA, 21 nt, Human
uccgcccccucuaccccuucc

SEQ ID NO: 23849 - RNA, 30 nt, Human
ucccggcaccuacagagaauguuucacagu

SEQ ID NO: 23850 - RNA, 24 nt, Human
uuccccaggcaggaguugggguug

SEQ ID NO: 23851 - RNA, 22 nt, Human
ucucccucccccuucaggggcu

SEQ ID NO: 23852 - RNA, 19 nt, Human
uucuuugguaauuguguga

SEQ ID NO: 23853 - RNA, 22 nt, Human
uuaagacugcgcgaggagcuag

SEQ ID NO: 23854 - RNA, 23 nt, Human
ugccuguuaucucagcuacuugg

SEQ ID NO: 23855 - RNA, 22 nt, Human
guauggaauuccagugccaggc

SEQ ID NO: 23856 - RNA, 22 nt, Human
ucacccaggcuguggugcagua

SEQ ID NO: 23857 - RNA, 22 nt, Human
cuuccugcuguaugugagcugu

SEQ ID NO: 23858 - RNA, 21 nt, Human
caucugaaccccaucagugga

SEQ ID NO: 23859 - RNA, 20 nt, Human
auaaggcuucuagaauugga

SEQ ID NO: 23860 - RNA, 21 nt, Human
uauuagugaccucagcuuuga

SEQ ID NO: 23861 - RNA, 21 nt, Human
gggccuggcgaucugacucag

SEQ ID NO: 23862 - RNA, 21 nt, Human
ccgcggccaccggaagagucg

SEQ ID NO: 23863 - RNA, 20 nt, Human
cagccuucaucagugcaaug

SEQ ID NO: 23864 - RNA, 26 nt, Human
gagcaguucccaaggacagucagcau

SEQ ID NO: 23865 - RNA, 18 nt, Human
auucuugugucuacuucu

SEQ ID NO: 23866 - RNA, 24 nt, Human
cacuuaaagucaggaguccaagac

SEQ ID NO: 23867 - RNA, 21 nt, Human
gguggcagcugugggaggagg

SEQ ID NO: 23868 - RNA, 23 nt, Human
gggauuacaggcuugagccucca

SEQ ID NO: 23869 - RNA, 21 nt, Human
uucucauugagccucaggcua

SEQ ID NO: 23870 - RNA, 22 nt, Human
aucagccugggcaaugugauaa

SEQ ID NO: 23871 - RNA, 24 nt, Human
uuacccagcaucuggaguacagga

SEQ ID NO: 23872 - RNA, 19 nt, Human
ucugugggcaccagcacuu

SEQ ID NO: 23873 - RNA, 22 nt, Human
auguuaccuguccguguuacau

SEQ ID NO: 23874 - RNA, 22 nt, Human
accagccucaucaacacaguga

SEQ ID NO: 23875 - RNA, 28 nt, Human
gccccuucaccacccccuccgcccugcc

SEQ ID NO: 23876 - RNA, 24 nt, Human
ccuccauccucauuccugccugaa

SEQ ID NO: 23877 - RNA, 21 nt, Human
uuccauggagauucagucugu

SEQ ID NO: 23878 - RNA, 27 nt, Human
ugcucacaaccauccuggucauucucg

SEQ ID NO: 23879 - RNA, 27 nt, Human
ccacaaaccaccaucuauuuugugaac

SEQ ID NO: 23880 - RNA, 22 nt, Human
guauagaggggacccacguagc

SEQ ID NO: 23881 - RNA, 22 nt, Human
cuuucuggcccuuucuggacca

SEQ ID NO: 23882 - RNA, 23 nt, Human
cguguuuuuaucacaccugcucc

SEQ ID NO: 23883 - RNA, 20 nt, Human
ugcaguucugagaaggugga

SEQ ID NO: 23884 - RNA, 28 nt, Human
ccagaagcaaaccuggaggugagaccca

SEQ ID NO: 23885 - RNA, 23 nt, Human
acugaucacuaaaugaauggaug

SEQ ID NO: 23886 - RNA, 22 nt, Human
aacgugcugggauuauaggcgu

SEQ ID NO: 23887 - RNA, 18 nt, Human
cuuccgccccugccuccg

SEQ ID NO: 23888 - RNA, 26 nt, Human
ucagccaggcuggaggcggcaggcgg

SEQ ID NO: 23889 - RNA, 18 nt, Human
uuugucaugguguuuuac

SEQ ID NO: 23890 - RNA, 26 nt, Human
uuaaaccauuuuugcugaauucaucu

SEQ ID NO: 23891 - RNA, 25 nt, Human
cccauagaaacaugacacugaccuu

SEQ ID NO: 23892 - RNA, 18 nt, Human
guguuaaccugucucugu

SEQ ID NO: 23893 - RNA, 22 nt, Human
gucaaauuauuaagugccaugg

SEQ ID NO: 23894 - RNA, 26 nt, Human
aaacagcuuuaaacacuuccaaugag

SEQ ID NO: 23895 - RNA, 23 nt, Human
agaggaagagagaguggcuucca

SEQ ID NO: 23896 - RNA, 21 nt, Human
gccucucccagacagcagcug

SEQ ID NO: 23897 - RNA, 25 nt, Human
acccaggcuggagugcagugcugcg

SEQ ID NO: 23898 - RNA, 21 nt, Human
uuuucucaugucuaccaggaa

SEQ ID NO: 23899 - RNA, 22 nt, Human
ugcacugagcugagaucgugcc

SEQ ID NO: 23900 - RNA, 30 nt, Human
agaggaaacgaggugagcagaggacuuccu

SEQ ID NO: 23901 - RNA, 22 nt, Human
cagccuucugaguucaagcaau

SEQ ID NO: 23902 - RNA, 26 nt, Human
uccuagagugagaguuuggaaggugu

SEQ ID NO: 23903 - RNA, 31 nt, Human
gagucuugcccuugacuucugcucuggauuc

SEQ ID NO: 23904 - RNA, 27 nt, Human
cuugacauguagcuucuucugaaagaa

SEQ ID NO: 23905 - RNA, 24 nt, Human
ggggugagccucuuagcaggacag

SEQ ID NO: 23906 - RNA, 20 nt, Human
ucaugccaccacauucgcca

SEQ ID NO: 23907 - RNA, 23 nt, Human
agcuuguuuuugucuucucagcu

SEQ ID NO: 23908 - RNA, 23 nt, Human
aggcuuguauuuugcacauuuua

SEQ ID NO: 23909 - RNA, 25 nt, Human
ccacccuggcccugccccagccugu

SEQ ID NO: 23910 - RNA, 20 nt, Human
ggaggugggguuuugccaug

SEQ ID NO: 23911 - RNA, 20 nt, Human
aaugauaaccaacagucuuc

SEQ ID NO: 23912 - RNA, 23 nt, Human
uccugggcuccagccuccugcaa

SEQ ID NO: 23913 - RNA, 27 nt, Human
aguaaagcauuuucaaaacucaguauu

SEQ ID NO: 23914 - RNA, 23 nt, Human
aacuggggcgggggguguuuccu

SEQ ID NO: 23915 - RNA, 20 nt, Human
acucccuggaccugccuucu

SEQ ID NO: 23916 - RNA, 28 nt, Human
uccugcugugaaaacucagaaugauaac

SEQ ID NO: 23917 - RNA, 22 nt, Human
aguagcacaggcugagugcagg

SEQ ID NO: 23918 - RNA, 21 nt, Human
uuggaaggcaaagucuuggcu

SEQ ID NO: 23919 - RNA, 26 nt, Human
ugcagcucgggggccugggcugcccc

SEQ ID NO: 23920 - RNA, 19 nt, Human
gccuggugccaaacuggcu

SEQ ID NO: 23921 - RNA, 22 nt, Human
gucucacucugaauaaaggaca

SEQ ID NO: 23922 - RNA, 23 nt, Human
ucccccacuggagugauuucagu

SEQ ID NO: 23923 - RNA, 21 nt, Human
cuccagcccaaucuucugggu

SEQ ID NO: 23924 - RNA, 23 nt, Human
ucuccugccagucucuuguacuc

SEQ ID NO: 23925 - RNA, 22 nt, Human
ccuccugcucacagacccuguc

SEQ ID NO: 23926 - RNA, 23 nt, Human
ugcagugaacugagaucguaccc

SEQ ID NO: 23927 - RNA, 22 nt, Human
gacuacaggcacgugugaccau

SEQ ID NO: 23928 - RNA, 31 nt, Human
ccgaugcacgccaccaccaugccuguguuac

SEQ ID NO: 23929 - RNA, 22 nt, Human
ugggauuacagggaugagccac

SEQ ID NO: 23930 - RNA, 27 nt, Human
gaacccauggauauggagggcugacua

SEQ ID NO: 23931 - RNA, 21 nt, Human
auccuuggaucaguacugaac

SEQ ID NO: 23932 - RNA, 21 nt, Human
cccuccuccccuuccugcacc

SEQ ID NO: 23933 - RNA, 30 nt, Human
aagccccuuggagagagaggcugccucagc

SEQ ID NO: 23934 - RNA, 22 nt, Human
cugaggcacgagaaucgcuuga

SEQ ID NO: 23935 - RNA, 26 nt, Human
ccaggauugagacuuccugugggcac

SEQ ID NO: 23936 - RNA, 30 nt, Human
uggagaaaaugggcggggguggugugggug

SEQ ID NO: 23937 - RNA, 27 nt, Human
ggggaaagggaagccuggguuuuugua

SEQ ID NO: 23938 - RNA, 23 nt, Human
guacacauacauacccuauacca

SEQ ID NO: 23939 - RNA, 22 nt, Human
guugggagcacuggagugcagg

SEQ ID NO: 23940 - RNA, 25 nt, Human
acugacuccuuggaguguccaggac

SEQ ID NO: 23941 - RNA, 24 nt, Human
gcucuuuucagccccuccugguau

SEQ ID NO: 23942 - RNA, 22 nt, Human
aggugccacggccacaccagug

SEQ ID NO: 23943 - RNA, 20 nt, Human
gcuuggcucuccucuggcua

SEQ ID NO: 23944 - RNA, 21 nt, Human
ccugcagcuccuuuacaguuc

SEQ ID NO: 23945 - RNA, 26 nt, Human
ccugggaggaguggcccugauccagg

SEQ ID NO: 23946 - RNA, 22 nt, Human
gggauuacaggcuugagcuacc

SEQ ID NO: 23947 - RNA, 22 nt, Human
gggagguggcugucccgcggga

SEQ ID NO: 23948 - RNA, 19 nt, Human
acaaguguacagaaaacuc

SEQ ID NO: 23949 - RNA, 23 nt, Human
caggauuucuaaaauucugugau

SEQ ID NO: 23950 - RNA, 25 nt, Human
cccugcagaacaugaaccuuccgcu

SEQ ID NO: 23951 - RNA, 19 nt, Human
gcucugucacccaggcugg

SEQ ID NO: 23952 - RNA, 22 nt, Human
uaaagaaguggauuguauugug

SEQ ID NO: 23953 - RNA, 21 nt, Human
ggcccacaucuuccggccaac

SEQ ID NO: 23954 - RNA, 27 nt, Human
uguggacaggcuggggaauuuugcugc

SEQ ID NO: 23955 - RNA, 26 nt, Human
uucaauaacaugaguggcagaucuug

SEQ ID NO: 23956 - RNA, 22 nt, Human
cuucugauccucauccugggug

SEQ ID NO: 23957 - RNA, 21 nt, Human
guuucaucuguucauucacug

SEQ ID NO: 23958 - RNA, 26 nt, Human
gcagcaccugggaaugcugccucgug

SEQ ID NO: 23959 - RNA, 25 nt, Human
aguuggccuucccuuccuagugcua

SEQ ID NO: 23960 - RNA, 23 nt, Human
acuagccucuguagcugguggug

SEQ ID NO: 23961 - RNA, 17 nt, Human
cugcccuuuuguuuacu

SEQ ID NO: 23962 - RNA, 19 nt, Human
cuugucccagccucagccu

SEQ ID NO: 23963 - RNA, 26 nt, Human
ccaggugaaagagcaaaguucaagug

SEQ ID NO: 23964 - RNA, 21 nt, Human
ggcagagggaggaaggacagc

SEQ ID NO: 23965 - RNA, 27 nt, Human
ggaggguuaggaaaaccacaaacggag

SEQ ID NO: 23966 - RNA, 20 nt, Human
gcccagcgcccuuccccuca

SEQ ID NO: 23967 - RNA, 27 nt, Human
uaggaagggaaauggcuacuuggccag

SEQ ID NO: 23968 - RNA, 21 nt, Human
gugagcuggcucagggugggg

SEQ ID NO: 23969 - RNA, 22 nt, Human
ucucuugauuccuagucucucg

SEQ ID NO: 23970 - RNA, 25 nt, Human
aacccuagucuucgaaauguuaaua

SEQ ID NO: 23971 - RNA, 21 nt, Human
uggcccucaucugugcugaaa

SEQ ID NO: 23972 - RNA, 21 nt, Human
ucuccaucuaguuuacuucua

SEQ ID NO: 23973 - RNA, 19 nt, Human
cuucagccuccaucccugg

SEQ ID NO: 23974 - RNA, 19 nt, Human
ucuguucugugcugugcua

SEQ ID NO: 23975 - RNA, 18 nt, Human
cucugcgggcaggugcug

SEQ ID NO: 23976 - RNA, 27 nt, Human
cugcugugucuuggacccugcccccca

SEQ ID NO: 23977 - RNA, 20 nt, Human
acccagagugcagagccgcc

SEQ ID NO: 23978 - RNA, 21 nt, Human
ggcuuuguauaaucccaccca

SEQ ID NO: 23979 - RNA, 22 nt, Human
gccucggcagucugggcuccgg

SEQ ID NO: 23980 - RNA, 20 nt, Human
ggauccuugccacugcucuu

SEQ ID NO: 23981 - RNA, 21 nt, Human
ugaccaggcuggagugcagug

SEQ ID NO: 23982 - RNA, 19 nt, Human
ggcagcauagaauuuugga

SEQ ID NO: 23983 - RNA, 24 nt, Human
uugccuuugcugggccuucugugc

SEQ ID NO: 23984 - RNA, 24 nt, Human
ggucucucaggguguaguggugug

SEQ ID NO: 23985 - RNA, 24 nt, Human
augcauuuuaagguggaguacagu

SEQ ID NO: 23986 - RNA, 20 nt, Human
ccugccggaaugugcagccu

SEQ ID NO: 23987 - RNA, 21 nt, Human
ccgagcccugggaggcuacgg

SEQ ID NO: 23988 - RNA, 25 nt, Human
auccagucagguaauuauuuucuau

SEQ ID NO: 23989 - RNA, 22 nt, Human
auuccauuaaggucagcccacc

SEQ ID NO: 23990 - RNA, 21 nt, Human
cuuacucagagcugcgggcug

SEQ ID NO: 23991 - RNA, 25 nt, Human
gaaugugguaaaacuuacaauccuc

SEQ ID NO: 23992 - RNA, 27 nt, Human
gacucacugacuccucacuggcuuugu

SEQ ID NO: 23993 - RNA, 24 nt, Human
ggacuuagucaugaggagagggug

SEQ ID NO: 23994 - RNA, 26 nt, Human
agucauguaauguauagugaauuuau

SEQ ID NO: 23995 - RNA, 26 nt, Human
agagacacuucuauagacugcauccu

SEQ ID NO: 23996 - RNA, 24 nt, Human
cuuucuccccacuaguuuacacca

SEQ ID NO: 23997 - RNA, 23 nt, Human
ccagaguagcugggacuacaggu

SEQ ID NO: 23998 - RNA, 21 nt, Human
cagcauuuucauucauuuuaa

SEQ ID NO: 23999 - RNA, 24 nt, Human
acucagcaaugccuuccuggacca

SEQ ID NO: 24000 - RNA, 22 nt, Human
gaaggggugcacccaccuguuu

SEQ ID NO: 24001 - RNA, 26 nt, Human
cuuaccucaaauuaagcauauguguu

SEQ ID NO: 24002 - RNA, 22 nt, Human
uucucucugccacccacauucc

SEQ ID NO: 24003 - RNA, 22 nt, Human
cugagugucugcuuuguuuagu

SEQ ID NO: 24004 - RNA, 24 nt, Human
ggagguggaggaaggagcaggugc

SEQ ID NO: 24005 - RNA, 27 nt, Human
uguuuuuaaaaguuucaaugugauucu

SEQ ID NO: 24006 - RNA, 21 nt, Human
cuuguugccacagcuggagcu

SEQ ID NO: 24007 - RNA, 30 nt, Human
cuagcugucuggcuguauaacucuuacagu

SEQ ID NO: 24008 - RNA, 22 nt, Human
uugcccaggcuggagugcagug

SEQ ID NO: 24009 - RNA, 22 nt, Human
uugcccaggcuagagugcaaug

SEQ ID NO: 24010 - RNA, 22 nt, Human
ucgcccaggcuggaguguagug

SEQ ID NO: 24011 - RNA, 24 nt, Human
uguuaagugccauuacuacuguac

SEQ ID NO: 24012 - RNA, 24 nt, Human
acuucagacggaccucaggguagg

SEQ ID NO: 24013 - RNA, 23 nt, Human
cucaucauuucccaucuggaccu

SEQ ID NO: 24014 - RNA, 20 nt, Human
ccuuggccuccagccuggag

SEQ ID NO: 24015 - RNA, 20 nt, Human
uuugcccaggcuggucucaa

SEQ ID NO: 24016 - RNA, 21 nt, Human
ucauucuuguuaauuauacca

SEQ ID NO: 24017 - RNA, 22 nt, Human
cuccucucccacucaggcacaa

SEQ ID NO: 24018 - RNA, 18 nt, Human
ccaguauucuuuuauaaa

SEQ ID NO: 24019 - RNA, 22 nt, Human
uugcacuccaggcugggcagca

SEQ ID NO: 24020 - RNA, 22 nt, Human
caaauucugccuaccacaggca

SEQ ID NO: 24021 - RNA, 21 nt, Human
uuccagaacaaaagaauuuug

SEQ ID NO: 24022 - RNA, 18 nt, Human
uaggaacuuaaauuugua

SEQ ID NO: 24023 - RNA, 26 nt, Human
caccuccagucucggcuuuccccggg

SEQ ID NO: 24024 - RNA, 22 nt, Human
guugcccaggcugaagugcagu

SEQ ID NO: 24025 - RNA, 24 nt, Human
ccaucauuuugaaaagauuuauua

SEQ ID NO: 24026 - RNA, 22 nt, Human
cccaaagagcugggaauuuaug

SEQ ID NO: 24027 - RNA, 20 nt, Human
aucagaauaauaaaaggagg

SEQ ID NO: 24028 - RNA, 23 nt, Human
ggggauggagugacagccucagc

SEQ ID NO: 24029 - RNA, 29 nt, Human
gauuauacucaacuuacuguuuagaaaau

SEQ ID NO: 24030 - RNA, 20 nt, Human
cucccauuggccaaaggaca

SEQ ID NO: 24031 - RNA, 19 nt, Human
aggaggaucagccacaguu

SEQ ID NO: 24032 - RNA, 23 nt, Human
aauaaaucuacauguuuauugaa

SEQ ID NO: 24033 - RNA, 21 nt, Human
acacauuuggcucaggguuac

SEQ ID NO: 24034 - RNA, 20 nt, Human
agcgcccauguugugauaca

SEQ ID NO: 24035 - RNA, 27 nt, Human
ccacugcacuccagcucggggaacaga

SEQ ID NO: 24036 - RNA, 26 nt, Human
ugguggagagauggaagggcaucagg

SEQ ID NO: 24037 - RNA, 21 nt, Human
ccuacuucuuugcuuugccca

SEQ ID NO: 24038 - RNA, 24 nt, Human
gagguuagagccagccacacuuga

SEQ ID NO: 24039 - RNA, 20 nt, Human
gcacuuacacccacaacccg

SEQ ID NO: 24040 - RNA, 23 nt, Human
agcauauaaaauuuucccccuua

SEQ ID NO: 24041 - RNA, 21 nt, Human
cacuauauuccaccacuuugg

SEQ ID NO: 24042 - RNA, 25 nt, Human
acuuccggauggagggagagguugu

SEQ ID NO: 24043 - RNA, 22 nt, Human
ccugccugccccacugugcugg

SEQ ID NO: 24044 - RNA, 21 nt, Human
aagaaaacagaaaggagcagc

SEQ ID NO: 24045 - RNA, 27 nt, Human
cggcaggcggaggcgcgguccgggcgc

SEQ ID NO: 24046 - RNA, 27 nt, Human
gccuuucucucuuucucuuaauaagcc

SEQ ID NO: 24047 - RNA, 20 nt, Human
auaugaucuuaaaugaugaa

SEQ ID NO: 24048 - RNA, 26 nt, Human
gggaggaagagagagacuguggagcu

SEQ ID NO: 24049 - RNA, 23 nt, Human
aacucacuguaaccuccgccucc

SEQ ID NO: 24050 - RNA, 22 nt, Human
uuucaauaaaccuuuugauauu

SEQ ID NO: 24051 - RNA, 20 nt, Human
cggcgaucucuaagcgcugc

SEQ ID NO: 24052 - RNA, 25 nt, Human
uaagacaguuuauuagaaauagcau

SEQ ID NO: 24053 - RNA, 27 nt, Human
ccuccugcccuugcuagggucugagcc

SEQ ID NO: 24054 - RNA, 17 nt, Human
gcaaagagaauauggca

SEQ ID NO: 24055 - RNA, 26 nt, Human
cacuguacuccagccuggaugacaga

SEQ ID NO: 24056 - RNA, 26 nt, Human
cacugcacuccagucuggaugacaga

SEQ ID NO: 24057 - RNA, 25 nt, Human
gugucucucacaccacauuuccuca

SEQ ID NO: 24058 - RNA, 21 nt, Human
acacuccucaucaauucucag

SEQ ID NO: 24059 - RNA, 21 nt, Human
uucugguuuuaauuuaaagga

SEQ ID NO: 24060 - RNA, 22 nt, Human
acccaggcuggagugcuauggc

SEQ ID NO: 24061 - RNA, 23 nt, Human
uuuaagaguauuuucugguaaaa

SEQ ID NO: 24062 - RNA, 24 nt, Human
caggaaguuaccuuccuggugcac

SEQ ID NO: 24063 - RNA, 20 nt, Human
uucugucucuuucugaguca

SEQ ID NO: 24064 - RNA, 21 nt, Human
ggccccuggccgcggcagagc

SEQ ID NO: 24065 - RNA, 27 nt, Human
cuggcaauauuacaauccuugaccuca

SEQ ID NO: 24066 - RNA, 22 nt, Human
uuccuguucugacagcugagga

SEQ ID NO: 24067 - RNA, 21 nt, Human
ucacccaggcugaagugcagu

SEQ ID NO: 24068 - RNA, 22 nt, Human
ucgccaggcuggaguguagugg

SEQ ID NO: 24069 - RNA, 20 nt, Human
acaucacuacaaaaagaagg

SEQ ID NO: 24070 - RNA, 27 nt, Human
guuucacuauguugccuaagcuggucu

SEQ ID NO: 24071 - RNA, 26 nt, Human
gggaguuagagguugcagugagcuga

SEQ ID NO: 24072 - RNA, 25 nt, Human
cuaggagaaccaaaucuggaagcca

SEQ ID NO: 24073 - RNA, 18 nt, Human
uagagugguaaacucucu

SEQ ID NO: 24074 - RNA, 23 nt, Human
gccugucccagccuccuggcccc

SEQ ID NO: 24075 - RNA, 22 nt, Human
ggccacugaaagagugugcagu

SEQ ID NO: 24076 - RNA, 25 nt, Human
ggccagggccuggugugaggcuggg

SEQ ID NO: 24077 - RNA, 23 nt, Human
gaagaacaaaagcauuuggaagu

SEQ ID NO: 24078 - RNA, 24 nt, Human
acaucccugaagcuagucuccugu

SEQ ID NO: 24079 - RNA, 27 nt, Human
accucaagcccugaggggcagucccaa

SEQ ID NO: 24080 - RNA, 22 nt, Human
uauuuuaaaaucaaucuuccua

SEQ ID NO: 24081 - RNA, 22 nt, Human
gcccaggcuggagugcaaugcc

SEQ ID NO: 24082 - RNA, 23 nt, Human
ggagguggguguuugggaaaggc

SEQ ID NO: 24083 - RNA, 22 nt, Human
cauccaggcuggagugcggugg

SEQ ID NO: 24084 - RNA, 22 nt, Human
cguccaggcuggagugcagugg

SEQ ID NO: 24085 - RNA, 27 nt, Human
caggaugaacaugcaaacaaagacugg

SEQ ID NO: 24086 - RNA, 20 nt, Human
ccugcuguagugccuucugc

SEQ ID NO: 24087 - RNA, 30 nt, Human
acaccuuuucagguuggagugcauucauuc

SEQ ID NO: 24088 - RNA, 22 nt, Human
agcaguuucccacuugccaaag

SEQ ID NO: 24089 - RNA, 19 nt, Human
uguccucuccccucugccc

SEQ ID NO: 24090 - RNA, 28 nt, Human
uuaaaugaaauauucuauagaaucgauc

SEQ ID NO: 24091 - RNA, 22 nt, Human
ccagcccugccccugccuccug

SEQ ID NO: 24092 - RNA, 26 nt, Human
ccacaggcacacaggucucauugcuu

SEQ ID NO: 24093 - RNA, 26 nt, Human
acuguccuuggguuuaaugacgucuc

SEQ ID NO: 24094 - RNA, 26 nt, Human
gaggacagcugcagagguggcagugu

SEQ ID NO: 24095 - RNA, 24 nt, Human
uauuucuugaauucagacacuaca

SEQ ID NO: 24096 - RNA, 27 nt, Human
cacuacccucuuuccuagggcauaguc

SEQ ID NO: 24097 - RNA, 21 nt, Human
cugucccucuuugccugugug

SEQ ID NO: 24098 - RNA, 21 nt, Human
gugauuucuuuucuucuugau

SEQ ID NO: 24099 - RNA, 21 nt, Human
cucccaaaccaugucaggacc

SEQ ID NO: 24100 - RNA, 19 nt, Human
ucugcuguugaguccuggg

SEQ ID NO: 24101 - RNA, 28 nt, Human
ggcaggauugggcuuuucuggcuucuac

SEQ ID NO: 24102 - RNA, 18 nt, Human
caguaaucaaaaugugau

SEQ ID NO: 24103 - RNA, 23 nt, Human
aggccagccugguagaccucugg

SEQ ID NO: 24104 - RNA, 20 nt, Human
agucaaggcccuucaugacc

SEQ ID NO: 24105 - RNA, 27 nt, Human
caggcuggagugcaauggcacgaucuc

SEQ ID NO: 24106 - RNA, 21 nt, Human
uuacucuuauucuuagcugua

SEQ ID NO: 24107 - RNA, 20 nt, Human
ucucgcccagcucacccucu

SEQ ID NO: 24108 - RNA, 27 nt, Human
uggccuuaaacauugagaagugcugcu

SEQ ID NO: 24109 - RNA, 24 nt, Human
ugaagaccaaaugauagaacugua

SEQ ID NO: 24110 - RNA, 23 nt, Human
ucuccccuuggcgucugaugacc

SEQ ID NO: 24111 - RNA, 22 nt, Human
auguguauucagagugaagauu

SEQ ID NO: 24112 - RNA, 20 nt, Human
uguguccgugggugugcagu

SEQ ID NO: 24113 - RNA, 25 nt, Human
uggauugacuuuggaaaaucuacac

SEQ ID NO: 24114 - RNA, 21 nt, Human
aagccauuaagggggcucauc

SEQ ID NO: 24115 - RNA, 22 nt, Human
ucuccuucccccuaccugggcc

SEQ ID NO: 24116 - RNA, 20 nt, Human
ccucucucaggccaaacuca

SEQ ID NO: 24117 - RNA, 24 nt, Human
cacuuccugggaguucaggaacug

SEQ ID NO: 24118 - RNA, 26 nt, Human
cacuuccuucaagaaaacaagcagcu

SEQ ID NO: 24119 - RNA, 22 nt, Human
uuuacuuuccgggcaagugaau

SEQ ID NO: 24120 - RNA, 21 nt, Human
gucugacuccuggguucuagg

SEQ ID NO: 24121 - RNA, 24 nt, Human
gugccaccuccacagugggagcca

SEQ ID NO: 24122 - RNA, 27 nt, Human
ccaacccaugcccgcuagaaaccugcu

SEQ ID NO: 24123 - RNA, 25 nt, Human
uuguaugauuuauacuaagcauuaa

SEQ ID NO: 24124 - RNA, 27 nt, Human
aguucacauuuuguacuucugucaugc

SEQ ID NO: 24125 - RNA, 20 nt, Human
aggcuccacagagcacauga

SEQ ID NO: 24126 - RNA, 21 nt, Human
acugaaccgccgcuacaagcc

SEQ ID NO: 24127 - RNA, 19 nt, Human
accuguaauauacauagua

SEQ ID NO: 24128 - RNA, 26 nt, Human
caagagaaaucaggugacuugcccaa

SEQ ID NO: 24129 - RNA, 25 nt, Human
cacugggccggccacagucuggacc

SEQ ID NO: 24130 - RNA, 21 nt, Human
ccuaagagucuucccugccug

SEQ ID NO: 24131 - RNA, 26 nt, Human
ccccuguucugcucucucagucaaca

SEQ ID NO: 24132 - RNA, 24 nt, Human
ggagcaguuuuugggguuugaugc

SEQ ID NO: 24133 - RNA, 21 nt, Human
acggccaacgguggauuaucc

SEQ ID NO: 24134 - RNA, 23 nt, Human
aguaagacauugggucuauucca

SEQ ID NO: 24135 - RNA, 23 nt, Human
ucauguacuuaauaacacuucac

SEQ ID NO: 24136 - RNA, 22 nt, Human
auagauucaugugaugccuugu

SEQ ID NO: 24137 - RNA, 22 nt, Human
gacucacugucaacaacauccc

SEQ ID NO: 24138 - RNA, 22 nt, Human
cggggaggggcagagaggaagu

SEQ ID NO: 24139 - RNA, 25 nt, Human
ggagaacuauuuauuauacacucca

SEQ ID NO: 24140 - RNA, 27 nt, Human
uaguaaaguuuucagggaaacugacug

SEQ ID NO: 24141 - RNA, 27 nt, Human
cuuguccaucauuugcugaaguggacc

SEQ ID NO: 24142 - RNA, 26 nt, Human
ucuucuuuguuguguccucgaauggc

SEQ ID NO: 24143 - RNA, 24 nt, Human
guggagcuuccccaagggagccag

SEQ ID NO: 24144 - RNA, 21 nt, Human
uggaauguuuuaacugcagcc

SEQ ID NO: 24145 - RNA, 19 nt, Human
ucuguucuuucuggcagcu

SEQ ID NO: 24146 - RNA, 22 nt, Human
acucugaccccagcauucucag

SEQ ID NO: 24147 - RNA, 25 nt, Human
ugacucuaccuccagguuuaccaua

SEQ ID NO: 24148 - RNA, 22 nt, Human
gcugggagaggggaacguggga

SEQ ID NO: 24149 - RNA, 21 nt, Human
gauaaaccagacagggaggaa

SEQ ID NO: 24150 - RNA, 23 nt, Human
ucccuaguggcuuccuccgucug

SEQ ID NO: 24151 - RNA, 14 nt, Human
caccccuuacccca

SEQ ID NO: 24152 - RNA, 22 nt, Human
ggaaaguaaugguaguucaugu

SEQ ID NO: 24153 - RNA, 26 nt, Human
ccaacaaccugguguaugacaccucg

SEQ ID NO: 24154 - RNA, 21 nt, Human
augaugggacagcaguuccuu

SEQ ID NO: 24155 - RNA, 23 nt, Human
aucuaguguagcagccuccaggc

SEQ ID NO: 24156 - RNA, 21 nt, Human
aagguuuuuguucaagagcca

SEQ ID NO: 24157 - RNA, 27 nt, Human
cauuguacuccagccugggcaacaaga

SEQ ID NO: 24158 - RNA, 28 nt, Human
acacacacaugcuucccuuuccugaguc

SEQ ID NO: 24159 - RNA, 27 nt, Human
gcugccucucuucugugucguuuuguu

SEQ ID NO: 24160 - RNA, 23 nt, Human
cagggagguagagguugcaguga

SEQ ID NO: 24161 - RNA, 25 nt, Human
guuuccccauuauaccuccuucacc

SEQ ID NO: 24162 - RNA, 21 nt, Human
gccgcugccggccccuccuca

SEQ ID NO: 24163 - RNA, 22 nt, Human
uuuauuccuuguaauuaaguca

SEQ ID NO: 24164 - RNA, 22 nt, Human
aaaaagccacgucgugcugcug

SEQ ID NO: 24165 - RNA, 21 nt, Human
ucccuguuagcauuccccggg

SEQ ID NO: 24166 - RNA, 27 nt, Human
uuucugcugcacucacaggauccugag

SEQ ID NO: 24167 - RNA, 21 nt, Human
uuggguccugcuccucaggcc

SEQ ID NO: 24168 - RNA, 24 nt, Human
cucuaaggaguccuccugccuucu

SEQ ID NO: 24169 - RNA, 21 nt, Human
uucaguauuucugaauacuua

SEQ ID NO: 24170 - RNA, 20 nt, Human
uggcguaguguaggccagac

SEQ ID NO: 24171 - RNA, 21 nt, Human
ccaaaaacaauaccaaaaaga

SEQ ID NO: 24172 - RNA, 26 nt, Human
cagccccucucacaggcagcucugag

SEQ ID NO: 24173 - RNA, 21 nt, Human
gguagugcuggcuccagguga

SEQ ID NO: 24174 - RNA, 22 nt, Human
ugucaaccgggcuggagugcag

SEQ ID NO: 24175 - RNA, 26 nt, Human
caggagccagcauacuuccugaacau

SEQ ID NO: 24176 - RNA, 25 nt, Human
caaucucggcucacugcauccucug

SEQ ID NO: 24177 - RNA, 18 nt, Human
uauggaagaauggggugg

SEQ ID NO: 24178 - RNA, 25 nt, Human
aaaaguguuauuucucuuguccaca

SEQ ID NO: 24179 - RNA, 20 nt, Human
gcuuguauuuuaaaaggagg

SEQ ID NO: 24180 - RNA, 27 nt, Human
cuggcaggcgggggaggcugcaggcuc

SEQ ID NO: 24181 - RNA, 27 nt, Human
aaccaaaacuaguucaaaugaugaaga

SEQ ID NO: 24182 - RNA, 27 nt, Human
ucuuuauuuucccuuguggauaugcug

SEQ ID NO: 24183 - RNA, 23 nt, Human
gugugggaccaggaugucuuuuc

SEQ ID NO: 24184 - RNA, 20 nt, Human
agcaucugcaugugaacacc

SEQ ID NO: 24185 - RNA, 22 nt, Human
cacaacugcacuccagcuuggg

SEQ ID NO: 24186 - RNA, 21 nt, Human
uucaaaccuaccggcuuccug

SEQ ID NO: 24187 - RNA, 26 nt, Human
ucugagaugauggcucugggcgcagc

SEQ ID NO: 24188 - RNA, 26 nt, Human
guaaagugccuagggcccaucaaugu

SEQ ID NO: 24189 - RNA, 20 nt, Human
aaacacacacaucucacuca

SEQ ID NO: 24190 - RNA, 21 nt, Human
cgcccccagcugugaccgugg

SEQ ID NO: 24191 - RNA, 24 nt, Human
cacuugaggucaggaguucgagac

SEQ ID NO: 24192 - RNA, 20 nt, Human
uguggagggagggcagcugg

SEQ ID NO: 24193 - RNA, 26 nt, Human
agaagcagugggacugcuuccuugac

SEQ ID NO: 24194 - RNA, 23 nt, Human
ggacuggugcuaaccaccugcca

SEQ ID NO: 24195 - RNA, 26 nt, Human
accauccugaagaaguucaaugggga

SEQ ID NO: 24196 - RNA, 21 nt, Human
aacuuccagaccagccccucu

SEQ ID NO: 24197 - RNA, 22 nt, Human
uggcucacaccuguaauuccag

SEQ ID NO: 24198 - RNA, 22 nt, Human
uggcucacaucuguaaucccag

SEQ ID NO: 24199 - RNA, 19 nt, Human
cugcagcuccucaagcacc

SEQ ID NO: 24200 - RNA, 28 nt, Human
gccagcgacugucucagacugggcaggg

SEQ ID NO: 24201 - RNA, 23 nt, Human
gcugggagcgagcaagcgagcgu

SEQ ID NO: 24202 - RNA, 22 nt, Human
cagggauggggacagggugggu

SEQ ID NO: 24203 - RNA, 26 nt, Human
caguucucaugacuccuacuuuucau

SEQ ID NO: 24204 - RNA, 24 nt, Human
guuaaaugaacaguaauugccugg

SEQ ID NO: 24205 - RNA, 22 nt, Human
auuauuugucucagaucccaga

SEQ ID NO: 24206 - RNA, 20 nt, Human
auggggucuccacagccuga

SEQ ID NO: 24207 - RNA, 26 nt, Human
ucuguuuuguuaaugcagcugugcca

SEQ ID NO: 24208 - RNA, 22 nt, Human
gcgugagacccugucucaaaga

SEQ ID NO: 24209 - RNA, 20 nt, Human
acuggagcaaauagccaagg

SEQ ID NO: 24210 - RNA, 25 nt, Human
cacagccguguguucaaauguacag

SEQ ID NO: 24211 - RNA, 22 nt, Human
ugaucaauucuuuaauuuugga

SEQ ID NO: 24212 - RNA, 25 nt, Human
ggcauggugccugggcugccgggaa

SEQ ID NO: 24213 - RNA, 22 nt, Human
acuguuucugguaaugaagcag

SEQ ID NO: 24214 - RNA, 22 nt, Human
gcaggcaaaagcagcccagucc

SEQ ID NO: 24215 - RNA, 22 nt, Human
guugcccaggcuggaguacaau

SEQ ID NO: 24216 - RNA, 19 nt, Human
uaagcacauuggugaccuu

SEQ ID NO: 24217 - RNA, 20 nt, Human
uuuuuuccuguuugggaaga

SEQ ID NO: 24218 - RNA, 20 nt, Human
acaggccacaccacagcaga

SEQ ID NO: 24219 - RNA, 24 nt, Human
cugcagggccucagccucaggaug

SEQ ID NO: 24220 - RNA, 26 nt, Human
gucugugugugaccccuccuggggcc

SEQ ID NO: 24221 - RNA, 24 nt, Human
uacuacuuuaaaacuaaacugaac

SEQ ID NO: 24222 - RNA, 23 nt, Human
uuggccaagaucugcucaucguc

SEQ ID NO: 24223 - RNA, 23 nt, Human
gccugggugccuggcuggcugag

SEQ ID NO: 24224 - RNA, 21 nt, Human
ccuaucucucacucuggaccc

SEQ ID NO: 24225 - RNA, 23 nt, Human
uuaaaaauagucuuccacaaaaa

SEQ ID NO: 24226 - RNA, 23 nt, Human
uuuucuuuuguuucucucucccc

SEQ ID NO: 24227 - RNA, 22 nt, Human
uucagucucaguggcucagccu

SEQ ID NO: 24228 - RNA, 21 nt, Human
ucacauacagcuucagcugcc

SEQ ID NO: 24229 - RNA, 28 nt, Human
uacaggaagucccuugccauccuaaaag

SEQ ID NO: 24230 - RNA, 27 nt, Human
ugccagcucuguucugauucaccaggg

SEQ ID NO: 24231 - RNA, 20 nt, Human
gauuucccuguagaaaguga

SEQ ID NO: 24232 - RNA, 21 nt, Human
ugaccagcguugcccauuuga

SEQ ID NO: 24233 - RNA, 21 nt, Human
cccucacugcccacucugccc

SEQ ID NO: 24234 - RNA, 24 nt, Human
gugucuggaggggguuugugccug

SEQ ID NO: 24235 - RNA, 23 nt, Human
ugggcagcagcucaguugaguua

SEQ ID NO: 24236 - RNA, 23 nt, Human
cgccucucgccucacgcccccag

SEQ ID NO: 24237 - RNA, 21 nt, Human
guuugucuucuccccaggguu

SEQ ID NO: 24238 - RNA, 19 nt, Human
cauugcugagccagaguca

SEQ ID NO: 24239 - RNA, 25 nt, Human
gggggcggggacggcgcuggagggg

SEQ ID NO: 24240 - RNA, 28 nt, Human
gugaaccaagaucuauaaagcgauauac

SEQ ID NO: 24241 - RNA, 24 nt, Human
caguggugugaucccagcucacug

SEQ ID NO: 24242 - RNA, 29 nt, Human
gggagccgccagcccugccugcggauccc

SEQ ID NO: 24243 - RNA, 19 nt, Human
uguucaaagaguccugguc

SEQ ID NO: 24244 - RNA, 22 nt, Human
gcaaaacucaggcagaagugga

SEQ ID NO: 24245 - RNA, 22 nt, Human
ugcuucaaccugggaggcagag

SEQ ID NO: 24246 - RNA, 21 nt, Human
ggggccccccucugcuccagc

SEQ ID NO: 24247 - RNA, 19 nt, Human
gugccuuaaggaacccgcc

SEQ ID NO: 24248 - RNA, 24 nt, Human
cacacugacggggggaccuaguga

SEQ ID NO: 24249 - RNA, 21 nt, Human
ggcuuuggaagagaaggugag

SEQ ID NO: 24250 - RNA, 22 nt, Human
gauuucaggagauugugcagug

SEQ ID NO: 24251 - RNA, 20 nt, Human
accacuaccagccagccucc

SEQ ID NO: 24252 - RNA, 21 nt, Human
guacuauauacuauuaccuuu

SEQ ID NO: 24253 - RNA, 27 nt, Human
aacaauguguuuucuagugugucgagg

SEQ ID NO: 24254 - RNA, 24 nt, Human
gagagggagaagaguggucucagc

SEQ ID NO: 24255 - RNA, 25 nt, Human
ggcgcgccugccuuuucuaguuuua

SEQ ID NO: 24256 - RNA, 26 nt, Human
gucuucauaugucaacuacagaaaag

SEQ ID NO: 24257 - RNA, 24 nt, Human
caggcugccaggcuggaguggagu

SEQ ID NO: 24258 - RNA, 21 nt, Human
ggucagauguacucucuguca

SEQ ID NO: 24259 - RNA, 19 nt, Human
guuuuaaaaauaaguuuua

SEQ ID NO: 24260 - RNA, 25 nt, Human
cccuccauccagccuggcguccagg

SEQ ID NO: 24261 - RNA, 15 nt, Human
uccauaaaauccuua

SEQ ID NO: 24262 - RNA, 22 nt, Human
cagcagaagaacuaacauaacu

SEQ ID NO: 24263 - RNA, 27 nt, Human
agguuugcagggucagggaggaggaac

SEQ ID NO: 24264 - RNA, 20 nt, Human
gacaucucauccauucucau

SEQ ID NO: 24265 - RNA, 21 nt, Human
ggccuuugugcucccaccucu

SEQ ID NO: 24266 - RNA, 21 nt, Human
gucaccucccuacuccuguca

SEQ ID NO: 24267 - RNA, 20 nt, Human
uuugagagucaggggagggg

SEQ ID NO: 24268 - RNA, 21 nt, Human
agccuccugucucaucuggaa

SEQ ID NO: 24269 - RNA, 23 nt, Human
ugucauauccagacuggaggccg

SEQ ID NO: 24270 - RNA, 21 nt, Human
uucaaagcuuuuugcuaccaa

SEQ ID NO: 24271 - RNA, 21 nt, Human
uaccuaccacaugccaagcac

SEQ ID NO: 24272 - RNA, 23 nt, Human
gccucucugugccgcuucauuug

SEQ ID NO: 24273 - RNA, 23 nt, Human
augccaccaccacugccaagcag

SEQ ID NO: 24274 - RNA, 27 nt, Human
aguguuuucacagguucuccuccuuuu

SEQ ID NO: 24275 - RNA, 21 nt, Human
aucccagggcauuguaccaag

SEQ ID NO: 24276 - RNA, 23 nt, Human
aucaaugcuuuauuucaggccga

SEQ ID NO: 24277 - RNA, 26 nt, Human
aguauuucauaaugaucugcaucagu

SEQ ID NO: 24278 - RNA, 17 nt, Human
agagagaucuuacuaga

SEQ ID NO: 24279 - RNA, 22 nt, Human
ccccuguaaucucagcacuuug

SEQ ID NO: 24280 - RNA, 22 nt, Human
uuauguagcugaaacaaaaaug

SEQ ID NO: 24281 - RNA, 23 nt, Human
cuuguuuuuaaauaacuuccuca

SEQ ID NO: 24282 - RNA, 27 nt, Human
ggggugagggacagagccccacgcugu

SEQ ID NO: 24283 - RNA, 22 nt, Human
gccgccgccucugcccgcccgg

SEQ ID NO: 24284 - RNA, 22 nt, Human
agauacuguuguggucaccucu

SEQ ID NO: 24285 - RNA, 20 nt, Human
aaaugauuugucgccugucu

SEQ ID NO: 24286 - RNA, 23 nt, Human
agauggggccuuugguaagggaa

SEQ ID NO: 24287 - RNA, 27 nt, Human
gaguagcugggauuacaggcgccugcc

SEQ ID NO: 24288 - RNA, 23 nt, Human
acugaugcugccccucaucucuc

SEQ ID NO: 24289 - RNA, 20 nt, Human
cauuccccgcccucugacag

SEQ ID NO: 24290 - RNA, 27 nt, Human
aagcaaaacaaauaaaacguuuauaaa

SEQ ID NO: 24291 - RNA, 23 nt, Human
cagucccaugccccacacucuga

SEQ ID NO: 24292 - RNA, 27 nt, Human
uggcuggagugccucucuggucugggg

SEQ ID NO: 24293 - RNA, 27 nt, Human
gccccaaacuccucggccucacuggga

SEQ ID NO: 24294 - RNA, 20 nt, Human
guuuggaaacuucuccuuca

SEQ ID NO: 24295 - RNA, 21 nt, Human
ggaagugcugggauuacaggc

SEQ ID NO: 24296 - RNA, 21 nt, Human
agcauaaggaagacuugcucc

SEQ ID NO: 24297 - RNA, 23 nt, Human
ggucuccagggcucugggcuggc

SEQ ID NO: 24298 - RNA, 24 nt, Human
aagcaggcuacacugacacuggua

SEQ ID NO: 24299 - RNA, 20 nt, Human
ggggaggggggaggggaagc

SEQ ID NO: 24300 - RNA, 22 nt, Human
aagaaagagaaaugaugcagcu

SEQ ID NO: 24301 - RNA, 27 nt, Human
uuuucucuugguuguagaguggcccag

SEQ ID NO: 24302 - RNA, 26 nt, Human
cuguucugcugcaccugaaugcuuuc

SEQ ID NO: 24303 - RNA, 21 nt, Human
cagcugagccugucucucacg

SEQ ID NO: 24304 - RNA, 22 nt, Human
ggccucccaaagcucucuggca

SEQ ID NO: 24305 - RNA, 19 nt, Human
ggcuguggcccugccucac

SEQ ID NO: 24306 - RNA, 19 nt, Human
gagacauugauuggugagg

SEQ ID NO: 24307 - RNA, 27 nt, Human
aguccuccagccucggccucccaaagu

SEQ ID NO: 24308 - RNA, 21 nt, Human
caaccucaccagggcugucuc

SEQ ID NO: 24309 - RNA, 23 nt, Human
ucucauaacucugugaucuugcu

SEQ ID NO: 24310 - RNA, 30 nt, Human
ucugggggcugggugaggccacucaugccu

SEQ ID NO: 24311 - RNA, 22 nt, Human
gcccccucccccuucccggguu

SEQ ID NO: 24312 - RNA, 24 nt, Human
uggacuuagagauuucagacacag

SEQ ID NO: 24313 - RNA, 20 nt, Human
uucuguugcccuugugcucc

SEQ ID NO: 24314 - RNA, 22 nt, Human
cucacagucuuaaaccgugcca

SEQ ID NO: 24315 - RNA, 27 nt, Human
cuguacagaaucgagugcuguagccug

SEQ ID NO: 24316 - RNA, 25 nt, Human
ccagggcuccaaaucugccuagaaa

SEQ ID NO: 24317 - RNA, 23 nt, Human
caguaacuuugcaaaagcauuaa

SEQ ID NO: 24318 - RNA, 24 nt, Human
ccuucuggcccccugccuggagca

SEQ ID NO: 24319 - RNA, 23 nt, Human
cucacccuggggccagagugggc

SEQ ID NO: 24320 - RNA, 23 nt, Human
gggccuggcugggccagacccca

SEQ ID NO: 24321 - RNA, 22 nt, Human
ggggugagggaguuagggagag

SEQ ID NO: 24322 - RNA, 17 nt, Human
cugcccuaccagccugc

SEQ ID NO: 24323 - RNA, 23 nt, Human
aggccaaggaugcccaccugucc

SEQ ID NO: 24324 - RNA, 19 nt, Human
gauuacacuccagccugag

SEQ ID NO: 24325 - RNA, 24 nt, Human
aacuauauaaagacauaugcagua

SEQ ID NO: 24326 - RNA, 23 nt, Human
aggcuggagggcaguggcacgau

SEQ ID NO: 24327 - RNA, 26 nt, Human
acuguagcuaauucuagaugcccuuc

SEQ ID NO: 24328 - RNA, 22 nt, Human
ugggcacugccugcccuucuag

SEQ ID NO: 24329 - RNA, 23 nt, Human
cuuccacaaagagcuuaauccuc

SEQ ID NO: 24330 - RNA, 17 nt, Human
ucauccagcaaccagga

SEQ ID NO: 24331 - RNA, 19 nt, Human
ggagggugcugggagcugg

SEQ ID NO: 24332 - RNA, 23 nt, Human
gggaggcgggggcugcccuuggg

SEQ ID NO: 24333 - RNA, 22 nt, Human
ggcagccuucugggcagaccuu

SEQ ID NO: 24334 - RNA, 28 nt, Human
cuguuaggaagccauucuaaagagaaga

SEQ ID NO: 24335 - RNA, 26 nt, Human
guuuuuaaaaaagugcuucccugcaa

SEQ ID NO: 24336 - RNA, 23 nt, Human
gcuuuccugcgcgcacugcggag

SEQ ID NO: 24337 - RNA, 19 nt, Human
ucucaguggccaucauguc

SEQ ID NO: 24338 - RNA, 27 nt, Human
ccuggaagcucggcgaauucucaggau

SEQ ID NO: 24339 - RNA, 27 nt, Human
cauucacaaaguagcaccaaauaaauu

SEQ ID NO: 24340 - RNA, 21 nt, Human
caccauaguaauacuuauuuu

SEQ ID NO: 24341 - RNA, 24 nt, Human
cugugccguaguuugucuccuggg

SEQ ID NO: 24342 - RNA, 31 nt, Human
uugaccugauuaaucagucagaaagucccua

SEQ ID NO: 24343 - RNA, 22 nt, Human
caggcuggagucagugucugcc

SEQ ID NO: 24344 - RNA, 22 nt, Human
uauugcacuccauccuggauga

SEQ ID NO: 24345 - RNA, 26 nt, Human
cgcugguaaaggucaaauggggucau

SEQ ID NO: 24346 - RNA, 21 nt, Human
agaaacagaagcacagagaug

SEQ ID NO: 24347 - RNA, 15 nt, Human
cuucugcuacccacu

SEQ ID NO: 24348 - RNA, 26 nt, Human
cacuaugucuucaaucccaaaaauua

SEQ ID NO: 24349 - RNA, 24 nt, Human
uuuuacauuuuuccuauucacugc

SEQ ID NO: 24350 - RNA, 20 nt, Human
uuuacugaugacuccuggcu

SEQ ID NO: 24351 - RNA, 19 nt, Human
gggaucuggccuccucaug

SEQ ID NO: 24352 - RNA, 22 nt, Human
ucaggagggcuuccugggaggu

SEQ ID NO: 24353 - RNA, 19 nt, Human
uucacacugugugcugccg

SEQ ID NO: 24354 - RNA, 27 nt, Human
ccuacuucuuugcuuugcccagcauuu

SEQ ID NO: 24355 - RNA, 22 nt, Human
agcuuuuccagaauuuggcugg

SEQ ID NO: 24356 - RNA, 22 nt, Human
uucuuucuucaugacccugccc

SEQ ID NO: 24357 - RNA, 20 nt, Human
cuggaacccagccaguggga

SEQ ID NO: 24358 - RNA, 25 nt, Human
ggcuggaagcacugaaccuaccuca

SEQ ID NO: 24359 - RNA, 23 nt, Human
agccuguggaugaucaauccuuu

SEQ ID NO: 24360 - RNA, 21 nt, Human
ugauguuguauuuuacacucu

SEQ ID NO: 24361 - RNA, 17 nt, Human
ccaugaaccacucccau

SEQ ID NO: 24362 - RNA, 22 nt, Human
gcucuuccucccuucgcucgca

SEQ ID NO: 24363 - RNA, 20 nt, Human
gcagaguggaggccuggacu

SEQ ID NO: 24364 - RNA, 28 nt, Human
accuuugggaaccugcugugagagugcu

SEQ ID NO: 24365 - RNA, 21 nt, Human
ggccugccacccagagccaag

SEQ ID NO: 24366 - RNA, 20 nt, Human
ccuguuccuguguccccucc

SEQ ID NO: 24367 - RNA, 21 nt, Human
uuucuguuuucuucucagucu

SEQ ID NO: 24368 - RNA, 25 nt, Human
gaguauuauuauuuuaaaaauugca

SEQ ID NO: 24369 - RNA, 21 nt, Human
guguguggagugcccugcugc

SEQ ID NO: 24370 - RNA, 25 nt, Human
aauaucggguuggccauucuuuuug

SEQ ID NO: 24371 - RNA, 26 nt, Human
uccaaacuuuugcagaaaaaacaaaa

SEQ ID NO: 24372 - RNA, 24 nt, Human
ccaagucacagccacucagaugcu

SEQ ID NO: 24373 - RNA, 22 nt, Human
ggucucaaaccccggaccucag

SEQ ID NO: 24374 - RNA, 19 nt, Human
gauggagauauucugucaa

SEQ ID NO: 24375 - RNA, 25 nt, Human
caucgcugucacaggcgguuaugaa

SEQ ID NO: 24376 - RNA, 29 nt, Human
guuaccuucuggguuuccacauuuuuauu

SEQ ID NO: 24377 - RNA, 22 nt, Human
acacauuuaucauuuaaugcau

SEQ ID NO: 24378 - RNA, 23 nt, Human
agcaagagaaucagcuuugggca

SEQ ID NO: 24379 - RNA, 25 nt, Human
uggguuccuggauggugggauuguu

SEQ ID NO: 24380 - RNA, 23 nt, Human
uuuguuccuaucuucuaaaggaa

SEQ ID NO: 24381 - RNA, 25 nt, Human
ggugcccgagccucucagggccaga

SEQ ID NO: 24382 - RNA, 21 nt, Human
caccauguacauggcugguau

SEQ ID NO: 24383 - RNA, 25 nt, Human
cuaucuagcaugcagaguguagugu

SEQ ID NO: 24384 - RNA, 26 nt, Human
cccaagaaguagacaucaaaaauuaa

SEQ ID NO: 24385 - RNA, 25 nt, Human
auauguaaaauuacacuuugaacua

SEQ ID NO: 24386 - RNA, 26 nt, Human
augcccaggagacugguuucccggug

SEQ ID NO: 24387 - RNA, 23 nt, Human
gagacccccaucucuacaaaaaa

SEQ ID NO: 24388 - RNA, 22 nt, Human
ccaacguggagaaaccccaucu

SEQ ID NO: 24389 - RNA, 21 nt, Human
cacugcauuucauaucacacu

SEQ ID NO: 24390 - RNA, 20 nt, Human
cgggccgcugggaacuccac

SEQ ID NO: 24391 - RNA, 22 nt, Human
ggacuccugcuaguccccucuu

SEQ ID NO: 24392 - RNA, 23 nt, Human
cgcugcugagcugagcuggggcg

SEQ ID NO: 24393 - RNA, 25 nt, Human
ggcuuggaaaucuuccauuucucuu

SEQ ID NO: 24394 - RNA, 21 nt, Human
uuuggacgcguuccugcccag

SEQ ID NO: 24395 - RNA, 20 nt, Human
aucaaauuagugaacugaga

SEQ ID NO: 24396 - RNA, 19 nt, Human
cucccucucugggcauguc

SEQ ID NO: 24397 - RNA, 22 nt, Human
ccuugcuuuaacauuaucucca

SEQ ID NO: 24398 - RNA, 20 nt, Human
aaagccugcauguaagaaca

SEQ ID NO: 24399 - RNA, 26 nt, Human
ggaagauuggguaaugcugauguguu

SEQ ID NO: 24400 - RNA, 22 nt, Human
aggagggagagaaggaggccgc

SEQ ID NO: 24401 - RNA, 22 nt, Human
uuuucucaguugaagaagagaa

SEQ ID NO: 24402 - RNA, 20 nt, Human
gcgacaaguccaucagcaga

SEQ ID NO: 24403 - RNA, 25 nt, Human
cuggaguccacagcgccuccggugu

SEQ ID NO: 24404 - RNA, 24 nt, Human
gguggcgggcaccuguagucccag

SEQ ID NO: 24405 - RNA, 22 nt, Human
ggaguaaccaauuucuuucuaa

SEQ ID NO: 24406 - RNA, 22 nt, Human
gguucaagcgauucucuugccu

SEQ ID NO: 24407 - RNA, 29 nt, Human
gagcaaagcauggauucaaacuuagguga

SEQ ID NO: 24408 - RNA, 26 nt, Human
ugacacugcacuaggauuauugggaa

SEQ ID NO: 24409 - RNA, 24 nt, Human
gggggcuuaccagcaaagccauau

SEQ ID NO: 24410 - RNA, 22 nt, Human
uccagagcugaggaguggugcc

SEQ ID NO: 24411 - RNA, 18 nt, Human
ccaggcuggaggucagug

SEQ ID NO: 24412 - RNA, 19 nt, Human
uaucccauugaaacaaaac

SEQ ID NO: 24413 - RNA, 17 nt, Human
ccuccacccucccuccc

SEQ ID NO: 24414 - RNA, 20 nt, Human
aggcccagcagacuugaguc

SEQ ID NO: 24415 - RNA, 20 nt, Human
gaacucugucuuucucaguu

SEQ ID NO: 24416 - RNA, 24 nt, Human
cucuuucaucaaaacaaaacagca

SEQ ID NO: 24417 - RNA, 21 nt, Human
ccccagccuccugcagaguug

SEQ ID NO: 24418 - RNA, 27 nt, Human
gucccaggcugagccucagucucccuc

SEQ ID NO: 24419 - RNA, 20 nt, Human
acuauuuaaaaaugaaauua

SEQ ID NO: 24420 - RNA, 23 nt, Human
cgcggcuuccugccuccaugcca

SEQ ID NO: 24421 - RNA, 25 nt, Human
gagcagccuggcaacggcgguggcg

SEQ ID NO: 24422 - RNA, 24 nt, Human
ccuaaagccuccuguuccaccuca

SEQ ID NO: 24423 - RNA, 24 nt, Human
cgggaccuucagacccagggaaag

SEQ ID NO: 24424 - RNA, 23 nt, Human
gcuggggcaagaugaggcaccag

SEQ ID NO: 24425 - RNA, 24 nt, Human
agccuccugucuccagcucucucc

SEQ ID NO: 24426 - RNA, 25 nt, Human
uguuuguacuaccuguuuucugcgg

SEQ ID NO: 24427 - RNA, 24 nt, Human
ccaacagccaguguguguuuccca

SEQ ID NO: 24428 - RNA, 20 nt, Human
cacugccuuuucauaugugu

SEQ ID NO: 24429 - RNA, 21 nt, Human
caguucuggggguuccuguuc

SEQ ID NO: 24430 - RNA, 27 nt, Human
uuuuccccuugauggaaauugaccaua

SEQ ID NO: 24431 - RNA, 22 nt, Human
auggaaaggaaacaaggggaga

SEQ ID NO: 24432 - RNA, 23 nt, Human
uccggcccagcuccaagcccucc

SEQ ID NO: 24433 - RNA, 22 nt, Human
agaaucugguugcuuucuugga

SEQ ID NO: 24434 - RNA, 22 nt, Human
gugggaggcggagguugcagug

SEQ ID NO: 24435 - RNA, 20 nt, Human
agagcauccuccucucaucu

SEQ ID NO: 24436 - RNA, 24 nt, Human
cuccugagcagcucuugguuuugg

SEQ ID NO: 24437 - RNA, 24 nt, Human
uaggagaguucuuuggggugacuu

SEQ ID NO: 24438 - RNA, 25 nt, Human
caagugucaagaucagcaagugucc

SEQ ID NO: 24439 - RNA, 22 nt, Human
guuugcagagagguaacucccu

SEQ ID NO: 24440 - RNA, 20 nt, Human
gagaccaccugcccccaccu

SEQ ID NO: 24441 - RNA, 22 nt, Human
cucaagcaauccuuccaccuca

SEQ ID NO: 24442 - RNA, 27 nt, Human
cgugccaucccucgaauccaccagcac

SEQ ID NO: 24443 - RNA, 23 nt, Human
acaaagcaucucauucauauuac

SEQ ID NO: 24444 - RNA, 22 nt, Human
uuguaguguaaagaaugaucac

SEQ ID NO: 24445 - RNA, 21 nt, Human
uuacaccauuuagaacuuucc

SEQ ID NO: 24446 - RNA, 23 nt, Human
agaucauagaaaccagagccuuc

SEQ ID NO: 24447 - RNA, 32 nt, Human
ucccaguggaggcaucuuacauuuaggcuacu

SEQ ID NO: 24448 - RNA, 22 nt, Human
ccuuagugcuuucuuucuuaac

SEQ ID NO: 24449 - RNA, 23 nt, Human
agagccagccccuuucugcucca

SEQ ID NO: 24450 - RNA, 20 nt, Human
uagugugacccaaauuugua

SEQ ID NO: 24451 - RNA, 28 nt, Human
ccuagguaucagcacauuuacuccuaac

SEQ ID NO: 24452 - RNA, 23 nt, Human
ggcagucuucagccuccucuacc

SEQ ID NO: 24453 - RNA, 22 nt, Human
gcccucugggaucucugguacc

SEQ ID NO: 24454 - RNA, 27 nt, Human
uggccaacauggugaaaccuugucuac

SEQ ID NO: 24455 - RNA, 22 nt, Human
gaacagcuauugaaacuguuaa

SEQ ID NO: 24456 - RNA, 22 nt, Human
guuccugguaaaacucuguuuu

SEQ ID NO: 24457 - RNA, 22 nt, Human
guugcccagacuggagagcagu

SEQ ID NO: 24458 - RNA, 26 nt, Human
cacugcacuccugggcaacagagcaa

SEQ ID NO: 24459 - RNA, 26 nt, Human
uuggggcaguccaagacauagcuggu

SEQ ID NO: 24460 - RNA, 23 nt, Human
cugcaaaggguacagggauugca

SEQ ID NO: 24461 - RNA, 23 nt, Human
aggucccagccccuccucccuca

SEQ ID NO: 24462 - RNA, 25 nt, Human
gaggagauggggacagggcuggagu

SEQ ID NO: 24463 - RNA, 21 nt, Human
uacuguacaugaauuacacaa

SEQ ID NO: 24464 - RNA, 22 nt, Human
uauguauuuauucauuuguuau

SEQ ID NO: 24465 - RNA, 21 nt, Human
agguagagagacacagagcug

SEQ ID NO: 24466 - RNA, 21 nt, Human
ccuccaccccuuccugaagac

SEQ ID NO: 24467 - RNA, 21 nt, Human
acugguggcuaggucuccccu

SEQ ID NO: 24468 - RNA, 21 nt, Human
auguccagugagcaguguugc

SEQ ID NO: 24469 - RNA, 20 nt, Human
uuucauguucuuggaccuuu

SEQ ID NO: 24470 - RNA, 21 nt, Human
cagcccaggcuggagugcagu

SEQ ID NO: 24471 - RNA, 22 nt, Human
gaccagccucgccaacauggug

SEQ ID NO: 24472 - RNA, 25 nt, Human
ucauggaccgagguucccacucugg

SEQ ID NO: 24473 - RNA, 22 nt, Human
gcucuccaccuggacucaggcc

SEQ ID NO: 24474 - RNA, 24 nt, Human
aguccccugcaccccuuccuggga

SEQ ID NO: 24475 - RNA, 22 nt, Human
gguccucagaaggugucaggag

SEQ ID NO: 24476 - RNA, 22 nt, Human
aggaagcugagaagcuggaagc

SEQ ID NO: 24477 - RNA, 23 nt, Human
augacacaacugcacuccagcuu

SEQ ID NO: 24478 - RNA, 24 nt, Human
aucuuuccaaccacaucugcuggc

SEQ ID NO: 24479 - RNA, 27 nt, Human
uggugugaugagcaggaucagagugac

SEQ ID NO: 24480 - RNA, 23 nt, Human
cacugcacauggaccucugggaa

SEQ ID NO: 24481 - RNA, 22 nt, Human
agcaucugcuuuccucuuggcc

SEQ ID NO: 24482 - RNA, 21 nt, Human
acacguaagcacauucgggcc

SEQ ID NO: 24483 - RNA, 20 nt, Human
ugguuaggaagcaauuuccc

SEQ ID NO: 24484 - RNA, 20 nt, Human
uuugcccaguuggagacugu

SEQ ID NO: 24485 - RNA, 21 nt, Human
auuagcaguuuagaauggagg

SEQ ID NO: 24486 - RNA, 25 nt, Human
acccucacucugccagggcagugcu

SEQ ID NO: 24487 - RNA, 21 nt, Human
ccuaccccuccuccaugggcc

SEQ ID NO: 24488 - RNA, 26 nt, Human
cccccucccuuccugcccccagucug

SEQ ID NO: 24489 - RNA, 27 nt, Human
cacugccuuuggggcuggagggagacg

SEQ ID NO: 24490 - RNA, 27 nt, Human
ccuaaaguuacugcugaccuugaagca

SEQ ID NO: 24491 - RNA, 21 nt, Human
aagccuguggcucaccugccu

SEQ ID NO: 24492 - RNA, 22 nt, Human
caggccuguguuugcagcgccu

SEQ ID NO: 24493 - RNA, 25 nt, Human
gaggaagagguugauggcggcggcg

SEQ ID NO: 24494 - RNA, 24 nt, Human
gugccgugcugcgcucaccugccu

SEQ ID NO: 24495 - RNA, 28 nt, Human
aggugugaggacaagaaugcaaauggcu

SEQ ID NO: 24496 - RNA, 26 nt, Human
cacugccucucgcccuguaucuguca

SEQ ID NO: 24497 - RNA, 21 nt, Human
guuuugaaacucuuguauuua

SEQ ID NO: 24498 - RNA, 21 nt, Human
ugcucuuguagcccaggcugg

SEQ ID NO: 24499 - RNA, 24 nt, Human
gguauuugggggacucuguauuug

SEQ ID NO: 24500 - RNA, 31 nt, Human
cgcccggccuccauauccauucuugggaaca

SEQ ID NO: 24501 - RNA, 26 nt, Human
gggaggcagaggcuuggguaaacuca

SEQ ID NO: 24502 - RNA, 18 nt, Human
cugcagcugcuuguuguc

SEQ ID NO: 24503 - RNA, 20 nt, Human
gcccaaauccagugugcacc

SEQ ID NO: 24504 - RNA, 24 nt, Human
agcacuuacccuccacuuccuccu

SEQ ID NO: 24505 - RNA, 21 nt, Human
cugccaccgcugcccgagccc

SEQ ID NO: 24506 - RNA, 27 nt, Human
ccaagcccacauuuccaaagucacccc

SEQ ID NO: 24507 - RNA, 19 nt, Human
uggacaagccuccccaaau

SEQ ID NO: 24508 - RNA, 25 nt, Human
ccugucugugucguucucugugcca

SEQ ID NO: 24509 - RNA, 23 nt, Human
ggcuuggccuugaugaugcagcu

SEQ ID NO: 24510 - RNA, 23 nt, Human
ucuuauagaagcuucagcaggag

SEQ ID NO: 24511 - RNA, 19 nt, Human
uucaugaaagaaaguggaa

SEQ ID NO: 24512 - RNA, 23 nt, Human
aaaauugaagauugggguggugg

SEQ ID NO: 24513 - RNA, 25 nt, Human
ucuguuuuugucuguguccuagguc

SEQ ID NO: 24514 - RNA, 21 nt, Human
uggccagcuaguggaguggag

SEQ ID NO: 24515 - RNA, 24 nt, Human
ugugguauuugauacagcucauca

SEQ ID NO: 24516 - RNA, 29 nt, Human
cugcuauccccaucucccugccuggcccc

SEQ ID NO: 24517 - RNA, 24 nt, Human
ccagugaacaaauccuacucugaa

SEQ ID NO: 24518 - RNA, 21 nt, Human
gucuuguuauguugcccaggc

SEQ ID NO: 24519 - RNA, 23 nt, Human
cagcuuuccuguauuucuuccca

SEQ ID NO: 24520 - RNA, 23 nt, Human
ugcuguuguaaacauauuugaaa

SEQ ID NO: 24521 - RNA, 23 nt, Human
agacccuucucuuaacagagaga

SEQ ID NO: 24522 - RNA, 20 nt, Human
ugaaucaggguuaggcucca

SEQ ID NO: 24523 - RNA, 21 nt, Human
cagguguccacccaauugugg

SEQ ID NO: 24524 - RNA, 26 nt, Human
ggcugccaguagcagacuguuaaauu

SEQ ID NO: 24525 - RNA, 21 nt, Human
cacugcucuccagccugggga

SEQ ID NO: 24526 - RNA, 25 nt, Human
ucugucacacaugcacacaugugcc

SEQ ID NO: 24527 - RNA, 20 nt, Human
ucaagacgggguggggaagg

SEQ ID NO: 24528 - RNA, 25 nt, Human
uccucugaugugaaauuaaaugaag

SEQ ID NO: 24529 - RNA, 26 nt, Human
caaucagcuggguuuacugugauuca

SEQ ID NO: 24530 - RNA, 22 nt, Human
uguagugagcugucauugugcc

SEQ ID NO: 24531 - RNA, 23 nt, Human
uucugucucaaaaaggagagaau

SEQ ID NO: 24532 - RNA, 22 nt, Human
acacagaugcuacagacuugua

SEQ ID NO: 24533 - RNA, 21 nt, Human
gagaggucaagguugcaguga

SEQ ID NO: 24534 - RNA, 26 nt, Human
gccagaccucacccuugaccaaccuc

SEQ ID NO: 24535 - RNA, 23 nt, Human
agcauuuuuucauaugcuucuua

SEQ ID NO: 24536 - RNA, 20 nt, Human
acauaaccgugaagcucuuc

SEQ ID NO: 24537 - RNA, 20 nt, Human
uugccuagcuugccguaaug

SEQ ID NO: 24538 - RNA, 20 nt, Human
gccccaggguuaugagacua

SEQ ID NO: 24539 - RNA, 25 nt, Human
agggaugggacaaagccuucuucaa

SEQ ID NO: 24540 - RNA, 21 nt, Human
auaguuucugaauggaagcac

SEQ ID NO: 24541 - RNA, 21 nt, Human
gaggagcgaucucagcaggcc

SEQ ID NO: 24542 - RNA, 27 nt, Human
gcugugcuggaauuccacagggaccag

SEQ ID NO: 24543 - RNA, 26 nt, Human
cucagugcaaccuccgccuccugggu

SEQ ID NO: 24544 - RNA, 24 nt, Human
acucguguucacucagcacuuucc

SEQ ID NO: 24545 - RNA, 26 nt, Human
uuuauucaagauguuuuaccguaaua

SEQ ID NO: 24546 - RNA, 27 nt, Human
ucaacuugccauacaccucaaauucgg

SEQ ID NO: 24547 - RNA, 23 nt, Human
uucgccucugcugaagucucccc

SEQ ID NO: 24548 - RNA, 24 nt, Human
ggcugggugcagcucucuuuucag

SEQ ID NO: 24549 - RNA, 23 nt, Human
ccaagaguggggaguggggaaga

SEQ ID NO: 24550 - RNA, 22 nt, Human
aacuauucggcaggcugaggca

SEQ ID NO: 24551 - RNA, 22 nt, Human
cugaccuccucugggcccuguc

SEQ ID NO: 24552 - RNA, 22 nt, Human
uguugcuuuguucaguaccuuu

SEQ ID NO: 24553 - RNA, 27 nt, Human
ucuguccagaucugggguugggucaug

SEQ ID NO: 24554 - RNA, 25 nt, Human
ucccaggcuggaggucaguggcaca

SEQ ID NO: 24555 - RNA, 23 nt, Human
aguaucaugcagugcugcccuca

SEQ ID NO: 24556 - RNA, 27 nt, Human
aacuugucauuuuaauuuuguuuaaca

SEQ ID NO: 24557 - RNA, 25 nt, Human
gggagguggugguggguggcggugg

SEQ ID NO: 24558 - RNA, 25 nt, Human
ucugcuccuggguuuuaauuuggga

SEQ ID NO: 24559 - RNA, 27 nt, Human
uucaccgcucauuauguagucuggcua

SEQ ID NO: 24560 - RNA, 31 nt, Human
ugagcgcagaguaaaauaaggcuccuucaug

SEQ ID NO: 24561 - RNA, 21 nt, Human
ccuggaaugaagcauguagcu

SEQ ID NO: 24562 - RNA, 21 nt, Human
gugcccaggcuggagugcaau

SEQ ID NO: 24563 - RNA, 29 nt, Human
ggagggaaguggagguugcuguacaggaa

SEQ ID NO: 24564 - RNA, 28 nt, Human
ccuucugcaaaguggcagggaccggcag

SEQ ID NO: 24565 - RNA, 26 nt, Human
gaggcucaggagaagcucuacaagga

SEQ ID NO: 24566 - RNA, 22 nt, Human
uucuauaaauaacccauucaua

SEQ ID NO: 24567 - RNA, 19 nt, Human
uaagcuuggugcuccggcu

SEQ ID NO: 24568 - RNA, 23 nt, Human
ccugaggacagagaacauggucu

SEQ ID NO: 24569 - RNA, 24 nt, Human
uagaagauugguugcacucccaaa

SEQ ID NO: 24570 - RNA, 27 nt, Human
cauggcauugguaugaaggccauuuag

SEQ ID NO: 24571 - RNA, 22 nt, Human
ccaaagugcugggauuagaggc

SEQ ID NO: 24572 - RNA, 23 nt, Human
uugcccaaggucgcacagcuagu

SEQ ID NO: 24573 - RNA, 19 nt, Human
ccuuccaccugucauuccc

SEQ ID NO: 24574 - RNA, 24 nt, Human
gucuuagaagcuuuauggugauua

SEQ ID NO: 24575 - RNA, 27 nt, Human
gcugaucucucuggguaggugcccucu

SEQ ID NO: 24576 - RNA, 19 nt, Human
gagucuaauggucaagcgc

SEQ ID NO: 24577 - RNA, 27 nt, Human
cagggagggagggugggacacagaggu

SEQ ID NO: 24578 - RNA, 22 nt, Human
gcaccaggcugggaugagcugu

SEQ ID NO: 24579 - RNA, 22 nt, Human
aagcugucacucacaaaaggcu

SEQ ID NO: 24580 - RNA, 20 nt, Human
ucuggagaacuauaccugcu

SEQ ID NO: 24581 - RNA, 21 nt, Human
gcagccccaagccuccugggg

SEQ ID NO: 24582 - RNA, 22 nt, Human
ugugugccaggcacuacacuag

SEQ ID NO: 24583 - RNA, 24 nt, Human
gacaaccaaaccaaucucggugga

SEQ ID NO: 24584 - RNA, 19 nt, Human
acagauuuacaugugcaca

SEQ ID NO: 24585 - RNA, 22 nt, Human
aaagaucuuugcaugagguaaa

SEQ ID NO: 24586 - RNA, 21 nt, Human
cccguagagacacucccaagg

SEQ ID NO: 24587 - RNA, 26 nt, Human
guggguggaggcuggggugucugcac

SEQ ID NO: 24588 - RNA, 26 nt, Human
gaggggcuucggagcugaggagcagc

SEQ ID NO: 24589 - RNA, 26 nt, Human
acaggcuuuuucuucauuaccuuuuu

SEQ ID NO: 24590 - RNA, 22 nt, Human
cugaggaggggcacugcccugg

SEQ ID NO: 24591 - RNA, 26 nt, Human
auugacucagaauaaaagaacagucu

SEQ ID NO: 24592 - RNA, 30 nt, Human
agcaggaaugacaaagcuugcuuuucuggu

SEQ ID NO: 24593 - RNA, 23 nt, Human
uuaacuuggcucacuucucuuca

SEQ ID NO: 24594 - RNA, 27 nt, Human
acccugcauuccauagccaugugcuug

SEQ ID NO: 24595 - RNA, 22 nt, Human
uuccuuugggaucucugaggcc

SEQ ID NO: 24596 - RNA, 18 nt, Human
ucauuugcgcacaacuua

SEQ ID NO: 24597 - RNA, 22 nt, Human
aagaccaacaccagcccguggg

SEQ ID NO: 24598 - RNA, 26 nt, Human
ccaaguguuugcuaugugcaacacac

SEQ ID NO: 24599 - RNA, 26 nt, Human
caccagguucuuucuuuaaagcagga

SEQ ID NO: 24600 - RNA, 28 nt, Human
cucggccugacugcuccaacuuccugcu

SEQ ID NO: 24601 - RNA, 24 nt, Human
ccuguguguuggcaccagcaucgg

SEQ ID NO: 24602 - RNA, 21 nt, Human
agaguaaucagaguacuuucg

SEQ ID NO: 24603 - RNA, 24 nt, Human
uuccauuccauuuucaaguguaca

SEQ ID NO: 24604 - RNA, 22 nt, Human
gggcuugugaugcugagcuugg

SEQ ID NO: 24605 - RNA, 21 nt, Human
cuucugcuucagucucccaag

SEQ ID NO: 24606 - RNA, 24 nt, Human
cucugcgcgagaagccucagacau

SEQ ID NO: 24607 - RNA, 22 nt, Human
aauggcacgaucuuggcucacu

SEQ ID NO: 24608 - RNA, 24 nt, Human
guaguacuacuuaaaagcaugucg

SEQ ID NO: 24609 - RNA, 22 nt, Human
uguugccuaggcuggagugcag

SEQ ID NO: 24610 - RNA, 24 nt, Human
aaauguuccuuuuaauggaugguu

SEQ ID NO: 24611 - RNA, 19 nt, Human
aucugaaagggucuccucu

SEQ ID NO: 24612 - RNA, 21 nt, Human
gagaaguuaagaaauacaucc

SEQ ID NO: 24613 - RNA, 21 nt, Human
gagggagggagggaggggagc

SEQ ID NO: 24614 - RNA, 25 nt, Human
gaacugcaccucuggagcggacuua

SEQ ID NO: 24615 - RNA, 26 nt, Human
gcuuauugcccaggcuggagugcaau

SEQ ID NO: 24616 - RNA, 22 nt, Human
gggugccucuuaucuccuucua

SEQ ID NO: 24617 - RNA, 23 nt, Human
ccucaaguaauccuccugccuca

SEQ ID NO: 24618 - RNA, 19 nt, Human
uauuucaguauaaaacagu

SEQ ID NO: 24619 - RNA, 24 nt, Human
cggccggcaguugcaguguagaca

SEQ ID NO: 24620 - RNA, 22 nt, Human
ugcauugagcugagaucgugcc

SEQ ID NO: 24621 - RNA, 27 nt, Human
gcccaugcaaauuagcucacaucuuuc

SEQ ID NO: 24622 - RNA, 23 nt, Human
uucuccaaagaaagguggugagg

SEQ ID NO: 24623 - RNA, 19 nt, Human
uggaaacugacauaauguu

SEQ ID NO: 24624 - RNA, 26 nt, Human
guggguggugggcaaggcggugggug

SEQ ID NO: 24625 - RNA, 21 nt, Human
ucaucuccacauggagccaag

SEQ ID NO: 24626 - RNA, 23 nt, Human
aacuaaaacuuuucaguucuacu

SEQ ID NO: 24627 - RNA, 22 nt, Human
cccaggaggugacgaggcaggg

SEQ ID NO: 24628 - RNA, 22 nt, Human
uuggaguuuggcuucaucuucc

SEQ ID NO: 24629 - RNA, 22 nt, Human
gcaugagccacugcaccugacc

SEQ ID NO: 24630 - RNA, 25 nt, Human
caccagccacagagauccaggcuuu

SEQ ID NO: 24631 - RNA, 22 nt, Human
gucucccaggcugaagugcagu

SEQ ID NO: 24632 - RNA, 23 nt, Human
gcaaaacuaugucaggaauggag

SEQ ID NO: 24633 - RNA, 24 nt, Human
ugugcuguuuccaucuuccuugcc

SEQ ID NO: 24634 - RNA, 18 nt, Human
cuccccucagccgaggcu

SEQ ID NO: 24635 - RNA, 32 nt, Human
gucucccaugaugggguggagucagcccugcu

SEQ ID NO: 24636 - RNA, 27 nt, Human
uuguaguaucaucaugaagauucagag

SEQ ID NO: 24637 - RNA, 22 nt, Human
ucugcccucaccggacucuggg

SEQ ID NO: 24638 - RNA, 22 nt, Human
ugucuaagagguacauucuucc

SEQ ID NO: 24639 - RNA, 22 nt, Human
uuuggaauaucuaugaaugaau

SEQ ID NO: 24640 - RNA, 27 nt, Human
acugcucucugcugcccucccauccuc

SEQ ID NO: 24641 - RNA, 22 nt, Human
gggugggaaagauuacuuuuuc

SEQ ID NO: 24642 - RNA, 25 nt, Human
uccugugccccucugcuccggcacg

SEQ ID NO: 24643 - RNA, 27 nt, Human
gcucagaagaauuuaaguucuauucag

SEQ ID NO: 24644 - RNA, 27 nt, Human
caagacgcccauccuggaaaagguccc

SEQ ID NO: 24645 - RNA, 23 nt, Human
ugagggaugauuaugagcucucu

SEQ ID NO: 24646 - RNA, 22 nt, Human
ggagagggaugcccaggaacgc

SEQ ID NO: 24647 - RNA, 25 nt, Human
uuucuacugcuaugugucacacuuu

SEQ ID NO: 24648 - RNA, 27 nt, Human
cuagggagcuugaguccugaggcccuc

SEQ ID NO: 24649 - RNA, 22 nt, Human
gcuggucgugaacuccugggcu

SEQ ID NO: 24650 - RNA, 22 nt, Human
ccaaucauuugccauuuaugac

SEQ ID NO: 24651 - RNA, 22 nt, Human
cuccugagcccccgcgcauccu

SEQ ID NO: 24652 - RNA, 24 nt, Human
gccauggaacuguuuucuucauca

SEQ ID NO: 24653 - RNA, 27 nt, Human
gugaccuuuuccaucgugagcuaagag

SEQ ID NO: 24654 - RNA, 26 nt, Human
cuccacccccuccacagugaugcaga

SEQ ID NO: 24655 - RNA, 22 nt, Human
gaccucuuccugaaucacugga

SEQ ID NO: 24656 - RNA, 21 nt, Human
gccgugagccaagaucacgcc

SEQ ID NO: 24657 - RNA, 27 nt, Human
cagucucucagugcuuggcagaggggu

SEQ ID NO: 24658 - RNA, 22 nt, Human
gcguaggcaccugggagcugcu

SEQ ID NO: 24659 - RNA, 27 nt, Human
caucugaaggcuauauauccuuuaauc

SEQ ID NO: 24660 - RNA, 26 nt, Human
guaguguggccuggugcuggggugaa

SEQ ID NO: 24661 - RNA, 21 nt, Human
gcccguaauaaaaaugcucuc

SEQ ID NO: 24662 - RNA, 24 nt, Human
acuuuuauuuuauaaauacacagc

SEQ ID NO: 24663 - RNA, 22 nt, Human
ccaaccuggugaaacccugucu

SEQ ID NO: 24664 - RNA, 27 nt, Human
cugcccuuccuuagaccaucacaugcc

SEQ ID NO: 24665 - RNA, 21 nt, Human
uuuuggagguugggugcuggg

SEQ ID NO: 24666 - RNA, 20 nt, Human
uuggguuggaggcucauuga

SEQ ID NO: 24667 - RNA, 22 nt, Human
ggcuauaaauauauaaaaagaa

SEQ ID NO: 24668 - RNA, 19 nt, Human
ugcuucuuaaguucaucaa

SEQ ID NO: 24669 - RNA, 23 nt, Human
uucaaguuuauguuacugccagg

SEQ ID NO: 24670 - RNA, 22 nt, Human
uugagccuccaggcuucuccuu

SEQ ID NO: 24671 - RNA, 21 nt, Human
ugcugagcucuguucucucca

SEQ ID NO: 24672 - RNA, 27 nt, Human
uggucucaagcuaugaucagaagacuu

SEQ ID NO: 24673 - RNA, 20 nt, Human
cuucaugguguucaugacaa

SEQ ID NO: 24674 - RNA, 24 nt, Human
uuguagcccacugcaucuggauau

SEQ ID NO: 24675 - RNA, 21 nt, Human
gucagcucaggcuggagcagg

SEQ ID NO: 24676 - RNA, 20 nt, Human
ccagcuuucugcauggaugg

SEQ ID NO: 24677 - RNA, 21 nt, Human
gcuuggcaucacacaucacuc

SEQ ID NO: 24678 - RNA, 18 nt, Human
uaccaaugcuacucugcu

SEQ ID NO: 24679 - RNA, 23 nt, Human
gggagggugagcaggagcaaggc

SEQ ID NO: 24680 - RNA, 22 nt, Human
guuccugaaccugaugcugacu

SEQ ID NO: 24681 - RNA, 24 nt, Human
gcagcccagagucagucauugaag

SEQ ID NO: 24682 - RNA, 23 nt, Human
cugucucuucuccaugagggaga

SEQ ID NO: 24683 - RNA, 26 nt, Human
gacauguggguggagaagggagggug

SEQ ID NO: 24684 - RNA, 30 nt, Human
ugcugaauagauucuucucaguuugaaaga

SEQ ID NO: 24685 - RNA, 22 nt, Human
ucgagaucaugccauugcauuc

SEQ ID NO: 24686 - RNA, 21 nt, Human
ucaguucauugaccucaucau

SEQ ID NO: 24687 - RNA, 26 nt, Human
ucugggucugguuuucugauguugcc

SEQ ID NO: 24688 - RNA, 25 nt, Human
uugccuuugcaucuccacacauggc

SEQ ID NO: 24689 - RNA, 21 nt, Human
ggugguugucccaggaggcag

SEQ ID NO: 24690 - RNA, 21 nt, Human
uggacccugaucuuacccgug

SEQ ID NO: 24691 - RNA, 24 nt, Human
uccuucagucccucacaucucuga

SEQ ID NO: 24692 - RNA, 24 nt, Human
cccugcagcuacucuucagaucug

SEQ ID NO: 24693 - RNA, 21 nt, Human
guuucugcauuauuugugcau

SEQ ID NO: 24694 - RNA, 24 nt, Human
gcacuauaauucgggauguaaucc

SEQ ID NO: 24695 - RNA, 22 nt, Human
cgccaaaggccagccuccuggc

SEQ ID NO: 24696 - RNA, 18 nt, Human
cgcgcagcgcugcaguga

SEQ ID NO: 24697 - RNA, 21 nt, Human
uuucaucuugcuuugcuuugu

SEQ ID NO: 24698 - RNA, 22 nt, Human
aucgcccucaugagugccaccu

SEQ ID NO: 24699 - RNA, 27 nt, Human
gccuggcagaugaaugacuccaggaag

SEQ ID NO: 24700 - RNA, 20 nt, Human
ucugaacucuucaauuugga

SEQ ID NO: 24701 - RNA, 21 nt, Human
ccuggugccugcaccugcacu

SEQ ID NO: 24702 - RNA, 21 nt, Human
agaacaacugcaaagaaagug

SEQ ID NO: 24703 - RNA, 23 nt, Human
acacauuuacaagaaaaauguuu

SEQ ID NO: 24704 - RNA, 19 nt, Human
aaggcagcagcagcggugg

SEQ ID NO: 24705 - RNA, 24 nt, Human
ugaaaccagaauuguuuugcauuu

SEQ ID NO: 24706 - RNA, 25 nt, Human
ggaaagauggggagcucuggaggug

SEQ ID NO: 24707 - RNA, 22 nt, Human
aacuucugaugcuuuuauugcc

SEQ ID NO: 24708 - RNA, 24 nt, Human
ccaacuggaaggcuuuauucuucc

SEQ ID NO: 24709 - RNA, 20 nt, Human
gcccugcaagggcguggugg

SEQ ID NO: 24710 - RNA, 26 nt, Human
aagcccagagacagcuugaucaaagg

SEQ ID NO: 24711 - RNA, 22 nt, Human
ccagugcugcacacuccugguu

SEQ ID NO: 24712 - RNA, 26 nt, Human
gcguauuucucccugaaauggggucu

SEQ ID NO: 24713 - RNA, 19 nt, Human
ugccuauccugggaccucc

SEQ ID NO: 24714 - RNA, 27 nt, Human
gccuggcucgaugucugcuucuuccca

SEQ ID NO: 24715 - RNA, 27 nt, Human
ugcacacauuacaggugguguguucug

SEQ ID NO: 24716 - RNA, 21 nt, Human
ggauucugcaaaaugugucuc

SEQ ID NO: 24717 - RNA, 19 nt, Human
cauucaggcuguugacaag

SEQ ID NO: 24718 - RNA, 21 nt, Human
uggcucucuggacuuaacguc

SEQ ID NO: 24719 - RNA, 26 nt, Human
cagguggcgggggcugcgcuccgccc

SEQ ID NO: 24720 - RNA, 19 nt, Human
cuagcuccccuccucuccc

SEQ ID NO: 24721 - RNA, 22 nt, Human
cuaaggcagggagauggcuuga

SEQ ID NO: 24722 - RNA, 22 nt, Human
ccugcagcaucuuacaucugua

SEQ ID NO: 24723 - RNA, 19 nt, Human
gggcagcagaguggagcga

SEQ ID NO: 24724 - RNA, 26 nt, Human
gugcucaggcuggugccagccuuuca

SEQ ID NO: 24725 - RNA, 22 nt, Human
aagcugaggcgggagaaucaug

SEQ ID NO: 24726 - RNA, 24 nt, Human
agccucagcauaccccuuccucca

SEQ ID NO: 24727 - RNA, 22 nt, Human
cccugagggaggcauucaccuu

SEQ ID NO: 24728 - RNA, 21 nt, Human
uccaauuucuauuauuacaau

SEQ ID NO: 24729 - RNA, 19 nt, Human
ggagagggcagggagcggc

SEQ ID NO: 24730 - RNA, 22 nt, Human
caggcuggagugcgguggcuau

SEQ ID NO: 24731 - RNA, 24 nt, Human
gagcggcgcuggagggaggaaagc

SEQ ID NO: 24732 - RNA, 22 nt, Human
ucccuucaccuuuccucuccug

SEQ ID NO: 24733 - RNA, 21 nt, Human
aguaggaacuuggaaugcaag

SEQ ID NO: 24734 - RNA, 22 nt, Human
ggaaaucaaguggcuuaucaug

SEQ ID NO: 24735 - RNA, 20 nt, Human
uccaggcuagagugcagugg

SEQ ID NO: 24736 - RNA, 20 nt, Human
uccaggcuggagugcaaugg

SEQ ID NO: 24737 - RNA, 26 nt, Human
cacccccucacaggacagagcuguau

SEQ ID NO: 24738 - RNA, 16 nt, Human
uucauaaaaaucuuug

SEQ ID NO: 24739 - RNA, 21 nt, Human
aguucacugcaaccucugccu

SEQ ID NO: 24740 - RNA, 22 nt, Human
aggggagagggucuggagaagc

SEQ ID NO: 24741 - RNA, 22 nt, Human
augcuguaacaguuagcauggc

SEQ ID NO: 24742 - RNA, 23 nt, Human
gcuuguuucauaaucaucuaacu

SEQ ID NO: 24743 - RNA, 22 nt, Human
agggaaagagaaccacaauaga

SEQ ID NO: 24744 - RNA, 23 nt, Human
aaggaggaucgagcucacugugg

SEQ ID NO: 24745 - RNA, 27 nt, Human
uuauagaauguggaaauuauuucucca

SEQ ID NO: 24746 - RNA, 22 nt, Human
cgaauauuuaauaaaacugaua

SEQ ID NO: 24747 - RNA, 21 nt, Human
uccucauccuccuccuccucc

SEQ ID NO: 24748 - RNA, 23 nt, Human
uaauuaauaaaaaucaguuucuu

SEQ ID NO: 24749 - RNA, 27 nt, Human
caagucaaauccagaccuauguuggau

SEQ ID NO: 24750 - RNA, 20 nt, Human
ccucaagguagugaggcuag

SEQ ID NO: 24751 - RNA, 27 nt, Human
cuaguguuuauaccagcaagccacgug

SEQ ID NO: 24752 - RNA, 26 nt, Human
gugcccuggaaucagccugguugagc

SEQ ID NO: 24753 - RNA, 26 nt, Human
aacuuguauauuccaccauucacauu

SEQ ID NO: 24754 - RNA, 20 nt, Human
ugagaagaaggaagaucuug

SEQ ID NO: 24755 - RNA, 20 nt, Human
aacccaucuuccuggaccug

SEQ ID NO: 24756 - RNA, 21 nt, Human
auuucaguuuuucauucuuug

SEQ ID NO: 24757 - RNA, 21 nt, Human
ccaagccccagaccaugggag

SEQ ID NO: 24758 - RNA, 24 nt, Human
cuacuuccucgguucccuccccga

SEQ ID NO: 24759 - RNA, 22 nt, Human
aagcugaggcgggcggaucacc

SEQ ID NO: 24760 - RNA, 21 nt, Human
uccaugucccaugauccccuc

SEQ ID NO: 24761 - RNA, 21 nt, Human
ucagcuguucuuucuagcucu

SEQ ID NO: 24762 - RNA, 20 nt, Human
acucuucuagcagcauuaug

SEQ ID NO: 24763 - RNA, 22 nt, Human
aauuaaaaucaguauuugucua

SEQ ID NO: 24764 - RNA, 23 nt, Human
gcgauggggugguaaugggggug

SEQ ID NO: 24765 - RNA, 20 nt, Human
uauuguucucugucaugccc

SEQ ID NO: 24766 - RNA, 21 nt, Human
ggggacaccucaggcacuggg

SEQ ID NO: 24767 - RNA, 23 nt, Human
gacuuccuguuguaacacacuuu

SEQ ID NO: 24768 - RNA, 22 nt, Human
aauguaaaaggcucacuugccu

SEQ ID NO: 24769 - RNA, 19 nt, Human
ccugaguccucccugccug

SEQ ID NO: 24770 - RNA, 21 nt, Human
cugagccuuguugugacacau

SEQ ID NO: 24771 - RNA, 27 nt, Human
ucacuuuuuauuuuuaugggggugggu

SEQ ID NO: 24772 - RNA, 23 nt, Human
ugccuguggaguggaauauucug

SEQ ID NO: 24773 - RNA, 26 nt, Human
cugccuggccguaucgccgcccccac

SEQ ID NO: 24774 - RNA, 24 nt, Human
cuggcuuccuuucccuuuucuucu

SEQ ID NO: 24775 - RNA, 24 nt, Human
ccugugcacguuggccucagaugg

SEQ ID NO: 24776 - RNA, 25 nt, Human
ccauacucguuucugauucagaauc

SEQ ID NO: 24777 - RNA, 21 nt, Human
uacucuuuaacaugauaaaug

SEQ ID NO: 24778 - RNA, 26 nt, Human
cuuagcccuucucugcuccuuauucc

SEQ ID NO: 24779 - RNA, 24 nt, Human
uugcacagggagugcaggagguga

SEQ ID NO: 24780 - RNA, 22 nt, Human
gcugcucuccucgacauggacc

SEQ ID NO: 24781 - RNA, 21 nt, Human
uaagagucauccagcucuugc

SEQ ID NO: 24782 - RNA, 24 nt, Human
gucuuauccccauaauccuugcca

SEQ ID NO: 24783 - RNA, 27 nt, Human
ugcccugcuguuuauucuguaagggga

SEQ ID NO: 24784 - RNA, 22 nt, Human
cucgccuguaaucccagcacuu

SEQ ID NO: 24785 - RNA, 22 nt, Human
cccgccuguaaucccaguacuu

SEQ ID NO: 24786 - RNA, 22 nt, Human
ugcaugggcugcauuaucuaca

SEQ ID NO: 24787 - RNA, 24 nt, Human
uguagcccugcauccuccaguguu

SEQ ID NO: 24788 - RNA, 24 nt, Human
uucaccccaucaaccaccucugcg

SEQ ID NO: 24789 - RNA, 21 nt, Human
caccacacuccagcuacugug

SEQ ID NO: 24790 - RNA, 22 nt, Human
ucuggaauauugugauucuguu

SEQ ID NO: 24791 - RNA, 27 nt, Human
ccacacaaccacaucugccuuuuccac

SEQ ID NO: 24792 - RNA, 27 nt, Human
uugucccaggcugggcagaggucagga

SEQ ID NO: 24793 - RNA, 23 nt, Human
gagggagggagaauaagucaguc

SEQ ID NO: 24794 - RNA, 21 nt, Human
uaauuaaaaacuaguaguucu

SEQ ID NO: 24795 - RNA, 24 nt, Human
gcuugcaggccaccucuagcuuuc

SEQ ID NO: 24796 - RNA, 26 nt, Human
gugccuggcuucucuugccugccuug

SEQ ID NO: 24797 - RNA, 24 nt, Human
agccagggcccgggagagugugag

SEQ ID NO: 24798 - RNA, 19 nt, Human
uuaaacuuccaaucuuacu

SEQ ID NO: 24799 - RNA, 26 nt, Human
uuucauguuuuugaucaaaaacuauu

SEQ ID NO: 24800 - RNA, 23 nt, Human
auggcagcagaaaacuuguguga

SEQ ID NO: 24801 - RNA, 21 nt, Human
accagccuggccaacacagug

SEQ ID NO: 24802 - RNA, 21 nt, Human
cugccugaauuuauggcauua

SEQ ID NO: 24803 - RNA, 23 nt, Human
aggggauggaggucuacccugga

SEQ ID NO: 24804 - RNA, 23 nt, Human
aucauagucaaagggcuucccuu

SEQ ID NO: 24805 - RNA, 20 nt, Human
gagggaagcgcugaggauca

SEQ ID NO: 24806 - RNA, 23 nt, Human
aaaccaggcugaugccgugcggg

SEQ ID NO: 24807 - RNA, 22 nt, Human
gcaacguucgauuucuaccuca

SEQ ID NO: 24808 - RNA, 14 nt, Human
gcuuauaugccuua

SEQ ID NO: 24809 - RNA, 26 nt, Human
aaccucuucugccgucucagccuggg

SEQ ID NO: 24810 - RNA, 23 nt, Human
gcccccagcccccuccuggugcc

SEQ ID NO: 24811 - RNA, 22 nt, Human
aucgcuugaacccaggaggugg

SEQ ID NO: 24812 - RNA, 23 nt, Human
uccagaauagcugggauuacagg

SEQ ID NO: 24813 - RNA, 23 nt, Human
aucugggcaaggugggugauucc

SEQ ID NO: 24814 - RNA, 20 nt, Human
uuagccuagccauuauguua

SEQ ID NO: 24815 - RNA, 22 nt, Human
ucgaguagcugggaccacaguu

SEQ ID NO: 24816 - RNA, 22 nt, Human
gcagaaacaaauggcuguccag

SEQ ID NO: 24817 - RNA, 25 nt, Human
uuuugaaaguugccuuuucucucca

SEQ ID NO: 24818 - RNA, 24 nt, Human
gccuauccuggccagguguggugg

SEQ ID NO: 24819 - RNA, 21 nt, Human
uuuggagaauuugagaggagg

SEQ ID NO: 24820 - RNA, 23 nt, Human
uguuguugccaaccagucuccca

SEQ ID NO: 24821 - RNA, 22 nt, Human
cacgccuguauucccagcaguu

SEQ ID NO: 24822 - RNA, 22 nt, Human
aacaucaaagagcacauuuacc

SEQ ID NO: 24823 - RNA, 25 nt, Human
ggccucgggccccagaggucccgcu

SEQ ID NO: 24824 - RNA, 21 nt, Human
cuaacccagguauccaaaaau

SEQ ID NO: 24825 - RNA, 21 nt, Human
ccuagccuggaucccaaaaag

SEQ ID NO: 24826 - RNA, 27 nt, Human
cgagccuggagaacugcaggggccaag

SEQ ID NO: 24827 - RNA, 22 nt, Human
cacugcacuccagccuuggcaa

SEQ ID NO: 24828 - RNA, 22 nt, Human
cacugcacgccagccugggcaa

SEQ ID NO: 24829 - RNA, 21 nt, Human
ugugccauggcugguguauau

SEQ ID NO: 24830 - RNA, 27 nt, Human
cuucaaaauuuuuacgugauaguauaa

SEQ ID NO: 24831 - RNA, 22 nt, Human
gaggacuucgcuuuugcucuga

SEQ ID NO: 24832 - RNA, 24 nt, Human
ugggaagaaaaauuggucagcuug

SEQ ID NO: 24833 - RNA, 26 nt, Human
ucuuccuuccgcucugaggcaacccc

SEQ ID NO: 24834 - RNA, 22 nt, Human
augucuggacaacuccuuccug

SEQ ID NO: 24835 - RNA, 27 nt, Human
cucuugauaguccugaccucaugaucu

SEQ ID NO: 24836 - RNA, 26 nt, Human
ccuccugggccggggcucuggccccc

SEQ ID NO: 24837 - RNA, 24 nt, Human
cuauuucgauggcaaauguuaagc

SEQ ID NO: 24838 - RNA, 20 nt, Human
gagagggccgggcagagggg

SEQ ID NO: 24839 - RNA, 22 nt, Human
aucugccaggcggagggggcuu

SEQ ID NO: 24840 - RNA, 25 nt, Human
acccaggcuggagugcagugacaug

SEQ ID NO: 24841 - RNA, 23 nt, Human
aauccgagccagcucugggggcu

SEQ ID NO: 24842 - RNA, 22 nt, Human
uuaguggguaaagaccagggau

SEQ ID NO: 24843 - RNA, 24 nt, Human
ccgugcuuaacaggaaaggaccua

SEQ ID NO: 24844 - RNA, 20 nt, Human
aauaauccugaacauuagaa

SEQ ID NO: 24845 - RNA, 22 nt, Human
cgagggagggagggcugccuga

SEQ ID NO: 24846 - RNA, 23 nt, Human
cuggauccuagccuuauccucug

SEQ ID NO: 24847 - RNA, 24 nt, Human
uucacuugauacuauaugauauga

SEQ ID NO: 24848 - RNA, 23 nt, Human
guuacccagcuccuggaggcagu

SEQ ID NO: 24849 - RNA, 19 nt, Human
ugugccuguggggugggga

SEQ ID NO: 24850 - RNA, 26 nt, Human
ucugcuggagccccugccugaccagc

SEQ ID NO: 24851 - RNA, 27 nt, Human
ccuaagugggauggcucuccuucuccc

SEQ ID NO: 24852 - RNA, 23 nt, Human
uuuucucagagauugcaaaggau

SEQ ID NO: 24853 - RNA, 28 nt, Human
ucucgagcuccugaccucaggugaucua

SEQ ID NO: 24854 - RNA, 21 nt, Human
aggcugagaaacuucagcagc

SEQ ID NO: 24855 - RNA, 22 nt, Human
ggaaaccuggcuuauucuucua

SEQ ID NO: 24856 - RNA, 25 nt, Human
gugagggugaugccaucuacccugc

SEQ ID NO: 24857 - RNA, 22 nt, Human
ugaguggguuugcuaucaauga

SEQ ID NO: 24858 - RNA, 22 nt, Human
ccaacauggagaaaccccaucu

SEQ ID NO: 24859 - RNA, 26 nt, Human
gccccccaggacugggcaguugcagg

SEQ ID NO: 24860 - RNA, 22 nt, Human
gagaucaugccacuacacucca

SEQ ID NO: 24861 - RNA, 19 nt, Human
agcagagauacccauacac

SEQ ID NO: 24862 - RNA, 22 nt, Human
ugugcgagcuguggagugcagg

SEQ ID NO: 24863 - RNA, 30 nt, Human
uuagauauuauuuugcaucuguaacuaacc

SEQ ID NO: 24864 - RNA, 27 nt, Human
ggcucacuggaucccaauccuuggagc

SEQ ID NO: 24865 - RNA, 20 nt, Human
aaaacuuccagcccucuguu

SEQ ID NO: 24866 - RNA, 22 nt, Human
ucugucucccaggcuggagugc

SEQ ID NO: 24867 - RNA, 21 nt, Human
caaaggucccugagcucuugc

SEQ ID NO: 24868 - RNA, 19 nt, Human
gaccuguuucauaagcuuu

SEQ ID NO: 24869 - RNA, 24 nt, Human
ucauucucacuucaaauuccuggg

SEQ ID NO: 24870 - RNA, 24 nt, Human
uaugguuuaguuuucaaaaaacuu

SEQ ID NO: 24871 - RNA, 20 nt, Human
aaaauucugcagauggccuu

SEQ ID NO: 24872 - RNA, 23 nt, Human
uggacucaggacugaagugcugu

SEQ ID NO: 24873 - RNA, 21 nt, Human
agauagugucugccuucugga

SEQ ID NO: 24874 - RNA, 25 nt, Human
uaagggguggggugaggggauggag

SEQ ID NO: 24875 - RNA, 27 nt, Human
gccucacuccaggaaggggcuggacug

SEQ ID NO: 24876 - RNA, 19 nt, Human
auuaucuaaaguguguugu

SEQ ID NO: 24877 - RNA, 22 nt, Human
auuugccagacaaugaaaacag

SEQ ID NO: 24878 - RNA, 27 nt, Human
ucuuuuuucuuuuuuagaaaacucaga

SEQ ID NO: 24879 - RNA, 31 nt, Human
ccugucuccagcugcucugcacacauggaca

SEQ ID NO: 24880 - RNA, 20 nt, Human
ucagaagugaagauaggaag

SEQ ID NO: 24881 - RNA, 22 nt, Human
cccacaauuccuccucuggcca

SEQ ID NO: 24882 - RNA, 24 nt, Human
gaaaggaauggccuuucaccuucu

SEQ ID NO: 24883 - RNA, 21 nt, Human
gaggaagagaagacaccagug

SEQ ID NO: 24884 - RNA, 25 nt, Human
ugcagugaugcgauugaucauggcu

SEQ ID NO: 24885 - RNA, 21 nt, Human
acggcccagacccgggcuggg

SEQ ID NO: 24886 - RNA, 32 nt, Human
ccuguggcugaaggaagccuuagcaauucacu

SEQ ID NO: 24887 - RNA, 32 nt, Human
ucccugccuucacugugcuccaaccugaaggu

SEQ ID NO: 24888 - RNA, 22 nt, Human
gguuuccuaaccucuucuuccu

SEQ ID NO: 24889 - RNA, 30 nt, Human
cugccucgagggccgccugccuuagcaaug

SEQ ID NO: 24890 - RNA, 27 nt, Human
cccgccucccccugccucagcggcugc

SEQ ID NO: 24891 - RNA, 26 nt, Human
gccuccaacucuugggcucaagcauc

SEQ ID NO: 24892 - RNA, 22 nt, Human
aacauagauugaucaacgugau

SEQ ID NO: 24893 - RNA, 23 nt, Human
ggcucaaucuauccugugcuuga

SEQ ID NO: 24894 - RNA, 20 nt, Human
uaucagauuuguaaauaacu

SEQ ID NO: 24895 - RNA, 26 nt, Human
auagacuugcccuuguuacugcccag

SEQ ID NO: 24896 - RNA, 23 nt, Human
ugugagccgggagaucugggcug

SEQ ID NO: 24897 - RNA, 22 nt, Human
acuuucuccuacucuuccuucc

SEQ ID NO: 24898 - RNA, 29 nt, Human
gccgucagccugugaacugccaggcagcu

SEQ ID NO: 24899 - RNA, 23 nt, Human
ccucaggcagcagagaacuggcc

SEQ ID NO: 24900 - RNA, 24 nt, Human
uacaucccacagagauacccagac

SEQ ID NO: 24901 - RNA, 27 nt, Human
aguuuauauuuaacucucuuuaugucu

SEQ ID NO: 24902 - RNA, 22 nt, Human
ugugcuggggacauaggaagac

SEQ ID NO: 24903 - RNA, 22 nt, Human
cagauguuuuuauugcagguca

SEQ ID NO: 24904 - RNA, 23 nt, Human
cccuuucucuucuuccccagguc

SEQ ID NO: 24905 - RNA, 27 nt, Human
ggucucgaacuucugagcucgagcgau

SEQ ID NO: 24906 - RNA, 21 nt, Human
cauuaucucccccuaguuaga

SEQ ID NO: 24907 - RNA, 22 nt, Human
cucuaccaucuguaaacaacug

SEQ ID NO: 24908 - RNA, 22 nt, Human
uaucugucuacuuagcguggcu

SEQ ID NO: 24909 - RNA, 24 nt, Human
caugaaguuaaccacagucgggaa

SEQ ID NO: 24910 - RNA, 21 nt, Human
uccggcaccuccuccuccuuc

SEQ ID NO: 24911 - RNA, 22 nt, Human
cacuccuuggcuggaggcagug

SEQ ID NO: 24912 - RNA, 26 nt, Human
cgccaacauggugagacccugucucu

SEQ ID NO: 24913 - RNA, 22 nt, Human
cauggcagacagggaagggaaa

SEQ ID NO: 24914 - RNA, 20 nt, Human
caugcuuuucuuaccuguca

SEQ ID NO: 24915 - RNA, 23 nt, Human
uuccuguucaugacagcuacuaa

SEQ ID NO: 24916 - RNA, 27 nt, Human
aagccauguuccccaguucaguguugc

SEQ ID NO: 24917 - RNA, 25 nt, Human
gugccucccuccuccagcuguaacc

SEQ ID NO: 24918 - RNA, 30 nt, Human
cuuucugcccagagcuccuggaccaaugca

SEQ ID NO: 24919 - RNA, 25 nt, Human
cgcugggagguguacacggaggucu

SEQ ID NO: 24920 - RNA, 21 nt, Human
gacugauuucaaaucauguuu

SEQ ID NO: 24921 - RNA, 17 nt, Human
ucuaagaaacaauuaug

SEQ ID NO: 24922 - RNA, 23 nt, Human
aacacacacgccagcuccucucu

SEQ ID NO: 24923 - RNA, 23 nt, Human
uuccaccuucccugaaaauuuua

SEQ ID NO: 24924 - RNA, 20 nt, Human
cucuccucuucuagcauuuc

SEQ ID NO: 24925 - RNA, 21 nt, Human
caggaagguuuugcagaggag

SEQ ID NO: 24926 - RNA, 23 nt, Human
ugggcucucgcggccucuucucu

SEQ ID NO: 24927 - RNA, 22 nt, Human
ccaagccucagcuuccucgccu

SEQ ID NO: 24928 - RNA, 18 nt, Human
uggagguggaguagcuga

SEQ ID NO: 24929 - RNA, 23 nt, Human
guguugcuacaucagcacugggc

SEQ ID NO: 24930 - RNA, 27 nt, Human
cugccuuguacccugagcugcaucacc

SEQ ID NO: 24931 - RNA, 27 nt, Human
ugucuacauugccaaccacaggccucu

SEQ ID NO: 24932 - RNA, 20 nt, Human
cauaacuuaccucugcuucu

SEQ ID NO: 24933 - RNA, 23 nt, Human
aacggugaccuuuagugccaacu

SEQ ID NO: 24934 - RNA, 21 nt, Human
cuguagugccugcuguuugga

SEQ ID NO: 24935 - RNA, 20 nt, Human
gcagguaggacagugaccuc

SEQ ID NO: 24936 - RNA, 23 nt, Human
cucuccucccggauggucauguu

SEQ ID NO: 24937 - RNA, 22 nt, Human
gcccagucuguaaugcagugcu

SEQ ID NO: 24938 - RNA, 21 nt, Human
uggccaagagcaggguuuucu

SEQ ID NO: 24939 - RNA, 19 nt, Human
gaggaagaggaacucuaca

SEQ ID NO: 24940 - RNA, 22 nt, Human
gggcgucuucuccacuccucug

SEQ ID NO: 24941 - RNA, 22 nt, Human
gcucacugcaacuuccaccucu

SEQ ID NO: 24942 - RNA, 21 nt, Human
agugauuugucauugcuuuau

SEQ ID NO: 24943 - RNA, 20 nt, Human
cuuccucacuaugacacuga

SEQ ID NO: 24944 - RNA, 24 nt, Human
uugauggcuguuagucccccucuc

SEQ ID NO: 24945 - RNA, 24 nt, Human
cucccucugcugaucucaguuucc

SEQ ID NO: 24946 - RNA, 22 nt, Human
gcccuuuucagcagcuugccca

SEQ ID NO: 24947 - RNA, 22 nt, Human
uguccuuuggucauguuucugu

SEQ ID NO: 24948 - RNA, 22 nt, Human
uuuuaaauuaaaaaaucaugca

SEQ ID NO: 24949 - RNA, 22 nt, Human
acuuuaagauuaucugccugcu

SEQ ID NO: 24950 - RNA, 22 nt, Human
ccuucauuuuauguuuuuucuu

SEQ ID NO: 24951 - RNA, 19 nt, Human
accaggaucagccaggagg

SEQ ID NO: 24952 - RNA, 27 nt, Human
ccugcuguguggcucuguaugacuguu

SEQ ID NO: 24953 - RNA, 17 nt, Human
cccgcccccaccuccuu

SEQ ID NO: 24954 - RNA, 24 nt, Human
ccagcacucugccuucuguaucca

SEQ ID NO: 24955 - RNA, 22 nt, Human
ggagcucaugucagccgugugg

SEQ ID NO: 24956 - RNA, 21 nt, Human
ggaggcaggggacaagggagg

SEQ ID NO: 24957 - RNA, 20 nt, Human
ucuccucucuccgccauggc

SEQ ID NO: 24958 - RNA, 21 nt, Human
ccuguaaucccagcacacugg

SEQ ID NO: 24959 - RNA, 22 nt, Human
cuaauucuugcauauuuuguaa

SEQ ID NO: 24960 - RNA, 23 nt, Human
ggaccaggaagagaggaacucgg

SEQ ID NO: 24961 - RNA, 24 nt, Human
gugcaguggcccugccacagcccu

SEQ ID NO: 24962 - RNA, 21 nt, Human
gccuucuguccugccugccca

SEQ ID NO: 24963 - RNA, 22 nt, Human
gccuaguuucuguaauauugug

SEQ ID NO: 24964 - RNA, 20 nt, Human
ucugagcagugccucuuguc

SEQ ID NO: 24965 - RNA, 21 nt, Human
uaccuguaaugccagcacuuu

SEQ ID NO: 24966 - RNA, 25 nt, Human
ugugccugguucucuaucagaaagg

SEQ ID NO: 24967 - RNA, 22 nt, Human
cuucccuucugauugauggugc

SEQ ID NO: 24968 - RNA, 22 nt, Human
auaagacaaagcuacugccuuc

SEQ ID NO: 24969 - RNA, 25 nt, Human
uaccaaaguaacugaauuauuucag

SEQ ID NO: 24970 - RNA, 27 nt, Human
cuuuuggugaacacguucauucaacug

SEQ ID NO: 24971 - RNA, 22 nt, Human
gacagaacaugcuugugcuucu

SEQ ID NO: 24972 - RNA, 20 nt, Human
cuguauagcugggauugggc

SEQ ID NO: 24973 - RNA, 22 nt, Human
gcgggggccauggcggagccag

SEQ ID NO: 24974 - RNA, 25 nt, Human
cagguucuuuucaaggcuccaguca

SEQ ID NO: 24975 - RNA, 25 nt, Human
cgaaaucaagaaacucauguucuua

SEQ ID NO: 24976 - RNA, 26 nt, Human
ugggacagaagcagaggaggcugccu

SEQ ID NO: 24977 - RNA, 22 nt, Human
gagugagacccugucucaaaca

SEQ ID NO: 24978 - RNA, 19 nt, Human
cguggugucucacucugaa

SEQ ID NO: 24979 - RNA, 22 nt, Human
gacuacaggcacaugccaccaa

SEQ ID NO: 24980 - RNA, 21 nt, Human
acaaaccuucuuuaaggcaua

SEQ ID NO: 24981 - RNA, 28 nt, Human
acuaaggguggagaguugggggccagca

SEQ ID NO: 24982 - RNA, 27 nt, Human
agucagaagucauuuugacugcccuca

SEQ ID NO: 24983 - RNA, 16 nt, Human
cuucccuuuugaguag

SEQ ID NO: 24984 - RNA, 23 nt, Human
gucacucguaugggacugcuugu

SEQ ID NO: 24985 - RNA, 27 nt, Human
cugacuggccccacacugugccaccgg

SEQ ID NO: 24986 - RNA, 27 nt, Human
ccccugccccugcccgagagcucuuag

SEQ ID NO: 24987 - RNA, 26 nt, Human
cuggcccugacugcuguuaauaauug

SEQ ID NO: 24988 - RNA, 22 nt, Human
uuuuguuguucacugcucagcu

SEQ ID NO: 24989 - RNA, 20 nt, Human
gcaggggaagucuugugucu

SEQ ID NO: 24990 - RNA, 27 nt, Human
agaagaccucuggcuuuccuggaacac

SEQ ID NO: 24991 - RNA, 24 nt, Human
aauacagaacagacuuauuuuuau

SEQ ID NO: 24992 - RNA, 26 nt, Human
caguguguccauucuggcagugguuu

SEQ ID NO: 24993 - RNA, 23 nt, Human
agucucucuucccacuugcugac

SEQ ID NO: 24994 - RNA, 25 nt, Human
cauucucucacaucccgugcgguca

SEQ ID NO: 24995 - RNA, 24 nt, Human
agacagcccuuccaacugugucau

SEQ ID NO: 24996 - RNA, 20 nt, Human
uacaguacuguuucuggacc

SEQ ID NO: 24997 - RNA, 25 nt, Human
cuccuuuggggcaacgacgguuuca

SEQ ID NO: 24998 - RNA, 20 nt, Human
agcccuacuucuugcacuga

SEQ ID NO: 24999 - RNA, 27 nt, Human
agaagcagcagaaaacuagcuuguaaa

SEQ ID NO: 25000 - RNA, 19 nt, Human
gcugcuuggugaacaauca

SEQ ID NO: 25001 - RNA, 22 nt, Human
ggcuaguuuuuguauuuuuagu

SEQ ID NO: 25002 - RNA, 22 nt, Human
ggcuaauuuuuguguuuuuagu

SEQ ID NO: 25003 - RNA, 22 nt, Human
ggcgccagaauccugcgcugcg

SEQ ID NO: 25004 - RNA, 22 nt, Human
acucuccguccugcccagagca

SEQ ID NO: 25005 - RNA, 25 nt, Human
gaccaucguccuuccucucaagcua

SEQ ID NO: 25006 - RNA, 26 nt, Human
agcaccacucuugauuuucugggauu

SEQ ID NO: 25007 - RNA, 24 nt, Human
cagaugagaacaaagcuguuaaac

SEQ ID NO: 25008 - RNA, 27 nt, Human
cugacagcagaggcuuugcugcuguga

SEQ ID NO: 25009 - RNA, 21 nt, Human
ccuguaauccuagcaccuugg

SEQ ID NO: 25010 - RNA, 23 nt, Human
uuccacagcccuccucucccaag

SEQ ID NO: 25011 - RNA, 25 nt, Human
ugcuugaguucccagauggcuggaa

SEQ ID NO: 25012 - RNA, 21 nt, Human
ccuguaauucuagcacuuugg

SEQ ID NO: 25013 - RNA, 22 nt, Human
gacgggguuucgccauguuggc

SEQ ID NO: 25014 - RNA, 20 nt, Human
uuugucaaggagagugcagu

SEQ ID NO: 25015 - RNA, 27 nt, Human
ccauacagaauuagcagagaaaauaca

SEQ ID NO: 25016 - RNA, 23 nt, Human
agggagaagcucuggggagccag

SEQ ID NO: 25017 - RNA, 25 nt, Human
ugugugccaguacucaggcagcugg

SEQ ID NO: 25018 - RNA, 25 nt, Human
gcccaugcuggagugcaguggcgcg

SEQ ID NO: 25019 - RNA, 20 nt, Human
guucuuauguuuaucuugcu

SEQ ID NO: 25020 - RNA, 27 nt, Human
uggguauuuugcuauaguugcuaauua

SEQ ID NO: 25021 - RNA, 19 nt, Human
cagcucuuugcaaagcugc

SEQ ID NO: 25022 - RNA, 24 nt, Human
ucucauguugaagccacugccuuc

SEQ ID NO: 25023 - RNA, 17 nt, Human
acaguuguuccuaucuc

SEQ ID NO: 25024 - RNA, 27 nt, Human
aaacuauuuuccacucaaauccugagu

SEQ ID NO: 25025 - RNA, 26 nt, Human
caugccaccacacuguaccauggggg

SEQ ID NO: 25026 - RNA, 23 nt, Human
uaagcugagcgauuucuaauaaa

SEQ ID NO: 25027 - RNA, 23 nt, Human
ggcuauuccauccaucuggaagc

SEQ ID NO: 25028 - RNA, 20 nt, Human
auauuuucucucaucuaaca

SEQ ID NO: 25029 - RNA, 25 nt, Human
ccucugccucucgucugaccuugca

SEQ ID NO: 25030 - RNA, 27 nt, Human
uaaauuugaaaccugcauuucucccac

SEQ ID NO: 25031 - RNA, 23 nt, Human
cauccaggaaaacuugugcugga

SEQ ID NO: 25032 - RNA, 25 nt, Human
agagacaccuagcuuagucauggca

SEQ ID NO: 25033 - RNA, 26 nt, Human
cccagccagggugugacucgggagcu

SEQ ID NO: 25034 - RNA, 29 nt, Human
ucagccugaucaggcuuccuggugagaac

SEQ ID NO: 25035 - RNA, 22 nt, Human
ggaccagccuggacaacauggu

SEQ ID NO: 25036 - RNA, 21 nt, Human
uggaauauugcuuaaauguuu

SEQ ID NO: 25037 - RNA, 26 nt, Human
cuugucgcucaggcuggagugccaug

SEQ ID NO: 25038 - RNA, 22 nt, Human
aggacucuagacaaaaccuucu

SEQ ID NO: 25039 - RNA, 18 nt, Human
ugaauucccugggaguca

SEQ ID NO: 25040 - RNA, 26 nt, Human
cacaugcucacaaccauccuggucau

SEQ ID NO: 25041 - RNA, 21 nt, Human
uccuaagcuggagugcagugg

SEQ ID NO: 25042 - RNA, 21 nt, Human
augauuucucccuguauugag

SEQ ID NO: 25043 - RNA, 22 nt, Human
augcuagggggccagggaaaca

SEQ ID NO: 25044 - RNA, 23 nt, Human
ccccacccucccaugagacugcc

SEQ ID NO: 25045 - RNA, 21 nt, Human
gccacugcacgccagccuggg

SEQ ID NO: 25046 - RNA, 26 nt, Human
ccaggccgccuccccacucccccuca

SEQ ID NO: 25047 - RNA, 20 nt, Human
gggguagcgagguugcagga

SEQ ID NO: 25048 - RNA, 20 nt, Human
agguaugagggaaagagagu

SEQ ID NO: 25049 - RNA, 20 nt, Human
acugcagaucuugagauaug

SEQ ID NO: 25050 - RNA, 21 nt, Human
agccaagagcacagacuugga

SEQ ID NO: 25051 - RNA, 27 nt, Human
aaugccagguaggaggaagggcugggg

SEQ ID NO: 25052 - RNA, 22 nt, Human
ugaccaacauggugaaacccca

SEQ ID NO: 25053 - RNA, 22 nt, Human
uggccaacauagugaaacccca

SEQ ID NO: 25054 - RNA, 22 nt, Human
ccacugcacuccagccugggag

SEQ ID NO: 25055 - RNA, 21 nt, Human
auuggccaggcuggugucgaa

SEQ ID NO: 25056 - RNA, 21 nt, Human
cuugugauccgccugccucgg

SEQ ID NO: 25057 - RNA, 19 nt, Human
gggcuggcuguggccaggu

SEQ ID NO: 25058 - RNA, 22 nt, Human
ggggcggggacccagccuagcc

SEQ ID NO: 25059 - RNA, 22 nt, Human
gcacggggagacguacguauca

SEQ ID NO: 25060 - RNA, 26 nt, Human
uuauuucuucauuucucaguaaucau

SEQ ID NO: 25061 - RNA, 28 nt, Human
ccuuugaggcuccugagugcccucagau

SEQ ID NO: 25062 - RNA, 21 nt, Human
ugagaaugugaccgguuuuga

SEQ ID NO: 25063 - RNA, 22 nt, Human
gugauuucucccuuguccaaag

SEQ ID NO: 25064 - RNA, 18 nt, Human
gaugccaucaugcagccu

SEQ ID NO: 25065 - RNA, 26 nt, Human
ugaaccacgauggcuguugaggaauu

SEQ ID NO: 25066 - RNA, 20 nt, Human
gcucuuuguuuugugucucu

SEQ ID NO: 25067 - RNA, 21 nt, Human
aguguuuaaugagaguuuaca

SEQ ID NO: 25068 - RNA, 22 nt, Human
augucagacuuugcugcauuuu

SEQ ID NO: 25069 - RNA, 20 nt, Human
ggguugggggagcaggaagc

SEQ ID NO: 25070 - RNA, 21 nt, Human
cagacuucugggcagagcuga

SEQ ID NO: 25071 - RNA, 26 nt, Human
uuaggaaacgugaaaggcuguggcau

SEQ ID NO: 25072 - RNA, 23 nt, Human
caggagguggaggaauuaaguga

SEQ ID NO: 25073 - RNA, 22 nt, Human
gccuaucucuagcccaugguuu

SEQ ID NO: 25074 - RNA, 21 nt, Human
acagacaccucccccuaccca

SEQ ID NO: 25075 - RNA, 19 nt, Human
cuguuuuccucucucuuuc

SEQ ID NO: 25076 - RNA, 22 nt, Human
aaguagcugggauuacaggcau

SEQ ID NO: 25077 - RNA, 26 nt, Human
gucugcucccugucuucugucagccu

SEQ ID NO: 25078 - RNA, 24 nt, Human
cucuaggcuggccccuuguccacc

SEQ ID NO: 25079 - RNA, 22 nt, Human
uggucucaaacuccuaggauca

SEQ ID NO: 25080 - RNA, 25 nt, Human
ugguagcucacaccuauaaucccag

SEQ ID NO: 25081 - RNA, 22 nt, Human
gagaaacaggcucugagauuuc

SEQ ID NO: 25082 - RNA, 25 nt, Human
gccucaaggccggcuucucuucugg

SEQ ID NO: 25083 - RNA, 27 nt, Human
cccuccaggaaaggccugaggaugugu

SEQ ID NO: 25084 - RNA, 25 nt, Human
gggggugguugaggggggaggcagc

SEQ ID NO: 25085 - RNA, 24 nt, Human
cauuuucuuucuucucuuuuuguu

SEQ ID NO: 25086 - RNA, 27 nt, Human
ugguucauaaaugaauuuuaguuuggu

SEQ ID NO: 25087 - RNA, 25 nt, Human
cucugcucccaggaagcugugcgga

SEQ ID NO: 25088 - RNA, 22 nt, Human
ccuuuggccucccccuuuaccc

SEQ ID NO: 25089 - RNA, 25 nt, Human
uuccaacaacaaccagcuccaacug

SEQ ID NO: 25090 - RNA, 32 nt, Human
gggagacgggggcagagagggacccuccacca

SEQ ID NO: 25091 - RNA, 24 nt, Human
gagucaggggcagagcagggcggu

SEQ ID NO: 25092 - RNA, 22 nt, Human
cccaggagcaggcagggcaguu

SEQ ID NO: 25093 - RNA, 28 nt, Human
cuuaucucauccuuuccucuagcuuuuc

SEQ ID NO: 25094 - RNA, 26 nt, Human
gccucccaaguugcugggauuacuga

SEQ ID NO: 25095 - RNA, 22 nt, Human
guggaaauguaaauuaaauuag

SEQ ID NO: 25096 - RNA, 24 nt, Human
aguuuguaaauguuauuucugcaa

SEQ ID NO: 25097 - RNA, 22 nt, Human
cugcucucucugucucucuguc

SEQ ID NO: 25098 - RNA, 23 nt, Human
ucagccaccucccucugccaguc

SEQ ID NO: 25099 - RNA, 27 nt, Human
ugacuucuaagagacaaggaaguagga

SEQ ID NO: 25100 - RNA, 26 nt, Human
ugagaggugguagagcaggaagcugc

SEQ ID NO: 25101 - RNA, 24 nt, Human
gcccagccaggcuccuguggugcu

SEQ ID NO: 25102 - RNA, 22 nt, Human
guacauuuuugaagugugcagg

SEQ ID NO: 25103 - RNA, 24 nt, Human
cuuggagggaauucugagaagaca

SEQ ID NO: 25104 - RNA, 23 nt, Human
ccucagucccucccagcugcagu

SEQ ID NO: 25105 - RNA, 25 nt, Human
uguguaauuccagaugagucacugu

SEQ ID NO: 25106 - RNA, 22 nt, Human
auucauauucacagggucguug

SEQ ID NO: 25107 - RNA, 22 nt, Human
ggaggcaccugaggcccagaga

SEQ ID NO: 25108 - RNA, 21 nt, Human
acaugaggacagaaggacugg

SEQ ID NO: 25109 - RNA, 25 nt, Human
gagacagagccucagccugccugga

SEQ ID NO: 25110 - RNA, 26 nt, Human
ccuaaaacaaauaguuuauaaaugug

SEQ ID NO: 25111 - RNA, 18 nt, Human
gcuaaucucaggacuggg

SEQ ID NO: 25112 - RNA, 27 nt, Human
uccuccuggguucauguuguaauaaaa

SEQ ID NO: 25113 - RNA, 22 nt, Human
uacugaguguaccacugccuuc

SEQ ID NO: 25114 - RNA, 25 nt, Human
ggucuucuucaagagagcuaaguau

SEQ ID NO: 25115 - RNA, 27 nt, Human
cuguggcuaccaaaauccaugcuucuc

SEQ ID NO: 25116 - RNA, 20 nt, Human
accucagccugcacaguguc

SEQ ID NO: 25117 - RNA, 21 nt, Human
gguagguggaaucaguuaaug

SEQ ID NO: 25118 - RNA, 27 nt, Human
gucgcccaggcuggagguuaauggcau

SEQ ID NO: 25119 - RNA, 27 nt, Human
uucucaugugguugaaccaguguguuu

SEQ ID NO: 25120 - RNA, 26 nt, Human
auugguuucuuucuuuacuuugugcu

SEQ ID NO: 25121 - RNA, 28 nt, Human
uaccuauugcacuccauccuggaugaaa

SEQ ID NO: 25122 - RNA, 21 nt, Human
ucauccagaaagagaagaaga

SEQ ID NO: 25123 - RNA, 21 nt, Human
gguggaugaguuggugcugcu

SEQ ID NO: 25124 - RNA, 20 nt, Human
uccugagaggguuuccuaac

SEQ ID NO: 25125 - RNA, 20 nt, Human
caguggcaccuccuggaaac

SEQ ID NO: 25126 - RNA, 24 nt, Human
ucucagcccccaccucagguuagg

SEQ ID NO: 25127 - RNA, 22 nt, Human
caggggcugggacaugggggug

SEQ ID NO: 25128 - RNA, 22 nt, Human
aagcagaaaguucuacucucgu

SEQ ID NO: 25129 - RNA, 25 nt, Human
aaaccuacagccagcagcagucugg

SEQ ID NO: 25130 - RNA, 18 nt, Human
cacuuccugcgagcauau

SEQ ID NO: 25131 - RNA, 20 nt, Human
aucccuugagcuuagaccug

SEQ ID NO: 25132 - RNA, 27 nt, Human
agcuuugcuccuucaguucugcuugcu

SEQ ID NO: 25133 - RNA, 27 nt, Human
ggcucacuggaccauugucacaacccu

SEQ ID NO: 25134 - RNA, 20 nt, Human
uugcugccuuuuaacuacuu

SEQ ID NO: 25135 - RNA, 24 nt, Human
ccucagcccucucuugccaaaaag

SEQ ID NO: 25136 - RNA, 22 nt, Human
cugggagguggagguugcagug

SEQ ID NO: 25137 - RNA, 21 nt, Human
cucagcuugcugaguggauga

SEQ ID NO: 25138 - RNA, 22 nt, Human
ugaccccuucuuuccuuucucu

SEQ ID NO: 25139 - RNA, 23 nt, Human
ggugcccaccaccaugccuggcu

SEQ ID NO: 25140 - RNA, 19 nt, Human
gcaucuccccuagcucacc

SEQ ID NO: 25141 - RNA, 21 nt, Human
cccacauuucucggguuugug

SEQ ID NO: 25142 - RNA, 22 nt, Human
acgaggcaggggccauuuuacc

SEQ ID NO: 25143 - RNA, 24 nt, Human
uucuccucuucugguccugcccgg

SEQ ID NO: 25144 - RNA, 21 nt, Human
caugucccuccagggggaccc

SEQ ID NO: 25145 - RNA, 23 nt, Human
ugacaagcagaaauuacuuuuaa

SEQ ID NO: 25146 - RNA, 20 nt, Human
auuccugcccccaucaugcc

SEQ ID NO: 25147 - RNA, 24 nt, Human
cuguaaucccagcuacacuggagg

SEQ ID NO: 25148 - RNA, 21 nt, Human
accucuacugaauuguguuaa

SEQ ID NO: 25149 - RNA, 27 nt, Human
ggccagccuggccaaaauggcaaaacc

SEQ ID NO: 25150 - RNA, 25 nt, Human
ucaucauuaaaaauuucuuguauuu

SEQ ID NO: 25151 - RNA, 24 nt, Human
gaaccaccacacccagcagcuccu

SEQ ID NO: 25152 - RNA, 26 nt, Human
ccauuuuacaguuaaggaauauaaug

SEQ ID NO: 25153 - RNA, 23 nt, Human
uuuucuuuucuuuuucuuuuucu

SEQ ID NO: 25154 - RNA, 23 nt, Human
acauggucagaaccuuuggacaa

SEQ ID NO: 25155 - RNA, 25 nt, Human
agcuagcaaagacuugugugaugcc

SEQ ID NO: 25156 - RNA, 25 nt, Human
ccccuagacggccuuuccuuuugca

SEQ ID NO: 25157 - RNA, 26 nt, Human
gcucgggagagagggacgcgggcugc

SEQ ID NO: 25158 - RNA, 22 nt, Human
gagucucgcuguguugccaagg

SEQ ID NO: 25159 - RNA, 19 nt, Human
caacaguucugggaaaugc

SEQ ID NO: 25160 - RNA, 22 nt, Human
ucugcagcuccuggaagguguc

SEQ ID NO: 25161 - RNA, 19 nt, Human
gugacauccuuugcucucu

SEQ ID NO: 25162 - RNA, 20 nt, Human
uggagagcagagcaccaaga

SEQ ID NO: 25163 - RNA, 22 nt, Human
caaggcugaaaccauccgcaac

SEQ ID NO: 25164 - RNA, 24 nt, Human
cugccucugggcucauguaucugc

SEQ ID NO: 25165 - RNA, 18 nt, Human
ggccugaaccccaccuca

SEQ ID NO: 25166 - RNA, 24 nt, Human
uuaguuuuaaaauagcucugugau

SEQ ID NO: 25167 - RNA, 18 nt, Human
agaccuacacucgcucuu

SEQ ID NO: 25168 - RNA, 19 nt, Human
guaguuaaauaacugugug

SEQ ID NO: 25169 - RNA, 23 nt, Human
uucucagcuguccuuuuuucuug

SEQ ID NO: 25170 - RNA, 21 nt, Human
agucauuaguauaauauugcu

SEQ ID NO: 25171 - RNA, 23 nt, Human
uuugucacugacuuguguuccug

SEQ ID NO: 25172 - RNA, 18 nt, Human
gugccuuggaaaugcaaa

SEQ ID NO: 25173 - RNA, 27 nt, Human
ccacugugcuccagccugggcaacaga

SEQ ID NO: 25174 - RNA, 19 nt, Human
ccaggagacguagguugug

SEQ ID NO: 25175 - RNA, 21 nt, Human
uacauaagagaaugaauggaa

SEQ ID NO: 25176 - RNA, 23 nt, Human
ugaagaccaaguccagaacugaa

SEQ ID NO: 25177 - RNA, 25 nt, Human
ugccucucuguuacuuuuggccuau

SEQ ID NO: 25178 - RNA, 22 nt, Human
cccgcagacuucucuguagauc

SEQ ID NO: 25179 - RNA, 20 nt, Human
cucuuagcacauuucuuagg

SEQ ID NO: 25180 - RNA, 23 nt, Human
uguugcccaaccuggagugcagu

SEQ ID NO: 25181 - RNA, 23 nt, Human
gagcuaaauaaauguaauagcca

SEQ ID NO: 25182 - RNA, 25 nt, Human
caggugaaauaaacagcuuuauugc

SEQ ID NO: 25183 - RNA, 26 nt, Human
gggaaagacgaaaaaggcagaaagau

SEQ ID NO: 25184 - RNA, 19 nt, Human
ggggagccucacugugaag

SEQ ID NO: 25185 - RNA, 25 nt, Human
auggccgcuccacagagucgcccca

SEQ ID NO: 25186 - RNA, 27 nt, Human
ccugcagcccccagcaugcgggcaggc

SEQ ID NO: 25187 - RNA, 26 nt, Human
cuggaccagacucucuggcagaggag

SEQ ID NO: 25188 - RNA, 30 nt, Human
agcucacuacaaccuccgccucccauguuc

SEQ ID NO: 25189 - RNA, 23 nt, Human
cgauuucucccuuccuccuagaa

SEQ ID NO: 25190 - RNA, 21 nt, Human
gcaaaguugcaguuuguucuu

SEQ ID NO: 25191 - RNA, 24 nt, Human
ucuuugugcugugacugcaucacc

SEQ ID NO: 25192 - RNA, 21 nt, Human
acuuuccuguucauagcaaua

SEQ ID NO: 25193 - RNA, 20 nt, Human
guacagucuucaccuguaca

SEQ ID NO: 25194 - RNA, 21 nt, Human
ucccggggccuuccuuuugag

SEQ ID NO: 25195 - RNA, 25 nt, Human
uuccugggccuggcucuuacaggcu

SEQ ID NO: 25196 - RNA, 21 nt, Human
cucauuucacagccuuucguu

SEQ ID NO: 25197 - RNA, 20 nt, Human
aauuacccuauccuuuguuc

SEQ ID NO: 25198 - RNA, 25 nt, Human
ggagggaggagcaggcuaggaagac

SEQ ID NO: 25199 - RNA, 22 nt, Human
ggucuccaacuccugagcucag

SEQ ID NO: 25200 - RNA, 19 nt, Human
augccuggcuggguauuua

SEQ ID NO: 25201 - RNA, 27 nt, Human
cagccucucacuacucuuucuggcuaa

SEQ ID NO: 25202 - RNA, 17 nt, Human
ugaacaaauggccuuua

SEQ ID NO: 25203 - RNA, 22 nt, Human
ucaucugggacuggcuuuugcu

SEQ ID NO: 25204 - RNA, 25 nt, Human
agcuaaauaacuugccauuucuuua

SEQ ID NO: 25205 - RNA, 23 nt, Human
aguuguucucccaucucugagca

SEQ ID NO: 25206 - RNA, 22 nt, Human
agagugagggagggaaggaagg

SEQ ID NO: 25207 - RNA, 21 nt, Human
ggcggucagauuucuuugaga

SEQ ID NO: 25208 - RNA, 21 nt, Human
uguacuuacauugugccaaag

SEQ ID NO: 25209 - RNA, 20 nt, Human
ugucugcuuuaagcuguaau

SEQ ID NO: 25210 - RNA, 22 nt, Human
uggcugcugcaggguguggcug

SEQ ID NO: 25211 - RNA, 22 nt, Human
cccaugucccacaaggcugcuu

SEQ ID NO: 25212 - RNA, 19 nt, Human
gacacaaguuuucuuuuug

SEQ ID NO: 25213 - RNA, 22 nt, Human
uucccagagccaaaugacacua

SEQ ID NO: 25214 - RNA, 23 nt, Human
ucuguagggcuuccccaccucuc

SEQ ID NO: 25215 - RNA, 27 nt, Human
ggggagggagagugaacuccgaggggu

SEQ ID NO: 25216 - RNA, 25 nt, Human
gggagacaacggcagagggagugag

SEQ ID NO: 25217 - RNA, 22 nt, Human
aggcccuuccccuuuagggagg

SEQ ID NO: 25218 - RNA, 22 nt, Human
uacaacacaaggcagcaagcac

SEQ ID NO: 25219 - RNA, 20 nt, Human
ccugcuaguccccucuuggc

SEQ ID NO: 25220 - RNA, 23 nt, Human
cuuagcccugcaauaucagggcc

SEQ ID NO: 25221 - RNA, 18 nt, Human
agcuuuuucguauauugu

SEQ ID NO: 25222 - RNA, 23 nt, Human
gucuacccugaucaccucagggc

SEQ ID NO: 25223 - RNA, 27 nt, Human
aaaacauuccguuuacauuuuagacag

SEQ ID NO: 25224 - RNA, 27 nt, Human
guaguugggagagagccucaauauugg

SEQ ID NO: 25225 - RNA, 22 nt, Human
ugcgaccuuaauuuaacuuucc

SEQ ID NO: 25226 - RNA, 19 nt, Human
ccuaaacugcugauuggcc

SEQ ID NO: 25227 - RNA, 27 nt, Human
uggagggcagagggccgcggaggccgc

SEQ ID NO: 25228 - RNA, 20 nt, Human
aucuuaaccuuuuguauuua

SEQ ID NO: 25229 - RNA, 26 nt, Human
agcuggacaaagacucuggagagaga

SEQ ID NO: 25230 - RNA, 22 nt, Human
ugaacaacugucuccauuuuuc

SEQ ID NO: 25231 - RNA, 27 nt, Human
gguccgcggggaagucuuggcggugga

SEQ ID NO: 25232 - RNA, 23 nt, Human
auggcccuccuaaagacacucua

SEQ ID NO: 25233 - RNA, 22 nt, Human
cccacugcaucagaagcagguu

SEQ ID NO: 25234 - RNA, 21 nt, Human
acaccuggcuaccauuuuguu

SEQ ID NO: 25235 - RNA, 25 nt, Human
ccaucugccgucuugguucaucuca

SEQ ID NO: 25236 - RNA, 23 nt, Human
ucuguugucaaccgccugccucu

SEQ ID NO: 25237 - RNA, 24 nt, Human
gccauccaggcugggaggggaaga

SEQ ID NO: 25238 - RNA, 21 nt, Human
ucagauaauacagcucaucau

SEQ ID NO: 25239 - RNA, 23 nt, Human
gaaucccaggaggcaggggccgg

SEQ ID NO: 25240 - RNA, 19 nt, Human
augaaugcaaaaggugcug

SEQ ID NO: 25241 - RNA, 24 nt, Human
cugucacccagacuggagugcagu

SEQ ID NO: 25242 - RNA, 21 nt, Human
gcgagggagagaaaugaaggg

SEQ ID NO: 25243 - RNA, 22 nt, Human
ccccgcuaccggcgccuccucu

SEQ ID NO: 25244 - RNA, 23 nt, Human
uuggcucaguggaagcccucuuu

SEQ ID NO: 25245 - RNA, 26 nt, Human
ggaaaggggagcgaugagcuguggag

SEQ ID NO: 25246 - RNA, 31 nt, Human
ugggcugcucucaaaccaugucccaucuuca

SEQ ID NO: 25247 - RNA, 22 nt, Human
aacuacaggcacaugccaccau

SEQ ID NO: 25248 - RNA, 23 nt, Human
gcauuugccuaggacuucucagc

SEQ ID NO: 25249 - RNA, 23 nt, Human
ccauuaacaaagguguucacagu

SEQ ID NO: 25250 - RNA, 21 nt, Human
agggucucccuuucugccuuu

SEQ ID NO: 25251 - RNA, 22 nt, Human
ccuucccucugagccaacaucu

SEQ ID NO: 25252 - RNA, 22 nt, Human
aggaggagggaggcgcugcugg

SEQ ID NO: 25253 - RNA, 23 nt, Human
auuuuuaaaaaauuguguuacua

SEQ ID NO: 25254 - RNA, 22 nt, Human
agagcaagaacauuuuuguuca

SEQ ID NO: 25255 - RNA, 21 nt, Human
aguuacauguuucauaacuuc

SEQ ID NO: 25256 - RNA, 22 nt, Human
uaguauuuuaccuagcauuuca

SEQ ID NO: 25257 - RNA, 21 nt, Human
gggcuuuuccaggaagcccga

SEQ ID NO: 25258 - RNA, 21 nt, Human
ggagggugagaggaagggugg

SEQ ID NO: 25259 - RNA, 18 nt, Human
gagcgcuucaggaaaggc

SEQ ID NO: 25260 - RNA, 23 nt, Human
ugucucccaggcuggagugcagu

SEQ ID NO: 25261 - RNA, 26 nt, Human
uucccagcuaggagugcacuuuaugg

SEQ ID NO: 25262 - RNA, 22 nt, Human
uucauucauagggaaagguuuu

SEQ ID NO: 25263 - RNA, 23 nt, Human
gcaggcuccaggaguuguuugcu

SEQ ID NO: 25264 - RNA, 20 nt, Human
ucacagugaagcaaaggaca

SEQ ID NO: 25265 - RNA, 24 nt, Human
ugagagggaaaagauugacugggg

SEQ ID NO: 25266 - RNA, 23 nt, Human
cuucugauguuucggaacaguca

SEQ ID NO: 25267 - RNA, 22 nt, Human
cgcgggcugggaaggauucacu

SEQ ID NO: 25268 - RNA, 22 nt, Human
gcuugcucuugugccuccuggg

SEQ ID NO: 25269 - RNA, 19 nt, Human
cccaccccacccugccccu

SEQ ID NO: 25270 - RNA, 18 nt, Human
ggccaggguggagcauug

SEQ ID NO: 25271 - RNA, 26 nt, Human
gggggcuugggaagcagaccaggguu

SEQ ID NO: 25272 - RNA, 22 nt, Human
ccagcaauaagaaccaaucugc

SEQ ID NO: 25273 - RNA, 21 nt, Human
cugagucugcccugggcucug

SEQ ID NO: 25274 - RNA, 18 nt, Human
uucugaucucaaaaggca

SEQ ID NO: 25275 - RNA, 22 nt, Human
ggagcgcgucccugcccuuagc

SEQ ID NO: 25276 - RNA, 28 nt, Human
ugcccccaguuaaauaccuccucuaccu

SEQ ID NO: 25277 - RNA, 21 nt, Human
ugaaauucugaauuugcaaag

SEQ ID NO: 25278 - RNA, 21 nt, Human
uuuuugggggcaacauaccuu

SEQ ID NO: 25279 - RNA, 21 nt, Human
augugcaugucuaaauaguca

SEQ ID NO: 25280 - RNA, 26 nt, Human
cccacuacaagugauccucaggcagg

SEQ ID NO: 25281 - RNA, 23 nt, Human
gguccaggcucuaugugaccucc

SEQ ID NO: 25282 - RNA, 24 nt, Human
acccagacuggagugcaggggggc

SEQ ID NO: 25283 - RNA, 23 nt, Human
uaucgcccaggcuggagugcaau

SEQ ID NO: 25284 - RNA, 22 nt, Human
ggcaccaccacaccuggcuuua

SEQ ID NO: 25285 - RNA, 26 nt, Human
cugccucugaacugcugcuggucacc

SEQ ID NO: 25286 - RNA, 27 nt, Human
ccugccugaguuuccagccugcuaguc

SEQ ID NO: 25287 - RNA, 20 nt, Human
ccugccaucaucugcuauuu

SEQ ID NO: 25288 - RNA, 27 nt, Human
ggagcgacggcuaauggcgagccccac

SEQ ID NO: 25289 - RNA, 24 nt, Human
gagguuggagggaaagccuuaagc

SEQ ID NO: 25290 - RNA, 18 nt, Human
agggaaaggggagagggg

SEQ ID NO: 25291 - RNA, 21 nt, Human
aggcugcgggcaguggcaccg

SEQ ID NO: 25292 - RNA, 27 nt, Human
caguucugugaggcuugagcauucaua

SEQ ID NO: 25293 - RNA, 21 nt, Human
gugggcacuggcuggguacgg

SEQ ID NO: 25294 - RNA, 18 nt, Human
uaccuuugaauucaagaa

SEQ ID NO: 25295 - RNA, 23 nt, Human
ccgccauaugcugccugccucgg

SEQ ID NO: 25296 - RNA, 25 nt, Human
aggaagagcagagaaaucuuagacg

SEQ ID NO: 25297 - RNA, 27 nt, Human
agcauuuugucauauccccucuccuua

SEQ ID NO: 25298 - RNA, 24 nt, Human
uguccccagggaagagaaugagga

SEQ ID NO: 25299 - RNA, 22 nt, Human
ucuccagagccuucucucuccu

SEQ ID NO: 25300 - RNA, 26 nt, Human
guccacccuuccaucagcgggucucc

SEQ ID NO: 25301 - RNA, 20 nt, Human
gguucacauaccugccugcu

SEQ ID NO: 25302 - RNA, 23 nt, Human
cauaccuguaaucccagcuacuu

SEQ ID NO: 25303 - RNA, 27 nt, Human
agggucagaaccaaacaauaccugcuc

SEQ ID NO: 25304 - RNA, 26 nt, Human
ccugccucuguggcucugccugugga

SEQ ID NO: 25305 - RNA, 22 nt, Human
caagugcuaggauuacaggcgu

SEQ ID NO: 25306 - RNA, 27 nt, Human
cacucacugcauuuggggccuuuccca

SEQ ID NO: 25307 - RNA, 22 nt, Human
ggugcacaggccucugccugcu

SEQ ID NO: 25308 - RNA, 21 nt, Human
auuccuuucagccuugcugac

SEQ ID NO: 25309 - RNA, 26 nt, Human
gggcgacagaagucuugucucaagaa

SEQ ID NO: 25310 - RNA, 26 nt, Human
gccuguaaucccagcuacuugggagg

SEQ ID NO: 25311 - RNA, 21 nt, Human
guugaugauagauugccuuca

SEQ ID NO: 25312 - RNA, 28 nt, Human
acuuaguuucacacccgggagcugggag

SEQ ID NO: 25313 - RNA, 21 nt, Human
caggccugggucugugucucu

SEQ ID NO: 25314 - RNA, 21 nt, Human
caguguugaaaauguucagaa

SEQ ID NO: 25315 - RNA, 22 nt, Human
aucucuagcauuucucuagccu

SEQ ID NO: 25316 - RNA, 27 nt, Human
ccauggcugguguauauaugugcaaug

SEQ ID NO: 25317 - RNA, 26 nt, Human
caugccacuacacccagcuaacuuuu

SEQ ID NO: 25318 - RNA, 22 nt, Human
ucuccccucugcacccuuggcu

SEQ ID NO: 25319 - RNA, 28 nt, Human
uguuuaaagggauguuauuuuaaagcau

SEQ ID NO: 25320 - RNA, 20 nt, Human
uuucacaccucauauaauca

SEQ ID NO: 25321 - RNA, 23 nt, Human
cagccgcaccuguuccugauggg

SEQ ID NO: 25322 - RNA, 27 nt, Human
agcucacucggaacaguaccagugucu

SEQ ID NO: 25323 - RNA, 23 nt, Human
agcucacaccuguccuucucagg

SEQ ID NO: 25324 - RNA, 24 nt, Human
aggacucagguugucugaagucac

SEQ ID NO: 25325 - RNA, 22 nt, Human
guccccuuguucucucugcuuc

SEQ ID NO: 25326 - RNA, 20 nt, Human
ucuagaaaacagcauuucau

SEQ ID NO: 25327 - RNA, 23 nt, Human
agagggagaugagacagcucucu

SEQ ID NO: 25328 - RNA, 22 nt, Human
cgccuccuggguucaagugauu

SEQ ID NO: 25329 - RNA, 20 nt, Human
uugcaguaagccaaggucau

SEQ ID NO: 25330 - RNA, 20 nt, Human
cgucacuggggcuuuggggu

SEQ ID NO: 25331 - RNA, 23 nt, Human
ucagaagucucuaauauaucauu

SEQ ID NO: 25332 - RNA, 22 nt, Human
uagcauuuggugcuugacguau

SEQ ID NO: 25333 - RNA, 24 nt, Human
cggcagccccucagggacucucag

SEQ ID NO: 25334 - RNA, 23 nt, Human
ccaacuggcagcuuucccugaca

SEQ ID NO: 25335 - RNA, 20 nt, Human
cccuucagacgagauccugu

SEQ ID NO: 25336 - RNA, 22 nt, Human
caagagguuuuucagcucuuug

SEQ ID NO: 25337 - RNA, 25 nt, Human
aucccaggcucuccccaaccccagg

SEQ ID NO: 25338 - RNA, 20 nt, Human
agguuuuggggaugugucuu

SEQ ID NO: 25339 - RNA, 26 nt, Human
ggacuccugccagaccacacagccca

SEQ ID NO: 25340 - RNA, 21 nt, Human
gcuuuuauuuucuuccaagcc

SEQ ID NO: 25341 - RNA, 21 nt, Human
uacugcugagucagacuguca

SEQ ID NO: 25342 - RNA, 20 nt, Human
cauuaucaucuucacuucag

SEQ ID NO: 25343 - RNA, 27 nt, Human
cuguuuguuucuccaagccugcuuugu

SEQ ID NO: 25344 - RNA, 25 nt, Human
uccccuuuuaaauuacacacacucu

SEQ ID NO: 25345 - RNA, 22 nt, Human
ggacaccaccuggccugguggg

SEQ ID NO: 25346 - RNA, 20 nt, Human
cgggugggugcaguggcuca

SEQ ID NO: 25347 - RNA, 24 nt, Human
acccuaaccacagcgccucuccag

SEQ ID NO: 25348 - RNA, 26 nt, Human
auuuuagaaucaguguguuacuaucu

SEQ ID NO: 25349 - RNA, 23 nt, Human
cacaggagugcagagagggggga

SEQ ID NO: 25350 - RNA, 28 nt, Human
ggggcugggagagcagaagggcaggccc

SEQ ID NO: 25351 - RNA, 27 nt, Human
ggaauuugggaagcuggcuccagaaaa

SEQ ID NO: 25352 - RNA, 20 nt, Human
ccaggaaagggggcugcaaa

SEQ ID NO: 25353 - RNA, 26 nt, Human
cuccuccucugcuccgccaccggcuu

SEQ ID NO: 25354 - RNA, 21 nt, Human
uuuucucaaaagaaggaggaa

SEQ ID NO: 25355 - RNA, 18 nt, Human
ugacccaggcuggaggac

SEQ ID NO: 25356 - RNA, 20 nt, Human
gggcgaaagauaucucucca

SEQ ID NO: 25357 - RNA, 26 nt, Human
gcagucugugugugaggcauagcccc

SEQ ID NO: 25358 - RNA, 21 nt, Human
uuucugcggcuccauccuaag

SEQ ID NO: 25359 - RNA, 26 nt, Human
uagccuguggcccuguccugccaugc

SEQ ID NO: 25360 - RNA, 23 nt, Human
uuuugcugcucuccuugaggaua

SEQ ID NO: 25361 - RNA, 27 nt, Human
accagccugcccaacauggcaaaaccu

SEQ ID NO: 25362 - RNA, 23 nt, Human
ccagcuccccacugagguguugu

SEQ ID NO: 25363 - RNA, 24 nt, Human
uaggccccugauucacugccuaug

SEQ ID NO: 25364 - RNA, 23 nt, Human
caccugcauggggagcccagugc

SEQ ID NO: 25365 - RNA, 21 nt, Human
ccagaucuccaacagugccuu

SEQ ID NO: 25366 - RNA, 23 nt, Human
ggucccuccccuucucugugcag

SEQ ID NO: 25367 - RNA, 22 nt, Human
aaaaauaaaccaaaggacauua

SEQ ID NO: 25368 - RNA, 27 nt, Human
ucuugggcaagaugaccuacuaguuuu

SEQ ID NO: 25369 - RNA, 21 nt, Human
agcuggagaaagaggcaaaaa

SEQ ID NO: 25370 - RNA, 21 nt, Human
gugugcgugcgcaucuugccu

SEQ ID NO: 25371 - RNA, 21 nt, Human
cucucuuguugcccaggcugg

SEQ ID NO: 25372 - RNA, 21 nt, Human
gcuugccaaagcagauuuucc

SEQ ID NO: 25373 - RNA, 23 nt, Human
cgccaccacaucacaugaccuua

SEQ ID NO: 25374 - RNA, 26 nt, Human
gucaggcuguggagcaggagcacagc

SEQ ID NO: 25375 - RNA, 25 nt, Human
uuuguucuugaacucugggaggcag

SEQ ID NO: 25376 - RNA, 26 nt, Human
cugcauucuuauagaaacaaagcaca

SEQ ID NO: 25377 - RNA, 21 nt, Human
cuggugggcugugcuucccuc

SEQ ID NO: 25378 - RNA, 23 nt, Human
gcuucaaauuaaaacagcugcau

SEQ ID NO: 25379 - RNA, 21 nt, Human
uuguaacaucugagauuagaa

SEQ ID NO: 25380 - RNA, 22 nt, Human
aacauguucagaaaagaaguga

SEQ ID NO: 25381 - RNA, 21 nt, Human
cgccuccaaguagcugggacu

SEQ ID NO: 25382 - RNA, 21 nt, Human
auggaaagcuguguuuggaaa

SEQ ID NO: 25383 - RNA, 27 nt, Human
cccucauuccuuccacccugaggcuug

SEQ ID NO: 25384 - RNA, 32 nt, Human
aaucaguuuucuauugaaaauguuugugauau

SEQ ID NO: 25385 - RNA, 23 nt, Human
agccacauccucuugcugauguu

SEQ ID NO: 25386 - RNA, 23 nt, Human
ucugucuccugcuucacaggguc

SEQ ID NO: 25387 - RNA, 25 nt, Human
aucaaguuuugacgguuuaugcugg

SEQ ID NO: 25388 - RNA, 22 nt, Human
agacccuaacaguccagcagga

SEQ ID NO: 25389 - RNA, 16 nt, Human
cugucugaggggccuc

SEQ ID NO: 25390 - RNA, 21 nt, Human
gccccagggaaggucacagcu

SEQ ID NO: 25391 - RNA, 23 nt, Human
aguuugggggcggccggcagcag

SEQ ID NO: 25392 - RNA, 24 nt, Human
ggcucuuaggagagcggaaaggac

SEQ ID NO: 25393 - RNA, 23 nt, Human
caugccuguaauuccagcugcuu

SEQ ID NO: 25394 - RNA, 27 nt, Human
ccaggaggcagcugcugacagguuugc

SEQ ID NO: 25395 - RNA, 21 nt, Human
auauaucucugugucucucca

SEQ ID NO: 25396 - RNA, 27 nt, Human
gcuuuucuccccauaucccaaggcgaa

SEQ ID NO: 25397 - RNA, 22 nt, Human
ccccaaaaauuuucgccacccc

SEQ ID NO: 25398 - RNA, 25 nt, Human
cuugacauggaaugccuuugaccau

SEQ ID NO: 25399 - RNA, 19 nt, Human
ccgaaaacuucacugugcu

SEQ ID NO: 25400 - RNA, 25 nt, Human
ggcugccuccagcccgggccugugu

SEQ ID NO: 25401 - RNA, 24 nt, Human
uuauagaauugcacauaguucugc

SEQ ID NO: 25402 - RNA, 23 nt, Human
guugcccaggcuggaguacaaug

SEQ ID NO: 25403 - RNA, 32 nt, Human
gccggcuucgcugcggguuugcacugcccggc

SEQ ID NO: 25404 - RNA, 21 nt, Human
uccacaugagguuuuucugag

SEQ ID NO: 25405 - RNA, 25 nt, Human
ggugucacccuggauaggcaaggga

SEQ ID NO: 25406 - RNA, 23 nt, Human
gaauuugagguucugacaacagu

SEQ ID NO: 25407 - RNA, 20 nt, Human
aacaacaaaagaacuagucc

SEQ ID NO: 25408 - RNA, 23 nt, Human
ccaagcccccauucccagagcag

SEQ ID NO: 25409 - RNA, 22 nt, Human
aaggcugaggcaggagaaucgc

SEQ ID NO: 25410 - RNA, 20 nt, Human
ggacaaacuucauuugacuu

SEQ ID NO: 25411 - RNA, 26 nt, Human
aaugccaggcccaagggacaaaaaga

SEQ ID NO: 25412 - RNA, 18 nt, Human
auacgugcuuaacuuugc

SEQ ID NO: 25413 - RNA, 27 nt, Human
cccugagacacuauggcccugaccuca

SEQ ID NO: 25414 - RNA, 27 nt, Human
gaaguguguuuagaaggguucaggacu

SEQ ID NO: 25415 - RNA, 21 nt, Human
uuucuuuuuugagguggaguc

SEQ ID NO: 25416 - RNA, 21 nt, Human
gggcuguaucucucccugggc

SEQ ID NO: 25417 - RNA, 21 nt, Human
uucgggccuagcggagccggg

SEQ ID NO: 25418 - RNA, 21 nt, Human
ucacugagcaccaugugucau

SEQ ID NO: 25419 - RNA, 22 nt, Human
uucagguggaggucccgagugg

SEQ ID NO: 25420 - RNA, 23 nt, Human
ucuuggggaaaccucagaacugg

SEQ ID NO: 25421 - RNA, 25 nt, Human
guggguuagcuaaaccaagaaggag

SEQ ID NO: 25422 - RNA, 26 nt, Human
cccugcucuccugcagggagguggcu

SEQ ID NO: 25423 - RNA, 24 nt, Human
aaugcauccagacacugugcuggg

SEQ ID NO: 25424 - RNA, 24 nt, Human
ucaguuucaguugauaccuccuca

SEQ ID NO: 25425 - RNA, 20 nt, Human
gccaucugaguguccaucua

SEQ ID NO: 25426 - RNA, 22 nt, Human
aggagggaaacccuacagcucc

SEQ ID NO: 25427 - RNA, 19 nt, Human
aaggaagagaaggccagca

SEQ ID NO: 25428 - RNA, 21 nt, Human
agagaagauauucuggugacu

SEQ ID NO: 25429 - RNA, 21 nt, Human
gaaccagccugagugcagcug

SEQ ID NO: 25430 - RNA, 23 nt, Human
ccucucauccauaacucaaauuu

SEQ ID NO: 25431 - RNA, 22 nt, Human
uugagggcaaggucaaggggug

SEQ ID NO: 25432 - RNA, 23 nt, Human
auugagcauuuuuucaugugcca

SEQ ID NO: 25433 - RNA, 21 nt, Human
uuccaaaauacucaaugggaa

SEQ ID NO: 25434 - RNA, 26 nt, Human
ugcccaggcuggaguguaguggugug

SEQ ID NO: 25435 - RNA, 26 nt, Human
ugcccaggcuggagugcaguggugcg

SEQ ID NO: 25436 - RNA, 28 nt, Human
gccuuuucuccccguuaaagggcacuug

SEQ ID NO: 25437 - RNA, 23 nt, Human
gugagguaggcgggaaaggaugg

SEQ ID NO: 25438 - RNA, 21 nt, Human
caggucuccugggaaagggag

SEQ ID NO: 25439 - RNA, 21 nt, Human
caguccaaaccggaagggaga

SEQ ID NO: 25440 - RNA, 23 nt, Human
gccuguaaucccagcuacugggg

SEQ ID NO: 25441 - RNA, 24 nt, Human
uucugguggguugaugguagggua

SEQ ID NO: 25442 - RNA, 26 nt, Human
uucacccuaacccuguacuaaccugc

SEQ ID NO: 25443 - RNA, 26 nt, Human
gcuggagguggaaaauggugccugga

SEQ ID NO: 25444 - RNA, 21 nt, Human
acuacuggaccuuauuuugga

SEQ ID NO: 25445 - RNA, 26 nt, Human
ugucccugugguacccuggcagagaa

SEQ ID NO: 25446 - RNA, 23 nt, Human
guuucauaaccugccuccuuugc

SEQ ID NO: 25447 - RNA, 25 nt, Human
guucugacaguauuucaugacaaug

SEQ ID NO: 25448 - RNA, 24 nt, Human
gucacagagucuccugggcacagg

SEQ ID NO: 25449 - RNA, 22 nt, Human
gcuuagaauggggcuaagggaa

SEQ ID NO: 25450 - RNA, 20 nt, Human
gccaccucugaaagcagguu

SEQ ID NO: 25451 - RNA, 22 nt, Human
ugugcugcagccgugugugugc

SEQ ID NO: 25452 - RNA, 22 nt, Human
gcccaggcuagaguggauuggc

SEQ ID NO: 25453 - RNA, 22 nt, Human
ugggcugugagaaugagcugua

SEQ ID NO: 25454 - RNA, 23 nt, Human
auuccagucaucucagucguugu

SEQ ID NO: 25455 - RNA, 21 nt, Human
uuugcaguucuucaucaugag

SEQ ID NO: 25456 - RNA, 22 nt, Human
uugcuucugugcuaugguacca

SEQ ID NO: 25457 - RNA, 22 nt, Human
caggccuggacuuccagugcuc

SEQ ID NO: 25458 - RNA, 29 nt, Human
uucaaaacguugauacuuacuuagauguu

SEQ ID NO: 25459 - RNA, 21 nt, Human
cuaucuagaccugaaguagcg

SEQ ID NO: 25460 - RNA, 27 nt, Human
aaauguucaucaauucccauugcauca

SEQ ID NO: 25461 - RNA, 20 nt, Human
uauaucuggccacacugggc

SEQ ID NO: 25462 - RNA, 22 nt, Human
agguguccuuuuccuuucuucu

SEQ ID NO: 25463 - RNA, 27 nt, Human
agguggagaugaugccucaggagcagu

SEQ ID NO: 25464 - RNA, 23 nt, Human
uuucugguaauaagaagcacuua

SEQ ID NO: 25465 - RNA, 21 nt, Human
ggcauuuucaucuuuccuucg

SEQ ID NO: 25466 - RNA, 22 nt, Human
cucagccucccaaagugcugga

SEQ ID NO: 25467 - RNA, 21 nt, Human
ucuccucccucuuucuucggg

SEQ ID NO: 25468 - RNA, 22 nt, Human
cuauagcaaccacauuugacua

SEQ ID NO: 25469 - RNA, 21 nt, Human
ccguuuugcccggcagcagca

SEQ ID NO: 25470 - RNA, 30 nt, Human
ccaggcaacaggacuaaacuaccuccaaag

SEQ ID NO: 25471 - RNA, 21 nt, Human
uccuccucgucuuaggggggu

SEQ ID NO: 25472 - RNA, 26 nt, Human
uagagugcugugagaugagagugggu

SEQ ID NO: 25473 - RNA, 22 nt, Human
aauuuauaacuuacuuauuuuu

SEQ ID NO: 25474 - RNA, 22 nt, Human
uucccugcuuugguuuguuuga

SEQ ID NO: 25475 - RNA, 22 nt, Human
cccaccccagagaccuccaccu

SEQ ID NO: 25476 - RNA, 22 nt, Human
aggcccuucaucugcugcucug

SEQ ID NO: 25477 - RNA, 20 nt, Human
ugaggcacccucagagaagg

SEQ ID NO: 25478 - RNA, 24 nt, Human
uugaaggaggaaacugaugacaga

SEQ ID NO: 25479 - RNA, 21 nt, Human
agagguggggguggaggggaa

SEQ ID NO: 25480 - RNA, 22 nt, Human
agcucacaccuguccuucucag

SEQ ID NO: 25481 - RNA, 21 nt, Human
ccaguucagcuuucaaaaaga

SEQ ID NO: 25482 - RNA, 21 nt, Human
ccaugcuccacucccugcugc

SEQ ID NO: 25483 - RNA, 24 nt, Human
ggcagaggucaggagacucagccc

SEQ ID NO: 25484 - RNA, 22 nt, Human
cacgccuguaauuccagcaugu

SEQ ID NO: 25485 - RNA, 24 nt, Human
caagaucauauuaaggaaugcuga

SEQ ID NO: 25486 - RNA, 23 nt, Human
ucuguucugccucuuaucagcca

SEQ ID NO: 25487 - RNA, 22 nt, Human
uaagaccaccuucccuuccuca

SEQ ID NO: 25488 - RNA, 21 nt, Human
ucucugagggagaggcugugg

SEQ ID NO: 25489 - RNA, 25 nt, Human
uggagcagugggcaagacaguccuu

SEQ ID NO: 25490 - RNA, 23 nt, Human
aguucugcaauaagauucuaguu

SEQ ID NO: 25491 - RNA, 26 nt, Human
guucguguucauacugcagcuuaaaa

SEQ ID NO: 25492 - RNA, 21 nt, Human
caguaaguccaguaaagccuu

SEQ ID NO: 25493 - RNA, 21 nt, Human
uaucucccaaaugagaaguca

SEQ ID NO: 25494 - RNA, 22 nt, Human
gaggcauuccagccccuauguu

SEQ ID NO: 25495 - RNA, 23 nt, Human
agccagguuccagagcagcaggc

SEQ ID NO: 25496 - RNA, 26 nt, Human
ucggaggacccuggaaaacagacggg

SEQ ID NO: 25497 - RNA, 24 nt, Human
acagaauaguuuacacacugugug

SEQ ID NO: 25498 - RNA, 23 nt, Human
uuucuuuaagauaauaguuuaca

SEQ ID NO: 25499 - RNA, 25 nt, Human
aggaccaccuggccagauccgcucc

SEQ ID NO: 25500 - RNA, 27 nt, Human
gggguuagaguggggagugggcuucuu

SEQ ID NO: 25501 - RNA, 23 nt, Human
gauaugggaaacuaaaucugccg

SEQ ID NO: 25502 - RNA, 26 nt, Human
ucuauggccuugcucucugcuguccu

SEQ ID NO: 25503 - RNA, 21 nt, Human
uacaauacaacacauugaaac

SEQ ID NO: 25504 - RNA, 22 nt, Human
gagcuaggagaugggaggcaca

SEQ ID NO: 25505 - RNA, 22 nt, Human
ccuuccucuaucccuagggcuc

SEQ ID NO: 25506 - RNA, 26 nt, Human
gugaaugacugcauaguauucacuuu

SEQ ID NO: 25507 - RNA, 22 nt, Human
cccaucugagccagccugcugg

SEQ ID NO: 25508 - RNA, 25 nt, Human
acaacaucauggcucuuggcaguuu

SEQ ID NO: 25509 - RNA, 27 nt, Human
auuuauaucugaauuauuaccuccaua

SEQ ID NO: 25510 - RNA, 21 nt, Human
gccagucucaaacuccuggcc

SEQ ID NO: 25511 - RNA, 24 nt, Human
cugucugucucugucuugguaguu

SEQ ID NO: 25512 - RNA, 24 nt, Human
aggcuggagugcagugaugcgauu

SEQ ID NO: 25513 - RNA, 23 nt, Human
uggaguagcugggauuuacuagu

SEQ ID NO: 25514 - RNA, 20 nt, Human
caucucaggccagagccaag

SEQ ID NO: 25515 - RNA, 25 nt, Human
cgaggaagcauugauugggagcuac

SEQ ID NO: 25516 - RNA, 25 nt, Human
guuugccaggauguccgagugcccc

SEQ ID NO: 25517 - RNA, 20 nt, Human
caagcuuggaaaguguuagg

SEQ ID NO: 25518 - RNA, 19 nt, Human
cugggugugaguguuuaca

SEQ ID NO: 25519 - RNA, 24 nt, Human
ggccaguuuugugcagcugacugu

SEQ ID NO: 25520 - RNA, 26 nt, Human
cugagggcgcuggcucugcagaucag

SEQ ID NO: 25521 - RNA, 24 nt, Human
aacccagucagcugacuuccucgu

SEQ ID NO: 25522 - RNA, 22 nt, Human
cuguguuuuuuaucuucauaua

SEQ ID NO: 25523 - RNA, 20 nt, Human
uaugagguuuugccaagcaa

SEQ ID NO: 25524 - RNA, 20 nt, Human
uccugugguuuuauuacaaa

SEQ ID NO: 25525 - RNA, 17 nt, Human
ccuccugcccuggagcu

SEQ ID NO: 25526 - RNA, 20 nt, Human
ucuucaucugagagaggcua

SEQ ID NO: 25527 - RNA, 26 nt, Human
cacacagcaaaagucaccaacucaaa

SEQ ID NO: 25528 - RNA, 22 nt, Human
uaggagcuaaagcaggucucca

SEQ ID NO: 25529 - RNA, 20 nt, Human
agcaggaagccgaugugacu

SEQ ID NO: 25530 - RNA, 20 nt, Human
ucucguuccuguugggcuga

SEQ ID NO: 25531 - RNA, 21 nt, Human
ggucuuuccaccugcgcggcu

SEQ ID NO: 25532 - RNA, 17 nt, Human
ccuuucuccuuuggguu

SEQ ID NO: 25533 - RNA, 27 nt, Human
uacccagcauuuaacggcaagaacuuu

SEQ ID NO: 25534 - RNA, 26 nt, Human
uuaaauggcaucagcacuuuaaccaa

SEQ ID NO: 25535 - RNA, 25 nt, Human
auguuuucacacucauuuuuccuua

SEQ ID NO: 25536 - RNA, 25 nt, Human
cugcagcugauguuaucagcaggcc

SEQ ID NO: 25537 - RNA, 27 nt, Human
guguuaccuggcuuuuggcuccacgcu

SEQ ID NO: 25538 - RNA, 18 nt, Human
cuucugcuccagcuugcu

SEQ ID NO: 25539 - RNA, 23 nt, Human
cacuucuccucucugggccuugg

SEQ ID NO: 25540 - RNA, 26 nt, Human
cacccuaccaacuuuacuguccuaac

SEQ ID NO: 25541 - RNA, 21 nt, Human
cagcagcugcuggccugugcc

SEQ ID NO: 25542 - RNA, 22 nt, Human
gccuguaaucccaggacuuugg

SEQ ID NO: 25543 - RNA, 24 nt, Human
ggucuggcaauauucuguaacuau

SEQ ID NO: 25544 - RNA, 24 nt, Human
augugggaaaaccuaaaggugucc

SEQ ID NO: 25545 - RNA, 25 nt, Human
guaugaucacagcucacugcagcuu

SEQ ID NO: 25546 - RNA, 27 nt, Human
gugguguugagaaagaaugagcauuga

SEQ ID NO: 25547 - RNA, 23 nt, Human
uuuguuuauaaauacccuagguc

SEQ ID NO: 25548 - RNA, 26 nt, Human
gucaauguuggcugaauuccuaaauc

SEQ ID NO: 25549 - RNA, 26 nt, Human
gacuccgucucaaggaaaaaauaaaa

SEQ ID NO: 25550 - RNA, 21 nt, Human
cucuaaccauaacacaggaga

SEQ ID NO: 25551 - RNA, 25 nt, Human
gcuugcuuuuaggagacagccacuu

SEQ ID NO: 25552 - RNA, 22 nt, Human
cuaacuccugggcucaagcaau

SEQ ID NO: 25553 - RNA, 23 nt, Human
gucacccagccagaucucaucug

SEQ ID NO: 25554 - RNA, 19 nt, Human
gcuuauuugcccugcagca

SEQ ID NO: 25555 - RNA, 22 nt, Human
uggcucauaccuguaaucccag

SEQ ID NO: 25556 - RNA, 18 nt, Human
agggagggggcagaggca

SEQ ID NO: 25557 - RNA, 26 nt, Human
gcugcaccccuuccugggcacacgcu

SEQ ID NO: 25558 - RNA, 23 nt, Human
gaugagaaaguucuggaggugga

SEQ ID NO: 25559 - RNA, 21 nt, Human
ugaacaaaucacauucugucc

SEQ ID NO: 25560 - RNA, 22 nt, Human
aggaguccagagcaggagccag

SEQ ID NO: 25561 - RNA, 24 nt, Human
ugguuggagagcugaacaggcugg

SEQ ID NO: 25562 - RNA, 19 nt, Human
guaguaaucucacacuuca

SEQ ID NO: 25563 - RNA, 27 nt, Human
gcccguuucugcccaccaguuguucuc

SEQ ID NO: 25564 - RNA, 21 nt, Human
cuucugcuugucauccacaca

SEQ ID NO: 25565 - RNA, 22 nt, Human
cgccuguaaucccagcaguuug

SEQ ID NO: 25566 - RNA, 18 nt, Human
gucucugcaagcuugguc

SEQ ID NO: 25567 - RNA, 24 nt, Human
ggagggagggaaagcuuccuccua

SEQ ID NO: 25568 - RNA, 23 nt, Human
aaacauucuuacauuuuacuuuu

SEQ ID NO: 25569 - RNA, 22 nt, Human
uagaauguauaugagaaacccc

SEQ ID NO: 25570 - RNA, 24 nt, Human
aaagcaccguugagguugcaguga

SEQ ID NO: 25571 - RNA, 27 nt, Human
cugggagguagaagagaugcagagaaa

SEQ ID NO: 25572 - RNA, 22 nt, Human
ugagacuacaagugugugccac

SEQ ID NO: 25573 - RNA, 23 nt, Human
ccaggaggcagaggguugcagug

SEQ ID NO: 25574 - RNA, 17 nt, Human
gaacugcacgggcuuua

SEQ ID NO: 25575 - RNA, 27 nt, Human
uuuguccauuguaaaucugaagaaagu

SEQ ID NO: 25576 - RNA, 23 nt, Human
uauuuaugaagauucuacucuug

SEQ ID NO: 25577 - RNA, 21 nt, Human
ccagccaggccaacaugguga

SEQ ID NO: 25578 - RNA, 26 nt, Human
ggggugcugugauucauguuuguuac

SEQ ID NO: 25579 - RNA, 26 nt, Human
aauggccauggaaugcacgaagucac

SEQ ID NO: 25580 - RNA, 24 nt, Human
auucugugguucauuguaguuuaa

SEQ ID NO: 25581 - RNA, 24 nt, Human
gagccccuucuuucaagcuucuug

SEQ ID NO: 25582 - RNA, 31 nt, Human; identical to SEQ ID NO: 7902

SEQ ID NO: 25583 - RNA, 22 nt, Human
gcugcugcugucacuccuccac

SEQ ID NO: 25584 - RNA, 23 nt, Human
aggcuggagugcaguggugugau

SEQ ID NO: 25585 - RNA, 23 nt, Human
caccacccucuuucuguacuuca

SEQ ID NO: 25586 - RNA, 19 nt, Human
aagcauuccuuucucuuca

SEQ ID NO: 25587 - RNA, 21 nt, Human
ccagggaggggugggagaggg

SEQ ID NO: 25588 - RNA, 21 nt, Human
cugcccuuucuauccaucguc

SEQ ID NO: 25589 - RNA, 26 nt, Human
ccucguuccaaucccugccguccuug

SEQ ID NO: 25590 - RNA, 16 nt, Human
uuaauaaaaaucuuug

SEQ ID NO: 25591 - RNA, 21 nt, Human
gacuucuagcucacugccuuu

SEQ ID NO: 25592 - RNA, 23 nt, Human
cauacugggcacccaccaugaga

SEQ ID NO: 25593 - RNA, 27 nt, Human
ggcuacuguaacacuugccuguaauca

SEQ ID NO: 25594 - RNA, 23 nt, Human
ggcaguuugucuacuacagcaga

SEQ ID NO: 25595 - RNA, 26 nt, Human
gccccuggcguuuccuaaguacgaaa

SEQ ID NO: 25596 - RNA, 23 nt, Human
ccacugcacuccaaccugggcag

SEQ ID NO: 25597 - RNA, 21 nt, Human
gauaguguuauaaauacugua

SEQ ID NO: 25598 - RNA, 21 nt, Human
uuuccacccuccagucauuuc

SEQ ID NO: 25599 - RNA, 22 nt, Human
cagagcugucuggugaucacuu

SEQ ID NO: 25600 - RNA, 28 nt, Human
ccagagcuccaccccaaccaggagcucu

SEQ ID NO: 25601 - RNA, 27 nt, Human
uguuuagcuggcucgaugauguuaaca

SEQ ID NO: 25602 - RNA, 19 nt, Human
ugcauuuucauauucuuua

SEQ ID NO: 25603 - RNA, 21 nt, Human
uauaaucagcacuuugccaug

SEQ ID NO: 25604 - RNA, 14 nt, Human
uuuggcugauauga

SEQ ID NO: 25605 - RNA, 24 nt, Human
cuuuucccuccuuccugagccucc

SEQ ID NO: 25606 - RNA, 28 nt, Human
uugaggguagcuggucccucugucccug

SEQ ID NO: 25607 - RNA, 26 nt, Human
uccucgggcucuucuggaccuugcac

SEQ ID NO: 25608 - RNA, 22 nt, Human
cuugaguagcugggauuacagg

SEQ ID NO: 25609 - RNA, 21 nt, Human
augaucaguuucaucuguaag

SEQ ID NO: 25610 - RNA, 22 nt, Human
gcagagaaacaaagucuggacc

SEQ ID NO: 25611 - RNA, 31 nt, Human
cugcagcuuccaggcuggcgugcagcaucag

SEQ ID NO: 25612 - RNA, 19 nt, Human
aaucaauaaaaauauuuua

SEQ ID NO: 25613 - RNA, 19 nt, Human
agacugaaucuaccugccu

SEQ ID NO: 25614 - RNA, 20 nt, Human
cuaaagcucauaauacacaa

SEQ ID NO: 25615 - RNA, 21 nt, Human
gcugcugcuccugcagcugcc

SEQ ID NO: 25616 - RNA, 19 nt, Human
guaaaguuuuucuauucuu

SEQ ID NO: 25617 - RNA, 22 nt, Human
gccgccgcugccaugucuccgg

SEQ ID NO: 25618 - RNA, 23 nt, Human
gucccuuauggggugaacacugu

SEQ ID NO: 25619 - RNA, 19 nt, Human
uuuuuuaaaaaauaaccua

SEQ ID NO: 25620 - RNA, 24 nt, Human
uucauucuagaauuaucuccuuga

SEQ ID NO: 25621 - RNA, 22 nt, Human
cugagguaggagaaucguuuga

SEQ ID NO: 25622 - RNA, 21 nt, Human
gcuuccugcaccucaggaugg

SEQ ID NO: 25623 - RNA, 22 nt, Human
aucagccuggccaaaaugcuga

SEQ ID NO: 25624 - RNA, 22 nt, Human
auuccaggucaccagauccaag

SEQ ID NO: 25625 - RNA, 24 nt, Human
uugagaacuuggcccugugcuuua

SEQ ID NO: 25626 - RNA, 23 nt, Human
gcagacggaguacacggagcagc

SEQ ID NO: 25627 - RNA, 22 nt, Human
acaaucauggcucacugcagcc

SEQ ID NO: 25628 - RNA, 22 nt, Human
ggccuuccaaagugcugggauu

SEQ ID NO: 25629 - RNA, 24 nt, Human
aucauuuucaaaauggagggaaua

SEQ ID NO: 25630 - RNA, 27 nt, Human
ggccucaugaauaaaggcuucuugccg

SEQ ID NO: 25631 - RNA, 21 nt, Human
gauuacuuuuucuuuaugugu

SEQ ID NO: 25632 - RNA, 21 nt, Human
cacacacauacccuacccuca

SEQ ID NO: 25633 - RNA, 22 nt, Human
ccgggaggcggagguuccagug

SEQ ID NO: 25634 - RNA, 25 nt, Human
augaaacaugggcugugauuacugc

SEQ ID NO: 25635 - RNA, 22 nt, Human
gcuaugacacagucacccacag

SEQ ID NO: 25636 - RNA, 20 nt, Human
cuuccuuugcugcuggagcu

SEQ ID NO: 25637 - RNA, 20 nt, Human
ggaccuuaagcuaaccuucu

SEQ ID NO: 25638 - RNA, 22 nt, Human
gucgcccaagcuggagcgcaau

SEQ ID NO: 25639 - RNA, 22 nt, Human
ugccucccggguucaagcgauu

SEQ ID NO: 25640 - RNA, 23 nt, Human
cucugugaggcuggcaggugagg

SEQ ID NO: 25641 - RNA, 19 nt, Human
ccuccauugaaauaacucc

SEQ ID NO: 25642 - RNA, 24 nt, Human
guagagaaaggcuaucccagaaau

SEQ ID NO: 25643 - RNA, 25 nt, Human
gugaagcugccgacugugcaugacu

SEQ ID NO: 25644 - RNA, 24 nt, Human
ccuauccuaacacagggauuuaca

SEQ ID NO: 25645 - RNA, 20 nt, Human
acucagcccagcuccucaau

SEQ ID NO: 25646 - RNA, 24 nt, Human
gaggaagaguagaugagccggguc

SEQ ID NO: 25647 - RNA, 28 nt, Human
ggauuucugcuuccuaauagaagugaaa

SEQ ID NO: 25648 - RNA, 26 nt, Human
gaggaagugaggaagggucaaggaug

SEQ ID NO: 25649 - RNA, 26 nt, Human
acacuaacaucccuuucuucccccca

SEQ ID NO: 25650 - RNA, 22 nt, Human
ugaacuccugaccucaagugau

SEQ ID NO: 25651 - RNA, 23 nt, Human
gauccugcaccuuccucucccag

SEQ ID NO: 25652 - RNA, 23 nt, Human
aauucuucuccuccuucacauca

SEQ ID NO: 25653 - RNA, 21 nt, Human
cucaacaacaggaaaggcagg

SEQ ID NO: 25654 - RNA, 23 nt, Human
ccucaaagcagcgccugccuccu

SEQ ID NO: 25655 - RNA, 21 nt, Human
augucugucugugugucucuc

SEQ ID NO: 25656 - RNA, 23 nt, Human
auccuaaacugagacaaugccuu

SEQ ID NO: 25657 - RNA, 27 nt, Human
uaagcuuauuucagaacaagucuaaua

SEQ ID NO: 25658 - RNA, 24 nt, Human
uucucaaggaaugcuuuccucuaa

SEQ ID NO: 25659 - RNA, 23 nt, Human
uuacaacugagagugaucugcag

SEQ ID NO: 25660 - RNA, 23 nt, Human
caugcugcaagagccugccagcc

SEQ ID NO: 25661 - RNA, 27 nt, Human
cacagacaagccuccauuaaagccaca

SEQ ID NO: 25662 - RNA, 21 nt, Human
agcaaggcaaagagugugggg

SEQ ID NO: 25663 - RNA, 18 nt, Human
uuuggauagucucuuagg

SEQ ID NO: 25664 - RNA, 29 nt, Human
agccuauagaacuccuaccucccaucccc

SEQ ID NO: 25665 - RNA, 21 nt, Human
ugacgguuuaccaucauucca

SEQ ID NO: 25666 - RNA, 19 nt, Human
ugcagcuccacgagaccuu

SEQ ID NO: 25667 - RNA, 23 nt, Human
ugcuggcaaccacuaagaauuca

SEQ ID NO: 25668 - RNA, 24 nt, Human
guccaggccugggugguauagggc

SEQ ID NO: 25669 - RNA, 27 nt, Human
cugaugacccaggcugccugagcaccu

SEQ ID NO: 25670 - RNA, 24 nt, Human
gcacagggacuggcuaucccaaga

SEQ ID NO: 25671 - RNA, 22 nt, Human
uugguaaaauauagagugguca

SEQ ID NO: 25672 - RNA, 23 nt, Human
gcuacuuggaaggcugaggcagg

SEQ ID NO: 25673 - RNA, 24 nt, Human
ugcagcuccagggcuggugcucua

SEQ ID NO: 25674 - RNA, 23 nt, Human
uuugcuaccauaaacauuuugga

SEQ ID NO: 25675 - RNA, 26 nt, Human
ccaggcagagagaaaaggaaauccaa

SEQ ID NO: 25676 - RNA, 20 nt, Human
cagacuccaggcagguucuc

SEQ ID NO: 25677 - RNA, 21 nt, Human
gccacagcucuccagccuggg

SEQ ID NO: 25678 - RNA, 18 nt, Human
uccucugcuucaguuuca

SEQ ID NO: 25679 - RNA, 27 nt, Human
cacgaccucaaacuggcuccuaaucuc

SEQ ID NO: 25680 - RNA, 24 nt, Human
cuuccucaaaacaaacaagagaug

SEQ ID NO: 25681 - RNA, 22 nt, Human
gucauucagccaagccuccucc

SEQ ID NO: 25682 - RNA, 22 nt, Human
uacccuuuucucacuguagcug

SEQ ID NO: 25683 - RNA, 23 nt, Human
ucucagcuuccacugccgucucc

SEQ ID NO: 25684 - RNA, 22 nt, Human
cacuguuuuccagccugggcaa

SEQ ID NO: 25685 - RNA, 22 nt, Human
gcgugcaccaccaugccaggcu

SEQ ID NO: 25686 - RNA, 19 nt, Human
cggcacccuuucccuaccu

SEQ ID NO: 25687 - RNA, 22 nt, Human
cugagaucacgccauugcacuc

SEQ ID NO: 25688 - RNA, 25 nt, Human
uguucugcaaaauugcaguuacuca

SEQ ID NO: 25689 - RNA, 21 nt, Human
uugagauuuaugaaugcaguu

SEQ ID NO: 25690 - RNA, 19 nt, Human
cacccccagccucugccgg

SEQ ID NO: 25691 - RNA, 23 nt, Human
gaucugcaggugggaugagggag

SEQ ID NO: 25692 - RNA, 27 nt, Human
uuccugauaaagcacagcuguaguggg

SEQ ID NO: 25693 - RNA, 21 nt, Human
cugcacuuaacccuuugugau

SEQ ID NO: 25694 - RNA, 22 nt, Human
cucacaguuaacaugcuuucag

SEQ ID NO: 25695 - RNA, 27 nt, Human
gucgcccaggcuggagugcaggggcgc

SEQ ID NO: 25696 - RNA, 25 nt, Human
ggugggagacgaacggaaggguugg

SEQ ID NO: 25697 - RNA, 23 nt, Human
uggguggaugcagugguccagga

SEQ ID NO: 25698 - RNA, 25 nt, Human
gcuguuuuccuccccucuguguacu

SEQ ID NO: 25699 - RNA, 21 nt, Human
ucagacuagggccuucaccuc

SEQ ID NO: 25700 - RNA, 23 nt, Human
uuaucguacgucacaguguaugg

SEQ ID NO: 25701 - RNA, 25 nt, Human
aaggaauauucaauauucugccuuu

SEQ ID NO: 25702 - RNA, 24 nt, Human
ggcucugaaccucuucaagagcau

SEQ ID NO: 25703 - RNA, 26 nt, Human
ucgcucucuuguccaggcuggagugc

SEQ ID NO: 25704 - RNA, 27 nt, Human
caguucugcaacauaucugaaauguga

SEQ ID NO: 25705 - RNA, 22 nt, Human
cgcuugaacccgggaggcagaa

SEQ ID NO: 25706 - RNA, 25 nt, Human
ccccauuccuugcgccucagcccuc

SEQ ID NO: 25707 - RNA, 23 nt, Human
gcagcugcugccccagcugccuc

SEQ ID NO: 25708 - RNA, 26 nt, Human
cugccuggauccccggccugccuggg

SEQ ID NO: 25709 - RNA, 21 nt, Human
ugcuccugccuugcaccucca

SEQ ID NO: 25710 - RNA, 20 nt, Human
cugauuuccucacucagaca

SEQ ID NO: 25711 - RNA, 27 nt, Human
gacucagcgguagcaaccucgccccuu

SEQ ID NO: 25712 - RNA, 25 nt, Human
ugcacccgggugggggacagaggga

SEQ ID NO: 25713 - RNA, 23 nt, Human
aggacaguuuggcuucacuucuc

SEQ ID NO: 25714 - RNA, 19 nt, Human
gcccaaccuggagugcagu

SEQ ID NO: 25715 - RNA, 22 nt, Human
acuccggccugggugacagagu

SEQ ID NO: 25716 - RNA, 22 nt, Human
ccaggagacggugguugcagug

SEQ ID NO: 25717 - RNA, 21 nt, Human
ugccuccuauuacugaaguca

SEQ ID NO: 25718 - RNA, 21 nt, Human
gauuucagauauucugcucua

SEQ ID NO: 25719 - RNA, 22 nt, Human
cacucacaaccccugcuccagu

SEQ ID NO: 25720 - RNA, 21 nt, Human
gccacacagagacacauacuu

SEQ ID NO: 25721 - RNA, 21 nt, Human
gugcuacaucuucacaguucc

SEQ ID NO: 25722 - RNA, 19 nt, Human
caaggaccuucuggaacau

SEQ ID NO: 25723 - RNA, 27 nt, Human
ggcucagaacaggguggggagagcggg

SEQ ID NO: 25724 - RNA, 29 nt, Human
uugcuguugaugaggccucuuggaccucu

SEQ ID NO: 25725 - RNA, 21 nt, Human
cuucucugagcuucaguuucc

SEQ ID NO: 25726 - RNA, 24 nt, Human
cuggagcuuuguuaugaguugcag

SEQ ID NO: 25727 - RNA, 18 nt, Human
gccucucccuggcagccc

SEQ ID NO: 25728 - RNA, 24 nt, Human
agcccagggcccucacccaccucg

SEQ ID NO: 25729 - RNA, 22 nt, Human
uuuauguagggcacugugcugg

SEQ ID NO: 25730 - RNA, 22 nt, Human
cagcaaacucuuuucccacugu

SEQ ID NO: 25731 - RNA, 18 nt, Human
agcccaccagccucucag

SEQ ID NO: 25732 - RNA, 20 nt, Human
ccagcauuuucauucauuuu

SEQ ID NO: 25733 - RNA, 20 nt, Human
uacauuuacacauuuacacu

SEQ ID NO: 25734 - RNA, 20 nt, Human
ccuucucuaacacuagcuuc

SEQ ID NO: 25735 - RNA, 26 nt, Human
gaggaagagaaaagcagagauaagca

SEQ ID NO: 25736 - RNA, 23 nt, Human
uuccagcagcagcaggucuggag

SEQ ID NO: 25737 - RNA, 23 nt, Human
cuccaucuggaaaugggaggaug

SEQ ID NO: 25738 - RNA, 21 nt, Human
uugaccaggcuggagugcagu

SEQ ID NO: 25739 - RNA, 22 nt, Human
ggagagaagagcaguucugcag

SEQ ID NO: 25740 - RNA, 21 nt, Human
agacugacucccuuaucucuu

SEQ ID NO: 25741 - RNA, 26 nt, Human
ggagggagccacagagagggguccag

SEQ ID NO: 25742 - RNA, 21 nt, Human
acacccaggcuggagugcagu

SEQ ID NO: 25743 - RNA, 22 nt, Human
uguuuuuuaaaaguaauuuuua

SEQ ID NO: 25744 - RNA, 22 nt, Human
gucggaauccaucucugaguca

SEQ ID NO: 25745 - RNA, 24 nt, Human
ccagagcagugggacaucugggga

SEQ ID NO: 25746 - RNA, 21 nt, Human
cugcaaccuccacuucccagg

SEQ ID NO: 25747 - RNA, 27 nt, Human
aacucacaguguccuuuuguaggcccu

SEQ ID NO: 25748 - RNA, 23 nt, Human
cugagccugguacccuguggcau

SEQ ID NO: 25749 - RNA, 22 nt, Human
cguacacggagacuggcagcgc

SEQ ID NO: 25750 - RNA, 27 nt, Human
cuguggguuggaagcugauggaaugag

SEQ ID NO: 25751 - RNA, 25 nt, Human
gcgcuauugcacuccagucugggua

SEQ ID NO: 25752 - RNA, 20 nt, Human
auugucccucagguagauuu

SEQ ID NO: 25753 - RNA, 21 nt, Human
gcucacugcagccuccgcuuc

SEQ ID NO: 25754 - RNA, 20 nt, Human
cagacaguuugaaggaauga

SEQ ID NO: 25755 - RNA, 24 nt, Human
ugucgcccaggcuggggugcagug

SEQ ID NO: 25756 - RNA, 25 nt, Human
uucuccucaacaucugaaucaugcc

SEQ ID NO: 25757 - RNA, 27 nt, Human
uucaguuaguauuguauuuaguucagu

SEQ ID NO: 25758 - RNA, 27 nt, Human
cgcugccucuggcaaguggaguuuuua

SEQ ID NO: 25759 - RNA, 26 nt, Human
ccuccuccucggaauccuggguuucu

SEQ ID NO: 25760 - RNA, 20 nt, Human
gggcuagagaggcagaggaa

SEQ ID NO: 25761 - RNA, 17 nt, Human
gaagcuggaugauaugg

SEQ ID NO: 25762 - RNA, 26 nt, Human
uccauccugagaauauuucacaaaga

SEQ ID NO: 25763 - RNA, 21 nt, Human
cccacagcgaaggcacaugcc

SEQ ID NO: 25764 - RNA, 21 nt, Human
aagaaacaucuaucaagcaac

SEQ ID NO: 25765 - RNA, 19 nt, Human
ggagguugcagugagccau

SEQ ID NO: 25766 - RNA, 21 nt, Human
cuuugucuuacauuggcuuuu

SEQ ID NO: 25767 - RNA, 18 nt, Human
agaccugagcuccccacc

SEQ ID NO: 25768 - RNA, 24 nt, Human
acuucuuccauauuuucucacuaa

SEQ ID NO: 25769 - RNA, 28 nt, Human
gagcgcgggaugacaggagcaaccgaag

SEQ ID NO: 25770 - RNA, 20 nt, Human
guggugagcaagcaccaacc

SEQ ID NO: 25771 - RNA, 24 nt, Human
cuuacuccugguucagugccacgc

SEQ ID NO: 25772 - RNA, 24 nt, Human
guaaaacaaaggacuugccauggu

SEQ ID NO: 25773 - RNA, 22 nt, Human
uggcucacgccuguaauucuag

SEQ ID NO: 25774 - RNA, 21 nt, Human
guaugaaggaccuguauuggg

SEQ ID NO: 25775 - RNA, 22 nt, Human
gaucacauuucucacugccuuc

SEQ ID NO: 25776 - RNA, 25 nt, Human
ucaucugagaagcaccacauccuuu

SEQ ID NO: 25777 - RNA, 22 nt, Human
gaauuaguuugcacuuccuauu

SEQ ID NO: 25778 - RNA, 24 nt, Human
acccaggcuggagugcaaugguga

SEQ ID NO: 25779 - RNA, 21 nt, Human
gacggggacagagugagggaa

SEQ ID NO: 25780 - RNA, 27 nt, Human
guugcccaggugggucucaaacuccug

SEQ ID NO: 25781 - RNA, 19 nt, Human
ugcccggcucagugcagug

SEQ ID NO: 25782 - RNA, 19 nt, Human
cugaguucugguucaugca

SEQ ID NO: 25783 - RNA, 19 nt, Human
gucccucaccagaggccuc

SEQ ID NO: 25784 - RNA, 21 nt, Human
gagaguugccccacccuaccu

SEQ ID NO: 25785 - RNA, 26 nt, Human
ggucccggggaagcuccggacuccua

SEQ ID NO: 25786 - RNA, 26 nt, Human
ugucugucuguucuaucuagagauca

SEQ ID NO: 25787 - RNA, 22 nt, Human
caaaaaagaacugcaccucugg

SEQ ID NO: 25788 - RNA, 23 nt, Human
cuggagagguggagugagaaguc

SEQ ID NO: 25789 - RNA, 19 nt, Human
uagagucugacugcaguuu

SEQ ID NO: 25790 - RNA, 24 nt, Human
uuuaguauuuuucaccauuuguga

SEQ ID NO: 25791 - RNA, 22 nt, Human
cgccuauacacccagcacuuug

SEQ ID NO: 25792 - RNA, 25 nt, Human
cccaaaugccuuaauuuuguggacu

SEQ ID NO: 25793 - RNA, 23 nt, Human
ccugccacugcuggagccauuuc

SEQ ID NO: 25794 - RNA, 22 nt, Human
ucugcccucugcauccucugga

SEQ ID NO: 25795 - RNA, 22 nt, Human
guggcuccaguugcucugucuc

SEQ ID NO: 25796 - RNA, 27 nt, Human
uaggaagggaagggccacagccuucau

SEQ ID NO: 25797 - RNA, 20 nt, Human
ucuucccuuucucuuuugga

SEQ ID NO: 25798 - RNA, 22 nt, Human
uuugguuucuagcaugaagaca

SEQ ID NO: 25799 - RNA, 21 nt, Human
uugucguggcagccaguggug

SEQ ID NO: 25800 - RNA, 20 nt, Human
ggugggggcgggugggcagg

SEQ ID NO: 25801 - RNA, 23 nt, Human
ggggaggaguugcacuugccccc

SEQ ID NO: 25802 - RNA, 23 nt, Human
gcacacgguaagaccucuugcuu

SEQ ID NO: 25803 - RNA, 22 nt, Human
cugcagccgccgccuccgaagg

SEQ ID NO: 25804 - RNA, 23 nt, Human
cugccaccacgcuggccaauuuu

SEQ ID NO: 25805 - RNA, 22 nt, Human
cccacagucuccggccucucca

SEQ ID NO: 25806 - RNA, 27 nt, Human
ucgcccccacacccccuccccuugcca

SEQ ID NO: 25807 - RNA, 25 nt, Human
ccaguagcugggacuauccccaggg

SEQ ID NO: 25808 - RNA, 26 nt, Human
uggggaggcugagucaggagaaucgc

SEQ ID NO: 25809 - RNA, 18 nt, Human
ggcacaaaaucaacugua

SEQ ID NO: 25810 - RNA, 22 nt, Human
uuuggaauagcccugucuaggg

SEQ ID NO: 25811 - RNA, 27 nt, Human
ucagauugaggaugcacauauacuggg

SEQ ID NO: 25812 - RNA, 22 nt, Human
ccuucuuagaggguucagucua

SEQ ID NO: 25813 - RNA, 20 nt, Human
acaccucccuuucuccugca

SEQ ID NO: 25814 - RNA, 17 nt, Human
ggcuacuguggcaucua

SEQ ID NO: 25815 - RNA, 26 nt, Human
cccaccccacuucagcccuguccccu

SEQ ID NO: 25816 - RNA, 25 nt, Human
gagaguuuucuagaagguugggauu

SEQ ID NO: 25817 - RNA, 24 nt, Human
ucagggguccaggaagaauuugua

SEQ ID NO: 25818 - RNA, 26 nt, Human
auaccuguuuuccacugcuaaaacug

SEQ ID NO: 25819 - RNA, 23 nt, Human
cagguggcagaauggggugcaug

SEQ ID NO: 25820 - RNA, 26 nt, Human
cccauccugaucccagacccauuccu

SEQ ID NO: 25821 - RNA, 19 nt, Human
cuaccugcagaguuacuaa

SEQ ID NO: 25822 - RNA, 30 nt, Human
ccuguagcuauuuuaucauaauuuauuauc

SEQ ID NO: 25823 - RNA, 14 nt, Human
accauaaagcuaaa

SEQ ID NO: 25824 - RNA, 24 nt, Human
ccagggcuggggaacacugugaaa

SEQ ID NO: 25825 - RNA, 24 nt, Human
gacugggugcuagacaagaaggaa

SEQ ID NO: 25826 - RNA, 19 nt, Human
cugggggucucagggagaa

SEQ ID NO: 25827 - RNA, 23 nt, Human
uguggcagccuucucucauucag

SEQ ID NO: 25828 - RNA, 23 nt, Human
agugcuggaagccuguggcagaa

SEQ ID NO: 25829 - RNA, 22 nt, Human
accaugaagugaaaaugccaca

SEQ ID NO: 25830 - RNA, 22 nt, Human
gaccauccuagccaacaucgug

SEQ ID NO: 25831 - RNA, 22 nt, Human
ccuuccucucugccccaaacuc

SEQ ID NO: 25832 - RNA, 21 nt, Human
gcugccaccagcccccgcccc

SEQ ID NO: 25833 - RNA, 25 nt, Human
auuucccaaauuccagcugccgcuc

SEQ ID NO: 25834 - RNA, 27 nt, Human
auuagucugugacuacaaaauauuuua

SEQ ID NO: 25835 - RNA, 23 nt, Human
uaauaaauacuccuuuucaagag

SEQ ID NO: 25836 - RNA, 24 nt, Human
cgggguucgucgggccuguggaag

SEQ ID NO: 25837 - RNA, 24 nt, Human
guuggcaggcuggccaguccaggc

SEQ ID NO: 25838 - RNA, 19 nt, Human
aggaagcugcaauucucug

SEQ ID NO: 25839 - RNA, 20 nt, Human
gacaguuuccagaugcuauc

SEQ ID NO: 25840 - RNA, 22 nt, Human
ugccugcaauuccagcacuuug

SEQ ID NO: 25841 - RNA, 21 nt, Human
uugaguuucuuuguguuuaca

SEQ ID NO: 25842 - RNA, 22 nt, Human
guugggccucacaaggaccagg

SEQ ID NO: 25843 - RNA, 22 nt, Human
cacugucaccagucucaagcua

SEQ ID NO: 25844 - RNA, 22 nt, Human
aggucucgacuucacugcucug

SEQ ID NO: 25845 - RNA, 23 nt, Human
gagcaggggagagcgagaccagu

SEQ ID NO: 25846 - RNA, 27 nt, Human
caugaacaccauaccuuugcuacuacu

SEQ ID NO: 25847 - RNA, 19 nt, Human
cagccaucuugccucaacu

SEQ ID NO: 25848 - RNA, 19 nt, Human
gggagagaagacgagccuc

SEQ ID NO: 25849 - RNA, 22 nt, Human
uccucugcuuccucuguuggcc

SEQ ID NO: 25850 - RNA, 23 nt, Human
ccuuugagaucuggggaggcagg

SEQ ID NO: 25851 - RNA, 27 nt, Human
gggcccaaacucagguucagugcagaa

SEQ ID NO: 25852 - RNA, 27 nt, Human
cacugcacuccagccugggcaacaaga

SEQ ID NO: 25853 - RNA, 20 nt, Human
gcaaagcaggcucuagcaac

SEQ ID NO: 25854 - RNA, 24 nt, Human
auacacagauuaggagaugaccuu

SEQ ID NO: 25855 - RNA, 22 nt, Human
ggaccagaccugcccugcucug

SEQ ID NO: 25856 - RNA, 22 nt, Human
ccggcccggugaaacugaacuu

SEQ ID NO: 25857 - RNA, 23 nt, Human
cugucucucugggcugcagaguc

SEQ ID NO: 25858 - RNA, 25 nt, Human
gaccgaguaccugcuccaucaugcu

SEQ ID NO: 25859 - RNA, 28 nt, Human
uguuguuucguuuucuagcuauaggaac

SEQ ID NO: 25860 - RNA, 22 nt, Human
ucauugugaaauaauuaccuca

SEQ ID NO: 25861 - RNA, 26 nt, Human
cacuuccuuuuaacugccaagaaauu

SEQ ID NO: 25862 - RNA, 26 nt, Human
uggaguccucugagagagccaccaag

SEQ ID NO: 25863 - RNA, 22 nt, Human
ugaaggugugguaucaaacuuc

SEQ ID NO: 25864 - RNA, 23 nt, Human
ggcuuggaguccaagguguucug

SEQ ID NO: 25865 - RNA, 22 nt, Human
gauggcagggcuggaagggcca

SEQ ID NO: 25866 - RNA, 20 nt, Human
gcauucucuaucaauauaua

SEQ ID NO: 25867 - RNA, 26 nt, Human
gcuguacaaccuauuuccucuuccuc

SEQ ID NO: 25868 - RNA, 25 nt, Human
uuccuaccauuauggcuuugugcuu

SEQ ID NO: 25869 - RNA, 22 nt, Human
ucccugcauaauuuuaguacuu

SEQ ID NO: 25870 - RNA, 27 nt, Human
uuuucucacugugccaauuagggggua

SEQ ID NO: 25871 - RNA, 20 nt, Human
ugugcagcaaagcaccaugg

SEQ ID NO: 25872 - RNA, 21 nt, Human
augcccacgcuggagugcagu

SEQ ID NO: 25873 - RNA, 24 nt, Human
uagggaaggaacugaauuucucca

SEQ ID NO: 25874 - RNA, 25 nt, Human
aauuauccuccuucacucccuguca

SEQ ID NO: 25875 - RNA, 23 nt, Human
ggguugacccagggcugucuccc

SEQ ID NO: 25876 - RNA, 26 nt, Human
aucaagugaucugcuccccucagccu

SEQ ID NO: 25877 - RNA, 17 nt, Human
uuguaggaugugucaca

SEQ ID NO: 25878 - RNA, 20 nt, Human
ucuccucucugagccuuugu

SEQ ID NO: 25879 - RNA, 22 nt, Human
cucugucucaaaacaaacaaaa

SEQ ID NO: 25880 - RNA, 21 nt, Human
cgggagguggagcuugcagug

SEQ ID NO: 25881 - RNA, 24 nt, Human
uauccguggccacagcugguuggc

SEQ ID NO: 25882 - RNA, 23 nt, Human
ugaaaacccaugcugcuguuaua

SEQ ID NO: 25883 - RNA, 20 nt, Human
gucagccucagagcauuuaa

SEQ ID NO: 25884 - RNA, 25 nt, Human
gucauccaggcuggacaguucagug

SEQ ID NO: 25885 - RNA, 27 nt, Human
uuucacguacauccaucauuugcaacu

SEQ ID NO: 25886 - RNA, 22 nt, Human
ccuacccccaaccccugccucc

SEQ ID NO: 25887 - RNA, 25 nt, Human
cccuuucccuucuuggugcuuacac

SEQ ID NO: 25888 - RNA, 25 nt, Human
ucucucuuccccaucuugcauugga

SEQ ID NO: 25889 - RNA, 21 nt, Human
ucauaucacuguaucuucuca

SEQ ID NO: 25890 - RNA, 19 nt, Human
gcccaggucacagcacaag

SEQ ID NO: 25891 - RNA, 24 nt, Human
ucauuuuccuguuuacacugggga

SEQ ID NO: 25892 - RNA, 21 nt, Human
aagcguugggauuauaggcau

SEQ ID NO: 25893 - RNA, 28 nt, Human
ugcagugagccgacaucaugccacugca

SEQ ID NO: 25894 - RNA, 23 nt, Human
gcucgcugcaaccuucacccuuc

SEQ ID NO: 25895 - RNA, 21 nt, Human
uacuccugccaugcauugaag

SEQ ID NO: 25896 - RNA, 29 nt, Human
uggacuaccaagcuggcuuguuucuuaug

SEQ ID NO: 25897 - RNA, 22 nt, Human
cacugcacuccagccugggcaa

SEQ ID NO: 25898 - RNA, 22 nt, Human
cacuacacuccagccugggcga

SEQ ID NO: 25899 - RNA, 26 nt, Human
ccaucgcucuuacccgguaaguaaac

SEQ ID NO: 25900 - RNA, 18 nt, Human
gauccucugcugggugcc

SEQ ID NO: 25901 - RNA, 26 nt, Human
cuuugcucccugcucuuucugccucu

SEQ ID NO: 25902 - RNA, 21 nt, Human
aggcuagcugugcugguauug

SEQ ID NO: 25903 - RNA, 23 nt, Human
aacuccacugcuuaccuacuuuc

SEQ ID NO: 25904 - RNA, 25 nt, Human
agucccgggcuggcgggagugcagu

SEQ ID NO: 25905 - RNA, 22 nt, Human
cguuguacuccagcuugggcaa

SEQ ID NO: 25906 - RNA, 22 nt, Human
caccuagcaaggcacaccaaga

SEQ ID NO: 25907 - RNA, 27 nt, Human
gucaaucucuuuaccuccuuuucucuu

SEQ ID NO: 25908 - RNA, 26 nt, Human
gaucccguccuccaggcagugaccuc

SEQ ID NO: 25909 - RNA, 27 nt, Human
ucugccuggccuccugcugaugaggac

SEQ ID NO: 25910 - RNA, 22 nt, Human
ugcugccaucaagaugcagacc

SEQ ID NO: 25911 - RNA, 21 nt, Human
aaggcuggagugcaggccgcg

SEQ ID NO: 25912 - RNA, 22 nt, Human
gcugaucucaaacuccugggcu

SEQ ID NO: 25913 - RNA, 21 nt, Human
cccccauuaaggcagcucauc

SEQ ID NO: 25914 - RNA, 27 nt, Human
augagacagaaacuaauccuuacuauc

SEQ ID NO: 25915 - RNA, 24 nt, Human
gguauagaauuggagagauuaucu

SEQ ID NO: 25916 - RNA, 21 nt, Human
cuacauuccagauuuaaagaa

SEQ ID NO: 25917 - RNA, 25 nt, Human
acuuuugcuuccucuaccugaacaa

SEQ ID NO: 25918 - RNA, 21 nt, Human
cucagccucaagaucuucagc

SEQ ID NO: 25919 - RNA, 24 nt, Human
cugcaucuccagaggaaaauaaga

SEQ ID NO: 25920 - RNA, 27 nt, Human
agguaccacagaagagcuguagucaua

SEQ ID NO: 25921 - RNA, 21 nt, Human
gucugagaccucuggcugaag

SEQ ID NO: 25922 - RNA, 27 nt, Human
cccuccugguccgugggccaggaugug

SEQ ID NO: 25923 - RNA, 25 nt, Human
ggaccuacugcucgggaggcagcag

SEQ ID NO: 25924 - RNA, 20 nt, Human
uccauccugagccacaagag

SEQ ID NO: 25925 - RNA, 27 nt, Human
gcaaaauuucucccuuaucuacuguga

SEQ ID NO: 25926 - RNA, 24 nt, Human
uauguggccgaggcagacaagugg

SEQ ID NO: 25927 - RNA, 29 nt, Human
cagaauaaacacauuuagccuuauagaca

SEQ ID NO: 25928 - RNA, 22 nt, Human
auauggcccuggcucugcauug

SEQ ID NO: 25929 - RNA, 25 nt, Human
guguuacaggcucuaaagugcaaug

SEQ ID NO: 25930 - RNA, 20 nt, Human
ugcacaucuauaaucccagu

SEQ ID NO: 25931 - RNA, 21 nt, Human
cucaaagcaucuuguaaccua

SEQ ID NO: 25932 - RNA, 24 nt, Human
ggcccuuggcccagccccaccucc

SEQ ID NO: 25933 - RNA, 22 nt, Human
auugcauugacuuuccccacca

SEQ ID NO: 25934 - RNA, 24 nt, Human
cccggggaucagacauaccugucc

SEQ ID NO: 25935 - RNA, 26 nt, Human
uccaaggauguuuaaaaucuaguugg

SEQ ID NO: 25936 - RNA, 22 nt, Human
uauuuacagucuguaacuuucc

SEQ ID NO: 25937 - RNA, 26 nt, Human
ucugugcuuuucucucugauucucca

SEQ ID NO: 25938 - RNA, 22 nt, Human
cagcgaagggaaugagacucug

SEQ ID NO: 25939 - RNA, 27 nt, Human
gccugcuugcaggaaaugaauccagca

SEQ ID NO: 25940 - RNA, 22 nt, Human
ugaaacccugucucuaccaaaa

SEQ ID NO: 25941 - RNA, 21 nt, Human
uuuuuaaaaacuuacuuauuu

SEQ ID NO: 25942 - RNA, 23 nt, Human
ugcggcgaggcgggcagagccag

SEQ ID NO: 25943 - RNA, 23 nt, Human
aggcgaucuuguuugaagcucua

SEQ ID NO: 25944 - RNA, 23 nt, Human
ucaacuucaguugagagggugca

SEQ ID NO: 25945 - RNA, 22 nt, Human
cuggccccacacugugccaccg

SEQ ID NO: 25946 - RNA, 28 nt, Human
gccuugucucccuggcgagugccaggug

SEQ ID NO: 25947 - RNA, 24 nt, Human
agaagagaccucaugacagcugga

SEQ ID NO: 25948 - RNA, 24 nt, Human
ggcaucuuucugcuccugaucaga

SEQ ID NO: 25949 - RNA, 20 nt, Human
aaguuugcuaagcugcuggu

SEQ ID NO: 25950 - RNA, 26 nt, Human
gucucccaggcugcuggagugcagug

SEQ ID NO: 25951 - RNA, 21 nt, Human
gguuuagaauaaggaacaagc

SEQ ID NO: 25952 - RNA, 23 nt, Human
aacacuccuaagaaauguugaug

SEQ ID NO: 25953 - RNA, 23 nt, Human
uggacacugucacacucaacauc

SEQ ID NO: 25954 - RNA, 20 nt, Human
uuauuaucuauuaaccaaag

SEQ ID NO: 25955 - RNA, 21 nt, Human
guuuacuauuuacccuaaaac

SEQ ID NO: 25956 - RNA, 22 nt, Human
gggauuacaggcaagagccacc

SEQ ID NO: 25957 - RNA, 25 nt, Human
ggcccaguccaucuaccuggcuggg

SEQ ID NO: 25958 - RNA, 22 nt, Human
aguuaaauucgaacuagccaca

SEQ ID NO: 25959 - RNA, 32 nt, Human
gugcggcuacaggagugagcacugaggugugc

SEQ ID NO: 25960 - RNA, 20 nt, Human
auuugcacuagaugggccug

SEQ ID NO: 25961 - RNA, 27 nt, Human
ucuccugccucagcuucccgaguagcu

SEQ ID NO: 25962 - RNA, 18 nt, Human
uucacccaggcugcggag

SEQ ID NO: 25963 - RNA, 22 nt, Human
augccuaagggacaugcugcuu

SEQ ID NO: 25964 - RNA, 19 nt, Human
aagucccagggagcucugc

SEQ ID NO: 25965 - RNA, 22 nt, Human
ggcagacuaaaacaaguacauc

SEQ ID NO: 25966 - RNA, 21 nt, Human
agcucacugcagccucugcca

SEQ ID NO: 25967 - RNA, 24 nt, Human
gaaugagguauuauuuaaggcaga

SEQ ID NO: 25968 - RNA, 21 nt, Human
cgccaucuuggugacuuugaa

SEQ ID NO: 25969 - RNA, 19 nt, Human
ggggagcuagagggagcag

SEQ ID NO: 25970 - RNA, 21 nt, Human
acacacgguccacagcucauc

SEQ ID NO: 25971 - RNA, 23 nt, Human
gggagugagacaggcuggguccu

SEQ ID NO: 25972 - RNA, 22 nt, Human
gggaaguccauuugcaagcuga

SEQ ID NO: 25973 - RNA, 27 nt, Human
ugcagugagccgagaucaugggacugc

SEQ ID NO: 25974 - RNA, 23 nt, Human
gaaaugagagcccggcgcaugga

SEQ ID NO: 25975 - RNA, 24 nt, Human
acauuccugaagcuguucccacuc

SEQ ID NO: 25976 - RNA, 24 nt, Human
gccucagaaccucuccuucaggag

SEQ ID NO: 25977 - RNA, 25 nt, Human
aacuggaguggaguaggagaaagag

SEQ ID NO: 25978 - RNA, 22 nt, Human
gcugauggggaggcuggaagac

SEQ ID NO: 25979 - RNA, 24 nt, Human
uuguuuuuaccuuccuuuucuuuu

SEQ ID NO: 25980 - RNA, 22 nt, Human
gcaauuagguguucauuuuuua

SEQ ID NO: 25981 - RNA, 20 nt, Human
gucaccuccucagugcaguu

SEQ ID NO: 25982 - RNA, 28 nt, Human
gucuccagcaacuuuggaaaucucuuug

SEQ ID NO: 25983 - RNA, 18 nt, Human
guaguguccaucagcagg

SEQ ID NO: 25984 - RNA, 23 nt, Human
gcuggcuguguuugcagugcaaa

SEQ ID NO: 25985 - RNA, 21 nt, Human
gcagcccaggcgcggagggag

SEQ ID NO: 25986 - RNA, 22 nt, Human
aauccucccuccucuccucaca

SEQ ID NO: 25987 - RNA, 22 nt, Human
cagcacagcugagagaggcugu

SEQ ID NO: 25988 - RNA, 22 nt, Human
ugcucccucccagacacucccu

SEQ ID NO: 25989 - RNA, 22 nt, Human
gacucaccuauguggcaccuua

SEQ ID NO: 25990 - RNA, 20 nt, Human
cgccuuguugccugcuuugu

SEQ ID NO: 25991 - RNA, 21 nt, Human
uuugcucauuuuuaauuuggg

SEQ ID NO: 25992 - RNA, 27 nt, Human
aguauuuuuaucuucaauuuuauuuaa

SEQ ID NO: 25993 - RNA, 25 nt, Human
aguccuuccuggggcauuccaggca

SEQ ID NO: 25994 - RNA, 28 nt, Human
ggcugucugagugggcacuugucuggcu

SEQ ID NO: 25995 - RNA, 23 nt, Human
uaucauuugaacaacuaggcuuc

SEQ ID NO: 25996 - RNA, 19 nt, Human
acaaucaguuaaacacacc

SEQ ID NO: 25997 - RNA, 27 nt, Human
cagucucucaaagugcugggauuacag

SEQ ID NO: 25998 - RNA, 25 nt, Human
ugcuuagcccucacagggccccaag

SEQ ID NO: 25999 - RNA, 21 nt, Human
cacgcucagagacagcugcac

SEQ ID NO: 26000 - RNA, 23 nt, Human
gccugccuccucccuccuggguc

SEQ ID NO: 26001 - RNA, 18 nt, Human
uagccccuggauucuucu

SEQ ID NO: 26002 - RNA, 27 nt, Human
ugaagaagcaguuccacaaagccagcc

SEQ ID NO: 26003 - RNA, 20 nt, Human
uguaggaguaaagauaaaag

SEQ ID NO: 26004 - RNA, 22 nt, Human
gcuguuccuucaacugagugcu

SEQ ID NO: 26005 - RNA, 19 nt, Human
agggcuucucucagcccau

SEQ ID NO: 26006 - RNA, 19 nt, Human
ucccacccucuugguugcc

SEQ ID NO: 26007 - RNA, 29 nt, Human
uauccuacugagcauuugcaccucuguuc

SEQ ID NO: 26008 - RNA, 21 nt, Human
gcuucaaaggaauauaccacu

SEQ ID NO: 26009 - RNA, 17 nt, Human
cccaccccaccccaccu

SEQ ID NO: 26010 - RNA, 24 nt, Human
augcagcugcucauacucaauccc

SEQ ID NO: 26011 - RNA, 22 nt, Human
ugccuguaaacccagggcuuua

SEQ ID NO: 26012 - RNA, 24 nt, Human
uuacccugggcuggagaguugguu

SEQ ID NO: 26013 - RNA, 25 nt, Human
uuugcagcuguccgagucuccaucc

SEQ ID NO: 26014 - RNA, 25 nt, Human
ugccaucguacagaccagcuuuuag

SEQ ID NO: 26015 - RNA, 24 nt, Human
gcagcugcugccccagcugccucc

SEQ ID NO: 26016 - RNA, 25 nt, Human
uacuagggaguaacuguagagugag

SEQ ID NO: 26017 - RNA, 27 nt, Human
cugagguacgguaucucucuccagcca

SEQ ID NO: 26018 - RNA, 19 nt, Human
gccauaaaauuuugguuug

SEQ ID NO: 26019 - RNA, 23 nt, Human
acuguuaacauuaggaaaaucaa

SEQ ID NO: 26020 - RNA, 21 nt, Human
ggcucuuggggaaaagcaauu

SEQ ID NO: 26021 - RNA, 22 nt, Human
gcucacugcagccucagcgucc

SEQ ID NO: 26022 - RNA, 24 nt, Human
aggcgccuguaaucccagcuacuc

SEQ ID NO: 26023 - RNA, 20 nt, Human
ggggugagccugaaggccac

SEQ ID NO: 26024 - RNA, 20 nt, Human
ugcagacaacccuguccuca

SEQ ID NO: 26025 - RNA, 25 nt, Human
acgagucuuuuucucccuuaaguuc

SEQ ID NO: 26026 - RNA, 20 nt, Human
uuuagucaggagagugcaga

SEQ ID NO: 26027 - RNA, 24 nt, Human
caaaccugguaccuguugcuuccc

SEQ ID NO: 26028 - RNA, 22 nt, Human
guccuccccuccacccgcacau

SEQ ID NO: 26029 - RNA, 22 nt, Human
ucaaguagcugggauuuuaaac

SEQ ID NO: 26030 - RNA, 19 nt, Human
gcucuuccccaccuugcca

SEQ ID NO: 26031 - RNA, 23 nt, Human
cuugugaacuucuacucauuucc

SEQ ID NO: 26032 - RNA, 22 nt, Human
ugcagugagccuugaucacgcc

SEQ ID NO: 26033 - RNA, 25 nt, Human
ggggcacagggucucuaccaucccc

SEQ ID NO: 26034 - RNA, 22 nt, Human
uuugggaaaauacguugaggga

SEQ ID NO: 26035 - RNA, 27 nt, Human
gagcccaggaguucgaagcugcaggga

SEQ ID NO: 26036 - RNA, 22 nt, Human
cccaacgugcugggauuauagg

SEQ ID NO: 26037 - RNA, 21 nt, Human
acucaauccuuuucuggacca

SEQ ID NO: 26038 - RNA, 22 nt, Human
gaccuccuaggcucaagcgauc

SEQ ID NO: 26039 - RNA, 22 nt, Human
aaacuccuggccucaagcaauc

SEQ ID NO: 26040 - RNA, 22 nt, Human
gaacuccuagccucaagcaauc

SEQ ID NO: 26041 - RNA, 23 nt, Human
cccagcacuaacguaaauacaca

SEQ ID NO: 26042 - RNA, 21 nt, Human
aaacccucagcuuauguagcu

SEQ ID NO: 26043 - RNA, 26 nt, Human
aaaggaagaaugaaguggugauauuu

SEQ ID NO: 26044 - RNA, 22 nt, Human
uugaucagagcauugugcaaua

SEQ ID NO: 26045 - RNA, 17 nt, Human
ccuuccuuaccuacuca

SEQ ID NO: 26046 - RNA, 22 nt, Human
ccaaagacuucauuuguguauc

SEQ ID NO: 26047 - RNA, 21 nt, Human
aggguugccugcgggagccag

SEQ ID NO: 26048 - RNA, 26 nt, Human
cccugccugccuccccaacaccgugg

SEQ ID NO: 26049 - RNA, 26 nt, Human
agaugggacuacaggcacaggccauu

SEQ ID NO: 26050 - RNA, 24 nt, Human
ccugcugcuacagccuauuugcug

SEQ ID NO: 26051 - RNA, 23 nt, Human
ggcaugugggugugggugcaaug

SEQ ID NO: 26052 - RNA, 23 nt, Human
aguccaggccugugugcuuugua

SEQ ID NO: 26053 - RNA, 26 nt, Human
gagccccaaggccaccccaccagaag

SEQ ID NO: 26054 - RNA, 26 nt, Human
gaccaguguugaucuguaauguaaua

SEQ ID NO: 26055 - RNA, 25 nt, Human
cgggcagcagagaaggcccagcuga

SEQ ID NO: 26056 - RNA, 21 nt, Human
ucucccugcggcuccuggguu

SEQ ID NO: 26057 - RNA, 27 nt, Human
ugauguguugccacuuuccaagucacu

SEQ ID NO: 26058 - RNA, 27 nt, Human
cgcuucccuccuucaugauuuccauua

SEQ ID NO: 26059 - RNA, 20 nt, Human
uaccccugcugcugcagugg

SEQ ID NO: 26060 - RNA, 28 nt, Human
ggaguagcugggauugcaggcacccgcc

SEQ ID NO: 26061 - RNA, 24 nt, Human
ucuuccacucuccuugcuacccag

SEQ ID NO: 26062 - RNA, 20 nt, Human
uccacuuacagagaagauuu

SEQ ID NO: 26063 - RNA, 24 nt, Human
uacugcacucagauuuaagccuua

SEQ ID NO: 26064 - RNA, 24 nt, Human
agcagagucaggagaccccaaggc

SEQ ID NO: 26065 - RNA, 27 nt, Human
ggaggcugaggcaggagaaucgcuuga

SEQ ID NO: 26066 - RNA, 27 nt, Human
ggaggcugaggcaggaggaucgcuuaa

SEQ ID NO: 26067 - RNA, 26 nt, Human
cgacgcgcaaccccgcucagcaguca

SEQ ID NO: 26068 - RNA, 22 nt, Human
guucggugauucuccugccuca

SEQ ID NO: 26069 - RNA, 25 nt, Human
auugcacuccaggcugggcagcaag

SEQ ID NO: 26070 - RNA, 24 nt, Human
caccaggcuggagugcagugccgc

SEQ ID NO: 26071 - RNA, 25 nt, Human
aaaaagcuuuugcccuguuguguac

SEQ ID NO: 26072 - RNA, 21 nt, Human
uccucuuaacguuagaccaca

SEQ ID NO: 26073 - RNA, 19 nt, Human
uuucggcccuuaacccagc

SEQ ID NO: 26074 - RNA, 19 nt, Human
gcacagccccuggagccuc

SEQ ID NO: 26075 - RNA, 19 nt, Human
uaaaccugaccuccuuuau

SEQ ID NO: 26076 - RNA, 20 nt, Human
ucaaggacuacauuaaucac

SEQ ID NO: 26077 - RNA, 21 nt, Human
gcgggaagcggcgauccugcc

SEQ ID NO: 26078 - RNA, 20 nt, Human
agaacauuuggggaauuugg

SEQ ID NO: 26079 - RNA, 20 nt, Human
cacaugcacacaggugcaca

SEQ ID NO: 26080 - RNA, 21 nt, Human
ucgcccaugcuggagugcagu

SEQ ID NO: 26081 - RNA, 21 nt, Human
ucgcccaggcuggagggcagu

SEQ ID NO: 26082 - RNA, 22 nt, Human
gcagccugcaugacagagcaca

SEQ ID NO: 26083 - RNA, 26 nt, Human
uagcucccaguuuuaacauuucgcca

SEQ ID NO: 26084 - RNA, 20 nt, Human
caugugaguccuccauggca

SEQ ID NO: 26085 - RNA, 22 nt, Human
accacgcuugguuaauuuuugu

SEQ ID NO: 26086 - RNA, 16 nt, Human
cacacacgcgcuuuuc

SEQ ID NO: 26087 - RNA, 28 nt, Human
cccgagcuagcuggggacaagggcugcc

SEQ ID NO: 26088 - RNA, 20 nt, Human
ucucugagaagagccagcag

SEQ ID NO: 26089 - RNA, 26 nt, Human
aaaccugaaaucacaugccuauguaa

SEQ ID NO: 26090 - RNA, 23 nt, Human
ggaauguggccacagggagcaga

SEQ ID NO: 26091 - RNA, 23 nt, Human
cugucucucuaggaauagggucu

SEQ ID NO: 26092 - RNA, 29 nt, Human
ccugaacuuccugcuuccucagagggcca

SEQ ID NO: 26093 - RNA, 26 nt, Human
ccugcccuucuaucugggagcuaggg

SEQ ID NO: 26094 - RNA, 21 nt, Human
ggcuuagagauuaaagcuccu

SEQ ID NO: 26095 - RNA, 25 nt, Human
acagacucccuccagcucuuugugu

SEQ ID NO: 26096 - RNA, 26 nt, Human
gucacguuuccugaaacagcacguug

SEQ ID NO: 26097 - RNA, 23 nt, Human
uaggccuguaauuccagcuacuc

SEQ ID NO: 26098 - RNA, 29 nt, Human
cacccaagccucaccuccccaccccuuga

SEQ ID NO: 26099 - RNA, 24 nt, Human
ggcaggcgccauugggcagaggga

SEQ ID NO: 26100 - RNA, 25 nt, Human
ugcuccuauauuuuucauuuuuugu

SEQ ID NO: 26101 - RNA, 22 nt, Human
cacaucccuagggcucugugau

SEQ ID NO: 26102 - RNA, 21 nt, Human
guuacuggucaugccugcugu

SEQ ID NO: 26103 - RNA, 22 nt, Human
uuauuugcacuauugagucuuc

SEQ ID NO: 26104 - RNA, 21 nt, Human
ggaggaggaggcugcagugag

SEQ ID NO: 26105 - RNA, 24 nt, Human
ugugaaccuggagggcaagggguu

SEQ ID NO: 26106 - RNA, 26 nt, Human
uucugucauuaaacucauauuuugga

SEQ ID NO: 26107 - RNA, 19 nt, Human
cuaccuucugcccuguguc

SEQ ID NO: 26108 - RNA, 17 nt, Human
auguggcagugagggac

SEQ ID NO: 26109 - RNA, 23 nt, Human
ccuggaaaguugcccacuuuucu

SEQ ID NO: 26110 - RNA, 21 nt, Human
auuuccuuaagagcuggacug

SEQ ID NO: 26111 - RNA, 19 nt, Human
cagacuggagugcagugcc

SEQ ID NO: 26112 - RNA, 26 nt, Human
ucagugaagaugcagaagggaaaugg

SEQ ID NO: 26113 - RNA, 28 nt, Human
ccacugcacuugccaccugagucacauu

SEQ ID NO: 26114 - RNA, 27 nt, Human
ucuggggugaggcaugagaauguugcc

SEQ ID NO: 26115 - RNA, 24 nt, Human
ucuccugccucagcaucccgagua

SEQ ID NO: 26116 - RNA, 29 nt, Human
gcagccaggccucgccugcccuccucucc

SEQ ID NO: 26117 - RNA, 25 nt, Human
aggcucucucuuaacacggcacuua

SEQ ID NO: 26118 - RNA, 20 nt, Human
ccagcaggcagaguggcgug

SEQ ID NO: 26119 - RNA, 23 nt, Human
aaggaaggagacuggccagggaa

SEQ ID NO: 26120 - RNA, 24 nt, Human
ucuggggcucuucugggagcacgg

SEQ ID NO: 26121 - RNA, 26 nt, Human
ugucaggccagcucagugaccccagc

SEQ ID NO: 26122 - RNA, 20 nt, Human
cuggggcagagagauuuuga

SEQ ID NO: 26123 - RNA, 20 nt, Human
gggaucgauuggagcugucc

SEQ ID NO: 26124 - RNA, 22 nt, Human
cacgagaucaagagaucaagac

SEQ ID NO: 26125 - RNA, 24 nt, Human
ugaccccaaguuauccaccugccu

SEQ ID NO: 26126 - RNA, 22 nt, Human
gaaauguggcuccaguugcucu

SEQ ID NO: 26127 - RNA, 27 nt, Human
uuucaaaacguugggaauaagggccug

SEQ ID NO: 26128 - RNA, 23 nt, Human
acuaauugauuccuccauccuug

SEQ ID NO: 26129 - RNA, 27 nt, Human
gaguagcuggcauuacaggcgcccacc

SEQ ID NO: 26130 - RNA, 26 nt, Human
ccagcagaacaugugggaggaagaag

SEQ ID NO: 26131 - RNA, 24 nt, Human
cagaggaggcagaaauggaagcau

SEQ ID NO: 26132 - RNA, 22 nt, Human
guggagaaggugacaugacaga

SEQ ID NO: 26133 - RNA, 22 nt, Human
ccugaacucagaccacuugcau

SEQ ID NO: 26134 - RNA, 22 nt, Human
ugagggguagaaggggccagaa

SEQ ID NO: 26135 - RNA, 21 nt, Human
cugcagcugccuugccuugcc

SEQ ID NO: 26136 - RNA, 24 nt, Human
uuugguugacccuuguaugucaca

SEQ ID NO: 26137 - RNA, 21 nt, Human
caauuagaaucuaaguguuug

SEQ ID NO: 26138 - RNA, 23 nt, Human
gucuccagagcgcuugcaucaaa

SEQ ID NO: 26139 - RNA, 22 nt, Human
ccucacccuuggcgcuggacca

SEQ ID NO: 26140 - RNA, 20 nt, Human
acucagacuagaauggaggu

SEQ ID NO: 26141 - RNA, 26 nt, Human
uugggaggcugagacaggagaaucgc

SEQ ID NO: 26142 - RNA, 23 nt, Human
auggaaagaaaagaauguacauu

SEQ ID NO: 26143 - RNA, 21 nt, Human
gcaggcagccagcaucugggc

SEQ ID NO: 26144 - RNA, 20 nt, Human
cuaacagugaaacccugucu

SEQ ID NO: 26145 - RNA, 27 nt, Human
cccgcgccaggcccucagucuuccugc

SEQ ID NO: 26146 - RNA, 25 nt, Human
cagcaaaaacucuuaacaacugugg

SEQ ID NO: 26147 - RNA, 21 nt, Human
uuuggguuuauguauaaauca

SEQ ID NO: 26148 - RNA, 22 nt, Human
ggucucaaacuccugaccuugu

SEQ ID NO: 26149 - RNA, 18 nt, Human
gcauucucuccagcugca

SEQ ID NO: 26150 - RNA, 20 nt, Human
gugguggcaauuuaagcaca

SEQ ID NO: 26151 - RNA, 21 nt, Human
auugcaaagaaaauucucaag

SEQ ID NO: 26152 - RNA, 27 nt, Human
ggcucacugcccugaugacccacccgc

SEQ ID NO: 26153 - RNA, 21 nt, Human
cugggaggugggcacacaggg

SEQ ID NO: 26154 - RNA, 25 nt, Human
cccuguucccagagucugcagccau

SEQ ID NO: 26155 - RNA, 20 nt, Human
agaagauccggaauauuauc

SEQ ID NO: 26156 - RNA, 24 nt, Human
agacgccgggaacucacgccucca

SEQ ID NO: 26157 - RNA, 27 nt, Human
ccacugcucuccagccuggcgacagag

SEQ ID NO: 26158 - RNA, 21 nt, Human
cugcccaggauggagaugaga

SEQ ID NO: 26159 - RNA, 24 nt, Human
guagcuauggaugggacaggaagc

SEQ ID NO: 26160 - RNA, 26 nt, Human
gcccugcuugguugucuccacacaca

SEQ ID NO: 26161 - RNA, 22 nt, Human
acuauguucuagauaggucagu

SEQ ID NO: 26162 - RNA, 27 nt, Human
cacacacaccccuguccuccagcacca

SEQ ID NO: 26163 - RNA, 25 nt, Human
acgacggggccuuuucccuucgcca

SEQ ID NO: 26164 - RNA, 22 nt, Human
gacuaauuuuuguauuuuuagu

SEQ ID NO: 26165 - RNA, 21 nt, Human
acuguugcugacuacuacucu

SEQ ID NO: 26166 - RNA, 22 nt, Human
uccugccugagguugcagugag

SEQ ID NO: 26167 - RNA, 20 nt, Human
gcugacugugaaccugcccu

SEQ ID NO: 26168 - RNA, 20 nt, Human
ucggcuccggaaucacugca

SEQ ID NO: 26169 - RNA, 24 nt, Human
cuugcaguucauucauauggcccc

SEQ ID NO: 26170 - RNA, 21 nt, Human
uuguugcugaaacuugcugag

SEQ ID NO: 26171 - RNA, 25 nt, Human
ccaacuugucuuccuuucucucuuc

SEQ ID NO: 26172 - RNA, 20 nt, Human
cucaagacauggcugcccag

SEQ ID NO: 26173 - RNA, 22 nt, Human
gugugagccaccacaccugacc

SEQ ID NO: 26174 - RNA, 22 nt, Human
gccuagaaguccaccauccugc

SEQ ID NO: 26175 - RNA, 20 nt, Human
uucauugaacaaauggugcc

SEQ ID NO: 26176 - RNA, 22 nt, Human
aggccgaggcagguggaucgcu

SEQ ID NO: 26177 - RNA, 22 nt, Human
uucacaacagagugaaaaaucu

SEQ ID NO: 26178 - RNA, 25 nt, Human
ggcuuccuuucuuccuuguaaaauu

SEQ ID NO: 26179 - RNA, 25 nt, Human
gugagaugaauacuuccugagaaac

SEQ ID NO: 26180 - RNA, 21 nt, Human
gcuacuucccugucccucuga

SEQ ID NO: 26181 - RNA, 24 nt, Human
gggcccagcagagaguccguaggc

SEQ ID NO: 26182 - RNA, 22 nt, Human
ccgcugcugccgccgccgccgc

SEQ ID NO: 26183 - RNA, 26 nt, Human
gcccucucgccuccuccuccugggaa

SEQ ID NO: 26184 - RNA, 20 nt, Human
ccuagggaaacucaggcuuc

SEQ ID NO: 26185 - RNA, 23 nt, Human
cgccuucugggcuuucuucagag

SEQ ID NO: 26186 - RNA, 26 nt, Human
cucagccagaggaguacggauuaagg

SEQ ID NO: 26187 - RNA, 20 nt, Human
guucugagacuggauucagu

SEQ ID NO: 26188 - RNA, 20 nt, Human
ggagucagagugagagccag

SEQ ID NO: 26189 - RNA, 26 nt, Human
acagaagagcaacaacaaacugcuua

SEQ ID NO: 26190 - RNA, 21 nt, Human
ugugaccaacuaaaugacaga

SEQ ID NO: 26191 - RNA, 27 nt, Human
gggaggcagcgcuggcggcggggcugg

SEQ ID NO: 26192 - RNA, 23 nt, Human
gaggucaggguuuuaacgagcua

SEQ ID NO: 26193 - RNA, 26 nt, Human
cacauuuguauguugugcccuggaau

SEQ ID NO: 26194 - RNA, 22 nt, Human
aagagcuaagagcaguacucug

SEQ ID NO: 26195 - RNA, 19 nt, Human
uagggcuuaugacugugaa

SEQ ID NO: 26196 - RNA, 27 nt, Human
cugcuucugugaccgcugcuauaggcg

SEQ ID NO: 26197 - RNA, 24 nt, Human
caugguaagagucacaauuugcaa

SEQ ID NO: 26198 - RNA, 22 nt, Human
gucucccaggcuggagugcuau

SEQ ID NO: 26199 - RNA, 22 nt, Human
gucacccaggcuggagugcaau

SEQ ID NO: 26200 - RNA, 22 nt, Human
gucacccaggcuagagugcagu

SEQ ID NO: 26201 - RNA, 21 nt, Human
cuucccccugacucccccauu

SEQ ID NO: 26202 - RNA, 27 nt, Human
auugaacacuauugugucuuaaauacu

SEQ ID NO: 26203 - RNA, 26 nt, Human
uguucugcaagaauuaaaacugaguc

SEQ ID NO: 26204 - RNA, 24 nt, Human
aucuucuuuaggaauaauagauga

SEQ ID NO: 26205 - RNA, 18 nt, Human
uuguucgggugugcaaug

SEQ ID NO: 26206 - RNA, 22 nt, Human
uauguguaauguuuuaugucaa

SEQ ID NO: 26207 - RNA, 27 nt, Human
acccuccaaucucuguguguuuuguaa

SEQ ID NO: 26208 - RNA, 20 nt, Human
cccacauuucugcaaacaua

SEQ ID NO: 26209 - RNA, 21 nt, Human
uugcuuuuguugcuuguguuu

SEQ ID NO: 26210 - RNA, 20 nt, Human
gaugaagugacuuccucaaa

SEQ ID NO: 26211 - RNA, 24 nt, Human
uccucaaggucuccauucuccuag

SEQ ID NO: 26212 - RNA, 26 nt, Human
augcagcacgcaacauggcacaugug

SEQ ID NO: 26213 - RNA, 20 nt, Human
gugguuuggagauggguggg

SEQ ID NO: 26214 - RNA, 17 nt, Human
ucugacauccugaccuc

SEQ ID NO: 26215 - RNA, 22 nt, Human
ccugaguagcuaggauuacagg

SEQ ID NO: 26216 - RNA, 24 nt, Human
ugcuaaaagcauguauaguuagga

SEQ ID NO: 26217 - RNA, 26 nt, Human
cccacauuggauucaucagcauuugg

SEQ ID NO: 26218 - RNA, 24 nt, Human
cucaggcuucuaguuucucuuaga

SEQ ID NO: 26219 - RNA, 24 nt, Human
acagccccaagcauggccaggaag

SEQ ID NO: 26220 - RNA, 22 nt, Human
ugagaccauauguaugcuauua

SEQ ID NO: 26221 - RNA, 22 nt, Human
cagugagacucugucucaauaa

SEQ ID NO: 26222 - RNA, 24 nt, Human
gcaugagccaccacacccagcccc

SEQ ID NO: 26223 - RNA, 21 nt, Human
ugcucccuuccagcuggugag

SEQ ID NO: 26224 - RNA, 24 nt, Human
cccgcugucugugcugugagaguc

SEQ ID NO: 26225 - RNA, 23 nt, Human
gucucucuggcaggagugccugu

SEQ ID NO: 26226 - RNA, 22 nt, Human
gaauccaggaggcagaggcugu

SEQ ID NO: 26227 - RNA, 22 nt, Human
uuuuguaacucuuugcuuuuua

SEQ ID NO: 26228 - RNA, 22 nt, Human
gcagcauuuuuccuucaaaauc

SEQ ID NO: 26229 - RNA, 27 nt, Human
agggcuugccuaaggccagccauuuuu

SEQ ID NO: 26230 - RNA, 22 nt, Human
ggauaccauucucaacaaguca

SEQ ID NO: 26231 - RNA, 28 nt, Human
ccucugagcccaagaccuugccugaaaa

SEQ ID NO: 26232 - RNA, 22 nt, Human
uaccaguccacaugcaauuaaa

SEQ ID NO: 26233 - RNA, 22 nt, Human
ugcugggcuucauaccugggug

SEQ ID NO: 26234 - RNA, 21 nt, Human
cuggcuggcuccgaguguggg

SEQ ID NO: 26235 - RNA, 27 nt, Human
ggacacuugaguuuuuaaaacuguggu

SEQ ID NO: 26236 - RNA, 22 nt, Human
guaauuugggcccagugccuug

SEQ ID NO: 26237 - RNA, 26 nt, Human
gggcuugagcuggagcucgguuaggc

SEQ ID NO: 26238 - RNA, 25 nt, Human
ggugggcugaggggcagggagccgg

SEQ ID NO: 26239 - RNA, 27 nt, Human
gucagccuggcugggcucugguggggg

SEQ ID NO: 26240 - RNA, 21 nt, Human
cggugggggagaguacuggaa

SEQ ID NO: 26241 - RNA, 22 nt, Human
aggcugagucaggagaaucacu

SEQ ID NO: 26242 - RNA, 26 nt, Human
ucaagccauguauaaaugugauauga

SEQ ID NO: 26243 - RNA, 24 nt, Human
uauuuuuauuuuuugccuaacagc

SEQ ID NO: 26244 - RNA, 22 nt, Human
cgcccaggcuggacugcaguga

SEQ ID NO: 26245 - RNA, 22 nt, Human
ggacuccugggcucaagcaauc

SEQ ID NO: 26246 - RNA, 23 nt, Human
cuguucaucugcugacuucuguc

SEQ ID NO: 26247 - RNA, 24 nt, Human
ucuggagacugaacuuggguuggu

SEQ ID NO: 26248 - RNA, 22 nt, Human
aaguagcugggauuacaggugu

SEQ ID NO: 26249 - RNA, 20 nt, Human
cgggagcggagguugcagug

SEQ ID NO: 26250 - RNA, 25 nt, Human
cuagaaguuuucccucaucuguaaa

SEQ ID NO: 26251 - RNA, 25 nt, Human
uuacugacauggagugaagugcaau

SEQ ID NO: 26252 - RNA, 22 nt, Human
caaccagaaaacaucugcucac

SEQ ID NO: 26253 - RNA, 21 nt, Human
cuuaaccuugcaaagcaaguu

SEQ ID NO: 26254 - RNA, 19 nt, Human
acugccucuuuccuguugu

SEQ ID NO: 26255 - RNA, 20 nt, Human
ugucuuuauagauguacaua

SEQ ID NO: 26256 - RNA, 22 nt, Human
gaagcagaacuguucuauucag

SEQ ID NO: 26257 - RNA, 19 nt, Human
cucccgggggcaggguggg

SEQ ID NO: 26258 - RNA, 24 nt, Human
uaccugccagcaggagcaugaugg

SEQ ID NO: 26259 - RNA, 21 nt, Human
caguuuuaugucuccaugcaa

SEQ ID NO: 26260 - RNA, 27 nt, Human
ggucucgaucuccugaccuugucaucc

SEQ ID NO: 26261 - RNA, 27 nt, Human
aaaggauucgggaggcugauguuucuu

SEQ ID NO: 26262 - RNA, 20 nt, Human
ccucuucccuuccccucacc

SEQ ID NO: 26263 - RNA, 26 nt, Human
cugucccucuuugccugugugagcau

SEQ ID NO: 26264 - RNA, 23 nt, Human
uucaaguuuucuugugauuuggg

SEQ ID NO: 26265 - RNA, 19 nt, Human
ucuccccucagcugagucc

SEQ ID NO: 26266 - RNA, 20 nt, Human
ucagagcagaggggccagga

SEQ ID NO: 26267 - RNA, 26 nt, Human
agcaguuuuauaacccuuuuuccuca

SEQ ID NO: 26268 - RNA, 23 nt, Human
gcucuucugugauuauugucaug

SEQ ID NO: 26269 - RNA, 22 nt, Human
agagcuccugggaccaagcaaa

SEQ ID NO: 26270 - RNA, 27 nt, Human
gacagggccggagaaagauggagcagc

SEQ ID NO: 26271 - RNA, 23 nt, Human
aaccacagucuguaaucccagga

SEQ ID NO: 26272 - RNA, 23 nt, Human
aaagggcagggcaucuccugugc

SEQ ID NO: 26273 - RNA, 24 nt, Human
augauauuucagaagaguuggcug

SEQ ID NO: 26274 - RNA, 22 nt, Human
gcaugcuguagaaaugcucaaa

SEQ ID NO: 26275 - RNA, 26 nt, Human
uggaaagacaugaaagccacgacaua

SEQ ID NO: 26276 - RNA, 23 nt, Human
uucuggcuucugcuucauccugc

SEQ ID NO: 26277 - RNA, 29 nt, Human
cucuuaucaguaaaacaaaggacuugcca

SEQ ID NO: 26278 - RNA, 21 nt, Human
cuagccuuuauuucucuguca

SEQ ID NO: 26279 - RNA, 23 nt, Human
ccaggaggcagagguugcaguga

SEQ ID NO: 26280 - RNA, 23 nt, Human
ccgggaggcagagguugcgguga

SEQ ID NO: 26281 - RNA, 21 nt, Human
uuccuguggcucccucucucc

SEQ ID NO: 26282 - RNA, 26 nt, Human
guucugcuggccuggaucuccccacu

SEQ ID NO: 26283 - RNA, 22 nt, Human
accucacugcaaccuccgccuc

SEQ ID NO: 26284 - RNA, 27 nt, Human
gauguuuguuucaagaccagcuguuuc

SEQ ID NO: 26285 - RNA, 23 nt, Human
ggcccaggcugagagcagcaggg

SEQ ID NO: 26286 - RNA, 23 nt, Human
aaauuauuuguuacuguauccuc

SEQ ID NO: 26287 - RNA, 23 nt, Human
cugagugcaccacuucaagugac

SEQ ID NO: 26288 - RNA, 23 nt, Human
aaguggaauuucuuguuucucca

SEQ ID NO: 26289 - RNA, 27 nt, Human
cuccagugcccuccuucccugucucug

SEQ ID NO: 26290 - RNA, 20 nt, Human
cccagccucugcccagggac

SEQ ID NO: 26291 - RNA, 20 nt, Human
ucggggagagggcgcgcagc

SEQ ID NO: 26292 - RNA, 20 nt, Human
ucugcaaggacauuucucaa

SEQ ID NO: 26293 - RNA, 22 nt, Human
gcuucccucuuggcucauucca

SEQ ID NO: 26294 - RNA, 30 nt, Human
aaaacucaggcaaagucacagccucaaaau

SEQ ID NO: 26295 - RNA, 22 nt, Human
cuuuuucuugcugauuuaugca

SEQ ID NO: 26296 - RNA, 24 nt, Human
gugcucuugucacagguagaacag

SEQ ID NO: 26297 - RNA, 22 nt, Human
cuuaacagcaggaaacagagaa

SEQ ID NO: 26298 - RNA, 21 nt, Human
ccacauuccagcccaagggaa

SEQ ID NO: 26299 - RNA, 22 nt, Human
gccuccaacagcaucaucugca

SEQ ID NO: 26300 - RNA, 20 nt, Human
aaggagcagagagcaagauu

SEQ ID NO: 26301 - RNA, 27 nt, Human
ccugagcaacagagugagacccugucu

SEQ ID NO: 26302 - RNA, 20 nt, Human
gggacuucucucuucgggag

SEQ ID NO: 26303 - RNA, 23 nt, Human
aaaguagcugggauuacaggcac

SEQ ID NO: 26304 - RNA, 26 nt, Human
uuaugaauauuauguguuggaggagg

SEQ ID NO: 26305 - RNA, 27 nt, Human
ccuccaccugccccagccccugccucu

SEQ ID NO: 26306 - RNA, 22 nt, Human
gggguuagggagguuggggcgg

SEQ ID NO: 26307 - RNA, 27 nt, Human
agggaaaggccacgugccuguaugagc

SEQ ID NO: 26308 - RNA, 23 nt, Human
uagaaauauuuuuacucguucuu

SEQ ID NO: 26309 - RNA, 23 nt, Human
gucuccuuuccuccuccuggguu

SEQ ID NO: 26310 - RNA, 25 nt, Human
aauacucagcacuagagggagggag

SEQ ID NO: 26311 - RNA, 22 nt, Human
caccacugcucuccagccuggg

SEQ ID NO: 26312 - RNA, 21 nt, Human
gugcagucugcacccugcacu

SEQ ID NO: 26313 - RNA, 31 nt, Human
guacaucucuacuuauuuaugaacagacuuu

SEQ ID NO: 26314 - RNA, 21 nt, Human
cucauuucaguuccuucugca

SEQ ID NO: 26315 - RNA, 23 nt, Human
cucaccucuccggcaccuccucc

SEQ ID NO: 26316 - RNA, 22 nt, Human
guuucaaagaaaacagcuacaa

SEQ ID NO: 26317 - RNA, 23 nt, Human
ccgggaagcggagguugcaggga

SEQ ID NO: 26318 - RNA, 24 nt, Human
ucacauguuuucaaauggaguugg

SEQ ID NO: 26319 - RNA, 20 nt, Human
gccugccacaaaaacaagug

SEQ ID NO: 26320 - RNA, 22 nt, Human
uugccucccccgccuccaguca

SEQ ID NO: 26321 - RNA, 20 nt, Human
uuacagccacaggcacugug

SEQ ID NO: 26322 - RNA, 22 nt, Human
ugcaaccuccaccuccuggguu

SEQ ID NO: 26323 - RNA, 27 nt, Human
ccccaagaguggggcaugggaagggcu

SEQ ID NO: 26324 - RNA, 27 nt, Human
gaguagcugggauuacaggcacccacc

SEQ ID NO: 26325 - RNA, 21 nt, Human
gccugggagcgaccacuuugg

SEQ ID NO: 26326 - RNA, 26 nt, Human
ccaaccucgcccucucucaccagccu

SEQ ID NO: 26327 - RNA, 22 nt, Human
auaggauugaagacaguacagg

SEQ ID NO: 26328 - RNA, 25 nt, Human
cugcagccucagagcccucccaggu

SEQ ID NO: 26329 - RNA, 27 nt, Human
cccagccaguuaguuauucacugugcu

SEQ ID NO: 26330 - RNA, 26 nt, Human
aaaucuuagaagagagcccacuaauu

SEQ ID NO: 26331 - RNA, 22 nt, Human
gcuagaggcuaccccauuuucc

SEQ ID NO: 26332 - RNA, 21 nt, Human
ugagacugggaaggcuuggga

SEQ ID NO: 26333 - RNA, 19 nt, Human
guucucaccagcugccuca

SEQ ID NO: 26334 - RNA, 20 nt, Human
ccucaaggcacugaagcugg

SEQ ID NO: 26335 - RNA, 22 nt, Human
ggcugcugcagacaaguggaca

SEQ ID NO: 26336 - RNA, 22 nt, Human
ugaauuccugggcucaagcagu

SEQ ID NO: 26337 - RNA, 20 nt, Human
auuuccccuccuucccaugg

SEQ ID NO: 26338 - RNA, 21 nt, Human
aauuaaaauauuuugucuucu

SEQ ID NO: 26339 - RNA, 18 nt, Human
ggccucgggcgggccugg

SEQ ID NO: 26340 - RNA, 22 nt, Human
cccuccagcaaagcucccgcgg

SEQ ID NO: 26341 - RNA, 27 nt, Human
caugccuuucuaaagguaugcuagagu

SEQ ID NO: 26342 - RNA, 21 nt, Human
ucaucccuuguguucugccag

SEQ ID NO: 26343 - RNA, 22 nt, Human
ccucaguuucccuccucugcca

SEQ ID NO: 26344 - RNA, 19 nt, Human
aaugugaagagagagcuag

SEQ ID NO: 26345 - RNA, 22 nt, Human
ggagguggagccggccgggugc

SEQ ID NO: 26346 - RNA, 22 nt, Human
acucagcaccuccaaagcaguu

SEQ ID NO: 26347 - RNA, 26 nt, Human
cccucuuccgagagccuuccuccucg

SEQ ID NO: 26348 - RNA, 25 nt, Human
cuuaucucccagcucgcccaggccc

SEQ ID NO: 26349 - RNA, 27 nt, Human
acccuuccugcauuucucuucucagcu

SEQ ID NO: 26350 - RNA, 20 nt, Human
uucauucuucacccuccauu

SEQ ID NO: 26351 - RNA, 27 nt, Human
gcugacaguaaaucucuggguuucugu

SEQ ID NO: 26352 - RNA, 22 nt, Human
aaaaauucuucaagacucagag

SEQ ID NO: 26353 - RNA, 23 nt, Human
agcagguuuuaacaaaaggauga

SEQ ID NO: 26354 - RNA, 23 nt, Human
acuuugacagaaacucaugcuuc

SEQ ID NO: 26355 - RNA, 22 nt, Human
aggguggaacaggagggguggg

SEQ ID NO: 26356 - RNA, 20 nt, Human
ccaaagggaaggcuuccuau

SEQ ID NO: 26357 - RNA, 19 nt, Human
uacauggugcugaccacaa

SEQ ID NO: 26358 - RNA, 23 nt, Human
uucuguguccuuuauuguagcau

SEQ ID NO: 26359 - RNA, 20 nt, Human
ugacugccgucagcuccgac

SEQ ID NO: 26360 - RNA, 20 nt, Human
acauacucugcuacuauguc

SEQ ID NO: 26361 - RNA, 16 nt, Human
aucuaauuuuuuccca

SEQ ID NO: 26362 - RNA, 19 nt, Human
agcuuccugucaagcaauc

SEQ ID NO: 26363 - RNA, 21 nt, Human
cuccgccuugcugagacuuac

SEQ ID NO: 26364 - RNA, 21 nt, Human
uugacuuugcaccugucuuca

SEQ ID NO: 26365 - RNA, 20 nt, Human
cugucucuugcuuucaggcu

SEQ ID NO: 26366 - RNA, 21 nt, Human
cacaagccaccgugcccagcc

SEQ ID NO: 26367 - RNA, 29 nt, Human
uccaagacaacagggugcacugcugccug

SEQ ID NO: 26368 - RNA, 22 nt, Human
aacucgcuccuucuguuggcag

SEQ ID NO: 26369 - RNA, 24 nt, Human
cguccgccuucccuguguccccgc

SEQ ID NO: 26370 - RNA, 20 nt, Human
uuguccaaacccacaggagg

SEQ ID NO: 26371 - RNA, 25 nt, Human
ugcccccagcucacacucagcgugg

SEQ ID NO: 26372 - RNA, 19 nt, Human
gucguuuucaacagcagug

SEQ ID NO: 26373 - RNA, 27 nt, Human
uucauucuggaaccauacuaucaaaug

SEQ ID NO: 26374 - RNA, 26 nt, Human
augcuuccaaacuguagcugucacag

SEQ ID NO: 26375 - RNA, 20 nt, Human
ugccucgggguagcaccucc

SEQ ID NO: 26376 - RNA, 26 nt, Human
acccauggcuguguugguguggccca

SEQ ID NO: 26377 - RNA, 20 nt, Human
aaaccugcauuucucccaca

SEQ ID NO: 26378 - RNA, 27 nt, Human
ugaauccagagcuguagagguuacagu

SEQ ID NO: 26379 - RNA, 21 nt, Human
uuuuauguucuauauacccag

SEQ ID NO: 26380 - RNA, 27 nt, Human
ccugccuggccgcaggugcccuggaug

SEQ ID NO: 26381 - RNA, 17 nt, Human
caacagcaagucaccca

SEQ ID NO: 26382 - RNA, 19 nt, Human
uaccaggaagaaacauauu

SEQ ID NO: 26383 - RNA, 21 nt, Human
uuucugugccuagagucuuuc

SEQ ID NO: 26384 - RNA, 25 nt, Human
uccaccaggagucuggagugcaaug

SEQ ID NO: 26385 - RNA, 22 nt, Human
caugcauucagaucugaaguag

SEQ ID NO: 26386 - RNA, 22 nt, Human
gagccagagggcucuggaguga

SEQ ID NO: 26387 - RNA, 21 nt, Human
ccagcccagucccggggagcc

SEQ ID NO: 26388 - RNA, 22 nt, Human
agccacauuacaagcugccauc

SEQ ID NO: 26389 - RNA, 19 nt, Human
ccuagagucaguguccugu

SEQ ID NO: 26390 - RNA, 21 nt, Human
guuuuuaaaauuggccuuuua

SEQ ID NO: 26391 - RNA, 22 nt, Human
uuaagcugcaucaauggagcac

SEQ ID NO: 26392 - RNA, 27 nt, Human
ucugggagcuuucugggaauucaguug

SEQ ID NO: 26393 - RNA, 22 nt, Human
caggcuggagcacacuggugcg

SEQ ID NO: 26394 - RNA, 22 nt, Human
auuaacuguuagaacacuugcu

SEQ ID NO: 26395 - RNA, 26 nt, Human
cagaugggaggaaagagagcaggacu

SEQ ID NO: 26396 - RNA, 22 nt, Human
accugaaccagccugguccacu

SEQ ID NO: 26397 - RNA, 27 nt, Human
uugggaggcugagguugcaggaucgcu

SEQ ID NO: 26398 - RNA, 26 nt, Human
cagcacagcucucaggugggcacugc

SEQ ID NO: 26399 - RNA, 21 nt, Human
gcucggugccagcacuucccg

SEQ ID NO: 26400 - RNA, 21 nt, Human
cuugaggcuugaguccugggc

SEQ ID NO: 26401 - RNA, 21 nt, Human
uggcucauaaaacuaaccuga

SEQ ID NO: 26402 - RNA, 26 nt, Human
uuccagcuuucagccacuagcuuccu

SEQ ID NO: 26403 - RNA, 27 nt, Human
cggcccaggccaggugcccaggaaagg

SEQ ID NO: 26404 - RNA, 23 nt, Human
gaugcugggcaggaaaccccagc

SEQ ID NO: 26405 - RNA, 21 nt, Human
ggcugcuuucuccuuuacuug

SEQ ID NO: 26406 - RNA, 24 nt, Human
aggcuggaauccaagaguggggag

SEQ ID NO: 26407 - RNA, 23 nt, Human
agggcugaggggacugagugagc

SEQ ID NO: 26408 - RNA, 26 nt, Human
acaaugccaucacuggaauuucccac

SEQ ID NO: 26409 - RNA, 24 nt, Human
caggcagcaggaggggcgagcugg

SEQ ID NO: 26410 - RNA, 26 nt, Human
gggaauggggcgugggggguuagagc

SEQ ID NO: 26411 - RNA, 27 nt, Human
ggauggccagugucugucccggggucc

SEQ ID NO: 26412 - RNA, 22 nt, Human
uacaguauuuuucagauauaaa

SEQ ID NO: 26413 - RNA, 25 nt, Human
acuacauugagaaacuaaacccucu

SEQ ID NO: 26414 - RNA, 21 nt, Human
gugacuucugacuuucuaagg

SEQ ID NO: 26415 - RNA, 27 nt, Human
auagaagcuggagugaugaaauuuggg

SEQ ID NO: 26416 - RNA, 23 nt, Human
gggcuagaaccuggagagccaga

SEQ ID NO: 26417 - RNA, 22 nt, Human
aauucagagagcauugggucug

SEQ ID NO: 26418 - RNA, 22 nt, Human
cugggaggugucucugggggug

SEQ ID NO: 26419 - RNA, 25 nt, Human
gagacucuucagauucagcuuuccu

SEQ ID NO: 26420 - RNA, 24 nt, Human
ugaggacagaccuuaguugaaaug

SEQ ID NO: 26421 - RNA, 26 nt, Human
cccacaggauaagccucaggcccugg

SEQ ID NO: 26422 - RNA, 23 nt, Human
uccuguuguggcaguggccacug

SEQ ID NO: 26423 - RNA, 20 nt, Human
ccagucuaugcaccaaaaau

SEQ ID NO: 26424 - RNA, 23 nt, Human
uggauccuagccuuauccucuga

SEQ ID NO: 26425 - RNA, 27 nt, Human
cauuguacuccagccugggcaauaaga

SEQ ID NO: 26426 - RNA, 19 nt, Human
agcucccuccuggaaugcu

SEQ ID NO: 26427 - RNA, 23 nt, Human
aacuguauacugaauucugacaa

SEQ ID NO: 26428 - RNA, 26 nt, Human
ccagaagaaugagagagaggaagacu

SEQ ID NO: 26429 - RNA, 19 nt, Human
cacaaauguuuuauacaaa

SEQ ID NO: 26430 - RNA, 19 nt, Human
cuccucuuccuuggcuccu

SEQ ID NO: 26431 - RNA, 22 nt, Human
accccugguccugucuccagcc

SEQ ID NO: 26432 - RNA, 29 nt, Human
gcgcgcucagcccagccuaggaaagaggc

SEQ ID NO: 26433 - RNA, 18 nt, Human
ugcauaguucuagugcag

SEQ ID NO: 26434 - RNA, 21 nt, Human
ggagcauuggcugagagacca

SEQ ID NO: 26435 - RNA, 22 nt, Human
ugcccaggcuggagugcaaugg

SEQ ID NO: 26436 - RNA, 22 nt, Human
ugcccaggcuagagugcagugg

SEQ ID NO: 26437 - RNA, 27 nt, Human
aagaggaagacuccaggagggguauag

SEQ ID NO: 26438 - RNA, 26 nt, Human
auguaguuuuuguccaggcuugaguc

SEQ ID NO: 26439 - RNA, 21 nt, Human
acagaaaccugguugaaaugc

SEQ ID NO: 26440 - RNA, 20 nt, Human
gcacaucuucauucuuuuua

SEQ ID NO: 26441 - RNA, 20 nt, Human
auuacaggggcagugccuuu

SEQ ID NO: 26442 - RNA, 20 nt, Human
gagggaggcaggcugcagcu

SEQ ID NO: 26443 - RNA, 21 nt, Human
gacuugugugggaugggugca

SEQ ID NO: 26444 - RNA, 29 nt, Human
ucugcucuguugcaugccugcucuaauuu

SEQ ID NO: 26445 - RNA, 26 nt, Human
auauuccucuacuauuuuucaauguc

SEQ ID NO: 26446 - RNA, 19 nt, Human
caacauaguauugaaucuc

SEQ ID NO: 26447 - RNA, 30 nt, Human
cagccuuuggucuccuggaugggccuuuga

SEQ ID NO: 26448 - RNA, 23 nt, Human
uccuaaaccugucacucaagagg

SEQ ID NO: 26449 - RNA, 22 nt, Human
ccacacacauacacacauaugu

SEQ ID NO: 26450 - RNA, 20 nt, Human
uccggaucgaugugcugcug

SEQ ID NO: 26451 - RNA, 23 nt, Human
ugcuguuguuacaugugaagauu

SEQ ID NO: 26452 - RNA, 24 nt, Human
gagggggcuggaggcgaagggugg

SEQ ID NO: 26453 - RNA, 26 nt, Human
cgggaguggaggugcgcggagucagg

SEQ ID NO: 26454 - RNA, 26 nt, Human
ucgaaucucugugccuucgucuuucc

SEQ ID NO: 26455 - RNA, 26 nt, Human
uccaauuuguugucuucauuuugcuc

SEQ ID NO: 26456 - RNA, 23 nt, Human
cacccuaggucaggggaugggac

SEQ ID NO: 26457 - RNA, 24 nt, Human
gauucaagcgauucuccugucuca

SEQ ID NO: 26458 - RNA, 27 nt, Human
agauucccuaggcaagagcagcagcac

SEQ ID NO: 26459 - RNA, 22 nt, Human
cuuuguugcucagcaaggggcu

SEQ ID NO: 26460 - RNA, 27 nt, Human
cugccuugcagaccugccuggagguuc

SEQ ID NO: 26461 - RNA, 22 nt, Human
gcaugaaggauauggugcucua

SEQ ID NO: 26462 - RNA, 22 nt, Human
cccugcaacccugccaggcugg

SEQ ID NO: 26463 - RNA, 21 nt, Human
uuuccucugccccuucuugcu

SEQ ID NO: 26464 - RNA, 27 nt, Human
uugcccaggacccauuaaaguugcggu

SEQ ID NO: 26465 - RNA, 24 nt, Human
ggcugucuuggaucccaacaggca

SEQ ID NO: 26466 - RNA, 22 nt, Human
ugcagccucugccucuuggguu

SEQ ID NO: 26467 - RNA, 27 nt, Human
uaagcucucagaguuucugugaugauu

SEQ ID NO: 26468 - RNA, 21 nt, Human
gccacugcucuccagccuggg

SEQ ID NO: 26469 - RNA, 22 nt, Human
ccugccugucucccuccucugu

SEQ ID NO: 26470 - RNA, 19 nt, Human
ucuaucugugagcugcaaa

SEQ ID NO: 26471 - RNA, 26 nt, Human
cauuucaaucaagaauggcagggauc

SEQ ID NO: 26472 - RNA, 22 nt, Human
cauucugcuccuuccccaucgu

SEQ ID NO: 26473 - RNA, 19 nt, Human
aaccagaguuuuuaaagag

SEQ ID NO: 26474 - RNA, 26 nt, Human
aggcccgugugaggacugacccugga

SEQ ID NO: 26475 - RNA, 23 nt, Human
aucgcggggcagggaggggcagg

SEQ ID NO: 26476 - RNA, 19 nt, Human
uagccagagaaggagaagc

SEQ ID NO: 26477 - RNA, 23 nt, Human
agaggggcugagcaggacgccgc

SEQ ID NO: 26478 - RNA, 22 nt, Human
cuaccacccacccucucagucu

SEQ ID NO: 26479 - RNA, 27 nt, Human
uggccaaugugaugaaaccccgucucu

SEQ ID NO: 26480 - RNA, 23 nt, Human
auugaggcccggguuuguugucc

SEQ ID NO: 26481 - RNA, 20 nt, Human
aauucagagccguuaguccu

SEQ ID NO: 26482 - RNA, 24 nt, Human
cuuuauauccucugggccuggguu

SEQ ID NO: 26483 - RNA, 25 nt, Human
cucaacaacaugucaaagcugcaug

SEQ ID NO: 26484 - RNA, 24 nt, Human
cuaccugccuccugcguguauuuu

SEQ ID NO: 26485 - RNA, 23 nt, Human
cucaagccuuucuccaccaggcc

SEQ ID NO: 26486 - RNA, 25 nt, Human
auuuuucugcacugagcagagucuu

SEQ ID NO: 26487 - RNA, 27 nt, Human
agaacuccagcauagagccuuauagca

SEQ ID NO: 26488 - RNA, 22 nt, Human
ucugugugacugcucugugccc

SEQ ID NO: 26489 - RNA, 24 nt, Human
cagaccucuucccaggagacccua

SEQ ID NO: 26490 - RNA, 29 nt, Human
gcguacacccuugcccugcuuugccuuaa

SEQ ID NO: 26491 - RNA, 22 nt, Human
uuguguugagauccagugcagu

SEQ ID NO: 26492 - RNA, 19 nt, Human
auaauaauuaaccaaccuu

SEQ ID NO: 26493 - RNA, 22 nt, Human
ccagcacucccaccauucgugg

SEQ ID NO: 26494 - RNA, 27 nt, Human
ucgcgccugucccgcggcacucagccu

SEQ ID NO: 26495 - RNA, 28 nt, Human
cacugcccucucugugccuugguuuccc

SEQ ID NO: 26496 - RNA, 27 nt, Human
ugcaccuuggaugaggcagggccaggc

SEQ ID NO: 26497 - RNA, 24 nt, Human
gccaguuacagaucuaucccaaga

SEQ ID NO: 26498 - RNA, 22 nt, Human
acaacagguuucuacucucuuu

SEQ ID NO: 26499 - RNA, 20 nt, Human
ccacagacacgcgugugcau

SEQ ID NO: 26500 - RNA, 27 nt, Human
ccaggaggugaggagguuucgacaugg

SEQ ID NO: 26501 - RNA, 23 nt, Human
uucccucacagguuucuccagaa

SEQ ID NO: 26502 - RNA, 23 nt, Human
ccugcccccagcucacacucagc

SEQ ID NO: 26503 - RNA, 23 nt, Human
ucggagugacaaagcuggaacac

SEQ ID NO: 26504 - RNA, 21 nt, Human
agacaagcagguuuuguugau

SEQ ID NO: 26505 - RNA, 23 nt, Human
uaggcuagcaauauuuugguuaa

SEQ ID NO: 26506 - RNA, 22 nt, Human
ccaaccuccauuucuguucacu

SEQ ID NO: 26507 - RNA, 21 nt, Human
uucuccucacuguauccaggu

SEQ ID NO: 26508 - RNA, 22 nt, Human
uucaugcucucuccugccuucc

SEQ ID NO: 26509 - RNA, 18 nt, Human
gcucuuccugucagccgg

SEQ ID NO: 26510 - RNA, 23 nt, Human
ccccgggacccccgccuccaggc

SEQ ID NO: 26511 - RNA, 27 nt, Human
aagucuccuagacccccagggagccag

SEQ ID NO: 26512 - RNA, 26 nt, Human
guuggcucaggcagacaagagcugcu

SEQ ID NO: 26513 - RNA, 22 nt, Human
ggcaucguggugggugccugua

SEQ ID NO: 26514 - RNA, 22 nt, Human
uaacauugcagcuuucucucca

SEQ ID NO: 26515 - RNA, 21 nt, Human
agggcugagcguggaaggggg

SEQ ID NO: 26516 - RNA, 22 nt, Human
acuaugcugccucccauggccc

SEQ ID NO: 26517 - RNA, 22 nt, Human
gcaggugaccugguuacuuagc

SEQ ID NO: 26518 - RNA, 21 nt, Human
uguuccagugcuuccagggga

SEQ ID NO: 26519 - RNA, 24 nt, Human
gggaagagacaauaaagaugucuu

SEQ ID NO: 26520 - RNA, 26 nt, Human
gggcggcaccccagcccugcccuugc

SEQ ID NO: 26521 - RNA, 20 nt, Human
aaauugugcuauuacuccaa

SEQ ID NO: 26522 - RNA, 22 nt, Human
cgacucccugguucaagcgauu

SEQ ID NO: 26523 - RNA, 23 nt, Human
auugcucccaggaucuccugcca

SEQ ID NO: 26524 - RNA, 24 nt, Human
uuccuauucauucuuagcacuuug

SEQ ID NO: 26525 - RNA, 23 nt, Human
uugcaguuaaggguuaguuuaca

SEQ ID NO: 26526 - RNA, 26 nt, Human
gcugcacucuagauuccagagucacc

SEQ ID NO: 26527 - RNA, 20 nt, Human
cacacuuagggucccaguaa

SEQ ID NO: 26528 - RNA, 26 nt, Human
ugcccaggcagcguggaggggaaggg

SEQ ID NO: 26529 - RNA, 26 nt, Human
ggccagaagagagggucuggggccug

SEQ ID NO: 26530 - RNA, 21 nt, Human
ccugccugaguugcuacuucu

SEQ ID NO: 26531 - RNA, 23 nt, Human
uccauagcucuucacuuccucca

SEQ ID NO: 26532 - RNA, 28 nt, Human
gacugagccuggcccauagaaacaugac

SEQ ID NO: 26533 - RNA, 23 nt, Human
uuuagacuacuuuccucuucuau

SEQ ID NO: 26534 - RNA, 17 nt, Human
aagggaaaauacuggaa

SEQ ID NO: 26535 - RNA, 24 nt, Human
ccuccguaggagcucacagucuag

SEQ ID NO: 26536 - RNA, 22 nt, Human
ccaaagugcugggauuacagau

SEQ ID NO: 26537 - RNA, 22 nt, Human
ccaaugugcugggauuacaguu

SEQ ID NO: 26538 - RNA, 22 nt, Human
ccagggugcugagauuacaggu

SEQ ID NO: 26539 - RNA, 24 nt, Human
cagaaauugaguuaagucugugga

SEQ ID NO: 26540 - RNA, 23 nt, Human
ccuccgccccuccucucucccag

SEQ ID NO: 26541 - RNA, 28 nt, Human
gcugggcugugagaaugagcuguacaca

SEQ ID NO: 26542 - RNA, 21 nt, Human
agauuaucuaaaauuagccag

SEQ ID NO: 26543 - RNA, 20 nt, Human
cggggggcugcugccuccag

SEQ ID NO: 26544 - RNA, 27 nt, Human
uaccaagacaauaccugcuacaguauu

SEQ ID NO: 26545 - RNA, 27 nt, Human
ucuggcacucugaggucucuguggcag

SEQ ID NO: 26546 - RNA, 24 nt, Human
gauagaguguggcuucauuugucc

SEQ ID NO: 26547 - RNA, 18 nt, Human
uauuaaagugacuuucua

SEQ ID NO: 26548 - RNA, 25 nt, Human
gcacacagguguucauacaguggca

SEQ ID NO: 26549 - RNA, 22 nt, Human
gcagcagcaaccacuagccucc

SEQ ID NO: 26550 - RNA, 22 nt, Human
ggagaaacuccuaauuuaaaug

SEQ ID NO: 26551 - RNA, 20 nt, Human
cuugaguuccuugcugucac

SEQ ID NO: 26552 - RNA, 19 nt, Human
caaacaguuugaauacugu

SEQ ID NO: 26553 - RNA, 22 nt, Human
cuaacaaggugaaaccccgucu

SEQ ID NO: 26554 - RNA, 20 nt, Human
uccagaaaaugaagaaaaau

SEQ ID NO: 26555 - RNA, 20 nt, Human
ccacuuugggucccugcccu

SEQ ID NO: 26556 - RNA, 22 nt, Human
ccaggucccaggaaccuugccu

SEQ ID NO: 26557 - RNA, 25 nt, Human
ggcucagaaggagguggugugggga

SEQ ID NO: 26558 - RNA, 27 nt, Human
gcagaggggaugucuggcuugccugaa

SEQ ID NO: 26559 - RNA, 20 nt, Human
gcaaagcaccgcaacaugac

SEQ ID NO: 26560 - RNA, 20 nt, Human
uggaucuuuggguguguagg

SEQ ID NO: 26561 - RNA, 22 nt, Human
ggaagucagugacacccccaca

SEQ ID NO: 26562 - RNA, 22 nt, Human
aaccuguuucuacaaacacuuc

SEQ ID NO: 26563 - RNA, 21 nt, Human
auauauguacauauacaugua

SEQ ID NO: 26564 - RNA, 24 nt, Human
uaguccugccugagguugcaguga

SEQ ID NO: 26565 - RNA, 23 nt, Human
ugugucaugauucacccccaaac

SEQ ID NO: 26566 - RNA, 21 nt, Human
aggagacggugguugcaguga

SEQ ID NO: 26567 - RNA, 21 nt, Human
ccacucuugacucacucugag

SEQ ID NO: 26568 - RNA, 22 nt, Human
ggccucggaggugacuaacucc

SEQ ID NO: 26569 - RNA, 24 nt, Human
uuaaugaauagggaccaaugccac

SEQ ID NO: 26570 - RNA, 27 nt, Human
caggaagggcagcggcccucccaucac

SEQ ID NO: 26571 - RNA, 20 nt, Human
cugcagcugccugcaccccc

SEQ ID NO: 26572 - RNA, 18 nt, Human
acauguuuuaaagaaaga

SEQ ID NO: 26573 - RNA, 18 nt, Human
acgccgccucccacccag

SEQ ID NO: 26574 - RNA, 28 nt, Human
gccuuuuauuaacauauauuguuauuuu

SEQ ID NO: 26575 - RNA, 26 nt, Human
ggugggcucuggccauggcgcucugu

SEQ ID NO: 26576 - RNA, 21 nt, Human
agacagacaauaagccagaca

SEQ ID NO: 26577 - RNA, 19 nt, Human
ugccaugagaaaagggaag

SEQ ID NO: 26578 - RNA, 26 nt, Human
agagaggccuuggccaggagcggcgg

SEQ ID NO: 26579 - RNA, 23 nt, Human
auuuauuagaagcacauuaacca

SEQ ID NO: 26580 - RNA, 20 nt, Human
ucucacaccacauuuccuca

SEQ ID NO: 26581 - RNA, 30 nt, Human
ccgcccaggaggcuccucaggccgacccca

SEQ ID NO: 26582 - RNA, 23 nt, Human
ggugagcugcuggugggugaggg

SEQ ID NO: 26583 - RNA, 19 nt, Human
cuguucagcuuccugcugc

SEQ ID NO: 26584 - RNA, 21 nt, Human
gcucuggguggugguggcaca

SEQ ID NO: 26585 - RNA, 22 nt, Human
aaaauugaguuugggccaauag

SEQ ID NO: 26586 - RNA, 27 nt, Human
cugggaaucggagguugcagggccaag

SEQ ID NO: 26587 - RNA, 22 nt, Human
gagcuaguuuucagcugcucag

SEQ ID NO: 26588 - RNA, 26 nt, Human
uuuccccugcagagauuggucagccc

SEQ ID NO: 26589 - RNA, 25 nt, Human
ugagggagacaggaggaauaccagg

SEQ ID NO: 26590 - RNA, 20 nt, Human
ugggucccacagaugugaga

SEQ ID NO: 26591 - RNA, 27 nt, Human
cuaccugcagagcacgguucccauaag

SEQ ID NO: 26592 - RNA, 20 nt, Human
acucagaauacaguggcaug

SEQ ID NO: 26593 - RNA, 22 nt, Human
uacaaauauuaccuccaggguu

SEQ ID NO: 26594 - RNA, 22 nt, Human
ggaaaguauugagauucugcuu

SEQ ID NO: 26595 - RNA, 26 nt, Human
ccugagcucaagagguugaggcugca

SEQ ID NO: 26596 - RNA, 22 nt, Human
ugcagugagcagagaucacacc

SEQ ID NO: 26597 - RNA, 20 nt, Human
aaagaaaauggaucccacug

SEQ ID NO: 26598 - RNA, 21 nt, Human
ccguuagcugucuccuugcca

SEQ ID NO: 26599 - RNA, 22 nt, Human
aauauccaagagauugccaaga

SEQ ID NO: 26600 - RNA, 26 nt, Human
cacuuccccucucugauugggggugu

SEQ ID NO: 26601 - RNA, 20 nt, Human
uauuucuucaacauuccauc

SEQ ID NO: 26602 - RNA, 22 nt, Human
ucaguccacauggcaggucugc

SEQ ID NO: 26603 - RNA, 22 nt, Human
cucuggagaaggcaggaggaaa

SEQ ID NO: 26604 - RNA, 25 nt, Human
cuccagccucuugauauuuuuguac

SEQ ID NO: 26605 - RNA, 32 nt, Human
uuccuauuaaucuuaaaacaaagcgaaacaaa

SEQ ID NO: 26606 - RNA, 27 nt, Human
aagccaagagaccagagagucccugcc

SEQ ID NO: 26607 - RNA, 21 nt, Human
gguuuuccuguauaggaauga

SEQ ID NO: 26608 - RNA, 20 nt, Human
cuucccuuucuugaggaccu

SEQ ID NO: 26609 - RNA, 20 nt, Human
uguccaggcuggagugcagu

SEQ ID NO: 26610 - RNA, 31 nt, Human
ugcugcuuuuaacucuucuuccuucugugcc

SEQ ID NO: 26611 - RNA, 22 nt, Human
gaggccagcgucacacucccuc

SEQ ID NO: 26612 - RNA, 25 nt, Human
ggagacacaaagaugagacuguguu

SEQ ID NO: 26613 - RNA, 21 nt, Human
ggagaugucaaguuggguuca

SEQ ID NO: 26614 - RNA, 27 nt, Human
ggcagagaagagaccaagcuuguuucc

SEQ ID NO: 26615 - RNA, 26 nt, Human
accgcaaagaauucaccaugaccugu

SEQ ID NO: 26616 - RNA, 20 nt, Human
ugggccuguaauucagccug

SEQ ID NO: 26617 - RNA, 22 nt, Human
cuauacccauggugccucuggg

SEQ ID NO: 26618 - RNA, 23 nt, Human
auggaggcucacgaaguagggug

SEQ ID NO: 26619 - RNA, 24 nt, Human
acacagccccagaagggggcauua

SEQ ID NO: 26620 - RNA, 21 nt, Human
ucccugcauuagcgagcaguu

SEQ ID NO: 26621 - RNA, 26 nt, Human
uugccucucuggacgcucugcaccaa

SEQ ID NO: 26622 - RNA, 21 nt, Human
augacuucuguuuucucaaag

SEQ ID NO: 26623 - RNA, 24 nt, Human
gacuguuuuaacaaauacucauag

SEQ ID NO: 26624 - RNA, 27 nt, Human
ccacacaaacccagccuggggaggaac

SEQ ID NO: 26625 - RNA, 19 nt, Human
agggcaucugcugggcuga

SEQ ID NO: 26626 - RNA, 19 nt, Human
gcagcgcaaccucugcucc

SEQ ID NO: 26627 - RNA, 20 nt, Human
cugggugugggagcagggca

SEQ ID NO: 26628 - RNA, 25 nt, Human
aaggggaccuguuuucuucaaggga

SEQ ID NO: 26629 - RNA, 21 nt, Human
agagaccagagaucucuguac

SEQ ID NO: 26630 - RNA, 22 nt, Human
ccuuccacagaccccacaugcc

SEQ ID NO: 26631 - RNA, 20 nt, Human
gcccagagcugccuuuuucu

SEQ ID NO: 26632 - RNA, 22 nt, Human
uucagacaaacacacacucagc

SEQ ID NO: 26633 - RNA, 24 nt, Human
agcuucugcuuuucugcccuggcu

SEQ ID NO: 26634 - RNA, 21 nt, Human
gcccugcucaggaggcccuga

SEQ ID NO: 26635 - RNA, 20 nt, Human
ucagucuggccaucugucac

SEQ ID NO: 26636 - RNA, 23 nt, Human
ucauuuuucucuuccugggauuc

SEQ ID NO: 26637 - RNA, 23 nt, Human
ccgcugucuuugaguuguggugg

SEQ ID NO: 26638 - RNA, 22 nt, Human
ccaaguagcugggauuacagaa

SEQ ID NO: 26639 - RNA, 22 nt, Human
ggugggguuuugccauguugcc

SEQ ID NO: 26640 - RNA, 22 nt, Human
cacugcacuccagucuggucgg

SEQ ID NO: 26641 - RNA, 26 nt, Human
guucgggaggcggaaaaagaugagcg

SEQ ID NO: 26642 - RNA, 27 nt, Human
gugagagggacgguucacaaggcuugg

SEQ ID NO: 26643 - RNA, 19 nt, Human
cuuccuggcuccuucacug

SEQ ID NO: 26644 - RNA, 22 nt, Human
cuuuuuuaaauguuuuguguuu

SEQ ID NO: 26645 - RNA, 21 nt, Human
gccccuacuggagucccggga

SEQ ID NO: 26646 - RNA, 25 nt, Human
ccuuccucucccccugucuguuucc

SEQ ID NO: 26647 - RNA, 22 nt, Human
uuuccuaagguguuuaagcaca

SEQ ID NO: 26648 - RNA, 22 nt, Human
gguuuugcugcuaauguauuua

SEQ ID NO: 26649 - RNA, 27 nt, Human
uccaaguagagauuacacccagcacac

SEQ ID NO: 26650 - RNA, 27 nt, Human
uaaucagcuuaaaagcuauuuaaccca

SEQ ID NO: 26651 - RNA, 23 nt, Human
ucucccacuuaucuucccccuuc

SEQ ID NO: 26652 - RNA, 20 nt, Human
uggacuuuucagagucuuuc

SEQ ID NO: 26653 - RNA, 26 nt, Human
cccacccucuccuggugcugccuggg

SEQ ID NO: 26654 - RNA, 21 nt, Human
gaggccuugcugcuguggaua

SEQ ID NO: 26655 - RNA, 21 nt, Human
ccguggcugcucauucuugcc

SEQ ID NO: 26656 - RNA, 23 nt, Human
acuccagauuuuuuacagcugcc

SEQ ID NO: 26657 - RNA, 21 nt, Human
uaaaaacaagaaccacaaaaa

SEQ ID NO: 26658 - RNA, 27 nt, Human
cuuccuuccuguuaaaccccuguuaac

SEQ ID NO: 26659 - RNA, 23 nt, Human
gcuaaugggcugcugucauuuua

SEQ ID NO: 26660 - RNA, 19 nt, Human
uuucuauuuuaaucuugcu

SEQ ID NO: 26661 - RNA, 26 nt, Human
cuucauuuuugauggcuggcucugaa

SEQ ID NO: 26662 - RNA, 22 nt, Human
gcagaaaaaugauuguaggaaa

SEQ ID NO: 26663 - RNA, 24 nt, Human
guuuuguacauggugccucuuguu

SEQ ID NO: 26664 - RNA, 21 nt, Human
uccacaaaugaagauuuuauu

SEQ ID NO: 26665 - RNA, 22 nt, Human
agaauucuuuauuugcacccuc

SEQ ID NO: 26666 - RNA, 25 nt, Human
ugccaaggcuggagugcaggccgcg

SEQ ID NO: 26667 - RNA, 20 nt, Human
aggcuucucccagcccgugg

SEQ ID NO: 26668 - RNA, 21 nt, Human
agcacuguccugucuuaaucu

SEQ ID NO: 26669 - RNA, 22 nt, Human
agcugggucugaaauuugguca

SEQ ID NO: 26670 - RNA, 26 nt, Human
cugagcggaugcaucuggggaugagg

SEQ ID NO: 26671 - RNA, 18 nt, Human
ucagaucuuuuugguaaa

SEQ ID NO: 26672 - RNA, 22 nt, Human
acccucacucugccauuguucc

SEQ ID NO: 26673 - RNA, 23 nt, Human
cacccuggaggcucucucugccu

SEQ ID NO: 26674 - RNA, 22 nt, Human
ccagcuggcagucaaggcugua

SEQ ID NO: 26675 - RNA, 19 nt, Human
guuauucauucugugauca

SEQ ID NO: 26676 - RNA, 20 nt, Human
cugacuuuguuuucucauuc

SEQ ID NO: 26677 - RNA, 24 nt, Human
cugucuaaaccuccuacuccucaa

SEQ ID NO: 26678 - RNA, 21 nt, Human
uguguagaugaaaccaucuca

SEQ ID NO: 26679 - RNA, 23 nt, Human
auugcccaggcuggucuugaagu

SEQ ID NO: 26680 - RNA, 23 nt, Human
ggcagggcuguccccucuugcuu

SEQ ID NO: 26681 - RNA, 22 nt, Human
ugaugccacuguacugcagcuu

SEQ ID NO: 26682 - RNA, 26 nt, Human
gacccaccgcgucaagccucugacaa

SEQ ID NO: 26683 - RNA, 21 nt, Human
ucacaucuggaagaaacagga

SEQ ID NO: 26684 - RNA, 21 nt, Human
cagcuggcuguguuugcagug

SEQ ID NO: 26685 - RNA, 23 nt, Human
aaccuguugcagaaaagugaaag

SEQ ID NO: 26686 - RNA, 22 nt, Human
ggcgguggcugugagucuaguu

SEQ ID NO: 26687 - RNA, 20 nt, Human
uuuuuccugaacaaauaaca

SEQ ID NO: 26688 - RNA, 24 nt, Human
gccauggcgagaauccagcuuuga

SEQ ID NO: 26689 - RNA, 19 nt, Human
ucccgcagggcccagcaca

SEQ ID NO: 26690 - RNA, 26 nt, Human
ugguaucaauauauaauuauuuuuca

SEQ ID NO: 26691 - RNA, 21 nt, Human
ucacgagccuuaugauaucau

SEQ ID NO: 26692 - RNA, 24 nt, Human
ccugcccaccugccucccugcccc

SEQ ID NO: 26693 - RNA, 27 nt, Human
cuucugcugcaauuuagauuccuuucc

SEQ ID NO: 26694 - RNA, 22 nt, Human
ugacauagagagacuccaucuc

SEQ ID NO: 26695 - RNA, 20 nt, Human
cuucccuugcacgcucgcua

SEQ ID NO: 26696 - RNA, 23 nt, Human
gcugugcaaacaucucaagccag

SEQ ID NO: 26697 - RNA, 25 nt, Human
uguguuuuuaacagcccuuccccug

SEQ ID NO: 26698 - RNA, 26 nt, Human
ccgccuccggggagcccaaccagccg

SEQ ID NO: 26699 - RNA, 24 nt, Human
uagcucuuagggcuuagcuauuug

SEQ ID NO: 26700 - RNA, 27 nt, Human
gcugggcuuuugaauuggccuugggga

SEQ ID NO: 26701 - RNA, 21 nt, Human
acugggucucacuauguugcc

SEQ ID NO: 26702 - RNA, 19 nt, Human
uuaguuccuguauucuaaa

SEQ ID NO: 26703 - RNA, 27 nt, Human
ccuaguuuugguuuucaaauuacuugg

SEQ ID NO: 26704 - RNA, 22 nt, Human
ggccuuugcaugggaggcaggu

SEQ ID NO: 26705 - RNA, 23 nt, Human
aaaauucugccgucugagguuuu

SEQ ID NO: 26706 - RNA, 25 nt, Human
augaugaugccacuguacugcagcu

SEQ ID NO: 26707 - RNA, 24 nt, Human
uuauuucuuacaggcacaaaauga

SEQ ID NO: 26708 - RNA, 21 nt, Human
agagacacugggacacuguca

SEQ ID NO: 26709 - RNA, 20 nt, Human
auauucucuccacuuugggg

SEQ ID NO: 26710 - RNA, 24 nt, Human
ucugcugccugcucccucuuccug

SEQ ID NO: 26711 - RNA, 23 nt, Human
acaaaugucaucaaauauguuga

SEQ ID NO: 26712 - RNA, 20 nt, Human
cuuugggccuuuauuuccuu

SEQ ID NO: 26713 - RNA, 22 nt, Human
uucccaguucagacuagccaca

SEQ ID NO: 26714 - RNA, 27 nt, Human
uguccccagacauugcaccuggcgcug

SEQ ID NO: 26715 - RNA, 23 nt, Human
ggagagcuggagaacaggauucu

SEQ ID NO: 26716 - RNA, 27 nt, Human
uuggaaaugacuagagaggcagaggag

SEQ ID NO: 26717 - RNA, 23 nt, Human
uauacucuucaguaagaaucugu

SEQ ID NO: 26718 - RNA, 23 nt, Human
ccucagaugauuauugacugugu

SEQ ID NO: 26719 - RNA, 17 nt, Human
gccauaaaaaugcagug

SEQ ID NO: 26720 - RNA, 27 nt, Human
uguuucagugcuaacgauuucucaccu

SEQ ID NO: 26721 - RNA, 22 nt, Human
uucuaaaacuuuuaauuuuucu

SEQ ID NO: 26722 - RNA, 22 nt, Human
gcccaagcuggagugaaguggu

SEQ ID NO: 26723 - RNA, 23 nt, Human
gggccccaggauggggggccaca

SEQ ID NO: 26724 - RNA, 24 nt, Human
uucagcugauugccggcagcuuag

SEQ ID NO: 26725 - RNA, 27 nt, Human
aggccccucuauuuuauuuuucuugaa

SEQ ID NO: 26726 - RNA, 21 nt, Human
ucccuccaccuagacugccug

SEQ ID NO: 26727 - RNA, 26 nt, Human
ggaggugggggccgcaggguuggggc

SEQ ID NO: 26728 - RNA, 23 nt, Human
ugacccaccaucacccugcucug

SEQ ID NO: 26729 - RNA, 21 nt, Human
gcaagaaauauuccauugaaa

SEQ ID NO: 26730 - RNA, 22 nt, Human
uuuccagccugggcaacauagu

SEQ ID NO: 26731 - RNA, 26 nt, Human
gcuacccaauguuacuacuuauuuuu

SEQ ID NO: 26732 - RNA, 26 nt, Human
cccucaagaggaagugagcggugcug

SEQ ID NO: 26733 - RNA, 21 nt, Human
cagccucuuuuacuagucuuu

SEQ ID NO: 26734 - RNA, 22 nt, Human
ucucccacccucucggcugcag

SEQ ID NO: 26735 - RNA, 21 nt, Human
gucagaugcuaccugcuguua

SEQ ID NO: 26736 - RNA, 22 nt, Human
ggucuggucucuuguuugccag

SEQ ID NO: 26737 - RNA, 24 nt, Human
gguugaaaugagaaaaagcauuuu

SEQ ID NO: 26738 - RNA, 22 nt, Human
ugaaucugucucccaguuauga

SEQ ID NO: 26739 - RNA, 22 nt, Human
aaccauggguggauaaauauaa

SEQ ID NO: 26740 - RNA, 23 nt, Human
ugugugccauguguaugcccuag

SEQ ID NO: 26741 - RNA, 20 nt, Human
auguugcccaggauggucuc

SEQ ID NO: 26742 - RNA, 23 nt, Human
ggucugcucuggagcauugggug

SEQ ID NO: 26743 - RNA, 23 nt, Human
ccuccacugugcccaccacugcc

SEQ ID NO: 26744 - RNA, 26 nt, Human
cagaagcagcagcagcagccuccgca

SEQ ID NO: 26745 - RNA, 21 nt, Human
gcugggagaaggggcuccugg

SEQ ID NO: 26746 - RNA, 22 nt, Human
agcuguacugccggcucugccg

SEQ ID NO: 26747 - RNA, 21 nt, Human
ucgcaguguagcugaaauacu

SEQ ID NO: 26748 - RNA, 19 nt, Human
cagagccuggcugcccauc

SEQ ID NO: 26749 - RNA, 24 nt, Human
cuguagccuggaauccauauauau

SEQ ID NO: 26750 - RNA, 24 nt, Human
uucucaaggucucaggcuauuugg

SEQ ID NO: 26751 - RNA, 24 nt, Human
gggggccaggagagcaggaacaga

SEQ ID NO: 26752 - RNA, 27 nt, Human
guccaucugcauuugucacccaagaac

SEQ ID NO: 26753 - RNA, 27 nt, Human
augcucacuguugcugcgugggagagu

SEQ ID NO: 26754 - RNA, 23 nt, Human
acauuagcccaaaggacuucuua

SEQ ID NO: 26755 - RNA, 19 nt, Human
ggcgauucugagugugagg

SEQ ID NO: 26756 - RNA, 22 nt, Human
uucauucuuaagguugccuacu

SEQ ID NO: 26757 - RNA, 19 nt, Human
acccugaaucagaggcaga

SEQ ID NO: 26758 - RNA, 22 nt, Human
ucaucuaguccagacucccuca

SEQ ID NO: 26759 - RNA, 21 nt, Human
augcugcacuaguauuccuua

SEQ ID NO: 26760 - RNA, 27 nt, Human
uucccgcagcaucccacccccaaacca

SEQ ID NO: 26761 - RNA, 25 nt, Human
cgcgccgccucgcgcucugccucag

SEQ ID NO: 26762 - RNA, 22 nt, Human
uuccacggugugcugcuuuccc

SEQ ID NO: 26763 - RNA, 20 nt, Human
uucccaacauacuuaacaca

SEQ ID NO: 26764 - RNA, 21 nt, Human
uucaguuaauaaagauuugua

SEQ ID NO: 26765 - RNA, 21 nt, Human
gcuccaggagcccagcgccgg

SEQ ID NO: 26766 - RNA, 23 nt, Human
ggcacacacagcucgcuucuuca

SEQ ID NO: 26767 - RNA, 24 nt, Human
uuugguugcuuaagacugaagcaa

SEQ ID NO: 26768 - RNA, 22 nt, Human
aggcuggagugcaguggcgcau

SEQ ID NO: 26769 - RNA, 22 nt, Human
uuagcuccuuagagugaagcaa

SEQ ID NO: 26770 - RNA, 21 nt, Human
aguuuucuucuuugagaaacu

SEQ ID NO: 26771 - RNA, 20 nt, Human
cucagccucccuacagggug

SEQ ID NO: 26772 - RNA, 23 nt, Human
cccaccccaggcacggcucauuc

SEQ ID NO: 26773 - RNA, 20 nt, Human
cucaaggucaggaugcgaac

SEQ ID NO: 26774 - RNA, 20 nt, Human
gguuacagguuacagugagc

SEQ ID NO: 26775 - RNA, 26 nt, Human
gauugcugaaauuuuauaugcuuacu

SEQ ID NO: 26776 - RNA, 23 nt, Human
auguucucaauacccacugccag

SEQ ID NO: 26777 - RNA, 22 nt, Human
gacuauuuuacagccacuggag

SEQ ID NO: 26778 - RNA, 25 nt, Human
uccuccccuguacuccccagugccu

SEQ ID NO: 26779 - RNA, 22 nt, Human
cagggguagcgagguugcagga

SEQ ID NO: 26780 - RNA, 23 nt, Human
uauaacugcccucccguucugcc

SEQ ID NO: 26781 - RNA, 25 nt, Human
ccggcggagccaaguccacucuggg

SEQ ID NO: 26782 - RNA, 21 nt, Human
ccucacugcccuccccagucu

SEQ ID NO: 26783 - RNA, 22 nt, Human
guacuaggcucuguacuggcca

SEQ ID NO: 26784 - RNA, 24 nt, Human
agccacaggaagcaaaagucagcc

SEQ ID NO: 26785 - RNA, 27 nt, Human
gcacagauaugcugucuggacaugcac

SEQ ID NO: 26786 - RNA, 27 nt, Human
uggcucacaucuguaaccccagcacuu

SEQ ID NO: 26787 - RNA, 21 nt, Human
cacucggggguggagugagac

SEQ ID NO: 26788 - RNA, 24 nt, Human
cauuccccaccuuagccucccaaa

SEQ ID NO: 26789 - RNA, 21 nt, Human
ggaggggcuccugggggucug

SEQ ID NO: 26790 - RNA, 22 nt, Human
uucauucuuuuuugucauucca

SEQ ID NO: 26791 - RNA, 26 nt, Human
ggaggagcuagccugaaggauucugg

SEQ ID NO: 26792 - RNA, 23 nt, Human
auggaucagcuaaguugcaccaa

SEQ ID NO: 26793 - RNA, 22 nt, Human
accauaaagacacauggccuuc

SEQ ID NO: 26794 - RNA, 23 nt, Human
ccuccacucugccauuccggccc

SEQ ID NO: 26795 - RNA, 26 nt, Human
ucuccaggagccccugagaagauuug

SEQ ID NO: 26796 - RNA, 31 nt, Human
accauguuucauuccuuuuucccuauuuaua

SEQ ID NO: 26797 - RNA, 24 nt, Human
ugcuacuccccagaccucagggac

SEQ ID NO: 26798 - RNA, 22 nt, Human
uacaugguuuaauagaauauaa

SEQ ID NO: 26799 - RNA, 23 nt, Human
ugaguggcugggauugcgggcac

SEQ ID NO: 26800 - RNA, 22 nt, Human
cacuucucuucaucuacacugg

SEQ ID NO: 26801 - RNA, 21 nt, Human
aggaugucuuauaaagacuga

SEQ ID NO: 26802 - RNA, 26 nt, Human
ggcaggagacuguggagacugcuccu

SEQ ID NO: 26803 - RNA, 20 nt, Human
auaaaugaggccacugugcc

SEQ ID NO: 26804 - RNA, 23 nt, Human
cgccugggucaggaauccaagac

SEQ ID NO: 26805 - RNA, 20 nt, Human
uuugccaggcuggaugcugu

SEQ ID NO: 26806 - RNA, 24 nt, Human
ugucaucacauuacaggcaggugu

SEQ ID NO: 26807 - RNA, 25 nt, Human
cagcacauucaugcagaaaagucuu

SEQ ID NO: 26808 - RNA, 25 nt, Human
uccuucuaacagcaccuucccccug

SEQ ID NO: 26809 - RNA, 22 nt, Human
uuguuuugcauaugugcauuuu

SEQ ID NO: 26810 - RNA, 25 nt, Human
ccucuuccgugacgucacuggacca

SEQ ID NO: 26811 - RNA, 26 nt, Human
ccugucuggaagacguggcucugggu

SEQ ID NO: 26812 - RNA, 27 nt, Human
cuggauguagcugggauugaguccaug

SEQ ID NO: 26813 - RNA, 25 nt, Human
guucugcaguucucucuucuuuucc

SEQ ID NO: 26814 - RNA, 20 nt, Human
uguauaugcugcauugagac

SEQ ID NO: 26815 - RNA, 21 nt, Human
agcagcccacugagccaaguu

SEQ ID NO: 26816 - RNA, 23 nt, Human
cguuaauguaaaggggcagcagu

SEQ ID NO: 26817 - RNA, 21 nt, Human
caugccagcccgcagcuaggg

SEQ ID NO: 26818 - RNA, 23 nt, Human
uuuaaaaaaucacguuagccucc

SEQ ID NO: 26819 - RNA, 24 nt, Human
ccgcggcccgaggucuccgcccgc

SEQ ID NO: 26820 - RNA, 20 nt, Human
gagguugugguugcagugag

SEQ ID NO: 26821 - RNA, 20 nt, Human
cucacccuuucaggccuugu

SEQ ID NO: 26822 - RNA, 19 nt, Human
ggaccuucucccuccuagg

SEQ ID NO: 26823 - RNA, 24 nt, Human
ucaaccuagaagaugagauuugua

SEQ ID NO: 26824 - RNA, 21 nt, Human
ccugcccugccuuccuccugc

SEQ ID NO: 26825 - RNA, 22 nt, Human
ccugcuccagccccacccccac

SEQ ID NO: 26826 - RNA, 20 nt, Human
uccuguuuuuacagauugua

SEQ ID NO: 26827 - RNA, 21 nt, Human
ucaaggaccagcaaaccaaag

SEQ ID NO: 26828 - RNA, 20 nt, Human
agccaccuucaggccuggga

SEQ ID NO: 26829 - RNA, 26 nt, Human
aacccaugaguucagaaggcacacuc

SEQ ID NO: 26830 - RNA, 26 nt, Human
uguccccaucugcccuucuuguugcu

SEQ ID NO: 26831 - RNA, 26 nt, Human
ucaagacucuugaagacaacucugaa

SEQ ID NO: 26832 - RNA, 22 nt, Human
cuggaugugcggcagaggggug

SEQ ID NO: 26833 - RNA, 21 nt, Human
ggcucacugccacuggguacu

SEQ ID NO: 26834 - RNA, 27 nt, Human
uucagccuuccaugugcugccggaacu

SEQ ID NO: 26835 - RNA, 24 nt, Human
cagaggggagagagggcaggacag

SEQ ID NO: 26836 - RNA, 21 nt, Human
auagaaccuggaagaucaaua

SEQ ID NO: 26837 - RNA, 22 nt, Human
ggaagaaggggucucacaaaaa

SEQ ID NO: 26838 - RNA, 29 nt, Human
gggagagcggguggagggcccugaggugg

SEQ ID NO: 26839 - RNA, 21 nt, Human
guacuuacaucuuuguuuacc

SEQ ID NO: 26840 - RNA, 25 nt, Human
ggcggugaggaucggagggcgcuau

SEQ ID NO: 26841 - RNA, 19 nt, Human
gcauuuuucuaaggagaac

SEQ ID NO: 26842 - RNA, 19 nt, Human
acaacuucucaaagcacaa

SEQ ID NO: 26843 - RNA, 23 nt, Human
uaccccagccacuccucaaccuu

SEQ ID NO: 26844 - RNA, 23 nt, Human
ucugguggcugggauucagaugc

SEQ ID NO: 26845 - RNA, 25 nt, Human
aacggcaugcuaucacaagaaaggu

SEQ ID NO: 26846 - RNA, 27 nt, Human
ggucucccgcuuccuccuccugcucca

SEQ ID NO: 26847 - RNA, 21 nt, Human
aucucacugcaaccucugccu

SEQ ID NO: 26848 - RNA, 22 nt, Human
gggaagaccagcuuugcaguga

SEQ ID NO: 26849 - RNA, 23 nt, Human
uggacugccagcucccugggucu

SEQ ID NO: 26850 - RNA, 25 nt, Human
cccaggagguggcuggauugcaggg

SEQ ID NO: 26851 - RNA, 24 nt, Human
cuccuggccuucuaggaauggagg

SEQ ID NO: 26852 - RNA, 22 nt, Human
ccccagcugggggccaugagcu

SEQ ID NO: 26853 - RNA, 19 nt, Human
ccaacagccaguuuugucc

SEQ ID NO: 26854 - RNA, 27 nt, Human
gcagugucuguucuucauuucuauagc

SEQ ID NO: 26855 - RNA, 23 nt, Human
augggaaaauuaaacuucuacua

SEQ ID NO: 26856 - RNA, 23 nt, Human
aacuauacugccuugugaugccu

SEQ ID NO: 26857 - RNA, 25 nt, Human
uuaguaaacauagguauaauuacca

SEQ ID NO: 26858 - RNA, 24 nt, Human
aggaagcaagcggagguugcagug

SEQ ID NO: 26859 - RNA, 23 nt, Human
gcgugguguuuguauuucuguga

SEQ ID NO: 26860 - RNA, 27 nt, Human
acagucaggcuuccagcacauucuccc

SEQ ID NO: 26861 - RNA, 24 nt, Human
ggagucuauuguacacuguggaaa

SEQ ID NO: 26862 - RNA, 26 nt, Human
ugacaccuuggcaguguuuauggcca

SEQ ID NO: 26863 - RNA, 27 nt, Human
ucccugccucaucuuccgacggccggc

SEQ ID NO: 26864 - RNA, 21 nt, Human
cuuuucucccaauucugcgcu

SEQ ID NO: 26865 - RNA, 21 nt, Human
auagcucuuugcaagugccuu

SEQ ID NO: 26866 - RNA, 22 nt, Human
ugcaggaggcugccggcgagug

SEQ ID NO: 26867 - RNA, 22 nt, Human
ggucucgaacucccgaccucag

SEQ ID NO: 26868 - RNA, 22 nt, Human
ggucuugaacuccugaccucag

SEQ ID NO: 26869 - RNA, 23 nt, Human
acagagcccugggcaggcaguag

SEQ ID NO: 26870 - RNA, 21 nt, Human
cagguccccucuggcccucuc

SEQ ID NO: 26871 - RNA, 25 nt, Human
augcugcaugucuucacacauauac

SEQ ID NO: 26872 - RNA, 24 nt, Human
acacacgugcacagauaugcugcc

SEQ ID NO: 26873 - RNA, 22 nt, Human
gagggcaccagcuggguucucc

SEQ ID NO: 26874 - RNA, 22 nt, Human
uucuaggauguggagcuacuga

SEQ ID NO: 26875 - RNA, 25 nt, Human
cgcuagugccuaaccucacuggucc

SEQ ID NO: 26876 - RNA, 26 nt, Human
uagaaaacauuaguuuucuccuguug

SEQ ID NO: 26877 - RNA, 18 nt, Human
gccgggugugguggcaca

SEQ ID NO: 26878 - RNA, 26 nt, Human
gacuggguaaauuaggaagaggugga

SEQ ID NO: 26879 - RNA, 23 nt, Human
gguggauuaauuuggaaaaagaa

SEQ ID NO: 26880 - RNA, 21 nt, Human
ucuguguccaucagugaccac

SEQ ID NO: 26881 - RNA, 21 nt, Human
acugggagggcccacuucagg

SEQ ID NO: 26882 - RNA, 17 nt, Human
uuuucauuuuugucugc

SEQ ID NO: 26883 - RNA, 23 nt, Human
auuuccaugugucaagugggucu

SEQ ID NO: 26884 - RNA, 21 nt, Human
gcccuucucccugaggagccu

SEQ ID NO: 26885 - RNA, 27 nt, Human
ggggcagcuagggcugcccgccgcgcu

SEQ ID NO: 26886 - RNA, 19 nt, Human
agggcagcagaggcagaga

SEQ ID NO: 26887 - RNA, 23 nt, Human
aaccauaugaauuuacuacuuua

SEQ ID NO: 26888 - RNA, 22 nt, Human
gggcuaaggcaggaggaucacu

SEQ ID NO: 26889 - RNA, 22 nt, Human
auuugagagggaagaucugauc

SEQ ID NO: 26890 - RNA, 23 nt, Human
ugauucugucuggucaucccaca

SEQ ID NO: 26891 - RNA, 24 nt, Human
cucucccuguacacagugcccccu

SEQ ID NO: 26892 - RNA, 21 nt, Human
ggagguggaggaaggagcagg

SEQ ID NO: 26893 - RNA, 22 nt, Human
ccaaggcaggagaauugcucga

SEQ ID NO: 26894 - RNA, 22 nt, Human
ccgggaagcagagguugcagug

SEQ ID NO: 26895 - RNA, 18 nt, Human
agaauugccugaagauca

SEQ ID NO: 26896 - RNA, 20 nt, Human
guccucuggcggggcucggg

SEQ ID NO: 26897 - RNA, 18 nt, Human
gcuggcgccgccuccggg

SEQ ID NO: 26898 - RNA, 26 nt, Human
uucucucugcucagugaucucacuua

SEQ ID NO: 26899 - RNA, 23 nt, Human
uucuacuaaugugaugcuuucau

SEQ ID NO: 26900 - RNA, 22 nt, Human
gcacauuuaacaauuacagguu

SEQ ID NO: 26901 - RNA, 25 nt, Human
gagcuccuccagaccuccuaggccu

SEQ ID NO: 26902 - RNA, 23 nt, Human
uccguccuuacaaccauccuugu

SEQ ID NO: 26903 - RNA, 28 nt, Human
gucaucuuugauuccuggaccuaauaaa

SEQ ID NO: 26904 - RNA, 21 nt, Human
aacauuucaaaugucucucca

SEQ ID NO: 26905 - RNA, 23 nt, Human
gauccugccaacuuucuggggcu

SEQ ID NO: 26906 - RNA, 31 nt, Human
uccagagggacagucaguuuuaggguugccu

SEQ ID NO: 26907 - RNA, 23 nt, Human
gccacagccaacagaaaaaucaa

SEQ ID NO: 26908 - RNA, 24 nt, Human
agggccgugugacacucucguggu

SEQ ID NO: 26909 - RNA, 26 nt, Human
uucauuucuccuguccccuccccucc

SEQ ID NO: 26910 - RNA, 19 nt, Human
uggaagcuucagcaaccag

SEQ ID NO: 26911 - RNA, 19 nt, Human
gaaacauuuucauuuuagg

SEQ ID NO: 26912 - RNA, 26 nt, Human
gggccauccaauuucucuuuacuuga

SEQ ID NO: 26913 - RNA, 24 nt, Human
cuaccuuuauuuagcaauuaccua

SEQ ID NO: 26914 - RNA, 21 nt, Human
uuucuuuacuccaucauggcu

SEQ ID NO: 26915 - RNA, 20 nt, Human
agcaaguaauuuuuguuuua

SEQ ID NO: 26916 - RNA, 22 nt, Human
ggaaacacugagucuuguuggg

SEQ ID NO: 26917 - RNA, 21 nt, Human
cucuccuccuagaaugcugcc

SEQ ID NO: 26918 - RNA, 21 nt, Human
ucuguccaucugggccuuugu

SEQ ID NO: 26919 - RNA, 22 nt, Human
uuuccuucuccuccugucuuua

SEQ ID NO: 26920 - RNA, 20 nt, Human
gauuugacugguuuugcaga

SEQ ID NO: 26921 - RNA, 21 nt, Human
aagcacagcagauaagagugu

SEQ ID NO: 26922 - RNA, 26 nt, Human
uagagauauucugaauuuuuugaggg

SEQ ID NO: 26923 - RNA, 27 nt, Human
uuugaaaagucacuuacuauuguugcu

SEQ ID NO: 26924 - RNA, 22 nt, Human
accucucuuuuucaguuggcug

SEQ ID NO: 26925 - RNA, 22 nt, Human
cccaaagcacugggauuacagg

SEQ ID NO: 26926 - RNA, 23 nt, Human
agcaggauugaagaaaagggacu

SEQ ID NO: 26927 - RNA, 25 nt, Human
cuugugcuccccuuggagaagggcu

SEQ ID NO: 26928 - RNA, 27 nt, Human
gucucaaacuccugggcucaagcgaac

SEQ ID NO: 26929 - RNA, 27 nt, Human
agccccuggccgcugugcugaaggagg

SEQ ID NO: 26930 - RNA, 20 nt, Human
gcgagucucccuuagggccc

SEQ ID NO: 26931 - RNA, 21 nt, Human
gacaguugcuuucauucuucc

SEQ ID NO: 26932 - RNA, 18 nt, Human
cuuaucccugcucuccca

SEQ ID NO: 26933 - RNA, 25 nt, Human
gccuaagugccacccuccucccucc

SEQ ID NO: 26934 - RNA, 26 nt, Human
ugaggcucuucaauaagccaggcagc

SEQ ID NO: 26935 - RNA, 24 nt, Human
cauuuggaagccgcacuguauuua

SEQ ID NO: 26936 - RNA, 24 nt, Human
caggcugcuggaggaaaacugaga

SEQ ID NO: 26937 - RNA, 27 nt, Human
aacuucagacuuccuguccugcuggua

SEQ ID NO: 26938 - RNA, 21 nt, Human
ccaucucaggccagagccaag

SEQ ID NO: 26939 - RNA, 22 nt, Human
uuguucagucugaaaugcagcu

SEQ ID NO: 26940 - RNA, 27 nt, Human
accagcuugggcaacauggcaaagccc

SEQ ID NO: 26941 - RNA, 24 nt, Human
ugagcuccuggguguucauucauu

SEQ ID NO: 26942 - RNA, 22 nt, Human
cacugcacugcagccugggcga

SEQ ID NO: 26943 - RNA, 22 nt, Human
ccucuggaggugucaagcuccu

SEQ ID NO: 26944 - RNA, 24 nt, Human
cugccuaaggacuucuuuaauuuu

SEQ ID NO: 26945 - RNA, 26 nt, Human
ucuccuucccaccaucauggggaagc

SEQ ID NO: 26946 - RNA, 16 nt, Human
aaauguucuuccaguu

SEQ ID NO: 26947 - RNA, 22 nt, Human
ggggacugaggugggaggauca

SEQ ID NO: 26948 - RNA, 22 nt, Human
ggaggcugagauaggaggauca

SEQ ID NO: 26949 - RNA, 21 nt, Human
gcagccuccaccuccugggcu

SEQ ID NO: 26950 - RNA, 27 nt, Human
guugcccagguugaaacucccugacag

SEQ ID NO: 26951 - RNA, 23 nt, Human
gaagcaucugucuugucauucca

SEQ ID NO: 26952 - RNA, 22 nt, Human
ucuccccucgucgguggcuaag

SEQ ID NO: 26953 - RNA, 20 nt, Human
uuucagccucaguugguugc

SEQ ID NO: 26954 - RNA, 22 nt, Human
gggaaggucacagcugccugaa

SEQ ID NO: 26955 - RNA, 20 nt, Human
ugcacauaagaucauucaua

SEQ ID NO: 26956 - RNA, 27 nt, Human
gucaugaaagcaccugcccucuguuuc

SEQ ID NO: 26957 - RNA, 21 nt, Human
uacucccuccuccaaaaaagg

SEQ ID NO: 26958 - RNA, 22 nt, Human
agucucugucccaucgcuugaa

SEQ ID NO: 26959 - RNA, 22 nt, Human
gccacagcugacgccaaaaaga

SEQ ID NO: 26960 - RNA, 24 nt, Human
ggaagccucaagacgcggagcagc

SEQ ID NO: 26961 - RNA, 15 nt, Human
ccuuccuuaccuuca

SEQ ID NO: 26962 - RNA, 22 nt, Human
uuuacagcuguguuauucuuug

SEQ ID NO: 26963 - RNA, 27 nt, Human
gggaagguggagcagcugcaggccugg

SEQ ID NO: 26964 - RNA, 21 nt, Human
uccucucucuugcucucagag

SEQ ID NO: 26965 - RNA, 20 nt, Human
uagccugaaaccucuuccac

SEQ ID NO: 26966 - RNA, 19 nt, Human
gucucugcaaacugccuuc

SEQ ID NO: 26967 - RNA, 31 nt, Human
cccucuuacuuuuucucuuguggaacuuggc

SEQ ID NO: 26968 - RNA, 16 nt, Human
agcucuauucuguacc

SEQ ID NO: 26969 - RNA, 21 nt, Human
ugucuccuccccaccuugcaa

SEQ ID NO: 26970 - RNA, 22 nt, Human
ccaucaucaguggagccauguu

SEQ ID NO: 26971 - RNA, 22 nt, Human
ucuuugccucuaucugugguuu

SEQ ID NO: 26972 - RNA, 19 nt, Human
gcuucagccaggucugacu

SEQ ID NO: 26973 - RNA, 22 nt, Human
gagggagacucugucucgaaag

SEQ ID NO: 26974 - RNA, 22 nt, Human
ccaccgcacuucagccugggug

SEQ ID NO: 26975 - RNA, 27 nt, Human
cagcagcuuucccagcuucucugugag

SEQ ID NO: 26976 - RNA, 23 nt, Human
agcagugaggaaagaugaggcau

SEQ ID NO: 26977 - RNA, 26 nt, Human
cagcuccccucccugccucuuuguac

SEQ ID NO: 26978 - RNA, 22 nt, Human
acgauuugaugaugacacuggc

SEQ ID NO: 26979 - RNA, 19 nt, Human
aucuuucauuuugcaccug

SEQ ID NO: 26980 - RNA, 25 nt, Human
uugucucccaggcuggagugcaauc

SEQ ID NO: 26981 - RNA, 25 nt, Human
ucugcucucccagcucacacacucc

SEQ ID NO: 26982 - RNA, 26 nt, Human
aaaugauagaacuguacuguuuucug

SEQ ID NO: 26983 - RNA, 22 nt, Human
ugccaguguccccagcacuuuu

SEQ ID NO: 26984 - RNA, 29 nt, Human
gccucuggauucucuucauggccaggugg

SEQ ID NO: 26985 - RNA, 18 nt, Human
ugaaggcagagcagcuga

SEQ ID NO: 26986 - RNA, 27 nt, Human
uucauuccuuucagccaucguccuuuc

SEQ ID NO: 26987 - RNA, 24 nt, Human
gcaugaaauucugcucagugccuu

SEQ ID NO: 26988 - RNA, 20 nt, Human
uugugugacuuuaccauuga

SEQ ID NO: 26989 - RNA, 25 nt, Human
ugcuggcacguucugcuucucaccc

SEQ ID NO: 26990 - RNA, 26 nt, Human
cccagccucugcuguccaaggcuggc

SEQ ID NO: 26991 - RNA, 23 nt, Human
gagcucuuccugaauaaagccuc

SEQ ID NO: 26992 - RNA, 22 nt, Human
cauaggagacuccauuuuguua

SEQ ID NO: 26993 - RNA, 27 nt, Human
gaacagcuuccucucacugaacggaga

SEQ ID NO: 26994 - RNA, 20 nt, Human
gguguucuaguucaacuuuu

SEQ ID NO: 26995 - RNA, 27 nt, Human
ggucucaaacuccugacccugugaucc

SEQ ID NO: 26996 - RNA, 26 nt, Human
gugaagccucucuugaauuucuaguu

SEQ ID NO: 26997 - RNA, 23 nt, Human
uucuuacuggagcuucauuuugg

SEQ ID NO: 26998 - RNA, 27 nt, Human
aucacuacauugcuuuuucuauaaaac

SEQ ID NO: 26999 - RNA, 22 nt, Human
uguuuccagggucugagugcaa

SEQ ID NO: 27000 - RNA, 20 nt, Human
cccugcaccagcccuucccu

SEQ ID NO: 27001 - RNA, 20 nt, Human
uuugggaagcauauuacaga

SEQ ID NO: 27002 - RNA, 24 nt, Human
cgcggccgccucuugcggucccag

SEQ ID NO: 27003 - RNA, 21 nt, Human
cuggguccccucccuccuucc

SEQ ID NO: 27004 - RNA, 26 nt, Human
gaccccuuuucagcuucugcugggcu

SEQ ID NO: 27005 - RNA, 19 nt, Human
uucuauccugcucuucugu

SEQ ID NO: 27006 - RNA, 20 nt, Human
ccugcuguuugcaucuugag

SEQ ID NO: 27007 - RNA, 26 nt, Human
ggggcccaacccugcccacuucagcc

SEQ ID NO: 27008 - RNA, 27 nt, Human
ggcucaaugcaaccucugccccccggg

SEQ ID NO: 27009 - RNA, 22 nt, Human
cagagcuccaugcuguucugaa

SEQ ID NO: 27010 - RNA, 24 nt, Human
uugauuuuuuaaaaauacuguuca

SEQ ID NO: 27011 - RNA, 25 nt, Human
ggcacagccacaagucucaucucua

SEQ ID NO: 27012 - RNA, 22 nt, Human
aauaacuuagugaaucacugcc

SEQ ID NO: 27013 - RNA, 24 nt, Human
gcugcuccagggagcaccagcugc

SEQ ID NO: 27014 - RNA, 21 nt, Human
gacuaugugccgauuccugcu

SEQ ID NO: 27015 - RNA, 25 nt, Human
ggaccccggcgucugaggcucauag

SEQ ID NO: 27016 - RNA, 23 nt, Human
ugaaggagaaaaugcauuaugug

SEQ ID NO: 27017 - RNA, 22 nt, Human
agaauucuucccuagaggcuuu

SEQ ID NO: 27018 - RNA, 21 nt, Human
caaccaaaacuuuacaagcuu

SEQ ID NO: 27019 - RNA, 22 nt, Human
cccaaaguacugggauuacagg

SEQ ID NO: 27020 - RNA, 27 nt, Human
agagucgaauuuccagacagggaccca

SEQ ID NO: 27021 - RNA, 27 nt, Human
cucugaauuuccguuuccuccucugca

SEQ ID NO: 27022 - RNA, 26 nt, Human
gcugucugucucaguacaauccaaau

SEQ ID NO: 27023 - RNA, 22 nt, Human
caugucuauaaucccagcacuu

SEQ ID NO: 27024 - RNA, 25 nt, Human
ucuugccaagccucagucuuuggga

SEQ ID NO: 27025 - RNA, 22 nt, Human
uaugcugguaguagccucuuua

SEQ ID NO: 27026 - RNA, 22 nt, Human
cacugcuggacaggaugguuca

SEQ ID NO: 27027 - RNA, 21 nt, Human
ccuucccaugacccaggcugg

SEQ ID NO: 27028 - RNA, 24 nt, Human
acguggagaaaacuuucugcugag

SEQ ID NO: 27029 - RNA, 26 nt, Human
ucacugcagcuuugaucugaccgcuc

SEQ ID NO: 27030 - RNA, 21 nt, Human
ccggccgcccugccggugugc

SEQ ID NO: 27031 - RNA, 22 nt, Human
ggugugccaagugcugugcuaa

SEQ ID NO: 27032 - RNA, 22 nt, Human
aggagcugagagaggggggcag

SEQ ID NO: 27033 - RNA, 21 nt, Human
acaguucccuguaauccugcc

SEQ ID NO: 27034 - RNA, 20 nt, Human
aaugugguggagaaagggaa

SEQ ID NO: 27035 - RNA, 21 nt, Human
cggaaggcuggcugggcaugg

SEQ ID NO: 27036 - RNA, 19 nt, Human
caucugccagcugugucau

SEQ ID NO: 27037 - RNA, 28 nt, Human
gucaggcagggcuggagugagcagccag

SEQ ID NO: 27038 - RNA, 22 nt, Human
gaucucguuuuuucuucacugc

SEQ ID NO: 27039 - RNA, 22 nt, Human
ugaaggcaagagaugaauugca

SEQ ID NO: 27040 - RNA, 26 nt, Human
uucaaccaaaugaaacuugaaucugu

SEQ ID NO: 27041 - RNA, 27 nt, Human
uucauuugccgggacacucgggcccau

SEQ ID NO: 27042 - RNA, 24 nt, Human
agagaaggagggaggcgcuccugg

SEQ ID NO: 27043 - RNA, 22 nt, Human
cacgccuguaaucccaacauuu

SEQ ID NO: 27044 - RNA, 21 nt, Human
ggcagauguagauaauucagc

SEQ ID NO: 27045 - RNA, 23 nt, Human
acacaagauuugacuguaauauu

SEQ ID NO: 27046 - RNA, 27 nt, Human
gcuugcucuccacuuuucaaguggguc

SEQ ID NO: 27047 - RNA, 22 nt, Human
ggguuauuaguccaaaugugau

SEQ ID NO: 27048 - RNA, 23 nt, Human
uguuccuuuggcuuucucuugga

SEQ ID NO: 27049 - RNA, 22 nt, Human
uguccccagggaugaagugggu

SEQ ID NO: 27050 - RNA, 23 nt, Human
uucuggagcaguggacugccaca

SEQ ID NO: 27051 - RNA, 25 nt, Human
agcuccacacuaucucuuagcugag

SEQ ID NO: 27052 - RNA, 26 nt, Human
aaaugagauggcugguuagagcauga

SEQ ID NO: 27053 - RNA, 27 nt, Human
aaauguucuuuauacagccuaguuaau

SEQ ID NO: 27054 - RNA, 19 nt, Human
aauaugcacuuagcacuuu

SEQ ID NO: 27055 - RNA, 20 nt, Human
gacccugcacccuccuaggg

SEQ ID NO: 27056 - RNA, 21 nt, Human
agcucacugcaaccuccgccu

SEQ ID NO: 27057 - RNA, 21 nt, Human
cucaagccauggcaggcgugg

SEQ ID NO: 27058 - RNA, 24 nt, Human
ucuccugccucagcuccucgagua

SEQ ID NO: 27059 - RNA, 25 nt, Human
ggcaucagugcugcugcuuccaggg

SEQ ID NO: 27060 - RNA, 24 nt, Human
uucggggccaccuccaggcugcag

SEQ ID NO: 27061 - RNA, 23 nt, Human
uuauggcuuuaguucacugugau

SEQ ID NO: 27062 - RNA, 22 nt, Human
agccuggggaccccacuucaga

SEQ ID NO: 27063 - RNA, 22 nt, Human
ugcaaccucugccucccgggcu

SEQ ID NO: 27064 - RNA, 22 nt, Human
ugcaaccucugcuucccggguu

SEQ ID NO: 27065 - RNA, 24 nt, Human
aaggggaggggcgccaggugaggc

SEQ ID NO: 27066 - RNA, 21 nt, Human
acuggcuucguauuuuauuua

SEQ ID NO: 27067 - RNA, 24 nt, Human
caaacucccagguucucacuuccu

SEQ ID NO: 27068 - RNA, 20 nt, Human
gguuggcucuggccaggauu

SEQ ID NO: 27069 - RNA, 26 nt, Human
acgcaggagguggagccggccgggug

SEQ ID NO: 27070 - RNA, 20 nt, Human
guaguguugaugauccugga

SEQ ID NO: 27071 - RNA, 32 nt, Human
acugauaaaauacucuagccugggccagagaa

SEQ ID NO: 27072 - RNA, 24 nt, Human
ggucguugugggggucucuugccu

SEQ ID NO: 27073 - RNA, 27 nt, Human
cugauggcauccagagucauugcugug

SEQ ID NO: 27074 - RNA, 21 nt, Human
gccucacugcaacgccugccu

SEQ ID NO: 27075 - RNA, 23 nt, Human
gcuagugagcugggcaugguacc

SEQ ID NO: 27076 - RNA, 24 nt, Human
augcugaauauuucuuuggcugcu

SEQ ID NO: 27077 - RNA, 21 nt, Human
gcuucuccagccucggccucc

SEQ ID NO: 27078 - RNA, 22 nt, Human
aggcuggagugcagugggugau

SEQ ID NO: 27079 - RNA, 18 nt, Human
agguaaacuuggagagga

SEQ ID NO: 27080 - RNA, 24 nt, Human
ccuccuguagccccugccugcacc

SEQ ID NO: 27081 - RNA, 23 nt, Human
cacuacagaaaaacacaaaaagg

SEQ ID NO: 27082 - RNA, 20 nt, Human
cuauucacauuguuaagaaa

SEQ ID NO: 27083 - RNA, 31 nt, Human
guugcaauuguuuaagaaucauggauuuauu

SEQ ID NO: 27084 - RNA, 22 nt, Human
caauauuguaauccuagcacuu

SEQ ID NO: 27085 - RNA, 21 nt, Human
cugcuucugagugacggacca

SEQ ID NO: 27086 - RNA, 25 nt, Human
cugcaaguucucaguuucuucacca

SEQ ID NO: 27087 - RNA, 16 nt, Human
acuguaaaaugccaga

SEQ ID NO: 27088 - RNA, 26 nt, Human
ugggacuggagguuguauaagguguu

SEQ ID NO: 27089 - RNA, 24 nt, Human
uguuacccaggcuggagugcagug

SEQ ID NO: 27090 - RNA, 24 nt, Human
ugucacccagguuggagugcagug

SEQ ID NO: 27091 - RNA, 26 nt, Human
ccugccugguccagcugggacccugc

SEQ ID NO: 27092 - RNA, 27 nt, Human
cugggagggaaguggagguugcuguac

SEQ ID NO: 27093 - RNA, 24 nt, Human
ucugccuggggccucaccugcugg

SEQ ID NO: 27094 - RNA, 20 nt, Human
uccccccagggcugggcacu

SEQ ID NO: 27095 - RNA, 22 nt, Human
cuggaaguccccgggagccucu

SEQ ID NO: 27096 - RNA, 21 nt, Human
uuugcccaggcuggagugcag

SEQ ID NO: 27097 - RNA, 22 nt, Human
cucagccacugugaugcagagc

SEQ ID NO: 27098 - RNA, 19 nt, Human
uacauuauuuuaagccaca

SEQ ID NO: 27099 - RNA, 20 nt, Human
agaugauuguucuuuuguuu

SEQ ID NO: 27100 - RNA, 22 nt, Human
ggucuugaacucccgaccucag

SEQ ID NO: 27101 - RNA, 22 nt, Human
ggucucgaacuccugaccucag

SEQ ID NO: 27102 - RNA, 28 nt, Human
uuaucuuguugucacagggcuaacccuc

SEQ ID NO: 27103 - RNA, 22 nt, Human
cgccgaccgccucaugacccag

SEQ ID NO: 27104 - RNA, 27 nt, Human
gcccaacuuacugucuucuucauguca

SEQ ID NO: 27105 - RNA, 26 nt, Human
uguagccagaucuccaacagugccuu

SEQ ID NO: 27106 - RNA, 27 nt, Human
ucucucaugcuaccuuuugugggccug

SEQ ID NO: 27107 - RNA, 22 nt, Human
ugaacuccuggacucaagcaac

SEQ ID NO: 27108 - RNA, 23 nt, Human
aauuaaccuuccgcuuuguugcu

SEQ ID NO: 27109 - RNA, 18 nt, Human
uucaaaccaauacugccu

SEQ ID NO: 27110 - RNA, 20 nt, Human
uggguggauaaauuucugga

SEQ ID NO: 27111 - RNA, 21 nt, Human
gcuuggggauuguacacggga

SEQ ID NO: 27112 - RNA, 27 nt, Human
caaaacaauguagaguuuuauuuauug

SEQ ID NO: 27113 - RNA, 19 nt, Human
gcacucucccuugucgugg

SEQ ID NO: 27114 - RNA, 23 nt, Human
ggcucacgguaaccucugccucc

SEQ ID NO: 27115 - RNA, 21 nt, Human
gggcuggaagaagugaaaggg

SEQ ID NO: 27116 - RNA, 21 nt, Human
acccuccagguguccuucgca

SEQ ID NO: 27117 - RNA, 19 nt, Human
ccuccuaacuccugccaga

SEQ ID NO: 27118 - RNA, 22 nt, Human
cuguuccuuuucaccuaacugu

SEQ ID NO: 27119 - RNA, 27 nt, Human
agcaugacgacuacaauuucuuuucau

SEQ ID NO: 27120 - RNA, 24 nt, Human
aucacacacuaauguaaccauuuu

SEQ ID NO: 27121 - RNA, 20 nt, Human
ggacagugacccaugauauc

SEQ ID NO: 27122 - RNA, 18 nt, Human
caaagcugcagccagcau

SEQ ID NO: 27123 - RNA, 19 nt, Human
cagcuugauccuggagguc

SEQ ID NO: 27124 - RNA, 20 nt, Human
aaaggcugguacaacggagg

SEQ ID NO: 27125 - RNA, 21 nt, Human
ugagaggcaccaggcccagcc

SEQ ID NO: 27126 - RNA, 20 nt, Human
agguuggcaacauuguacaa

SEQ ID NO: 27127 - RNA, 27 nt, Human
ugcagugagcuuguaauugcaccacug

SEQ ID NO: 27128 - RNA, 21 nt, Human
ugagagagggggauguuuccu

SEQ ID NO: 27129 - RNA, 23 nt, Human
ugaggaaugcuugcaaugcucau

SEQ ID NO: 27130 - RNA, 22 nt, Human
gagucucucuuccuccucagcg

SEQ ID NO: 27131 - RNA, 27 nt, Human
cauugcacuccagccuggguaacaaga

SEQ ID NO: 27132 - RNA, 21 nt, Human
acccccacccacacagcugcc

SEQ ID NO: 27133 - RNA, 24 nt, Human
gcaaagcaguggacaacacagaac

SEQ ID NO: 27134 - RNA, 19 nt, Human
aggacagacacaggcucca

SEQ ID NO: 27135 - RNA, 21 nt, Human
ccauuuaaaugugcauggccc

SEQ ID NO: 27136 - RNA, 23 nt, Human
ucuugaccucuuggcucucucug

SEQ ID NO: 27137 - RNA, 24 nt, Human
cuguaagaauguuuaagguuuuua

SEQ ID NO: 27138 - RNA, 22 nt, Human
aagaauugaacccaggaggugg

SEQ ID NO: 27139 - RNA, 22 nt, Human
cuauaaucccagcuacuuggga

SEQ ID NO: 27140 - RNA, 20 nt, Human
uguuucacagcugccaccac

SEQ ID NO: 27141 - RNA, 23 nt, Human
cggggaggggaagcuugagcugc

SEQ ID NO: 27142 - RNA, 20 nt, Human
uccugcaggagccuacccug

SEQ ID NO: 27143 - RNA, 21 nt, Human
guaaaaugauaacuuaccuua

SEQ ID NO: 27144 - RNA, 23 nt, Human
ugaaaugcuucagggauuccaua

SEQ ID NO: 27145 - RNA, 22 nt, Human
acugcugcucucccggcuuccc

SEQ ID NO: 27146 - RNA, 22 nt, Human
gagagagacuccaucucaaaac

SEQ ID NO: 27147 - RNA, 25 nt, Human
gagcugccacugggcaccucgcgac

SEQ ID NO: 27148 - RNA, 25 nt, Human
cccaaaggaguggacauuuccuaac

SEQ ID NO: 27149 - RNA, 19 nt, Human
ucucucucaugccuccuga

SEQ ID NO: 27150 - RNA, 26 nt, Human
cagacuuggccuccagcuguucuuag

SEQ ID NO: 27151 - RNA, 26 nt, Human
accagccuguggacugcgccccuggc

SEQ ID NO: 27152 - RNA, 25 nt, Human
gggcuggcaggagcaggauggcggc

SEQ ID NO: 27153 - RNA, 21 nt, Human
guuagcaccagccagcucucu

SEQ ID NO: 27154 - RNA, 26 nt, Human
cuccugggcagugguuuuguugccug

SEQ ID NO: 27155 - RNA, 22 nt, Human
ucuuuuucuaugagcacacucu

SEQ ID NO: 27156 - RNA, 20 nt, Human
uugcucagagagaaggugga

SEQ ID NO: 27157 - RNA, 27 nt, Human
ggggaaagaaaucaggggacauguuau

SEQ ID NO: 27158 - RNA, 22 nt, Human
cagaucgcuaccccaggcugag

SEQ ID NO: 27159 - RNA, 24 nt, Human
caccaugaguuauuugguuuuuga

SEQ ID NO: 27160 - RNA, 25 nt, Human
ugugagguuaccauuaugugauguu

SEQ ID NO: 27161 - RNA, 21 nt, Human
uacugcacuugucugauguga

SEQ ID NO: 27162 - RNA, 22 nt, Human
uauacuagauggaagacuugca

SEQ ID NO: 27163 - RNA, 20 nt, Human
uaggugaagacaugggugaa

SEQ ID NO: 27164 - RNA, 27 nt, Human
auagagugggacucuuggaaucaggag

SEQ ID NO: 27165 - RNA, 20 nt, Human
agagaggcugccgggaccag

SEQ ID NO: 27166 - RNA, 20 nt, Human
ccagcauuggugaauauuca

SEQ ID NO: 27167 - RNA, 22 nt, Human
gaaggggagaagcauagagggc

SEQ ID NO: 27168 - RNA, 22 nt, Human
gcuugaggcucagccauggccc

SEQ ID NO: 27169 - RNA, 26 nt, Human
agcugauuuccucacucagacagcug

SEQ ID NO: 27170 - RNA, 21 nt, Human
agagucuauuucaaguguuug

SEQ ID NO: 27171 - RNA, 24 nt, Human
ggaaguguggggaggaaggaagug

SEQ ID NO: 27172 - RNA, 21 nt, Human
gcacagaucacacacaugcac

SEQ ID NO: 27173 - RNA, 26 nt, Human
ggcucugcucggaaaucguccuggcc

SEQ ID NO: 27174 - RNA, 22 nt, Human
aaaaagcaaccaacuuagccag

SEQ ID NO: 27175 - RNA, 19 nt, Human
ucauagcucacugcagcuu

SEQ ID NO: 27176 - RNA, 25 nt, Human
gaaugagggguagagccacucuggg

SEQ ID NO: 27177 - RNA, 22 nt, Human
uuuucaaacacuagucuagagg

SEQ ID NO: 27178 - RNA, 15 nt, Human
cccagcgcagugccu

SEQ ID NO: 27179 - RNA, 19 nt, Human
cucuaauuagcuuucccag

SEQ ID NO: 27180 - RNA, 22 nt, Human
aaucuuguucuugcucuccuca

SEQ ID NO: 27181 - RNA, 22 nt, Human
auuauacaacuguaccauaguc

SEQ ID NO: 27182 - RNA, 21 nt, Human
cuuucuucccuacccuugcca

SEQ ID NO: 27183 - RNA, 24 nt, Human
auuguuucccucauggccgaccag

SEQ ID NO: 27184 - RNA, 22 nt, Human
aucacaacuuccagcugcuauc

SEQ ID NO: 27185 - RNA, 28 nt, Human
uccaguuuuguauuuuguguauuauaaa

SEQ ID NO: 27186 - RNA, 23 nt, Human
ugugcggugcccuccugccucag

SEQ ID NO: 27187 - RNA, 22 nt, Human
aaagaacaugcaguuugaaauu

SEQ ID NO: 27188 - RNA, 23 nt, Human
ggccuccccaaagugcugggauu

SEQ ID NO: 27189 - RNA, 23 nt, Human
ugccacaggaucccagcacuuug

SEQ ID NO: 27190 - RNA, 20 nt, Human
cacuaaauguggaguguagg

SEQ ID NO: 27191 - RNA, 22 nt, Human
uguuguccaggcuggagugcaa

SEQ ID NO: 27192 - RNA, 26 nt, Human
cuccaaugucucuuuugcaagaguuu

SEQ ID NO: 27193 - RNA, 25 nt, Human
uucauguauaucaagcacagcagua

SEQ ID NO: 27194 - RNA, 25 nt, Human
uucuucuucuucuaaaauauugggc

SEQ ID NO: 27195 - RNA, 17 nt, Human
gcuguaaaaauguuacg

SEQ ID NO: 27196 - RNA, 25 nt, Human
uugcagacuuggcucagaagucacc

SEQ ID NO: 27197 - RNA, 23 nt, Human
gaucacugcuuguugcuggagcu

SEQ ID NO: 27198 - RNA, 24 nt, Human
cuaagaauuggcagaaauguuuua

SEQ ID NO: 27199 - RNA, 24 nt, Human
aguggcaguggcagagaauccaaa

SEQ ID NO: 27200 - RNA, 27 nt, Human
uccauggaagcuguucagaaaaaucaa

SEQ ID NO: 27201 - RNA, 27 nt, Human
guugccuaggcuggaggacaguggcac

SEQ ID NO: 27202 - RNA, 24 nt, Human
gggcccaggaggcggggagggagg

SEQ ID NO: 27203 - RNA, 20 nt, Human
uuauuagcauuucuuaguau

SEQ ID NO: 27204 - RNA, 27 nt, Human
caaacagagcaacaacaaguacgcggc

SEQ ID NO: 27205 - RNA, 21 nt, Human
accagucucuuuauuuuuauu

SEQ ID NO: 27206 - RNA, 22 nt, Human
aucucaguaacaaugagcagca

SEQ ID NO: 27207 - RNA, 20 nt, Human
ugcacacaucccuuccugug

SEQ ID NO: 27208 - RNA, 19 nt, Human
gcgccauggggcucagcga

SEQ ID NO: 27209 - RNA, 28 nt, Human
agaaguuuagguguuuggaccaagguca

SEQ ID NO: 27210 - RNA, 25 nt, Human
cuuauauuuugccugugcuugauca

SEQ ID NO: 27211 - RNA, 23 nt, Human
auaagccuuuuugacuguguaca

SEQ ID NO: 27212 - RNA, 22 nt, Human
ucagcauuucggugcuucccuu

SEQ ID NO: 27213 - RNA, 22 nt, Human
cccguccuugggcugacaggug

SEQ ID NO: 27214 - RNA, 27 nt, Human
ggaaccucaggcccugcuugacagugc

SEQ ID NO: 27215 - RNA, 25 nt, Human
gggagugggaacagggaggggcaga

SEQ ID NO: 27216 - RNA, 22 nt, Human
ucuugugagcccugggcuuagg

SEQ ID NO: 27217 - RNA, 22 nt, Human
ccgaaucucuuuucucuguaaa

SEQ ID NO: 27218 - RNA, 17 nt, Human
cccugcggucaggcugg

SEQ ID NO: 27219 - RNA, 23 nt, Human
cggcuggagugcaguggcaugau

SEQ ID NO: 27220 - RNA, 19 nt, Human
agcauuuuccugccaguca

SEQ ID NO: 27221 - RNA, 30 nt, Human
gccauucuugccaggaggaggaaugagagu

SEQ ID NO: 27222 - RNA, 32 nt, Human
agugggugguuugcgaggaugagggacgcuau

SEQ ID NO: 27223 - RNA, 22 nt, Human
ccuugaaaucacacagcuugca

SEQ ID NO: 27224 - RNA, 27 nt, Human
gcucugucacccaggcugaagugcagu

SEQ ID NO: 27225 - RNA, 22 nt, Human
ucuuaaccuugagcauagugac

SEQ ID NO: 27226 - RNA, 24 nt, Human
uugccucucgugauucuguuuguu

SEQ ID NO: 27227 - RNA, 23 nt, Human
ccagcccugccccugccuccugc

SEQ ID NO: 27228 - RNA, 27 nt, Human
cuugcagaaugcgugguguuaaucuac

SEQ ID NO: 27229 - RNA, 25 nt, Human
ggagaagggagagagugggaguuuc

SEQ ID NO: 27230 - RNA, 29 nt, Human
gaaugcauagaugaacauugcaugaccgg

SEQ ID NO: 27231 - RNA, 23 nt, Human
auggguggucacagggagaaaca

SEQ ID NO: 27232 - RNA, 20 nt, Human
ccuagcgaggcaccagcaca

SEQ ID NO: 27233 - RNA, 25 nt, Human
auguacagaguggccccucaccugg

SEQ ID NO: 27234 - RNA, 21 nt, Human
cucucaaggcccugaccucag

SEQ ID NO: 27235 - RNA, 25 nt, Human
ggccuccccuucccaucccaccucc

SEQ ID NO: 27236 - RNA, 19 nt, Human
gggcccccuacuuguuuua

SEQ ID NO: 27237 - RNA, 27 nt, Human
gcacagauaugcugucuggacaggcac

SEQ ID NO: 27238 - RNA, 20 nt, Human
agaaccucggcucucaggag

SEQ ID NO: 27239 - RNA, 20 nt, Human
acuguucucucuguaccaug

SEQ ID NO: 27240 - RNA, 22 nt, Human
uaauauauuuuucuaaggguca

SEQ ID NO: 27241 - RNA, 23 nt, Human
uagaagccucacucuugccccuc

SEQ ID NO: 27242 - RNA, 25 nt, Human
cuuccuggguucugcugagucuucc

SEQ ID NO: 27243 - RNA, 23 nt, Human
cacaguauucaguuuucucaccu

SEQ ID NO: 27244 - RNA, 23 nt, Human
gccccaggcucuccgacccagcu

SEQ ID NO: 27245 - RNA, 20 nt, Human
uccuccugccucuguugcca

SEQ ID NO: 27246 - RNA, 27 nt, Human
aacaacaaaaauauaacuacaacuucc

SEQ ID NO: 27247 - RNA, 27 nt, Human
agaaguuaaagagacuucucuguaaau

SEQ ID NO: 27248 - RNA, 27 nt, Human
cacugguuugaagugcccuucccuugc

SEQ ID NO: 27249 - RNA, 22 nt, Human
ccaucugcugccccgcuucccc

SEQ ID NO: 27250 - RNA, 22 nt, Human
acuaaaauggagagcaagacag

SEQ ID NO: 27251 - RNA, 26 nt, Human
uugccaggcuggaugcugucgucucu

SEQ ID NO: 27252 - RNA, 28 nt, Human
gcugcuucccucaccugccugccugucu

SEQ ID NO: 27253 - RNA, 27 nt, Human
cugcaagaggcugccuccugguccacu

SEQ ID NO: 27254 - RNA, 18 nt, Human
gaguuagcaacacuguuu

SEQ ID NO: 27255 - RNA, 24 nt, Human
gggggccgggcagguccugcccau

SEQ ID NO: 27256 - RNA, 20 nt, Human
uauuccgucaauaaaaaaga

SEQ ID NO: 27257 - RNA, 25 nt, Human
uaaauucuccuggcucuccugggcu

SEQ ID NO: 27258 - RNA, 22 nt, Human
cauuguguuggggcccaggaag

SEQ ID NO: 27259 - RNA, 21 nt, Human
ucauccaggcuggagugcagu

SEQ ID NO: 27260 - RNA, 27 nt, Human
cgcagccgccgccucagcugcucgcuc

SEQ ID NO: 27261 - RNA, 23 nt, Human
aauacaugggaagcuuugcugaa

SEQ ID NO: 27262 - RNA, 25 nt, Human
gucgcccaggcugguuuugaacucc

SEQ ID NO: 27263 - RNA, 22 nt, Human
ucucucaaacugucuuuucuca

SEQ ID NO: 27264 - RNA, 19 nt, Human
ucccugccucuccaggaca

SEQ ID NO: 27265 - RNA, 29 nt, Human
cugggccuggcgggggaggcaggggugag

SEQ ID NO: 27266 - RNA, 21 nt, Human
acacagaaagcaugcuuucug

SEQ ID NO: 27267 - RNA, 24 nt, Human
cucuucagacagcccgagccuucc

SEQ ID NO: 27268 - RNA, 22 nt, Human
ccccucuggcccugccagcugc

SEQ ID NO: 27269 - RNA, 24 nt, Human
cuucuaggccucuggaccgcagau

SEQ ID NO: 27270 - RNA, 22 nt, Human
accauccuggccaacaugguga

SEQ ID NO: 27271 - RNA, 21 nt, Human
uuaaaggacaauucucuuuca

SEQ ID NO: 27272 - RNA, 21 nt, Human
cagcuucuguccuuucuuggg

SEQ ID NO: 27273 - RNA, 27 nt, Human
cugcuucuguuccaaaaauaaaagcug

SEQ ID NO: 27274 - RNA, 26 nt, Human
caaucaggaauagauuugccaugaag

SEQ ID NO: 27275 - RNA, 22 nt, Human
agcagccgccuucuaguugggg

SEQ ID NO: 27276 - RNA, 24 nt, Human
cugcagccuccaccgugcugaggu

SEQ ID NO: 27277 - RNA, 26 nt, Human
gagagaaacuccuacucuucuguaag

SEQ ID NO: 27278 - RNA, 21 nt, Human
ggacaucugaaucuccaucuc

SEQ ID NO: 27279 - RNA, 21 nt, Human
uggcauccuucccucuaagcc

SEQ ID NO: 27280 - RNA, 20 nt, Human
ccuagcuuuuaaaaaauauu

SEQ ID NO: 27281 - RNA, 23 nt, Human
ugcaccacuccuuccccaggguu

SEQ ID NO: 27282 - RNA, 23 nt, Human
cuccugugugccuccugccaucc

SEQ ID NO: 27283 - RNA, 26 nt, Human
aguucacaguuuauuguuugucuguu

SEQ ID NO: 27284 - RNA, 21 nt, Human
caucccugucccuuucuggcc

SEQ ID NO: 27285 - RNA, 26 nt, Human
uaaagaagacgccaaugauggcugaa

SEQ ID NO: 27286 - RNA, 19 nt, Human
gggaggcgggagucggggg

SEQ ID NO: 27287 - RNA, 24 nt, Human
gacugcagccacugauucucucuu

SEQ ID NO: 27288 - RNA, 21 nt, Human
uuucacacaaaaggaaaauga

SEQ ID NO: 27289 - RNA, 26 nt, Human
ggcaaaagcuagacucuccucguguc

SEQ ID NO: 27290 - RNA, 23 nt, Human
uauaggggauacuugaaaccagu

SEQ ID NO: 27291 - RNA, 20 nt, Human
acugcaaccucaauccuggg

SEQ ID NO: 27292 - RNA, 21 nt, Human
uuuccccuuggacacuugguu

SEQ ID NO: 27293 - RNA, 26 nt, Human
guacacacacccccaccuccugcaau

SEQ ID NO: 27294 - RNA, 21 nt, Human
ccuccugguaggaggggguuu

SEQ ID NO: 27295 - RNA, 23 nt, Human
ugcaaagcauuuuaccguacaaa

SEQ ID NO: 27296 - RNA, 22 nt, Human
accccucaucaaccagcccagc

SEQ ID NO: 27297 - RNA, 19 nt, Human
ggacugagaucccaccucc

SEQ ID NO: 27298 - RNA, 23 nt, Human
ggcaggagggagaguuccuguga

SEQ ID NO: 27299 - RNA, 25 nt, Human
agaacuccaccauugugggcuuuga

SEQ ID NO: 27300 - RNA, 25 nt, Human
cagaaauucugcaaguuucuguuuc

SEQ ID NO: 27301 - RNA, 21 nt, Human
cugagccacagcagcauuuuu

SEQ ID NO: 27302 - RNA, 27 nt, Human
caggaagggaaagccagaaggggcacg

SEQ ID NO: 27303 - RNA, 27 nt, Human
ugcagugagccaaaauugcaccacugc

SEQ ID NO: 27304 - RNA, 22 nt, Human
gcacacagaccacauagcacac

SEQ ID NO: 27305 - RNA, 20 nt, Human
cauucaggcuggagugcagu

SEQ ID NO: 27306 - RNA, 30 nt, Human
gccugggaggugugaacccagggcccgcca

SEQ ID NO: 27307 - RNA, 27 nt, Human
gggagagacagagggagagugugcaua

SEQ ID NO: 27308 - RNA, 21 nt, Human
acucuuggcugugugcauuuu

SEQ ID NO: 27309 - RNA, 23 nt, Human
cagccucaguggccagaggauca

SEQ ID NO: 27310 - RNA, 27 nt, Human
aagagccuuuccaaagaggagcgaugg

SEQ ID NO: 27311 - RNA, 25 nt, Human
ucccaaaccaugucaggaccaccuu

SEQ ID NO: 27312 - RNA, 27 nt, Human
ggcuucauugagaaacugggaaaaguu

SEQ ID NO: 27313 - RNA, 26 nt, Human
aacuggagggugagaggaaggguggg

SEQ ID NO: 27314 - RNA, 24 nt, Human
uggagggcagggagugggagccaa

SEQ ID NO: 27315 - RNA, 22 nt, Human
accauggagucaugagcugucu

SEQ ID NO: 27316 - RNA, 17 nt, Human
cugcugcucccugcugc

SEQ ID NO: 27317 - RNA, 22 nt, Human
cauccacagagcagugcagugg

SEQ ID NO: 27318 - RNA, 21 nt, Human
ccaaaaacaacaacaaaauga

SEQ ID NO: 27319 - RNA, 27 nt, Human
ggucuugaacuccuggccucaagucau

SEQ ID NO: 27320 - RNA, 29 nt, Human
cuucccuaccucuuccucccagaguccuc

SEQ ID NO: 27321 - RNA, 23 nt, Human
uggggaggagaggaaagcuggaa

SEQ ID NO: 27322 - RNA, 22 nt, Human
uuuaacaaaugucauagcuaug

SEQ ID NO: 27323 - RNA, 23 nt, Human
uagaagcugcaugucaagaccca

SEQ ID NO: 27324 - RNA, 30 nt, Human
gcucauuucaaaagcagaaaaagacaacaa

SEQ ID NO: 27325 - RNA, 20 nt, Human
ggcccaccagagcugccauu

SEQ ID NO: 27326 - RNA, 22 nt, Human
accagccugggcaacauaguaa

SEQ ID NO: 27327 - RNA, 22 nt, Human
accagccugagcaacaugguaa

SEQ ID NO: 27328 - RNA, 23 nt, Human
guccucuccccauccuauugcau

SEQ ID NO: 27329 - RNA, 19 nt, Human
ccaucccccugccugcugc

SEQ ID NO: 27330 - RNA, 24 nt, Human
ugcauccuggagugcaaaaauaaa

SEQ ID NO: 27331 - RNA, 22 nt, Human
gcuguggcccaggccuccuggg

SEQ ID NO: 27332 - RNA, 19 nt, Human
agcaacaccccucauucca

SEQ ID NO: 27333 - RNA, 27 nt, Human
gacagucaucaucauuguuguggugcu

SEQ ID NO: 27334 - RNA, 27 nt, Human
uacccauuaaaaggcaggcuggaaggc

SEQ ID NO: 27335 - RNA, 25 nt, Human
gccugaguuagcuguuuacugacau

SEQ ID NO: 27336 - RNA, 20 nt, Human
ucuucagcccaggcuuuugc

SEQ ID NO: 27337 - RNA, 24 nt, Human
uggcccacagucucccagaaauga

SEQ ID NO: 27338 - RNA, 20 nt, Human
augaguauugagaagccaca

SEQ ID NO: 27339 - RNA, 30 nt, Human
cagccagucacagacccauucuaugcaaug

SEQ ID NO: 27340 - RNA, 23 nt, Human
ucuagaaugcugucuccagguag

SEQ ID NO: 27341 - RNA, 26 nt, Human
ggcccaauuagcaucaucuaggggaa

SEQ ID NO: 27342 - RNA, 26 nt, Human
aaauuacuucuuuauugacuugucca

SEQ ID NO: 27343 - RNA, 21 nt, Human
cuccaaaucucuugcuuguca

SEQ ID NO: 27344 - RNA, 18 nt, Human
cucagaggcgcacuguga

SEQ ID NO: 27345 - RNA, 24 nt, Human
ccuuuuagugguaucugacauaua

SEQ ID NO: 27346 - RNA, 22 nt, Human
gggaucugaccuggugagauua

SEQ ID NO: 27347 - RNA, 19 nt, Human
uggcagcugcuccuucgcc

SEQ ID NO: 27348 - RNA, 20 nt, Human
cuauggcggcgagcacuggc

SEQ ID NO: 27349 - RNA, 21 nt, Human
ggauucuaggcggaagcgaua

SEQ ID NO: 27350 - RNA, 24 nt, Human
ugcuggcaucuuagaacccucccu

SEQ ID NO: 27351 - RNA, 18 nt, Human
cuuccuuucccuggagcu

SEQ ID NO: 27352 - RNA, 20 nt, Human
gguucauuccaaauaguuuu

SEQ ID NO: 27353 - RNA, 22 nt, Human
ccauucuccccuccagggagcc

SEQ ID NO: 27354 - RNA, 25 nt, Human
guuggccaggcuggucucgagcucc

SEQ ID NO: 27355 - RNA, 23 nt, Human
aagcaagcccgccccucuggugg

SEQ ID NO: 27356 - RNA, 27 nt, Human
gggugcuugagaaaccuacauuuggac

SEQ ID NO: 27357 - RNA, 19 nt, Human
guacuaggccuacugggga

SEQ ID NO: 27358 - RNA, 27 nt, Human
ugggcucaagcgauccuccugccucag

SEQ ID NO: 27359 - RNA, 20 nt, Human
ccagcacugcggccaagucg

SEQ ID NO: 27360 - RNA, 22 nt, Human
gcgaucucagcucacugcagcc

SEQ ID NO: 27361 - RNA, 27 nt, Human
ucagcacuuugggaggcugagguggga

SEQ ID NO: 27362 - RNA, 24 nt, Human
cugugaaacuggcuuuauagaguu

SEQ ID NO: 27363 - RNA, 22 nt, Human
gcaguccccugcacaagaugcc

SEQ ID NO: 27364 - RNA, 22 nt, Human
gacugucucccuuucucuacca

SEQ ID NO: 27365 - RNA, 26 nt, Human
cgcgcacuccagcgcagcgcgugcgg

SEQ ID NO: 27366 - RNA, 22 nt, Human
cucaugacaacagaagggaggu

SEQ ID NO: 27367 - RNA, 26 nt, Human
acaaguccuuuaaccucugggcuuca

SEQ ID NO: 27368 - RNA, 26 nt, Human
cagcagacaaggccacagucaaugga

SEQ ID NO: 27369 - RNA, 24 nt, Human
ccuuggccuagcccacccugcugc

SEQ ID NO: 27370 - RNA, 20 nt, Human
gagagagacuggacagggua

SEQ ID NO: 27371 - RNA, 21 nt, Human
gcugcacuccagccuaggcaa

SEQ ID NO: 27372 - RNA, 24 nt, Human
ugcagaguggccuagagcacucuc

SEQ ID NO: 27373 - RNA, 23 nt, Human
uugggaugcaggcucagcccgcu

SEQ ID NO: 27374 - RNA, 24 nt, Human
ucucggaacccuggcgucucucca

SEQ ID NO: 27375 - RNA, 20 nt, Human
guuuggaccuauaacuacac

SEQ ID NO: 27376 - RNA, 25 nt, Human
uccauuucuuaacagucuccaaucc

SEQ ID NO: 27377 - RNA, 27 nt, Human
ucauagaccaagucccgggggucucca

SEQ ID NO: 27378 - RNA, 22 nt, Human
aaagggcagguugucuucaaac

SEQ ID NO: 27379 - RNA, 29 nt, Human
ccaacuggaacugugccuuuucucuuguc

SEQ ID NO: 27380 - RNA, 21 nt, Human
cuuguuccugugcccucuugu

SEQ ID NO: 27381 - RNA, 21 nt, Human
ugggcacacagauaagcugcc

SEQ ID NO: 27382 - RNA, 22 nt, Human
ccaaagugcugggauuacggac

SEQ ID NO: 27383 - RNA, 22 nt, Human
ccaaggugcuaggauuacaggc

SEQ ID NO: 27384 - RNA, 19 nt, Human
guccaggcuagagugcagu

SEQ ID NO: 27385 - RNA, 21 nt, Human
ggccucccaagugcugggauu

SEQ ID NO: 27386 - RNA, 20 nt, Human
agauuauacuuucaauucag

SEQ ID NO: 27387 - RNA, 27 nt, Human
gcgcagccacauuuaccauguggggcu

SEQ ID NO: 27388 - RNA, 25 nt, Human
ggagcaguucagaguggaggcgggc

SEQ ID NO: 27389 - RNA, 27 nt, Human
gucacccaaggcugguggucaguguga

SEQ ID NO: 27390 - RNA, 21 nt, Human
ggcugagauuuuggaacuagc

SEQ ID NO: 27391 - RNA, 23 nt, Human
cucuccaaacauguaggaggaaa

SEQ ID NO: 27392 - RNA, 22 nt, Human
cacccauucuccucaucccucu

SEQ ID NO: 27393 - RNA, 21 nt, Human
ggggcacccagcggaaugugc

SEQ ID NO: 27394 - RNA, 23 nt, Human
ccugcucugagagcaccacgcac

SEQ ID NO: 27395 - RNA, 24 nt, Human
caggacguuuguugaacaaaacug

SEQ ID NO: 27396 - RNA, 22 nt, Human
ccagcuggguccaacacuuguu

SEQ ID NO: 27397 - RNA, 22 nt, Human
gagcauccuggccaacauggug

SEQ ID NO: 27398 - RNA, 24 nt, Human
gggggaggggcgacaguagugagc

SEQ ID NO: 27399 - RNA, 26 nt, Human
acagagggagagguucaggagucagg

SEQ ID NO: 27400 - RNA, 23 nt, Human
ccuccagggagccuagaagcugg

SEQ ID NO: 27401 - RNA, 23 nt, Human
agucucucaaaagacuuuguugu

SEQ ID NO: 27402 - RNA, 23 nt, Human
cugggcccguggagcagcagugu

SEQ ID NO: 27403 - RNA, 27 nt, Human
gaccgaggcacagaggugcggugacuu

SEQ ID NO: 27404 - RNA, 26 nt, Human
cccaccccacuccaacaguuccucuu

SEQ ID NO: 27405 - RNA, 19 nt, Human
gcagauacugucucuuuca

SEQ ID NO: 27406 - RNA, 29 nt, Human
gccuuucaggaugaugguagagcaauauu

SEQ ID NO: 27407 - RNA, 22 nt, Human
cacccaaguuggagugcagugg

SEQ ID NO: 27408 - RNA, 20 nt, Human
gaaauaucacugacacucca

SEQ ID NO: 27409 - RNA, 27 nt, Human
cugcccaccagcuggccucaccuccug

SEQ ID NO: 27410 - RNA, 22 nt, Human
ugagagaagaaggaagaaucag

SEQ ID NO: 27411 - RNA, 25 nt, Human
cucgcccaggcuggagugcaacggu

SEQ ID NO: 27412 - RNA, 25 nt, Human
gccuuuuuucucccuuucguuuacc

SEQ ID NO: 27413 - RNA, 22 nt, Human
agcaaaguacacccauuauuua

SEQ ID NO: 27414 - RNA, 22 nt, Human
uuaaguaccaaaaugcauacca

SEQ ID NO: 27415 - RNA, 19 nt, Human
aagcuuaucuuagagccac

SEQ ID NO: 27416 - RNA, 21 nt, Human
cgaugcagacagggggccaga

SEQ ID NO: 27417 - RNA, 21 nt, Human
ggcuuuguauagaaccucuuu

SEQ ID NO: 27418 - RNA, 24 nt, Human
agggucugaguccucgucccagga

SEQ ID NO: 27419 - RNA, 20 nt, Human
uaacugauagaugcauuaga

SEQ ID NO: 27420 - RNA, 22 nt, Human
ugagaucauaccacuucauucc

SEQ ID NO: 27421 - RNA, 19 nt, Human
guuaacugcaaccuuguuu

SEQ ID NO: 27422 - RNA, 18 nt, Human
gucuuccuggaaguaauu

SEQ ID NO: 27423 - RNA, 23 nt, Human
uggaaccuagagcuggagugagg

SEQ ID NO: 27424 - RNA, 26 nt, Human
agaacaaugcucuguuugggcuggau

SEQ ID NO: 27425 - RNA, 20 nt, Human
agacaguggcaaaaugaaga

SEQ ID NO: 27426 - RNA, 22 nt, Human
ugcuugucaccagcacaccugu

SEQ ID NO: 27427 - RNA, 28 nt, Human
ccuccacucagcacucuggacuccacga

SEQ ID NO: 27428 - RNA, 22 nt, Human
uagauuuugcuuggguuuucuu

SEQ ID NO: 27429 - RNA, 23 nt, Human
agcaugcaaucauuuccaucuua

SEQ ID NO: 27430 - RNA, 24 nt, Human
ccacccaggccuggagcugggaug

SEQ ID NO: 27431 - RNA, 30 nt, Human
cccagcuucaguucaugaauacuccuguuc

SEQ ID NO: 27432 - RNA, 20 nt, Human
ucaaacgaaaaaucaguccu

SEQ ID NO: 27433 - RNA, 21 nt, Human
ugcccaggcuggaguacagug

SEQ ID NO: 27434 - RNA, 21 nt, Human
cucuccucgacaagucaugcu

SEQ ID NO: 27435 - RNA, 22 nt, Human
augaagagacuuaagaaagcuu

SEQ ID NO: 27436 - RNA, 24 nt, Human
cucucaucucacacugugagucca

SEQ ID NO: 27437 - RNA, 23 nt, Human
uuccauggagaauauguggcaug

SEQ ID NO: 27438 - RNA, 19 nt, Human
cacuucugugggagccgug

SEQ ID NO: 27439 - RNA, 31 nt, Human
uucugcuacuccccagaccucagggacaacu

SEQ ID NO: 27440 - RNA, 24 nt, Human
ucagcucuguacacaugauaugca

SEQ ID NO: 27441 - RNA, 27 nt, Human
uuucugcuguaguuggauuugcccaua

SEQ ID NO: 27442 - RNA, 23 nt, Human
ugugucaucuagcauuagguaua

SEQ ID NO: 27443 - RNA, 23 nt, Human
acuuugaccccaguuccuugcca

SEQ ID NO: 27444 - RNA, 24 nt, Human
gcguaaucucggcucacugcaagc

SEQ ID NO: 27445 - RNA, 20 nt, Human
aauuguaacaaaaaugacua

SEQ ID NO: 27446 - RNA, 26 nt, Human
uucccagggcaauaaaaugaccaugg

SEQ ID NO: 27447 - RNA, 24 nt, Human
cugcccaggcaaggaacagaagug

SEQ ID NO: 27448 - RNA, 19 nt, Human
caaggccugaaggccccgg

SEQ ID NO: 27449 - RNA, 23 nt, Human
uggagagaaaagagaaugcugaa

SEQ ID NO: 27450 - RNA, 27 nt, Human
aggcugagguuaaggucuuagagccga

SEQ ID NO: 27451 - RNA, 23 nt, Human
ugggaaacacgacucgugguucu

SEQ ID NO: 27452 - RNA, 20 nt, Human
uguggagggcagcuguggcu

SEQ ID NO: 27453 - RNA, 25 nt, Human
gcucacugcagugcugauguauuuc

SEQ ID NO: 27454 - RNA, 22 nt, Human
ugguuuguuccuucuccuugcc

SEQ ID NO: 27455 - RNA, 24 nt, Human
agggugacagggacacaacauggc

SEQ ID NO: 27456 - RNA, 27 nt, Human
gucagccaggcugcccuuaucagcugu

SEQ ID NO: 27457 - RNA, 22 nt, Human
gugcuccucccgcccuuuugga

SEQ ID NO: 27458 - RNA, 19 nt, Human
accgggcuggagugcagug

SEQ ID NO: 27459 - RNA, 20 nt, Human
cccucauuguguuucuaccg

SEQ ID NO: 27460 - RNA, 23 nt, Human
ugugaguggcuaugauccuaguu

SEQ ID NO: 27461 - RNA, 22 nt, Human
uacuggagauuucccuccugga

SEQ ID NO: 27462 - RNA, 22 nt, Human
aaugcaaaagcaagagugcaau

SEQ ID NO: 27463 - RNA, 22 nt, Human
caauccuuccagccaccugccu

SEQ ID NO: 27464 - RNA, 22 nt, Human
gaccagccugggcaacauggcg

SEQ ID NO: 27465 - RNA, 21 nt, Human
gggccacugacccaccugcgc

SEQ ID NO: 27466 - RNA, 22 nt, Human
aggcugagacaggagaaacacu

SEQ ID NO: 27467 - RNA, 23 nt, Human
ccuccaucuuacacguguuuccg

SEQ ID NO: 27468 - RNA, 20 nt, Human
cuguugcccaugcuggaggg

SEQ ID NO: 27469 - RNA, 26 nt, Human
uccaggccuuuccuuccuggagccac

SEQ ID NO: 27470 - RNA, 25 nt, Human
acgagcccuccuucuauaccugcuc

SEQ ID NO: 27471 - RNA, 22 nt, Human
cucuccaggcuggagugcagug

SEQ ID NO: 27472 - RNA, 23 nt, Human
ucuccaucuacuuuuugucacca

SEQ ID NO: 27473 - RNA, 23 nt, Human
gugcccccacacccaccuacccu

SEQ ID NO: 27474 - RNA, 27 nt, Human
cacugcucuccagccugggaggcacag

SEQ ID NO: 27475 - RNA, 23 nt, Human
aaucauaauugccgucuggacca

SEQ ID NO: 27476 - RNA, 20 nt, Human
gagggagggcuggggcuggc

SEQ ID NO: 27477 - RNA, 22 nt, Human
auauguugcuuugaaaaagccu

SEQ ID NO: 27478 - RNA, 24 nt, Human
ucuuuuuuguguuucucuaaaguc

SEQ ID NO: 27479 - RNA, 27 nt, Human
ccugcugcucugccccaacgcgaccgc

SEQ ID NO: 27480 - RNA, 26 nt, Human
ggggagccucacagcagccacgcagc

SEQ ID NO: 27481 - RNA, 26 nt, Human
uuccccagccucaguucacagcugcc

SEQ ID NO: 27482 - RNA, 21 nt, Human
ggaacaacucuccagugccug

SEQ ID NO: 27483 - RNA, 27 nt, Human
ggaaaguucuugacagagucugugucc

SEQ ID NO: 27484 - RNA, 29 nt, Human
aaucggggcgacaauagcucacugccuac

SEQ ID NO: 27485 - RNA, 21 nt, Human
cugccuauuuuuccucuuguu

SEQ ID NO: 27486 - RNA, 22 nt, Human
guggcucucaguuaaaauguga

SEQ ID NO: 27487 - RNA, 22 nt, Human
cuccuccugccugucugcacua

SEQ ID NO: 27488 - RNA, 25 nt, Human
caccuucugccuuuguccugcuccc

SEQ ID NO: 27489 - RNA, 20 nt, Human
aacuguuuuccacagcaguu

SEQ ID NO: 27490 - RNA, 20 nt, Human
cugcaacccacccaaggagg

SEQ ID NO: 27491 - RNA, 20 nt, Human
gucaugagauccuacuuagu

SEQ ID NO: 27492 - RNA, 24 nt, Human
ccugcugccugcccaaacacccca

SEQ ID NO: 27493 - RNA, 24 nt, Human
auuccuauauaauuccuggacugg

SEQ ID NO: 27494 - RNA, 27 nt, Human
ugcuauccauugauguauacaaguacc

SEQ ID NO: 27495 - RNA, 24 nt, Human
cccccaggacccaggaucuucucc

SEQ ID NO: 27496 - RNA, 23 nt, Human
acugcccaggcuauggggacaaa

SEQ ID NO: 27497 - RNA, 21 nt, Human
cucuucuggauuugucccaug

SEQ ID NO: 27498 - RNA, 27 nt, Human
gucugaagcugcugggcucaagcaauc

SEQ ID NO: 27499 - RNA, 25 nt, Human
gcagaccugcccugccucaguugga

SEQ ID NO: 27500 - RNA, 24 nt, Human
caggacccaaacccagacacuuca

SEQ ID NO: 27501 - RNA, 26 nt, Human
guccaggcuacucacuuuagugacua

SEQ ID NO: 27502 - RNA, 26 nt, Human
cagaacugugugugcgggacagggug

SEQ ID NO: 27503 - RNA, 21 nt, Human
uugccuccccucggauuugga

SEQ ID NO: 27504 - RNA, 27 nt, Human
agcaaaacuacacagucuugacugugu

SEQ ID NO: 27505 - RNA, 23 nt, Human
uuuaaauuggaauccuaaccuua

SEQ ID NO: 27506 - RNA, 27 nt, Human
gcacaucuccaggucuccaugugcaca

SEQ ID NO: 27507 - RNA, 21 nt, Human
ggaguaagugccuugcguggg

SEQ ID NO: 27508 - RNA, 23 nt, Human
agagaggaaggagguggagcagc

SEQ ID NO: 27509 - RNA, 22 nt, Human
uuuaaaaaugguggcuucagcu

SEQ ID NO: 27510 - RNA, 21 nt, Human
uugcuacccucuugagcagcu

SEQ ID NO: 27511 - RNA, 22 nt, Human
ugcuuuuaaucucaaaauucug

SEQ ID NO: 27512 - RNA, 22 nt, Human
cccagaucgcgccauugcacuc

SEQ ID NO: 27513 - RNA, 26 nt, Human
gcucacugacacucuguaaaggccaa

SEQ ID NO: 27514 - RNA, 20 nt, Human
uuauccuuauuccucccccg

SEQ ID NO: 27515 - RNA, 22 nt, Human
gggauuacaggugugagcuacu

SEQ ID NO: 27516 - RNA, 22 nt, Human
cgggguuggggacagagcaggu

SEQ ID NO: 27517 - RNA, 20 nt, Human
ucuguguccuugcugccuuc

SEQ ID NO: 27518 - RNA, 24 nt, Human
agaccugauugagccuuugcagca

SEQ ID NO: 27519 - RNA, 19 nt, Human
ccagcacuuugggaggccg

SEQ ID NO: 27520 - RNA, 21 nt, Human
uucacuacauuuuucuuugca

SEQ ID NO: 27521 - RNA, 23 nt, Human
ugggagccacuggguggaggggc

SEQ ID NO: 27522 - RNA, 22 nt, Human
gggugccugcuguuucugcugc

SEQ ID NO: 27523 - RNA, 20 nt, Human
gccuugcccuggcugaggga

SEQ ID NO: 27524 - RNA, 20 nt, Human
uggguuacagccacagcagg

SEQ ID NO: 27525 - RNA, 22 nt, Human
ggcuugcaugauggugguagag

SEQ ID NO: 27526 - RNA, 21 nt, Human
uaucuauucaauuucucaguu

SEQ ID NO: 27527 - RNA, 22 nt, Human
ugugagccauggugcccggcua

SEQ ID NO: 27528 - RNA, 21 nt, Human
auuacaccagccucgucuuca

SEQ ID NO: 27529 - RNA, 22 nt, Human
acaucuguaaccccagcacuuu

SEQ ID NO: 27530 - RNA, 27 nt, Human
uggagaaacaccuugguuucuaggaug

SEQ ID NO: 27531 - RNA, 22 nt, Human
aaagugcugggauuacaggcgg

SEQ ID NO: 27532 - RNA, 22 nt, Human
aaagugcugggaugacaggcgu

SEQ ID NO: 27533 - RNA, 21 nt, Human
accuguaauuccagcacuuca

SEQ ID NO: 27534 - RNA, 21 nt, Human
accucauaucuuccucaucag

SEQ ID NO: 27535 - RNA, 26 nt, Human
cugaaaacuucauucuuggguuaaca

SEQ ID NO: 27536 - RNA, 19 nt, Human
ccugagccaccaccgagcc

SEQ ID NO: 27537 - RNA, 22 nt, Human
aaagugcugaauuuacaguagu

SEQ ID NO: 27538 - RNA, 22 nt, Human
cgcggcggaagagcgcgcgcca

SEQ ID NO: 27539 - RNA, 27 nt, Human
ggaggggggagccagaggccaggaugc

SEQ ID NO: 27540 - RNA, 23 nt, Human
aggccccgcccgucucugcucug

SEQ ID NO: 27541 - RNA, 21 nt, Human
ugagcucucacucagugccuu

SEQ ID NO: 27542 - RNA, 25 nt, Human
ggacuccugagcucugccucuucca

SEQ ID NO: 27543 - RNA, 25 nt, Human
gcguugagccaccaagcugguggcu

SEQ ID NO: 27544 - RNA, 15 nt, Human
cuucccuuucauccg

SEQ ID NO: 27545 - RNA, 21 nt, Human
gcaguguccagaaccuuuuug

SEQ ID NO: 27546 - RNA, 24 nt, Human
ccuggaccucuuugcucguccuuc

SEQ ID NO: 27547 - RNA, 22 nt, Human
gcucacugcaguuucaaguucc

SEQ ID NO: 27548 - RNA, 26 nt, Human
cccucggggccuccagcgccggcucu

SEQ ID NO: 27549 - RNA, 21 nt, Human
cuguaggagcaagggcacaaa

SEQ ID NO: 27550 - RNA, 21 nt, Human
ggcauuucagaguguuggaga

SEQ ID NO: 27551 - RNA, 22 nt, Human
gaccagccuggccaauguggug

SEQ ID NO: 27552 - RNA, 27 nt, Human
uccucccagggaaucacuacaggcugg

SEQ ID NO: 27553 - RNA, 22 nt, Human
ucaagaagcacaucaucaccaa

SEQ ID NO: 27554 - RNA, 21 nt, Human
caugagacgcuacugcagcuu

SEQ ID NO: 27555 - RNA, 21 nt, Human
uugagaguauauggggaccag

SEQ ID NO: 27556 - RNA, 20 nt, Human
uccuagaguuugcagcuggu

SEQ ID NO: 27557 - RNA, 22 nt, Human
accuguaaucccagcuacgugg

SEQ ID NO: 27558 - RNA, 27 nt, Human
cuaauguuauuucuuaaaauucaguga

SEQ ID NO: 27559 - RNA, 18 nt, Human
cgggagguugaggcagga

SEQ ID NO: 27560 - RNA, 23 nt, Human
ucucugcaugaucuuguugaggc

SEQ ID NO: 27561 - RNA, 21 nt, Human
gccagccaggagcgcugcaug

SEQ ID NO: 27562 - RNA, 25 nt, Human
cacugccucgcagaguggccugggc

SEQ ID NO: 27563 - RNA, 24 nt, Human
aggaauuuggcuguggaguaagag

SEQ ID NO: 27564 - RNA, 22 nt, Human
cuuaaaaaauucauugcucuac

SEQ ID NO: 27565 - RNA, 24 nt, Human
gauaucaaaauguauuuugugaug

SEQ ID NO: 27566 - RNA, 23 nt, Human
agauguucaugguaaaaguacug

SEQ ID NO: 27567 - RNA, 21 nt, Human
aacacagccccauggccucug

SEQ ID NO: 27568 - RNA, 23 nt, Human
aauacuucgaugaugaugaugau

SEQ ID NO: 27569 - RNA, 28 nt, Human
uccuaccuggucccaucugccucuuuuc

SEQ ID NO: 27570 - RNA, 26 nt, Human
caauugccucuugcaggcugaguccc

SEQ ID NO: 27571 - RNA, 27 nt, Human
ucgcccaggcuggagugcagucgugcc

SEQ ID NO: 27572 - RNA, 24 nt, Human
cauggauggccauccaguccugag

SEQ ID NO: 27573 - RNA, 21 nt, Human
ucuguaaauguuccuuuccuu

SEQ ID NO: 27574 - RNA, 19 nt, Human
cuccaucugagcaaguaca

SEQ ID NO: 27575 - RNA, 26 nt, Human
gcucugacccucuccugggcauuggu

SEQ ID NO: 27576 - RNA, 28 nt, Human
gucacauugcaagugagugcaggaguga

SEQ ID NO: 27577 - RNA, 25 nt, Human
ccucuucuuuucccugcugccacuu

SEQ ID NO: 27578 - RNA, 19 nt, Human
ggggugagaagacagcaag

SEQ ID NO: 27579 - RNA, 23 nt, Human
agccaagagaaggcugaagccag

SEQ ID NO: 27580 - RNA, 22 nt, Human
uauuauggucuuugugcacauu

SEQ ID NO: 27581 - RNA, 21 nt, Human
cucagacaccaucaugaaaua

SEQ ID NO: 27582 - RNA, 22 nt, Human
acccauccagcugucaugguau

SEQ ID NO: 27583 - RNA, 25 nt, Human
agccuccugaguagcuaggacugca

SEQ ID NO: 27584 - RNA, 25 nt, Human
acauguguggauguguaaauggagc

SEQ ID NO: 27585 - RNA, 29 nt, Human
uccuggcagugccucugcugugcugcaca

SEQ ID NO: 27586 - RNA, 23 nt, Human
uugcagacuuuuaaauagaugac

SEQ ID NO: 27587 - RNA, 21 nt, Human
accaaauucagccuacugccu

SEQ ID NO: 27588 - RNA, 22 nt, Human
cugugaacccugugccuguguu

SEQ ID NO: 27589 - RNA, 20 nt, Human
aucgcuuccucucgcaacaa

SEQ ID NO: 27590 - RNA, 22 nt, Human
uggaccaccucccgcugcguuu

SEQ ID NO: 27591 - RNA, 22 nt, Human
uugugagagacacuguaaacga

SEQ ID NO: 27592 - RNA, 25 nt, Human
cccuuuauccuuacagguugacaua

SEQ ID NO: 27593 - RNA, 23 nt, Human
cuccugagggcuccaugcugaag

SEQ ID NO: 27594 - RNA, 23 nt, Human
aaaucacuggcaaaggguacccc

SEQ ID NO: 27595 - RNA, 26 nt, Human
uuguguaucauaugugauuuugaaau

SEQ ID NO: 27596 - RNA, 26 nt, Human
acugggagggggugggggaucugggc

SEQ ID NO: 27597 - RNA, 22 nt, Human
ccugaagccuuugcauuuugga

SEQ ID NO: 27598 - RNA, 23 nt, Human
agggugaggccaggcaggccugg

SEQ ID NO: 27599 - RNA, 21 nt, Human
uguuuacaugcagauuuuugu

SEQ ID NO: 27600 - RNA, 18 nt, Human
gcaugaaagcauucuucc

SEQ ID NO: 27601 - RNA, 23 nt, Human
aggcuguaaguuccacugcucca

SEQ ID NO: 27602 - RNA, 23 nt, Human
cuacaggcgccagccaccaugcc

SEQ ID NO: 27603 - RNA, 32 nt, Human
gccucauaucaaucccugucauaaaccaggca

SEQ ID NO: 27604 - RNA, 19 nt, Human
ucuuuucccucccucucuc

SEQ ID NO: 27605 - RNA, 29 nt, Human
gcaugugacucaccccugcccuugguuuc

SEQ ID NO: 27606 - RNA, 27 nt, Human
cgacucgcgcucucggcuucugcuccg

SEQ ID NO: 27607 - RNA, 25 nt, Human
ugaacugaaguuucacaugagcuau

SEQ ID NO: 27608 - RNA, 19 nt, Human
ucugccuucacagugcagu

SEQ ID NO: 27609 - RNA, 26 nt, Human
gcugccggaggagaccccacuaaccc

SEQ ID NO: 27610 - RNA, 21 nt, Human
acaguuccaaucaguagcuua

SEQ ID NO: 27611 - RNA, 19 nt, Human
gcacagaagcacaugcacc

SEQ ID NO: 27612 - RNA, 27 nt, Human
ugaaguugacuugcuccaagcugcagu

SEQ ID NO: 27613 - RNA, 24 nt, Human
uaucauugcuguggaaaaaucucu

SEQ ID NO: 27614 - RNA, 21 nt, Human
aacaggcaucugccaugcugg

SEQ ID NO: 27615 - RNA, 18 nt, Human
agcgagccggugcugcug

SEQ ID NO: 27616 - RNA, 22 nt, Human
cauucaugcuuagaguccugcc

SEQ ID NO: 27617 - RNA, 20 nt, Human
cucccucugcuguccucccc

SEQ ID NO: 27618 - RNA, 24 nt, Human
guaaagaacgcgacuuccacaaac

SEQ ID NO: 27619 - RNA, 26 nt, Human
acuuccagauccuggaaaucaggguu

SEQ ID NO: 27620 - RNA, 20 nt, Human
uugcacaggcuggcugcgug

SEQ ID NO: 27621 - RNA, 21 nt, Human
auuuuuuauuguuuucaucug

SEQ ID NO: 27622 - RNA, 21 nt, Human
cacuguguucacacgcauggu

SEQ ID NO: 27623 - RNA, 24 nt, Human
ggauucuugaacaaacuggaaagu

SEQ ID NO: 27624 - RNA, 23 nt, Human
gucuugucuucucauuuuauuga

SEQ ID NO: 27625 - RNA, 18 nt, Human
cuacaucuucucucuucc

SEQ ID NO: 27626 - RNA, 20 nt, Human
ggaggcugagucgcaggaca

SEQ ID NO: 27627 - RNA, 22 nt, Human
gcuccaggauucugcggcucgg

SEQ ID NO: 27628 - RNA, 22 nt, Human
cugagccucaccuuuccugccg

SEQ ID NO: 27629 - RNA, 20 nt, Human
guuuuccuaugcuuugaaac

SEQ ID NO: 27630 - RNA, 22 nt, Human
cacuccugugcccucugccugg

SEQ ID NO: 27631 - RNA, 27 nt, Human
aaguccccgggaaggagcaugacaaga

SEQ ID NO: 27632 - RNA, 26 nt, Human
ggcaggggaaacucuggugccgggga

SEQ ID NO: 27633 - RNA, 21 nt, Human
aaccccccagccucuccccaa

SEQ ID NO: 27634 - RNA, 25 nt, Human
gcauuugcccauauagugcucuuua

SEQ ID NO: 27635 - RNA, 22 nt, Human
acagcccagcaagaaggaggag

SEQ ID NO: 27636 - RNA, 22 nt, Human
ucccaaaccaaagcaucauuca

SEQ ID NO: 27637 - RNA, 31 nt, Human
ucuucuuucuuucuuaagcccuuugcucugg

SEQ ID NO: 27638 - RNA, 26 nt, Human
uucagggcaucuugaaaugucccgcu

SEQ ID NO: 27639 - RNA, 21 nt, Human
aucuguguuuuuguuucuggc

SEQ ID NO: 27640 - RNA, 22 nt, Human
uacagaagaaaagcaaaugacu

SEQ ID NO: 27641 - RNA, 22 nt, Human
ucagggcacaaagaugggugaa

SEQ ID NO: 27642 - RNA, 16 nt, Human
ggcugaaggaucccag

SEQ ID NO: 27643 - RNA, 29 nt, Human
acaggcccagucccugagcccaugaggag

SEQ ID NO: 27644 - RNA, 22 nt, Human
ccaccuucccuccucuccagcc

SEQ ID NO: 27645 - RNA, 27 nt, Human
ggagaaaauaauccagucuucacuggg

SEQ ID NO: 27646 - RNA, 23 nt, Human
uucagcaccuuguacauauauca

SEQ ID NO: 27647 - RNA, 21 nt, Human
agaggcuggaggaacaacugg

SEQ ID NO: 27648 - RNA, 23 nt, Human
acucuucagacugugauauugug

SEQ ID NO: 27649 - RNA, 28 nt, Human
ucucgaacuucugaccucaggugaucug

SEQ ID NO: 27650 - RNA, 23 nt, Human
gggcagcuacagaggagggucau

SEQ ID NO: 27651 - RNA, 22 nt, Human
gccaucacuuaccuugcacuga

SEQ ID NO: 27652 - RNA, 24 nt, Human
ggccacauggacuggggugcaaug

SEQ ID NO: 27653 - RNA, 22 nt, Human
ccucacgccuguaaucccagca

SEQ ID NO: 27654 - RNA, 24 nt, Human
cucuugcuaucaacucgccgcaug

SEQ ID NO: 27655 - RNA, 22 nt, Human
gcagauuuagagaacauuggcu

SEQ ID NO: 27656 - RNA, 22 nt, Human
gauauuuuuaaaccaugcucug

SEQ ID NO: 27657 - RNA, 27 nt, Human
caggaggcggagguugcaguaagccaa

SEQ ID NO: 27658 - RNA, 18 nt, Human
gucuccuccugaccccag

SEQ ID NO: 27659 - RNA, 24 nt, Human
cuccgaaucccuagucaacuggag

SEQ ID NO: 27660 - RNA, 22 nt, Human
ccaggaggucaaggcugcagug

SEQ ID NO: 27661 - RNA, 22 nt, Human
cugggaggucgaggcuguagug

SEQ ID NO: 27662 - RNA, 27 nt, Human
agcuuucgcuccuucuccaagacucag

SEQ ID NO: 27663 - RNA, 21 nt, Human
cucuaaguuccacugagcucc

SEQ ID NO: 27664 - RNA, 25 nt, Human
acccaggcuggagugcaguggcacg

SEQ ID NO: 27665 - RNA, 24 nt, Human
gucaccucccaccucuugccaccu

SEQ ID NO: 27666 - RNA, 25 nt, Human
ucaagaccauccagaaaugauauga

SEQ ID NO: 27667 - RNA, 21 nt, Human
ugccaacaagcugaaacccca

SEQ ID NO: 27668 - RNA, 26 nt, Human
gggagagacagagggagagugugcau

SEQ ID NO: 27669 - RNA, 24 nt, Human
agucaacauuuaugaaauauugcc

SEQ ID NO: 27670 - RNA, 21 nt, Human
aaacucauuuuuccuucuuca

SEQ ID NO: 27671 - RNA, 23 nt, Human
gaauccaccugcaauuccuggcu

SEQ ID NO: 27672 - RNA, 22 nt, Human
agaggaggagagaaguggccag

SEQ ID NO: 27673 - RNA, 23 nt, Human
ggugccuugcauuucaaaaacac

SEQ ID NO: 27674 - RNA, 23 nt, Human
uauucccuuuuaugcuaugauuu

SEQ ID NO: 27675 - RNA, 27 nt, Human
uccucaaggaagcuucugucaugaaag

SEQ ID NO: 27676 - RNA, 26 nt, Human
ugauuggccccacugacguuggccua

SEQ ID NO: 27677 - RNA, 21 nt, Human
ggcuguggcucugagugcaaa

SEQ ID NO: 27678 - RNA, 22 nt, Human
cccaaguagcugagacuacagg

SEQ ID NO: 27679 - RNA, 27 nt, Human
ggggagggagagaacuacgagaccuca

SEQ ID NO: 27680 - RNA, 20 nt, Human
cuuuucuguucacucacaca

SEQ ID NO: 27681 - RNA, 23 nt, Human
uuccaggauuuguuuucagaaac

SEQ ID NO: 27682 - RNA, 19 nt, Human
uagacuucuuugaaauuca

SEQ ID NO: 27683 - RNA, 26 nt, Human
gaggauugccugaggccaggaguuug

SEQ ID NO: 27684 - RNA, 20 nt, Human
uuugaggcagguuucuagga

SEQ ID NO: 27685 - RNA, 21 nt, Human
gucaaacuuagggggcaggca

SEQ ID NO: 27686 - RNA, 25 nt, Human
cuguaaccccaucuucucugaguac

SEQ ID NO: 27687 - RNA, 22 nt, Human
ccaccauucucuucucuacuuc

SEQ ID NO: 27688 - RNA, 17 nt, Human
gacagucgggaucuuuu

SEQ ID NO: 27689 - RNA, 18 nt, Human
uccucacuugcccagaaa

SEQ ID NO: 27690 - RNA, 27 nt, Human
ggugaccauaagucucccaaacagcca

SEQ ID NO: 27691 - RNA, 21 nt, Human
acacuacccuccaaucuugca

SEQ ID NO: 27692 - RNA, 22 nt, Human
gccgcucauccaaaugcugcug

SEQ ID NO: 27693 - RNA, 25 nt, Human
uugucuucuguuguccacagccaga

SEQ ID NO: 27694 - RNA, 26 nt, Human
cgcuccaccuugcagcucuccccuuc

SEQ ID NO: 27695 - RNA, 21 nt, Human
uuugagacuuuuugguggaug

SEQ ID NO: 27696 - RNA, 26 nt, Human
ggagccucuucugccaagagagggcc

SEQ ID NO: 27697 - RNA, 22 nt, Human
gccagccacagcugcugccucc

SEQ ID NO: 27698 - RNA, 21 nt, Human
ugugggguguuagugccaaac

SEQ ID NO: 27699 - RNA, 22 nt, Human
aucacuugaacccaggaggugg

SEQ ID NO: 27700 - RNA, 23 nt, Human
gccauccgggggcaaccaugccg

SEQ ID NO: 27701 - RNA, 20 nt, Human
ugcccugcugacgugacuga

SEQ ID NO: 27702 - RNA, 29 nt, Human
uuucacaugauacauuuaggguaugcagc

SEQ ID NO: 27703 - RNA, 23 nt, Human
ugcagucaucucuuugcacuuug

SEQ ID NO: 27704 - RNA, 22 nt, Human
ggugcucuccugcuguguggcu

SEQ ID NO: 27705 - RNA, 20 nt, Human
agaaaggggcagggagggga

SEQ ID NO: 27706 - RNA, 20 nt, Human
ggaggaggagagaaaggcgg

SEQ ID NO: 27707 - RNA, 23 nt, Human
uuuguucuuccccacaauuccau

SEQ ID NO: 27708 - RNA, 23 nt, Human
gccuccaaggaggggcuguaaaa

SEQ ID NO: 27709 - RNA, 21 nt, Human
ugagguaccuuacccaccuca

SEQ ID NO: 27710 - RNA, 22 nt, Human
cucaggagucugacuccugggu

SEQ ID NO: 27711 - RNA, 25 nt, Human
aauacaaaauccaggcgugguggca

SEQ ID NO: 27712 - RNA, 23 nt, Human
uaagaggaaugaacgugucugca

SEQ ID NO: 27713 - RNA, 24 nt, Human
ucugccuugucucucuuugucuua

SEQ ID NO: 27714 - RNA, 21 nt, Human
uuccaaauguauaccuuugag

SEQ ID NO: 27715 - RNA, 27 nt, Human
uguuguuguguugagauccagugcagu

SEQ ID NO: 27716 - RNA, 22 nt, Human
aggacucuugacugcagguucc

SEQ ID NO: 27717 - RNA, 23 nt, Human
uggccucaugccuauaaucccag

SEQ ID NO: 27718 - RNA, 21 nt, Human
acucuccaggcuggagugcag

SEQ ID NO: 27719 - RNA, 31 nt, Human
ccucuugauaguccugaccucaugaucugcc

SEQ ID NO: 27720 - RNA, 21 nt, Human
acugcaaccuccacccccggg

SEQ ID NO: 27721 - RNA, 20 nt, Human
ccgacagaaacgcagcagau

SEQ ID NO: 27722 - RNA, 20 nt, Human
cagcugggagccugcuuucu

SEQ ID NO: 27723 - RNA, 27 nt, Human
ucugggagggccaguuccacauugagc

SEQ ID NO: 27724 - RNA, 26 nt, Human
ugcgucuccccugcccuccuggagcc

SEQ ID NO: 27725 - RNA, 24 nt, Human
ccccccggugugggaaccagcacc

SEQ ID NO: 27726 - RNA, 23 nt, Human
aggcauucacugaccaggccuuu

SEQ ID NO: 27727 - RNA, 27 nt, Human
uuccagccuuggagcccuucugucucu

SEQ ID NO: 27728 - RNA, 22 nt, Human
ucauugugcaugcauccaguga

SEQ ID NO: 27729 - RNA, 22 nt, Human
ccuccucccucccauccucacc

SEQ ID NO: 27730 - RNA, 18 nt, Human
guccccuucuccaucgcc

SEQ ID NO: 27731 - RNA, 19 nt, Human
cucccucagggccuguguu

SEQ ID NO: 27732 - RNA, 22 nt, Human
ucuauacaaagcuacuauuauc

SEQ ID NO: 27733 - RNA, 20 nt, Human
gaugcuguccagaacuggga

SEQ ID NO: 27734 - RNA, 20 nt, Human
auuugcuuccugaguaagug

SEQ ID NO: 27735 - RNA, 21 nt, Human
ggccuguaaucccagcacuuu

SEQ ID NO: 27736 - RNA, 26 nt, Human
uuuuccuuuuauaauuugcuuauugc

SEQ ID NO: 27737 - RNA, 22 nt, Human
acggaugcugguggacugugug

SEQ ID NO: 27738 - RNA, 22 nt, Human
uauuucuuaagccauagucagu

SEQ ID NO: 27739 - RNA, 24 nt, Human
cucauucuuuuuucuauuaagcca

SEQ ID NO: 27740 - RNA, 20 nt, Human
gaauugauccccagaagaac

SEQ ID NO: 27741 - RNA, 19 nt, Human
uagacacaccagcuccugu

SEQ ID NO: 27742 - RNA, 23 nt, Human
uucuauacaacaaauguuucuuc

SEQ ID NO: 27743 - RNA, 21 nt, Human
ugaccuuuauucaagagacca

SEQ ID NO: 27744 - RNA, 22 nt, Human
agguaauuuuuuaaaagccagu

SEQ ID NO: 27745 - RNA, 21 nt, Human
ucaaaauugcuucuaaaacaa

SEQ ID NO: 27746 - RNA, 20 nt, Human
gucagugcgcugcucuccag

SEQ ID NO: 27747 - RNA, 23 nt, Human
ugggagggagaaggaguuggagc

SEQ ID NO: 27748 - RNA, 25 nt, Human
ucucaagugcuucagucuuugguuu

SEQ ID NO: 27749 - RNA, 22 nt, Human
gcuguucuuuacuuuacugccu

SEQ ID NO: 27750 - RNA, 24 nt, Human
aggcuacaacaaaaaucaccaucu

SEQ ID NO: 27751 - RNA, 24 nt, Human
agcuauguacagggagagcauuuu

SEQ ID NO: 27752 - RNA, 24 nt, Human
ucuggagaggcucacugggguucu

SEQ ID NO: 27753 - RNA, 20 nt, Human
cccuuccccacacagcccca

SEQ ID NO: 27754 - RNA, 21 nt, Human
ugugugacuuaugacucucug

SEQ ID NO: 27755 - RNA, 27 nt, Human
uugcccuuuugauucuuccacaaucag

SEQ ID NO: 27756 - RNA, 22 nt, Human
gaggcugcuucccagaggagca

SEQ ID NO: 27757 - RNA, 23 nt, Human
ugcuaucaaucaucuuaucauca

SEQ ID NO: 27758 - RNA, 22 nt, Human
agccaucuuuucccauguaaua

SEQ ID NO: 27759 - RNA, 25 nt, Human
cccugcaagcgcucagucucauccc

SEQ ID NO: 27760 - RNA, 19 nt, Human
gauuacaggcgugagccau

SEQ ID NO: 27761 - RNA, 19 nt, Human
aaacaguguuuccagugac

SEQ ID NO: 27762 - RNA, 19 nt, Human
ugcuuacacuuucucucca

SEQ ID NO: 27763 - RNA, 20 nt, Human
uaggccuguugaagggcccu

SEQ ID NO: 27764 - RNA, 21 nt, Human
cauccaggcugagacugaaag

SEQ ID NO: 27765 - RNA, 25 nt, Human
caguuucaguuacuuccauuuucua

SEQ ID NO: 27766 - RNA, 25 nt, Human
uuaguaaaguaauaauuuggcuuca

SEQ ID NO: 27767 - RNA, 22 nt, Human
cacuggagagacuugugcucaa

SEQ ID NO: 27768 - RNA, 21 nt, Human
ccuguaauccuagcacucugg

SEQ ID NO: 27769 - RNA, 25 nt, Human
gccaugagguguguuuaucccacag

SEQ ID NO: 27770 - RNA, 20 nt, Human
cccagcacgguuccuccucu

SEQ ID NO: 27771 - RNA, 20 nt, Human
ccuugauagaagaaccuugg

SEQ ID NO: 27772 - RNA, 22 nt, Human
ggcucacugcauccucugccuc

SEQ ID NO: 27773 - RNA, 24 nt, Human
aaaacuuugcagaaaauuagacag

SEQ ID NO: 27774 - RNA, 25 nt, Human
ugcucagagcaguguucuggcuucu

SEQ ID NO: 27775 - RNA, 22 nt, Human
uacagguacuugauacaguuau

SEQ ID NO: 27776 - RNA, 18 nt, Human
ugccgcccucucccugcc

SEQ ID NO: 27777 - RNA, 19 nt, Human
caguucugcacucuuguac

SEQ ID NO: 27778 - RNA, 21 nt, Human
aggaguauccucuugccaaag

SEQ ID NO: 27779 - RNA, 21 nt, Human
gugagcagcaacaaggccacg

SEQ ID NO: 27780 - RNA, 27 nt, Human
ccugcuucucugaucuguguguuuccu

SEQ ID NO: 27781 - RNA, 20 nt, Human
uuucauucuuccugcugaag

SEQ ID NO: 27782 - RNA, 23 nt, Human
ccaacuguuguaacuaggcucag

SEQ ID NO: 27783 - RNA, 27 nt, Human
ucugggaggaugacuccagucccugca

SEQ ID NO: 27784 - RNA, 20 nt, Human
uuuugaagagcacauucucc

SEQ ID NO: 27785 - RNA, 27 nt, Human
cuggccuuuuaaaauuuauuugagacc

SEQ ID NO: 27786 - RNA, 22 nt, Human
aucacaggugucagccauugca

SEQ ID NO: 27787 - RNA, 24 nt, Human
ggcaccgcgccugcccucugccgc

SEQ ID NO: 27788 - RNA, 25 nt, Human
ucucucuccauaucaaucuggacca

SEQ ID NO: 27789 - RNA, 26 nt, Human
aauuuggguugugugaaaacuucuuu

SEQ ID NO: 27790 - RNA, 24 nt, Human
gguggcaaauacuugcacucagua

SEQ ID NO: 27791 - RNA, 25 nt, Human
ugccaggugccaucaucucuuuacc

SEQ ID NO: 27792 - RNA, 27 nt, Human
uaggcuggagugcaguggcgugaucuu

SEQ ID NO: 27793 - RNA, 23 nt, Human
uggcagaauucagcaauaugaga

SEQ ID NO: 27794 - RNA, 26 nt, Human
ucguuucuucuugguaaaugaugcua

SEQ ID NO: 27795 - RNA, 20 nt, Human
gguuuauuuugcugugcaga

SEQ ID NO: 27796 - RNA, 20 nt, Human
uuuuuaaaaaacauugaccu

SEQ ID NO: 27797 - RNA, 26 nt, Human
cugggagcugggccaucgcgaugucg

SEQ ID NO: 27798 - RNA, 25 nt, Human
ucuguuucucucuccgauuuugcuc

SEQ ID NO: 27799 - RNA, 23 nt, Human
auccaaucucaaggaaucuuuaa

SEQ ID NO: 27800 - RNA, 27 nt, Human
uuuugcuuaaugaaagccucaguucug

SEQ ID NO: 27801 - RNA, 26 nt, Human
acugggugugagaaugaucaaggauc

SEQ ID NO: 27802 - RNA, 24 nt, Human
ucugcagagccucaguuaccaggu

SEQ ID NO: 27803 - RNA, 22 nt, Human
cuccccagccugggcccaucuc

SEQ ID NO: 27804 - RNA, 22 nt, Human
cuggugcauaacuuaaagauua

SEQ ID NO: 27805 - RNA, 26 nt, Human
guuauugcuggugcaaagauagaugg

SEQ ID NO: 27806 - RNA, 22 nt, Human
ucugucacccaggcuggagugc

SEQ ID NO: 27807 - RNA, 21 nt, Human
aguagcugggauuagaggcau

SEQ ID NO: 27808 - RNA, 22 nt, Human
guugacuucccagaaugcagug

SEQ ID NO: 27809 - RNA, 27 nt, Human
cccugugauacugcaucucacuggggc

SEQ ID NO: 27810 - RNA, 17 nt, Human
cacuuccugcugcgaaa

SEQ ID NO: 27811 - RNA, 21 nt, Human
caggaauauuaaagggauuca

SEQ ID NO: 27812 - RNA, 22 nt, Human
gcucacugcagccucugccacc

SEQ ID NO: 27813 - RNA, 21 nt, Human
ggcucacaccuguaaucccag

SEQ ID NO: 27814 - RNA, 26 nt, Human
gcacuauaguacaggcuuuuagcacc

SEQ ID NO: 27815 - RNA, 30 nt, Human
ugcugagcacacaacaggcuguguguggaa

SEQ ID NO: 27816 - RNA, 27 nt, Human
auggaaaggagaggaaagaacucagug

SEQ ID NO: 27817 - RNA, 18 nt, Human
gaucacugcauuuuguuu

SEQ ID NO: 27818 - RNA, 21 nt, Human
gccuguaaucccagcauuuug

SEQ ID NO: 27819 - RNA, 26 nt, Human
ucuguucugcccgaggcuugugguca

SEQ ID NO: 27820 - RNA, 21 nt, Human
gagcaccuucuaaaucuaaga

SEQ ID NO: 27821 - RNA, 27 nt, Human
acaggcagagucugcaccugccgccug

SEQ ID NO: 27822 - RNA, 20 nt, Human
guauaaacaggaagccaggc

SEQ ID NO: 27823 - RNA, 23 nt, Human
cuaguaguugggauuacaggcac

SEQ ID NO: 27824 - RNA, 28 nt, Human
acguccuccauaaguggagcacagggua

SEQ ID NO: 27825 - RNA, 18 nt, Human
ccccucacccccaccuca

SEQ ID NO: 27826 - RNA, 20 nt, Human
agcaauagguagcuggggag

SEQ ID NO: 27827 - RNA, 19 nt, Human
gccagugcugaccagggac

SEQ ID NO: 27828 - RNA, 22 nt, Human
uucuccaggaggauuagcuugg

SEQ ID NO: 27829 - RNA, 19 nt, Human
ccgcuuccccuugccacgg

SEQ ID NO: 27830 - RNA, 26 nt, Human
cccuuuccuguuggugucccagcaca

SEQ ID NO: 27831 - RNA, 18 nt, Human
caaguguccauccagaga

SEQ ID NO: 27832 - RNA, 21 nt, Human
cugcgcaggguggagggagug

SEQ ID NO: 27833 - RNA, 20 nt, Human
aggaggaccugcaaccaucu

SEQ ID NO: 27834 - RNA, 23 nt, Human
ccaaaauugcugggauuacaggu

SEQ ID NO: 27835 - RNA, 27 nt, Human
aaguagcugggauuacaggcgcauugg

SEQ ID NO: 27836 - RNA, 21 nt, Human
cuuggcgugugggaagggaug

SEQ ID NO: 27837 - RNA, 21 nt, Human
cuuuuuaauucuucagacaca

SEQ ID NO: 27838 - RNA, 27 nt, Human
gcccugaaagaaaacgccacuggccau

SEQ ID NO: 27839 - RNA, 27 nt, Human
guccacccucaguacucaagcugcagu

SEQ ID NO: 27840 - RNA, 21 nt, Human
agagguugugcacuguuuaca

SEQ ID NO: 27841 - RNA, 23 nt, Human
uugaggugggaggauuugcuuga

SEQ ID NO: 27842 - RNA, 25 nt, Human
gcaugaaaauauuuuagcccccuca

SEQ ID NO: 27843 - RNA, 26 nt, Human
acuauucuuuggaauucuccuucugu

SEQ ID NO: 27844 - RNA, 25 nt, Human
ggggcugggagagcagaagggcagg

SEQ ID NO: 27845 - RNA, 22 nt, Human
uuaagguaguuauucacaaaaa

SEQ ID NO: 27846 - RNA, 25 nt, Human
ccugagaugccuggugagcauuaca

SEQ ID NO: 27847 - RNA, 22 nt, Human
gggacaaggagcuuccgucugg

SEQ ID NO: 27848 - RNA, 26 nt, Human
ggccaggguuaugagauaggccugua

SEQ ID NO: 27849 - RNA, 25 nt, Human
aguucuaggaggcuguggguuuuau

SEQ ID NO: 27850 - RNA, 22 nt, Human
auaccuguaaucccagcacuuu

SEQ ID NO: 27851 - RNA, 27 nt, Human
ccuccuauccccaccuacuccuggguc

SEQ ID NO: 27852 - RNA, 27 nt, Human
augaaauagaaacuuuugucuuuacug

SEQ ID NO: 27853 - RNA, 22 nt, Human
gcccaggcuggaaugcaguggu

SEQ ID NO: 27854 - RNA, 22 nt, Human
cggggcacacccccaggaaggg

SEQ ID NO: 27855 - RNA, 22 nt, Human
cacuggcacguuugugagaaga

SEQ ID NO: 27856 - RNA, 20 nt, Human
uacuuugggguuugcuuugc

SEQ ID NO: 27857 - RNA, 22 nt, Human
aggcugaggugagaagaucauu

SEQ ID NO: 27858 - RNA, 21 nt, Human
cagaaccuuugucaacuucag

SEQ ID NO: 27859 - RNA, 19 nt, Human
ucucuggacgcucugcacc

SEQ ID NO: 27860 - RNA, 22 nt, Human
ccccaaaaauguauagugccuu

SEQ ID NO: 27861 - RNA, 19 nt, Human
cugauucucuaccuuucuu

SEQ ID NO: 27862 - RNA, 20 nt, Human
uuugggggucuaucucucca

SEQ ID NO: 27863 - RNA, 22 nt, Human
cccaccccagcacugcccaucu

SEQ ID NO: 27864 - RNA, 27 nt, Human
uucugagcuagagcuguacugccucac

SEQ ID NO: 27865 - RNA, 21 nt, Human
agccagggaagcagugcaaug

SEQ ID NO: 27866 - RNA, 17 nt, Human
acaaaccugcaggcaua

SEQ ID NO: 27867 - RNA, 27 nt, Human
gagucauugcauccucuaccagcuguu

SEQ ID NO: 27868 - RNA, 23 nt, Human
guuaauaugguguacauucuucc

SEQ ID NO: 27869 - RNA, 22 nt, Human
ccagagcaucucuuugcugcua

SEQ ID NO: 27870 - RNA, 18 nt, Human
ucuacagcugcucuagcc

SEQ ID NO: 27871 - RNA, 26 nt, Human
agcccugcugaguuccugcuuucuga

SEQ ID NO: 27872 - RNA, 21 nt, Human
caccacugggacaggccuggg

SEQ ID NO: 27873 - RNA, 21 nt, Human
agcugccucuuacgguuuggu

SEQ ID NO: 27874 - RNA, 29 nt, Human
caucccucagccccacaggcacgaucugu

SEQ ID NO: 27875 - RNA, 30 nt, Human
guguucugaucacuggucugugcccucaca

SEQ ID NO: 27876 - RNA, 22 nt, Human
acaggcugugccaacauguggg

SEQ ID NO: 27877 - RNA, 26 nt, Human
cuggguuuggcaggcacugcugcuac

SEQ ID NO: 27878 - RNA, 20 nt, Human
gccacggaguaucacaggca

SEQ ID NO: 27879 - RNA, 26 nt, Human
ucuuauaaguaguaggcguaaauaau

SEQ ID NO: 27880 - RNA, 22 nt, Human
agccucccgaguagcuggaauu

SEQ ID NO: 27881 - RNA, 23 nt, Human
ccagggaggggccuggggaaagc

SEQ ID NO: 27882 - RNA, 23 nt, Human
ucucaaaucccucuccaacugcc

SEQ ID NO: 27883 - RNA, 26 nt, Human
ggagguggugacuggcaggcccgggc

SEQ ID NO: 27884 - RNA, 22 nt, Human
augugguuuaucacuuaagaga

SEQ ID NO: 27885 - RNA, 25 nt, Human
agggcccuucacuuccaucacaaga

SEQ ID NO: 27886 - RNA, 22 nt, Human
agcugacucgcucacugccuuc

SEQ ID NO: 27887 - RNA, 27 nt, Human
ugugagucagccaugcccgcaaagcgu

SEQ ID NO: 27888 - RNA, 26 nt, Human
ggagaggccuccuucugaggggcggc

SEQ ID NO: 27889 - RNA, 22 nt, Human
gcugccuuuggcccugccuggc

SEQ ID NO: 27890 - RNA, 24 nt, Human
ccuccaucagggccagaucuucca

SEQ ID NO: 27891 - RNA, 31 nt, Human
gcugccuggagaugguugcugccauugcugc

SEQ ID NO: 27892 - RNA, 23 nt, Human
uuuacggcacccaugcuuucuuu

SEQ ID NO: 27893 - RNA, 27 nt, Human
gccuggcguucccucugcacggcugcc

SEQ ID NO: 27894 - RNA, 21 nt, Human
uggcuggugccucuucuaguc

SEQ ID NO: 27895 - RNA, 21 nt, Human
uuuguuugguuauagugcaau

SEQ ID NO: 27896 - RNA, 23 nt, Human
cucagcuuugagggcuccugugg

SEQ ID NO: 27897 - RNA, 17 nt, Human
gcuuuacaaaugccuug

SEQ ID NO: 27898 - RNA, 29 nt, Human
acacucaucagaagaaucugaagaaacaa

SEQ ID NO: 27899 - RNA, 20 nt, Human
aacuuucucccucaucggcc

SEQ ID NO: 27900 - RNA, 26 nt, Human
aggugaggacacagcaggcccaggac

SEQ ID NO: 27901 - RNA, 22 nt, Human
guuccagucacugauuuuuaca

SEQ ID NO: 27902 - RNA, 22 nt, Human
guuaugaaaaccuauuuaauuc

SEQ ID NO: 27903 - RNA, 19 nt, Human
cugaagccugcuaucuuuu

SEQ ID NO: 27904 - RNA, 26 nt, Human
ggaggggcaggagagcagugaggagc

SEQ ID NO: 27905 - RNA, 21 nt, Human
uaaugagagauuuuauaagga

SEQ ID NO: 27906 - RNA, 26 nt, Human
uuuucuaaauugaaucaugcaucuau

SEQ ID NO: 27907 - RNA, 22 nt, Human
cccaccccaguuuuuguugcuu

SEQ ID NO: 27908 - RNA, 26 nt, Human
aauccucuucuucauccucauaugaa

SEQ ID NO: 27909 - RNA, 23 nt, Human
auggccuuuauuaaaaacugagu

SEQ ID NO: 27910 - RNA, 22 nt, Human
uguucuauuuauuuauugucuu

SEQ ID NO: 27911 - RNA, 28 nt, Human
gagcccagcgacuucugaagggccccuu

SEQ ID NO: 27912 - RNA, 21 nt, Human
aaacuccaucucuacaaaaaa

SEQ ID NO: 27913 - RNA, 20 nt, Human
aucaagaauauucaaaugua

SEQ ID NO: 27914 - RNA, 23 nt, Human
uggguggaggauggacgagugag

SEQ ID NO: 27915 - RNA, 20 nt, Human
auauuguguacauguuacca

SEQ ID NO: 27916 - RNA, 21 nt, Human
uucuccaccaugucagucuaa

SEQ ID NO: 27917 - RNA, 20 nt, Human
gguggagaaagggaaggggu

SEQ ID NO: 27918 - RNA, 23 nt, Human
ccuggggucccugaagacuggcu

SEQ ID NO: 27919 - RNA, 19 nt, Human
cuuucccucccugggggug

SEQ ID NO: 27920 - RNA, 24 nt, Human
agcugauuucuaaaauaugauuaa

SEQ ID NO: 27921 - RNA, 25 nt, Human
auguggcucccauuaaagcauuuca

SEQ ID NO: 27922 - RNA, 26 nt, Human
uaccugcauccccagcacugguccug

SEQ ID NO: 27923 - RNA, 21 nt, Human
cacccucgccucacagccccg

SEQ ID NO: 27924 - RNA, 22 nt, Human
ggaauaagaagucagacagaga

SEQ ID NO: 27925 - RNA, 22 nt, Human
aaggucccugggacuuccucau

SEQ ID NO: 27926 - RNA, 25 nt, Human
gaacagcucaccacugugccuacau

SEQ ID NO: 27927 - RNA, 22 nt, Human
uccagugagggagaaagugauc

SEQ ID NO: 27928 - RNA, 22 nt, Human
gcaaccaaaaagggaaaaagga

SEQ ID NO: 27929 - RNA, 22 nt, Human
agaguuccugguugcuuuucau

SEQ ID NO: 27930 - RNA, 27 nt, Human
ccucuaaagcccugccugcuauugguc

SEQ ID NO: 27931 - RNA, 19 nt, Human
uagcauuucuuucucuccc

SEQ ID NO: 27932 - RNA, 27 nt, Human
cuguucccagcaaaguuuucagauugu

SEQ ID NO: 27933 - RNA, 25 nt, Human
guggucugugacaagccuguggcuc

SEQ ID NO: 27934 - RNA, 20 nt, Human
uuguacuuuacaaucaugcc

SEQ ID NO: 27935 - RNA, 23 nt, Human
aguuuccuauguuucacugugca

SEQ ID NO: 27936 - RNA, 21 nt, Human
caccccacucugucuucauau

SEQ ID NO: 27937 - RNA, 20 nt, Human
cccagcacggugauuagucc

SEQ ID NO: 27938 - RNA, 21 nt, Human
uugauagcagagguuuggugg

SEQ ID NO: 27939 - RNA, 28 nt, Human
gugcgauguuucaggaggcuggaggaag

SEQ ID NO: 27940 - RNA, 22 nt, Human
uaugcuuguaaucccagcacuu

SEQ ID NO: 27941 - RNA, 27 nt, Human
agaaauguugauuuugaucugggcagu

SEQ ID NO: 27942 - RNA, 21 nt, Human
uuccugacgagauaagcaguu

SEQ ID NO: 27943 - RNA, 21 nt, Human
uuguuacuguucuugcugcua

SEQ ID NO: 27944 - RNA, 23 nt, Human
uuugagacuggcccugccuaacc

SEQ ID NO: 27945 - RNA, 24 nt, Human
ggaugaucuuguuaaaacauuaaa

SEQ ID NO: 27946 - RNA, 27 nt, Human
uggcucacgcauguaaucccagcacuc

SEQ ID NO: 27947 - RNA, 22 nt, Human
ccaaagugcuaggauuacaggc

SEQ ID NO: 27948 - RNA, 22 nt, Human
ccaaagugcugggauuacgggc

SEQ ID NO: 27949 - RNA, 20 nt, Human
ccugcagccagcucacgucc

SEQ ID NO: 27950 - RNA, 21 nt, Human
gaucuugaacuccugaccuca

SEQ ID NO: 27951 - RNA, 27 nt, Human
gcagccgcaccagagagagauucuucc

SEQ ID NO: 27952 - RNA, 26 nt, Human
ggggcagcagcccaggcauccgcuca

SEQ ID NO: 27953 - RNA, 21 nt, Human
gcagggaucauagcugacuca

SEQ ID NO: 27954 - RNA, 23 nt, Human
ccuucuguaugacagguauaggu

SEQ ID NO: 27955 - RNA, 24 nt, Human
cacaaccacuaauuugucacugga

SEQ ID NO: 27956 - RNA, 27 nt, Human
ugccagacccaggugccccagugccuu

SEQ ID NO: 27957 - RNA, 24 nt, Human
ggcuggcucucggcccugcccagc

SEQ ID NO: 27958 - RNA, 21 nt, Human
ucuuugugacauucucucuca

SEQ ID NO: 27959 - RNA, 23 nt, Human
agaaaaauuaauauuucagugaa

SEQ ID NO: 27960 - RNA, 23 nt, Human
cuccucugugccaacuccuugug

SEQ ID NO: 27961 - RNA, 22 nt, Human
ucacugcagccucagcguccug

SEQ ID NO: 27962 - RNA, 23 nt, Human
accagguugcuugugagggauga

SEQ ID NO: 27963 - RNA, 20 nt, Human
acagacaaaagcgcuuuucc

SEQ ID NO: 27964 - RNA, 20 nt, Human
ccaugucuuucucucucacu

SEQ ID NO: 27965 - RNA, 30 nt, Human
cgcugucuccuggguuccccucguagcgac

SEQ ID NO: 27966 - RNA, 23 nt, Human
gagaaggcagaggugguccgugg

SEQ ID NO: 27967 - RNA, 24 nt, Human
ggagaucuggcauuuucugcuuua

SEQ ID NO: 27968 - RNA, 24 nt, Human
cuggucccaagcaguuuacuguac

SEQ ID NO: 27969 - RNA, 26 nt, Human
ugggaggugggagggaagggcuuugg

SEQ ID NO: 27970 - RNA, 21 nt, Human
cccaaucccagaaacccagga

SEQ ID NO: 27971 - RNA, 22 nt, Human
ugaaggaguuaagauggaagac

SEQ ID NO: 27972 - RNA, 22 nt, Human
gcauuagagggagcccagucug

SEQ ID NO: 27973 - RNA, 21 nt, Human
cuagaaaaguggcccagaaac

SEQ ID NO: 27974 - RNA, 22 nt, Human
gucucaaacuccugggcucagg

SEQ ID NO: 27975 - RNA, 26 nt, Human
ucagaaaagucuaccugggagacuag

SEQ ID NO: 27976 - RNA, 22 nt, Human
acacagacccacacauguuuac

SEQ ID NO: 27977 - RNA, 22 nt, Human
cugucucaaaaauaaaugaaua

SEQ ID NO: 27978 - RNA, 21 nt, Human
uuucuuuuuuaaaaagcaguu

SEQ ID NO: 27979 - RNA, 24 nt, Human
caucaucucuuccaucuuuggguc

SEQ ID NO: 27980 - RNA, 24 nt, Human
ugggagcauucgucgugcccagcc

SEQ ID NO: 27981 - RNA, 20 nt, Human
ucugagcccagcugccugga

SEQ ID NO: 27982 - RNA, 23 nt, Human
cugucuccuuuccuccuccuggg

SEQ ID NO: 27983 - RNA, 23 nt, Human
aacucugcugcuucccaacacaa

SEQ ID NO: 27984 - RNA, 21 nt, Human
uuggccugucaccagacccga

SEQ ID NO: 27985 - RNA, 27 nt, Human
ccagguggcauacugcagucuggcucu

SEQ ID NO: 27986 - RNA, 26 nt, Human
ccaaaaccacaccauaggguuuucug

SEQ ID NO: 27987 - RNA, 20 nt, Human
acaaaaacagcaaacucccu

SEQ ID NO: 27988 - RNA, 22 nt, Human
cuuauucccuuccugccagccc

SEQ ID NO: 27989 - RNA, 26 nt, Human
aaggagugacaaggaagcucacagcu

SEQ ID NO: 27990 - RNA, 22 nt, Human
gagcaaggacacaggagcccac

SEQ ID NO: 27991 - RNA, 23 nt, Human
gucaugaaugaggagguguguga

SEQ ID NO: 27992 - RNA, 22 nt, Human
ccaugaucugcaggggucuggg

SEQ ID NO: 27993 - RNA, 21 nt, Human
cucuggggcuaccucagggcc

SEQ ID NO: 27994 - RNA, 23 nt, Human
gccaccaggaacagaaggucugg

SEQ ID NO: 27995 - RNA, 22 nt, Human
acacacuucuagauucuuccca

SEQ ID NO: 27996 - RNA, 22 nt, Human
gcuccacauagcuccuggaccu

SEQ ID NO: 27997 - RNA, 20 nt, Human
ccagaagacguggaggggag

SEQ ID NO: 27998 - RNA, 19 nt, Human
ucucucacucuggacccag

SEQ ID NO: 27999 - RNA, 19 nt, Human
gcauaugagccugcccuca

SEQ ID NO: 28000 - RNA, 26 nt, Human
uuagauguuacaaacuccuugccucu

SEQ ID NO: 28001 - RNA, 22 nt, Human
agauugaacaaagcauuuagau

SEQ ID NO: 28002 - RNA, 22 nt, Human
guucccuuaggugacgcagcua

SEQ ID NO: 28003 - RNA, 19 nt, Human
gaagcuguguaaaugagua

SEQ ID NO: 28004 - RNA, 19 nt, Human
acccugacaggugcccuca

SEQ ID NO: 28005 - RNA, 22 nt, Human
guuucgucucuuuaacugacau

SEQ ID NO: 28006 - RNA, 20 nt, Human
gaggcuuggcuuucgagcca

SEQ ID NO: 28007 - RNA, 21 nt, Human
gaccgaaaaugaauuguaauu

SEQ ID NO: 28008 - RNA, 22 nt, Human
auucuaugaucauugcuuuuuc

SEQ ID NO: 28009 - RNA, 21 nt, Human
augacuuggcuuucucaucca

SEQ ID NO: 28010 - RNA, 24 nt, Human
gaacuauucuucuagacuauccca

SEQ ID NO: 28011 - RNA, 20 nt, Human
ccugcuguggaggcagcggc

SEQ ID NO: 28012 - RNA, 26 nt, Human
gcuccucuguggugucugccuguugc

SEQ ID NO: 28013 - RNA, 22 nt, Human
ggagagaagguacuauaccuuu

SEQ ID NO: 28014 - RNA, 21 nt, Human
uucauucugugaucauuuauu

SEQ ID NO: 28015 - RNA, 22 nt, Human
aucccauauauucuucugcagu

SEQ ID NO: 28016 - RNA, 21 nt, Human
ccacccuugacugccaaaaau

SEQ ID NO: 28017 - RNA, 27 nt, Human
acagagagcugcccugccuaggagcac

SEQ ID NO: 28018 - RNA, 27 nt, Human
gguuucaucugauugagaagggggaau

SEQ ID NO: 28019 - RNA, 23 nt, Human
cuguuuuaaaagaucauaguugc

SEQ ID NO: 28020 - RNA, 23 nt, Human
auuuuuacucugcauguucuguc

SEQ ID NO: 28021 - RNA, 22 nt, Human
ucugucgcccaggcuggaguac

SEQ ID NO: 28022 - RNA, 22 nt, Human
cauccaggcuggacaguucagu

SEQ ID NO: 28023 - RNA, 27 nt, Human
ggaggagaagagaagagccaaccagaa

SEQ ID NO: 28024 - RNA, 23 nt, Human
uuaucccucgaugccuggcuugg

SEQ ID NO: 28025 - RNA, 27 nt, Human
ucagcucccagcccuuccccccagccc

SEQ ID NO: 28026 - RNA, 21 nt, Human
caccuccagguucaagugauu

SEQ ID NO: 28027 - RNA, 26 nt, Human
cauuccccagccacuucccuuccgca

SEQ ID NO: 28028 - RNA, 27 nt, Human
gggagagaagauagcagggcauggcug

SEQ ID NO: 28029 - RNA, 26 nt, Human
gucuggaacuccugggcucaagggau

SEQ ID NO: 28030 - RNA, 22 nt, Human
gggcacugucugaacuccugac

SEQ ID NO: 28031 - RNA, 21 nt, Human
cucugccucuuggaguuuggu

SEQ ID NO: 28032 - RNA, 19 nt, Human
uuuggaauauugcuuaaau

SEQ ID NO: 28033 - RNA, 21 nt, Human
ccucagggcuccuugugggcc

SEQ ID NO: 28034 - RNA, 22 nt, Human
cugaggcaggagaaucacuugc

SEQ ID NO: 28035 - RNA, 19 nt, Human
ucagggauggagggaagac

SEQ ID NO: 28036 - RNA, 26 nt, Human
ugcuccuccaugaaugacaauuccag

SEQ ID NO: 28037 - RNA, 22 nt, Human
ucaaagugaagaaaauguaaca

SEQ ID NO: 28038 - RNA, 28 nt, Human
cucgacuucucagccuccugggguuccg

SEQ ID NO: 28039 - RNA, 22 nt, Human
agaccuguuacuacugauuuua

SEQ ID NO: 28040 - RNA, 22 nt, Human
ucugacauccagguugugcuau

SEQ ID NO: 28041 - RNA, 22 nt, Human
cgccgccacaaguugcgcugcu

SEQ ID NO: 28042 - RNA, 21 nt, Human
ccgccaccgccuccugccucc

SEQ ID NO: 28043 - RNA, 27 nt, Human
aacuucugcuuuauauucuuaaaaugg

SEQ ID NO: 28044 - RNA, 21 nt, Human
cucaacaaaauaugaugaugg

SEQ ID NO: 28045 - RNA, 23 nt, Human
cuguguuagaagcagcugugggg

SEQ ID NO: 28046 - RNA, 17 nt, Human
cucaaaccagucugcug

SEQ ID NO: 28047 - RNA, 26 nt, Human
ccuguuggucccuguccuugcugccc

SEQ ID NO: 28048 - RNA, 22 nt, Human
uucaagcuauucuccugccuca

SEQ ID NO: 28049 - RNA, 22 nt, Human
auacagcaaccccaaaucccua

SEQ ID NO: 28050 - RNA, 21 nt, Human
ugaauccuacuuagugacaag

SEQ ID NO: 28051 - RNA, 22 nt, Human
acuaugugcugggugccuccca

SEQ ID NO: 28052 - RNA, 22 nt, Human
gggagcugguggccaggggugc

SEQ ID NO: 28053 - RNA, 22 nt, Human
uucauauacugccuuguguuca

SEQ ID NO: 28054 - RNA, 26 nt, Human
cccuggccagagcucagcaugggcag

SEQ ID NO: 28055 - RNA, 22 nt, Human
cuccacuccuuccaucucuucc

SEQ ID NO: 28056 - RNA, 27 nt, Human
ugguggagaugaaggggugggucuaug

SEQ ID NO: 28057 - RNA, 21 nt, Human
gcuccucccucccccaacacu

SEQ ID NO: 28058 - RNA, 19 nt, Human
ugucacugcacuccagcuu

SEQ ID NO: 28059 - RNA, 21 nt, Human
ccccagggaggggccugggga

SEQ ID NO: 28060 - RNA, 27 nt, Human
ggugggaaagggagggugguuggugga

SEQ ID NO: 28061 - RNA, 25 nt, Human
uucaggccacaccacaucuuccaug

SEQ ID NO: 28062 - RNA, 22 nt, Human
ugacccaaaugcaaacauuuua

SEQ ID NO: 28063 - RNA, 23 nt, Human
acauaaggaauuguaaaguauuu

SEQ ID NO: 28064 - RNA, 23 nt, Human
ugcuagugauuucauuaccaagu

SEQ ID NO: 28065 - RNA, 22 nt, Human
agcuaaaauuuucgacuugacu

SEQ ID NO: 28066 - RNA, 28 nt, Human
gacacaggccagcuccacaguguugcca

SEQ ID NO: 28067 - RNA, 25 nt, Human
cccaacaacagaagccuguggcccc

SEQ ID NO: 28068 - RNA, 20 nt, Human
aaaacacaaaaauuagccgg

SEQ ID NO: 28069 - RNA, 22 nt, Human
ccugccuccuugucccugccag

SEQ ID NO: 28070 - RNA, 22 nt, Human
ggaccagagcugccaccugccu

SEQ ID NO: 28071 - RNA, 25 nt, Human
guggcaaaaggucagccuugggguu

SEQ ID NO: 28072 - RNA, 27 nt, Human
cccuccaggacgaaguuucagaauugg

SEQ ID NO: 28073 - RNA, 23 nt, Human
uguuuuuaaaguauuauugguua

SEQ ID NO: 28074 - RNA, 30 nt, Human
ccaacugcucugcccacugugaaaccacua

SEQ ID NO: 28075 - RNA, 24 nt, Human
cuggccuuuuaaaucgacgucucu

SEQ ID NO: 28076 - RNA, 23 nt, Human
uuaguggagacgggguuucucca

SEQ ID NO: 28077 - RNA, 25 nt, Human
gcuaucucccaucaccucugcuauc

SEQ ID NO: 28078 - RNA, 22 nt, Human
aggcaggcagaucacgagguca

SEQ ID NO: 28079 - RNA, 27 nt, Human
gugagggagggagacagacugacugac

SEQ ID NO: 28080 - RNA, 22 nt, Human
cucaaccucuacaggguuagag

SEQ ID NO: 28081 - RNA, 24 nt, Human
gcucacaucuuuccuccugcugca

SEQ ID NO: 28082 - RNA, 22 nt, Human
accuuuguuccuagccuguugg

SEQ ID NO: 28083 - RNA, 23 nt, Human
aucacacacugagaaucucuuca

SEQ ID NO: 28084 - RNA, 21 nt, Human
ccaaacagcaagaagcuguua

SEQ ID NO: 28085 - RNA, 19 nt, Human
ucaccccaucccacacccu

SEQ ID NO: 28086 - RNA, 21 nt, Human
uucuauaaguucuuguuuucu

SEQ ID NO: 28087 - RNA, 29 nt, Human
caggaagaaauagacaugaauuuuccuga

SEQ ID NO: 28088 - RNA, 22 nt, Human
uucauugucucuaguguucaga

SEQ ID NO: 28089 - RNA, 24 nt, Human
ggccaugucuccugcauagcuuuu

SEQ ID NO: 28090 - RNA, 27 nt, Human
gcggcuuuguggagggaacacugggua

SEQ ID NO: 28091 - RNA, 22 nt, Human
uuucaugucugaaauaacccug

SEQ ID NO: 28092 - RNA, 20 nt, Human
aaaauucaaaauuagccugg

SEQ ID NO: 28093 - RNA, 22 nt, Human
gggggaggaggagggacugggu

SEQ ID NO: 28094 - RNA, 28 nt, Human
caccccuccccagccuccugacccuucc

SEQ ID NO: 28095 - RNA, 22 nt, Human
cuggagcccagguugcaggugg

SEQ ID NO: 28096 - RNA, 25 nt, Human
gaucggagagucggacacaggacag

SEQ ID NO: 28097 - RNA, 21 nt, Human
ucccauuuguaauuuguaaaa

SEQ ID NO: 28098 - RNA, 27 nt, Human
ccucaucucccuguggacuugggagcu

SEQ ID NO: 28099 - RNA, 22 nt, Human
acgcugcccuggccuccugcag

SEQ ID NO: 28100 - RNA, 23 nt, Human
agcaucagucccacucaucucag

SEQ ID NO: 28101 - RNA, 22 nt, Human
gucaagagaguucugaccugga

SEQ ID NO: 28102 - RNA, 27 nt, Human
uuguggacccacagauugcaucuuuaa

SEQ ID NO: 28103 - RNA, 25 nt, Human
gucggugccugucaacugcuuuuca

SEQ ID NO: 28104 - RNA, 22 nt, Human
cacugaacuccggccuggguga

SEQ ID NO: 28105 - RNA, 24 nt, Human
caaccuuggggccagcaucuccca

SEQ ID NO: 28106 - RNA, 22 nt, Human
gaaugagacacugucucaagaa

SEQ ID NO: 28107 - RNA, 21 nt, Human
gaagagacccaagucucuuga

SEQ ID NO: 28108 - RNA, 22 nt, Human
ggcuuugggagagagcagcagc

SEQ ID NO: 28109 - RNA, 20 nt, Human
ggagaaguagcugugaacau

SEQ ID NO: 28110 - RNA, 23 nt, Human
aggcuagagugcaguggcgcgau

SEQ ID NO: 28111 - RNA, 23 nt, Human
aggcuggagugcaauggcgcgau

SEQ ID NO: 28112 - RNA, 20 nt, Human
gcccgcaagcgcccuccucc

SEQ ID NO: 28113 - RNA, 23 nt, Human
caccucucucaacacacuccuca

SEQ ID NO: 28114 - RNA, 27 nt, Human
gcagaaaacagugccccaaauggaaaa

SEQ ID NO: 28115 - RNA, 26 nt, Human
uuaccuuuuuguaugugaacaaauca

SEQ ID NO: 28116 - RNA, 22 nt, Human
aauucacaaccucccacccaaa

SEQ ID NO: 28117 - RNA, 17 nt, Human
ggcaaagcgccagcagc

SEQ ID NO: 28118 - RNA, 22 nt, Human
uaguuggcaaaaaugggcagua

SEQ ID NO: 28119 - RNA, 27 nt, Human
uuggcacaacggcccuggccucugcac

SEQ ID NO: 28120 - RNA, 29 nt, Human
cccagcaacaacaaaagaacuaguccucu

SEQ ID NO: 28121 - RNA, 27 nt, Human
ccuuuacugacaccuugugcucaggcc

SEQ ID NO: 28122 - RNA, 26 nt, Human
uucaugaucaguguuaagcauuuucc

SEQ ID NO: 28123 - RNA, 27 nt, Human
aacacaaagauucugaccuuaaaugca

SEQ ID NO: 28124 - RNA, 15 nt, Human
ugggcucucuucucu

SEQ ID NO: 28125 - RNA, 27 nt, Human
uggggcugugcauugaggaccccugcu

SEQ ID NO: 28126 - RNA, 26 nt, Human
gguggggaauggggagggaagggcau

SEQ ID NO: 28127 - RNA, 26 nt, Human
ccuccacugggcuaauucuacacccc

SEQ ID NO: 28128 - RNA, 21 nt, Human
aggaagaagguuuuugcucag

SEQ ID NO: 28129 - RNA, 27 nt, Human
ugggacccccacuaagacccuggucug

SEQ ID NO: 28130 - RNA, 26 nt, Human
cccugccuccuccaucagauccuuug

SEQ ID NO: 28131 - RNA, 23 nt, Human
gucacuuuuuacuucucagugcc

SEQ ID NO: 28132 - RNA, 22 nt, Human
ccagccaagaugcaagccacuc

SEQ ID NO: 28133 - RNA, 22 nt, Human
agaacuuugccauuugucuaca

SEQ ID NO: 28134 - RNA, 27 nt, Human
ucuaggguucucagaugcuaucugccg

SEQ ID NO: 28135 - RNA, 28 nt, Human
gcccccuuccuggauggaggcuugaggg

SEQ ID NO: 28136 - RNA, 24 nt, Human
auggaggagggaggcgugggaugg

SEQ ID NO: 28137 - RNA, 26 nt, Human
ggaggcuuugggagagcaggaaugaa

SEQ ID NO: 28138 - RNA, 27 nt, Human
gaggaagagguugcagugagccaagau

SEQ ID NO: 28139 - RNA, 24 nt, Human
gaucccucaucccugaaauugagu

SEQ ID NO: 28140 - RNA, 24 nt, Human
gaggcagcagucucagcgcggaga

SEQ ID NO: 28141 - RNA, 22 nt, Human
ccuuugaguuuccucaggcugc

SEQ ID NO: 28142 - RNA, 19 nt, Human
ggaaggcuugcaauguggu

SEQ ID NO: 28143 - RNA, 21 nt, Human
gcucaaggauggaagugcagu

SEQ ID NO: 28144 - RNA, 25 nt, Human
cccacccccacagcgcccugcaccc

SEQ ID NO: 28145 - RNA, 20 nt, Human
caucagcaacaccacacccu

SEQ ID NO: 28146 - RNA, 27 nt, Human
acagcucuaucaaggcuugucaagcag

SEQ ID NO: 28147 - RNA, 21 nt, Human
uucaguuugugcacuguguau

SEQ ID NO: 28148 - RNA, 25 nt, Human
gguggggggcaggaugggggagagg

SEQ ID NO: 28149 - RNA, 21 nt, Human
acauuuaccagcauacuccaa

SEQ ID NO: 28150 - RNA, 21 nt, Human
cucuaccucccagggucuuug

SEQ ID NO: 28151 - RNA, 22 nt, Human
acaccuguaaucucagcacuuu

SEQ ID NO: 28152 - RNA, 22 nt, Human
acacuuguaaucccagcacuuu

SEQ ID NO: 28153 - RNA, 18 nt, Human
cugccucuccgucuugua

SEQ ID NO: 28154 - RNA, 19 nt, Human
gaaaacaauggaaugagaa

SEQ ID NO: 28155 - RNA, 23 nt, Human
uugucccaggaggcagcugcuga

SEQ ID NO: 28156 - RNA, 30 nt, Human
cugcagcugcaccaucacacaugcaucauc

SEQ ID NO: 28157 - RNA, 22 nt, Human
gugugagccaccacaccuggcu

SEQ ID NO: 28158 - RNA, 21 nt, Human
cugggagcauggaggacagcu

SEQ ID NO: 28159 - RNA, 24 nt, Human
ggucugugucucuuuucucuuucu

SEQ ID NO: 28160 - RNA, 27 nt, Human
agaagcgaguccucuccgcccugcggc

SEQ ID NO: 28161 - RNA, 25 nt, Human
ucucucucuuugccucauagauuua

SEQ ID NO: 28162 - RNA, 24 nt, Human
agcucacuguaaccucaaacuccu

SEQ ID NO: 28163 - RNA, 23 nt, Human
ccuccaucuaugcacagcuuucc

SEQ ID NO: 28164 - RNA, 20 nt, Human
agaaaucauacuuugccaaa

SEQ ID NO: 28165 - RNA, 21 nt, Human
uucagaggcagccugcagucc

SEQ ID NO: 28166 - RNA, 23 nt, Human
guccagacuguggguguagauua

SEQ ID NO: 28167 - RNA, 26 nt, Human
ugccaacauggggaaacugaggcucg

SEQ ID NO: 28168 - RNA, 22 nt, Human
gauccaguggggcagaggacag

SEQ ID NO: 28169 - RNA, 22 nt, Human
uccucugcuaugcauuuucuuc

SEQ ID NO: 28170 - RNA, 27 nt, Human
ggggcugauucccaaguguggucgccc

SEQ ID NO: 28171 - RNA, 25 nt, Human
aguacagacugaaaggaaaauagau

SEQ ID NO: 28172 - RNA, 22 nt, Human
gccuuucuccgccgagaggauc

SEQ ID NO: 28173 - RNA, 24 nt, Human
gcuaagaggaucuccuguccauca

SEQ ID NO: 28174 - RNA, 21 nt, Human
gggcuguaggcagggacaguc

SEQ ID NO: 28175 - RNA, 26 nt, Human
ccagcacuugggagcugacugugcug

SEQ ID NO: 28176 - RNA, 23 nt, Human
gaaggauaagagaaacaggcccg

SEQ ID NO: 28177 - RNA, 19 nt, Human
uucaugggcucaucuuuaa

SEQ ID NO: 28178 - RNA, 22 nt, Human
gcuggugguuugaucauuucug

SEQ ID NO: 28179 - RNA, 26 nt, Human
cucagcaaccugcucuuccgcugcuc

SEQ ID NO: 28180 - RNA, 27 nt, Human
ucauguucugacccucugugcacugga

SEQ ID NO: 28181 - RNA, 24 nt, Human
gguaugugcuagaacaaugggagg

SEQ ID NO: 28182 - RNA, 22 nt, Human
gaccacaaugcaccuuugguug

SEQ ID NO: 28183 - RNA, 19 nt, Human
auuagaauuucauaugaca

SEQ ID NO: 28184 - RNA, 19 nt, Human
ccccugcacuaugcucuug

SEQ ID NO: 28185 - RNA, 23 nt, Human
cugagccucacauccuuuuccuu

SEQ ID NO: 28186 - RNA, 24 nt, Human
cugucccccaggcuggagugcagu

SEQ ID NO: 28187 - RNA, 24 nt, Human
cugucacccaggcuggagugccgu

SEQ ID NO: 28188 - RNA, 25 nt, Human
agcaggaggcacgcggagugugagg

SEQ ID NO: 28189 - RNA, 22 nt, Human
caguugccaccaccucuguggc

SEQ ID NO: 28190 - RNA, 19 nt, Human
ggagagcagcaggugcugu

SEQ ID NO: 28191 - RNA, 21 nt, Human
cuauuagugcuacauuugguc

SEQ ID NO: 28192 - RNA, 24 nt, Human
ggucccuggccuacgggcugaggc

SEQ ID NO: 28193 - RNA, 26 nt, Human
caggaggcugagugagcaggggagca

SEQ ID NO: 28194 - RNA, 26 nt, Human
augugucucugcuuuccuuuucucug

SEQ ID NO: 28195 - RNA, 20 nt, Human
uucugccuuuuaauuuugua

SEQ ID NO: 28196 - RNA, 27 nt, Human
agggucugggaccccgcucagcauggc

SEQ ID NO: 28197 - RNA, 20 nt, Human
ucguuuucuuugcugugcca

SEQ ID NO: 28198 - RNA, 27 nt, Human
cucauuucucuuugugauucuugacgg

SEQ ID NO: 28199 - RNA, 20 nt, Human
gcucaggacggaaggucagu

SEQ ID NO: 28200 - RNA, 27 nt, Human
acugcaaccuccgccucccgaguucaa

SEQ ID NO: 28201 - RNA, 22 nt, Human
caguuauucuuucugcaucuug

SEQ ID NO: 28202 - RNA, 28 nt, Human
uccagagagcagggaacuaccuugagua

SEQ ID NO: 28203 - RNA, 23 nt, Human
aagauguuuuaagaagcauuuua

SEQ ID NO: 28204 - RNA, 23 nt, Human
uugucugacagcaggaacugaga

SEQ ID NO: 28205 - RNA, 22 nt, Human
ggucuugaacuccugaugucag

SEQ ID NO: 28206 - RNA, 20 nt, Human
aagucuuguuuuuccagacu

SEQ ID NO: 28207 - RNA, 24 nt, Human
cuggcugccaacaugauccccguc

SEQ ID NO: 28208 - RNA, 20 nt, Human
ucuguagugagcaaaggaca

SEQ ID NO: 28209 - RNA, 25 nt, Human
aauccuucccucaucccaucacaca

SEQ ID NO: 28210 - RNA, 22 nt, Human
cauuugaaaggagugggaggaa

SEQ ID NO: 28211 - RNA, 22 nt, Human
aucucccaccuuucgggccaug

SEQ ID NO: 28212 - RNA, 24 nt, Human
cgggcagcagcuggagcuaaagga

SEQ ID NO: 28213 - RNA, 19 nt, Human
acaguuacagagugaacac

SEQ ID NO: 28214 - RNA, 20 nt, Human
agggagagaucgaagacuga

SEQ ID NO: 28215 - RNA, 21 nt, Human
ucccacauacuuacccacaug

SEQ ID NO: 28216 - RNA, 18 nt, Human
gggccacugccugcucca

SEQ ID NO: 28217 - RNA, 23 nt, Human
cguccgccucccaguaccaccag

SEQ ID NO: 28218 - RNA, 22 nt, Human
acagugguguggaauacuccaa

SEQ ID NO: 28219 - RNA, 20 nt, Human
gaugccuucucucuccaucu

SEQ ID NO: 28220 - RNA, 26 nt, Human
uuuccccuugguauuugaugacaaau

SEQ ID NO: 28221 - RNA, 21 nt, Human
cuucaaacugugaagcauuua

SEQ ID NO: 28222 - RNA, 22 nt, Human
cgcccaggcuggagugcaaugc

SEQ ID NO: 28223 - RNA, 26 nt, Human
uacuauaugccgcuacaaaaagguaa

SEQ ID NO: 28224 - RNA, 21 nt, Human
acucuauuuuuaguuugcuga

SEQ ID NO: 28225 - RNA, 26 nt, Human
uuccauccacuauccuggcaacucaa

SEQ ID NO: 28226 - RNA, 27 nt, Human
auucagcccaaucugguucaacuuugu

SEQ ID NO: 28227 - RNA, 19 nt, Human
gucucccagugcauuuugc

SEQ ID NO: 28228 - RNA, 27 nt, Human
cauauuccuaacuacuguauuuguuac

SEQ ID NO: 28229 - RNA, 24 nt, Human
ucuucacauuucuaucccucuguu

SEQ ID NO: 28230 - RNA, 22 nt, Human
ccacauggcugggauuuaaagc

SEQ ID NO: 28231 - RNA, 20 nt, Human
ccucauggaucugcauaacc

SEQ ID NO: 28232 - RNA, 24 nt, Human
uccgcgcgccccaccuccuccgcc

SEQ ID NO: 28233 - RNA, 22 nt, Human
aaccuagugagugacuguacuc

SEQ ID NO: 28234 - RNA, 22 nt, Human
ugaacucccagacucaagugau

SEQ ID NO: 28235 - RNA, 28 nt, Human
uguccccuacugcaggucuuacuaacag

SEQ ID NO: 28236 - RNA, 27 nt, Human
cuuuucauucgacacaauaaaauaaca

SEQ ID NO: 28237 - RNA, 22 nt, Human
gagucgggagcccagaggaacg

SEQ ID NO: 28238 - RNA, 23 nt, Human
cacagcucagacccacggacagg

SEQ ID NO: 28239 - RNA, 24 nt, Human
gggagagacgcgggaaagugcggg

SEQ ID NO: 28240 - RNA, 25 nt, Human
uuucagaucauuuaggauacucuua

SEQ ID NO: 28241 - RNA, 32 nt, Human
ucugcacaccuugaaucugccugcuggcuccc

SEQ ID NO: 28242 - RNA, 23 nt, Human
gaugggguuucacuauguuggcc

SEQ ID NO: 28243 - RNA, 23 nt, Human
gaugggguuucaccauguugguc

SEQ ID NO: 28244 - RNA, 19 nt, Human
uauuaaaaagaaguuucua

SEQ ID NO: 28245 - RNA, 22 nt, Human
cuuuuacauguaacuaggauaa

SEQ ID NO: 28246 - RNA, 23 nt, Human
cucucaguuuuggacaagugaca

SEQ ID NO: 28247 - RNA, 27 nt, Human
ccaccagcccaucccagaucuuccuuu

SEQ ID NO: 28248 - RNA, 24 nt, Human
uugucccaagucuuauuugcugac

SEQ ID NO: 28249 - RNA, 21 nt, Human
ucuuuauucccuccaucaucu

SEQ ID NO: 28250 - RNA, 22 nt, Human
uaaagcccugggaucacuguga

SEQ ID NO: 28251 - RNA, 21 nt, Human
uagaaaauauaaauuucauca

SEQ ID NO: 28252 - RNA, 22 nt, Human
gcucacugcagccucaaccucc

SEQ ID NO: 28253 - RNA, 22 nt, Human
cuucaguaccugaccaguauua

SEQ ID NO: 28254 - RNA, 19 nt, Human
ugacucacacuuacugcaa

SEQ ID NO: 28255 - RNA, 22 nt, Human
uauucauuuguuccuuucccua

SEQ ID NO: 28256 - RNA, 18 nt, Human
gcuuagcuugggcucaga

SEQ ID NO: 28257 - RNA, 25 nt, Human
cucuuguauguaauccuguggcuua

SEQ ID NO: 28258 - RNA, 18 nt, Human
acugcuugcccuaagcag

SEQ ID NO: 28259 - RNA, 22 nt, Human
ugaggggcccaaugggagccgc

SEQ ID NO: 28260 - RNA, 23 nt, Human
cacugcccuguuuuucauuggga

SEQ ID NO: 28261 - RNA, 22 nt, Human
uugaaguugacucugcucuugc

SEQ ID NO: 28262 - RNA, 24 nt, Human
aaaguacugggauuauauaggcau

SEQ ID NO: 28263 - RNA, 21 nt, Human
gucccauggcuacugaagggg

SEQ ID NO: 28264 - RNA, 26 nt, Human
ucaacuacuuucucuacagcuuuuca

SEQ ID NO: 28265 - RNA, 19 nt, Human
cugcugcacuccagccugc

SEQ ID NO: 28266 - RNA, 22 nt, Human
cugcugcaggauggaguggaaa

SEQ ID NO: 28267 - RNA, 20 nt, Human
gucacuucuucaccucuucc

SEQ ID NO: 28268 - RNA, 23 nt, Human
auaucgccacugcacuccagccu

SEQ ID NO: 28269 - RNA, 26 nt, Human
agagcgacagagcaguugagaggaca

SEQ ID NO: 28270 - RNA, 23 nt, Human
ggaccugggccuguucugcuccu

SEQ ID NO: 28271 - RNA, 17 nt, Human
guggguggggagaagac

SEQ ID NO: 28272 - RNA, 26 nt, Human
ccagugcuucuaguaggagggcugaa

SEQ ID NO: 28273 - RNA, 21 nt, Human
ggccuccuauuuagcuaagca

SEQ ID NO: 28274 - RNA, 22 nt, Human
guugcccaggcuggucugaagc

SEQ ID NO: 28275 - RNA, 26 nt, Human
gagagcuguaacugaggacuguuugc

SEQ ID NO: 28276 - RNA, 23 nt, Human
ggcaggagaaucacuugaaccug

SEQ ID NO: 28277 - RNA, 26 nt, Human
ccagugcuccaugccagcacuugaac

SEQ ID NO: 28278 - RNA, 22 nt, Human
uccaggagaaggugcugcucuc

SEQ ID NO: 28279 - RNA, 22 nt, Human
gaacaacaacuauccugacuuc

SEQ ID NO: 28280 - RNA, 22 nt, Human
uagaggcagagguugaagaugg

SEQ ID NO: 28281 - RNA, 26 nt, Human
acuguacuagaugcuguuuuugucug

SEQ ID NO: 28282 - RNA, 24 nt, Human
guaggggggacagcggaucccagc

SEQ ID NO: 28283 - RNA, 22 nt, Human
cagcccagccuacccaaccuca

SEQ ID NO: 28284 - RNA, 22 nt, Human
ggagugcaaggaugaugcugaa

SEQ ID NO: 28285 - RNA, 21 nt, Human
ugggagagcagacucaucuca

SEQ ID NO: 28286 - RNA, 18 nt, Human
acaguaacacacauguau

SEQ ID NO: 28287 - RNA, 23 nt, Human
cccgagcuccgcacagugcgccc

SEQ ID NO: 28288 - RNA, 26 nt, Human
caacagcaacaaaaucuguuuuuaaa

SEQ ID NO: 28289 - RNA, 22 nt, Human
gccugugcucaugacagcugcu

SEQ ID NO: 28290 - RNA, 22 nt, Human
agccuccaacuccagcugaguc

SEQ ID NO: 28291 - RNA, 22 nt, Human
aaucagagagggaagaucuggu

SEQ ID NO: 28292 - RNA, 23 nt, Human
ccccaucaggcugggcucuggca

SEQ ID NO: 28293 - RNA, 21 nt, Human
gccggggcaaggagagagugc

SEQ ID NO: 28294 - RNA, 20 nt, Human
ccuucauccuucugucucca

SEQ ID NO: 28295 - RNA, 22 nt, Human
ugaauaaaauauucagaggaaa

SEQ ID NO: 28296 - RNA, 25 nt, Human
cauauuauuucacuuuuguuagugc

SEQ ID NO: 28297 - RNA, 27 nt, Human
ugcuguaauagguuaaauccuacagca

SEQ ID NO: 28298 - RNA, 22 nt, Human
acacugcagccuccaacuccua

SEQ ID NO: 28299 - RNA, 25 nt, Human
ugcuuguaaaccaucgcgugcaaug

SEQ ID NO: 28300 - RNA, 23 nt, Human
acaguccuggugaaugggcuuca

SEQ ID NO: 28301 - RNA, 22 nt, Human
ucuguugcccaggcuggaaugc

SEQ ID NO: 28302 - RNA, 21 nt, Human
gcacacaaugcuauugaaauu

SEQ ID NO: 28303 - RNA, 19 nt, Human
aggaaagacgcugugggaa

SEQ ID NO: 28304 - RNA, 22 nt, Human
caggaggaggaggcugcaguga

SEQ ID NO: 28305 - RNA, 18 nt, Human
caguguugacacuuaaaa

SEQ ID NO: 28306 - RNA, 18 nt, Human
aggauugccaaggcucca

SEQ ID NO: 28307 - RNA, 22 nt, Human
agcaggaaaccacuguguggug

SEQ ID NO: 28308 - RNA, 25 nt, Human
uuccucccgccccaggaaaccugcc

SEQ ID NO: 28309 - RNA, 22 nt, Human
cagaucugaccacuguucucca

SEQ ID NO: 28310 - RNA, 26 nt, Human
uuugcccagguggauaaauguguaca

SEQ ID NO: 28311 - RNA, 20 nt, Human
aggcuguaacccaccugccc

SEQ ID NO: 28312 - RNA, 23 nt, Human
aacccaggccuggggggcggugg

SEQ ID NO: 28313 - RNA, 19 nt, Human
gcauuuuuaugguuccuuu

SEQ ID NO: 28314 - RNA, 22 nt, Human
aacagcucugccuccucuccag

SEQ ID NO: 28315 - RNA, 23 nt, Human
ggaguuggaagugcuauuuuccu

SEQ ID NO: 28316 - RNA, 22 nt, Human
cagagcagaggaaggcagggga

SEQ ID NO: 28317 - RNA, 23 nt, Human
aagccgcagacccuggugcaaug

SEQ ID NO: 28318 - RNA, 25 nt, Human
agcugagacccggcugugaggagcg

SEQ ID NO: 28319 - RNA, 23 nt, Human
ggaagcagccuucagugccuuca

SEQ ID NO: 28320 - RNA, 22 nt, Human
caccucccaggcucaagcaguc

SEQ ID NO: 28321 - RNA, 22 nt, Human
gcugguggcagugaccucacua

SEQ ID NO: 28322 - RNA, 28 nt, Human
cgcugcuuccuggcugggaacaacuuca

SEQ ID NO: 28323 - RNA, 22 nt, Human
caggaggcagagguugggguga

SEQ ID NO: 28324 - RNA, 21 nt, Human
ggugccggaggggaggacagg

SEQ ID NO: 28325 - RNA, 26 nt, Human
caaugccaccaguaguacgaugagcc

SEQ ID NO: 28326 - RNA, 21 nt, Human
gggagagaaggaaguggcuaa

SEQ ID NO: 28327 - RNA, 24 nt, Human
ggcaagggagagcggguggagggc

SEQ ID NO: 28328 - RNA, 26 nt, Human
aggagugaguggaguauguugcaaaa

SEQ ID NO: 28329 - RNA, 22 nt, Human
caugaagccuauugggguuaag

SEQ ID NO: 28330 - RNA, 22 nt, Human
cgagaagccagcuccuggaguu

SEQ ID NO: 28331 - RNA, 24 nt, Human
cguccgccccucacgcccucucuu

SEQ ID NO: 28332 - RNA, 23 nt, Human
auaauaguggugauauguuugcu

SEQ ID NO: 28333 - RNA, 22 nt, Human
ugcagugagccgagauagugcc

SEQ ID NO: 28334 - RNA, 24 nt, Human
gcuuucaugaauucugucauuuca

SEQ ID NO: 28335 - RNA, 20 nt, Human
uugcagaagauuacaguuau

SEQ ID NO: 28336 - RNA, 20 nt, Human
gccaaucugcucuagcugcc

SEQ ID NO: 28337 - RNA, 20 nt, Human
caggcagcagguuggaguga

SEQ ID NO: 28338 - RNA, 22 nt, Human
ccgggagacagagguugcagug

SEQ ID NO: 28339 - RNA, 22 nt, Human
aggcagaggcagguggaucacc

SEQ ID NO: 28340 - RNA, 21 nt, Human
aaggcaccugccuguuuuugu

SEQ ID NO: 28341 - RNA, 20 nt, Human
auagaugggggugggagugu

SEQ ID NO: 28342 - RNA, 27 nt, Human
agggagggcucaggcagcugagggcug

SEQ ID NO: 28343 - RNA, 21 nt, Human
ccugcagcuucagcaccugcc

SEQ ID NO: 28344 - RNA, 26 nt, Human
ugagacaaucuuguguuuccuaaacu

SEQ ID NO: 28345 - RNA, 23 nt, Human
ucuaagcaaguuuaaucuuugga

SEQ ID NO: 28346 - RNA, 27 nt, Human
gccuucuccgguccccuccucggaguc

SEQ ID NO: 28347 - RNA, 21 nt, Human
aacccaugauuccuaaacccg

SEQ ID NO: 28348 - RNA, 22 nt, Human
uuaagugcaugagaugguuuga

SEQ ID NO: 28349 - RNA, 29 nt, Human
gggaggaaagagagcaggacucacagguu

SEQ ID NO: 28350 - RNA, 20 nt, Human
gggcacgugucucagccugg

SEQ ID NO: 28351 - RNA, 27 nt, Human
ccccugcccugcccuagcugaggcaca

SEQ ID NO: 28352 - RNA, 22 nt, Human
cucugccaacaucaagcuggug

SEQ ID NO: 28353 - RNA, 21 nt, Human
guucauauguacuuguuugcu

SEQ ID NO: 28354 - RNA, 23 nt, Human
cugccaccgcccucccuccgcca

SEQ ID NO: 28355 - RNA, 21 nt, Human
ccaagaaagagucaggccuua

SEQ ID NO: 28356 - RNA, 21 nt, Human
cgaaggcagcagcagcggugg

SEQ ID NO: 28357 - RNA, 18 nt, Human
uuacccaggcuggagugc

SEQ ID NO: 28358 - RNA, 18 nt, Human
ucacccaggcuggagugu

SEQ ID NO: 28359 - RNA, 20 nt, Human
gggagggagaguuagcuagc

SEQ ID NO: 28360 - RNA, 21 nt, Human
ugggcccugauucucccucug

SEQ ID NO: 28361 - RNA, 22 nt, Human
gaauccaggaggcagagcuugc

SEQ ID NO: 28362 - RNA, 21 nt, Human
ccuccccugccaccaggccac

SEQ ID NO: 28363 - RNA, 27 nt, Human
uguacuuguuugccuuuuagguaggag

SEQ ID NO: 28364 - RNA, 21 nt, Human
uacagagucuggugaagcuca

SEQ ID NO: 28365 - RNA, 22 nt, Human
caguuuagugagacaagcaauu

SEQ ID NO: 28366 - RNA, 28 nt, Human
gucagucuucacuugcacugggggaaca

SEQ ID NO: 28367 - RNA, 24 nt, Human
ccuugaggcagaggugccgaguga

SEQ ID NO: 28368 - RNA, 25 nt, Human
cggguucagcacccaccuuucuuua

SEQ ID NO: 28369 - RNA, 22 nt, Human
gaauguucugacauuaacaguu

SEQ ID NO: 28370 - RNA, 25 nt, Human
cucuucuguucccaucuguugacaa

SEQ ID NO: 28371 - RNA, 21 nt, Human
acauuuccuuacagauuuuug

SEQ ID NO: 28372 - RNA, 23 nt, Human
cccuuugcaaugaggaggagauc

SEQ ID NO: 28373 - RNA, 26 nt, Human
cuucaaggagccaugggucugugcug

SEQ ID NO: 28374 - RNA, 22 nt, Human
agcucacuuggugauauguccu

SEQ ID NO: 28375 - RNA, 23 nt, Human
ggggagggagaagaaacgccugc

SEQ ID NO: 28376 - RNA, 23 nt, Human
ucuccaccgaagccguucugacu

SEQ ID NO: 28377 - RNA, 21 nt, Human
uuguuuuguuaauuacaccau

SEQ ID NO: 28378 - RNA, 17 nt, Human
gucagaugcuaccugcu

SEQ ID NO: 28379 - RNA, 24 nt, Human
cgggcagcaggcaggcggcgggcg

SEQ ID NO: 28380 - RNA, 19 nt, Human
ggaggugggcggggagcau

SEQ ID NO: 28381 - RNA, 20 nt, Human
auagggugccuaccuauuuc

SEQ ID NO: 28382 - RNA, 21 nt, Human
uaacugcauggcuuaaccugg

SEQ ID NO: 28383 - RNA, 27 nt, Human
acagacacuuacacauacuugaaacuu

SEQ ID NO: 28384 - RNA, 22 nt, Human
cuugcagcuguaaacauauugg

SEQ ID NO: 28385 - RNA, 22 nt, Human
agaaauguuucuguuugaagaa

SEQ ID NO: 28386 - RNA, 25 nt, Human
uacugguguucuguuuucaauguau

SEQ ID NO: 28387 - RNA, 21 nt, Human
caagcccggcaggagugcgga

SEQ ID NO: 28388 - RNA, 26 nt, Human
agggaaaggauggggaccacaaggaa

SEQ ID NO: 28389 - RNA, 20 nt, Human
gugagccaccgcccccagcc

SEQ ID NO: 28390 - RNA, 21 nt, Human
aacuugucugagacugacuuu

SEQ ID NO: 28391 - RNA, 22 nt, Human
cgccucccagguucaagagauu

SEQ ID NO: 28392 - RNA, 19 nt, Human
aacacaaaagccuuuuucc

SEQ ID NO: 28393 - RNA, 22 nt, Human
ccagagugcugggauuacaguu

SEQ ID NO: 28394 - RNA, 22 nt, Human
cugcccuuugauucggauuucc

SEQ ID NO: 28395 - RNA, 20 nt, Human
ccuaucucuuucuccaaccc

SEQ ID NO: 28396 - RNA, 23 nt, Human
gcacagccaaccuagcuagcaac

SEQ ID NO: 28397 - RNA, 21 nt, Human
ccaugauuguguucucugccu

SEQ ID NO: 28398 - RNA, 23 nt, Human
ccuuccauggaaacucaggcuga

SEQ ID NO: 28399 - RNA, 23 nt, Human
acggagcccuggcaugucaacag

SEQ ID NO: 28400 - RNA, 20 nt, Human
ucuucguccaucugcuuuuu

SEQ ID NO: 28401 - RNA, 22 nt, Human
ucauuucuuauaccuucugaca

SEQ ID NO: 28402 - RNA, 27 nt, Human
cauuauaaaaucccaacauauauacug

SEQ ID NO: 28403 - RNA, 22 nt, Human
gcagcuuccaaugccucuuguc

SEQ ID NO: 28404 - RNA, 26 nt, Human
uccccuagucccccaggagcucuuuc

SEQ ID NO: 28405 - RNA, 22 nt, Human
gcuucuauuugaagauugccuu

SEQ ID NO: 28406 - RNA, 28 nt, Human
cccuguggccucccuuguggaugggagg

SEQ ID NO: 28407 - RNA, 20 nt, Human
ccugaccuuuugcaaagcaa

SEQ ID NO: 28408 - RNA, 22 nt, Human
ccgcuaccgcaugaucaagcac

SEQ ID NO: 28409 - RNA, 22 nt, Human
agcauuuucuuacacccccucc

SEQ ID NO: 28410 - RNA, 25 nt, Human
auaauaaaaucugaauauuuuguaa

SEQ ID NO: 28411 - RNA, 22 nt, Human
aaccuggugauccgcccgccuc

SEQ ID NO: 28412 - RNA, 22 nt, Human
ucaggaggcagagguugcaaug

SEQ ID NO: 28413 - RNA, 26 nt, Human
aauuguuccuguuuucaucuagucag

SEQ ID NO: 28414 - RNA, 22 nt, Human
gcacacgccuguaaucucagcu

SEQ ID NO: 28415 - RNA, 23 nt, Human
uacauucuacaagcauugcuuuc

SEQ ID NO: 28416 - RNA, 26 nt, Human
ggguccagagcuaaauucugccugca

SEQ ID NO: 28417 - RNA, 27 nt, Human
ggggugaggguaggaggcauuuacaac

SEQ ID NO: 28418 - RNA, 25 nt, Human
gagcaaaggcugagaacacugugaa

SEQ ID NO: 28419 - RNA, 22 nt, Human
cucagcaggcuaaguugcgggg

SEQ ID NO: 28420 - RNA, 28 nt, Human
aguaguugugaggccacugugucucagg

SEQ ID NO: 28421 - RNA, 19 nt, Human
guuuaguuaggaaaaagga

SEQ ID NO: 28422 - RNA, 26 nt, Human
gcacaaaaucgcacaacgaugacgca

SEQ ID NO: 28423 - RNA, 22 nt, Human
guuccucccaguuuucuugccu

SEQ ID NO: 28424 - RNA, 20 nt, Human
ucuucccuuccccucucuca

SEQ ID NO: 28425 - RNA, 22 nt, Human
aucuagugacaccucagucaua

SEQ ID NO: 28426 - RNA, 23 nt, Human
gggguggagucaccaaaaccagu

SEQ ID NO: 28427 - RNA, 21 nt, Human
gaagugcuuuacuuaaguguu

SEQ ID NO: 28428 - RNA, 22 nt, Human
auauuuguaagugcugcuuuau

SEQ ID NO: 28429 - RNA, 30 nt, Human
gcugccuacaccuccaccuccuuccccuuc

SEQ ID NO: 28430 - RNA, 20 nt, Human
ccugcucugauucuauggcu

SEQ ID NO: 28431 - RNA, 23 nt, Human
ucggaaaguuaaauaacagggac

SEQ ID NO: 28432 - RNA, 20 nt, Human
agguggggagcugcccaggg

SEQ ID NO: 28433 - RNA, 21 nt, Human
cugugagaccuccuggaacac

SEQ ID NO: 28434 - RNA, 23 nt, Human
cacacagugauccggaucccaga

SEQ ID NO: 28435 - RNA, 22 nt, Human
uggcucacgccuauaaucccag

SEQ ID NO: 28436 - RNA, 24 nt, Human
ccucuuuguguacuucagucuugg

SEQ ID NO: 28437 - RNA, 23 nt, Human
cuuaggaggcugagguggcagaa

SEQ ID NO: 28438 - RNA, 23 nt, Human
ugagaccacagaaucagguuuuc

SEQ ID NO: 28439 - RNA, 23 nt, Human
agggggcaaaagaccaugcuaua

SEQ ID NO: 28440 - RNA, 24 nt, Human
ucucuacuggguguuccucucuaa

SEQ ID NO: 28441 - RNA, 25 nt, Human
cccggcaugaggccuuuccucaguc

SEQ ID NO: 28442 - RNA, 28 nt, Human
agcaaacccgccgggaucaaaguguacc

SEQ ID NO: 28443 - RNA, 22 nt, Human
aggccugagccccaaccccucu

SEQ ID NO: 28444 - RNA, 27 nt, Human
ggcuauguguuauuuucacugucuuuu

SEQ ID NO: 28445 - RNA, 23 nt, Human
cccacgugacaccaccgaauaua

SEQ ID NO: 28446 - RNA, 26 nt, Human
gggaagggaaaggugcaugguccaca

SEQ ID NO: 28447 - RNA, 22 nt, Human
ccaagaucgcggcgcugcacuc

SEQ ID NO: 28448 - RNA, 27 nt, Human
cuuuucuggagaguagucuagaccaag

SEQ ID NO: 28449 - RNA, 26 nt, Human
ccccuggauggacauguggacggcgc

SEQ ID NO: 28450 - RNA, 25 nt, Human
cccugcucuccccgggcugcgggcc

SEQ ID NO: 28451 - RNA, 27 nt, Human
gauuucugcuuucuucuuuagcaagau

SEQ ID NO: 28452 - RNA, 20 nt, Human
agacauggaggucagagcca

SEQ ID NO: 28453 - RNA, 20 nt, Human
aacagcuuccuucagaucug

SEQ ID NO: 28454 - RNA, 27 nt, Human
cccuccagggggcccugggccucuaug

SEQ ID NO: 28455 - RNA, 24 nt, Human
aacaacaaaaguccauucauauuu

SEQ ID NO: 28456 - RNA, 23 nt, Human
cauucaggacauaggcacaggca

SEQ ID NO: 28457 - RNA, 27 nt, Human
cugggaggugccagucauugaauagau

SEQ ID NO: 28458 - RNA, 25 nt, Human
ggggcagccugugccugccuuugug

SEQ ID NO: 28459 - RNA, 22 nt, Human
guccaccugucccuccugggcu

SEQ ID NO: 28460 - RNA, 20 nt, Human
uuuaugcacaccuaagccca

SEQ ID NO: 28461 - RNA, 23 nt, Human
ggaagaaguuguaccugacucau

SEQ ID NO: 28462 - RNA, 27 nt, Human
guuggccaggcugguggugagcuccug

SEQ ID NO: 28463 - RNA, 26 nt, Human
aaguacaugggauuucaugagccaga

SEQ ID NO: 28464 - RNA, 22 nt, Human
cuccuacuucuugcugccucac

SEQ ID NO: 28465 - RNA, 22 nt, Human
ccuggccuuggugccucuugua

SEQ ID NO: 28466 - RNA, 25 nt, Human
gggaagagaagagggcccagcccag

SEQ ID NO: 28467 - RNA, 26 nt, Human
guccaggcugcuagaggugcucaucc

SEQ ID NO: 28468 - RNA, 23 nt, Human
cccaguaaugcguguuguuuggc

SEQ ID NO: 28469 - RNA, 20 nt, Human
cggcccagagggugggcgcg

SEQ ID NO: 28470 - RNA, 25 nt, Human
uucuccccuugcucuuccuggccug

SEQ ID NO: 28471 - RNA, 20 nt, Human
cgcugcccacagccuagcag

SEQ ID NO: 28472 - RNA, 22 nt, Human
cuacaugugacuggcaguauua

SEQ ID NO: 28473 - RNA, 24 nt, Human
aggugacccauugagcuguguaug

SEQ ID NO: 28474 - RNA, 24 nt, Human
uguggcuucuguggcuuucauuug

SEQ ID NO: 28475 - RNA, 22 nt, Human
ucccaccucgaggcucuucuuc

SEQ ID NO: 28476 - RNA, 27 nt, Human
acaagggcagagaguccgucuagauuu

SEQ ID NO: 28477 - RNA, 18 nt, Human
uauuugaccguuuccaaa

SEQ ID NO: 28478 - RNA, 22 nt, Human
aucaacuuggaaaggaaacaaa

SEQ ID NO: 28479 - RNA, 23 nt, Human
cuggagugguugagguguugucc

SEQ ID NO: 28480 - RNA, 21 nt, Human
cacauucuacuucagcuuugg

SEQ ID NO: 28481 - RNA, 23 nt, Human
ucucccuguguuacccaggcugg

SEQ ID NO: 28482 - RNA, 21 nt, Human
cuggcugcugugcccacccuc

SEQ ID NO: 28483 - RNA, 24 nt, Human
uggcuaacacggugaaaccccguc

SEQ ID NO: 28484 - RNA, 27 nt, Human
ugcagcucuggaaagaggguuuaagau

SEQ ID NO: 28485 - RNA, 19 nt, Human
ucucuuguuuucuagaacu

SEQ ID NO: 28486 - RNA, 30 nt, Human
cacuccccacucucagccugggagacuccu

SEQ ID NO: 28487 - RNA, 19 nt, Human
ccgugucugucugucuugc

SEQ ID NO: 28488 - RNA, 26 nt, Human
ccagugcuggacccggccaggagaca

SEQ ID NO: 28489 - RNA, 27 nt, Human
ugcugugguucugacacacaggauccc

SEQ ID NO: 28490 - RNA, 18 nt, Human
ggggucuugggcauuuca

SEQ ID NO: 28491 - RNA, 22 nt, Human
cucaugucugugucccaugguc

SEQ ID NO: 28492 - RNA, 21 nt, Human
acagguugaagaacuggagcg

SEQ ID NO: 28493 - RNA, 23 nt, Human
agacuaacugggcucaaggggug

SEQ ID NO: 28494 - RNA, 21 nt, Human
ggcccggcucacauucgucag

SEQ ID NO: 28495 - RNA, 20 nt, Human
ccaggaccacacagucccca

SEQ ID NO: 28496 - RNA, 27 nt, Human
gacaagcuuacaucuuccucagccauc

SEQ ID NO: 28497 - RNA, 22 nt, Human
ccaaagcacugggauuacaggc

SEQ ID NO: 28498 - RNA, 22 nt, Human
ucagaauuuccuucagugccuc

SEQ ID NO: 28499 - RNA, 23 nt, Human
cuccucacugucgcugccgagau

SEQ ID NO: 28500 - RNA, 27 nt, Human
agaacaacaguugggcugucaacauuc

SEQ ID NO: 28501 - RNA, 22 nt, Human
uucucuugaagaacugacuagu

SEQ ID NO: 28502 - RNA, 25 nt, Human
gcccagaagacagacccacagcccu

SEQ ID NO: 28503 - RNA, 22 nt, Human
uucaccagccuguaucuugucu

SEQ ID NO: 28504 - RNA, 27 nt, Human
cuggagugcugcgggcagccuuucuca

SEQ ID NO: 28505 - RNA, 22 nt, Human
gcaggaggaucacuugagguca

SEQ ID NO: 28506 - RNA, 22 nt, Human
cuccacuuugcuucugaaggcc

SEQ ID NO: 28507 - RNA, 24 nt, Human
gccgggcaugagcugcuguaaacu

SEQ ID NO: 28508 - RNA, 26 nt, Human
ucuccacccuuuccccuucuuucguc

SEQ ID NO: 28509 - RNA, 22 nt, Human
ugggccauuaaccccaacaugg

SEQ ID NO: 28510 - RNA, 21 nt, Human
uuugcuugccuauaggaguua

SEQ ID NO: 28511 - RNA, 23 nt, Human
accgcacccugcuaauuuuuugu

SEQ ID NO: 28512 - RNA, 24 nt, Human
ugcacuuucuuccugccuuaggua

SEQ ID NO: 28513 - RNA, 27 nt, Human
cccuuaaacaggugaucccaccugucu

SEQ ID NO: 28514 - RNA, 22 nt, Human
augcuuagaauauggucacaga

SEQ ID NO: 28515 - RNA, 20 nt, Human
aauaaaugccacuucaccaa

SEQ ID NO: 28516 - RNA, 22 nt, Human
gucucccaggcuggagugcaau

SEQ ID NO: 28517 - RNA, 22 nt, Human
gucacccaggcuggagugcuau

SEQ ID NO: 28518 - RNA, 25 nt, Human
ggccccacagcagaguucaacugga

SEQ ID NO: 28519 - RNA, 21 nt, Human
gagaagagcaaggguucccuc

SEQ ID NO: 28520 - RNA, 22 nt, Human
accgugcacuucuccucucugg

SEQ ID NO: 28521 - RNA, 23 nt, Human
auucaggcucacauauguuacag

SEQ ID NO: 28522 - RNA, 21 nt, Human
acugaaaaaugaguuuagaaa

SEQ ID NO: 28523 - RNA, 29 nt, Human
aaugguuuccuccauuugagaaaauaaag

SEQ ID NO: 28524 - RNA, 18 nt, Human
ccugugcauaaugccuug

SEQ ID NO: 28525 - RNA, 29 nt, Human
aagagagaaguaauggaaggccugucuga

SEQ ID NO: 28526 - RNA, 22 nt, Human
gaggaagagaagaaacauggca

SEQ ID NO: 28527 - RNA, 27 nt, Human
ccaggagguggaggaaggagcaggugc

SEQ ID NO: 28528 - RNA, 22 nt, Human
ggaggugggaggacaguuagac

SEQ ID NO: 28529 - RNA, 23 nt, Human
augggcauccugaagcugcaagu

SEQ ID NO: 28530 - RNA, 23 nt, Human
caaauaccuaacuguacagugag

SEQ ID NO: 28531 - RNA, 23 nt, Human
ccaacuccugggcucaaggcauc

SEQ ID NO: 28532 - RNA, 21 nt, Human
uuguggguuuugaaugcaucu

SEQ ID NO: 28533 - RNA, 22 nt, Human
cuccaaaacaaaaauuagagga

SEQ ID NO: 28534 - RNA, 26 nt, Human
gggugagguaauaaaccuuaggaacu

SEQ ID NO: 28535 - RNA, 23 nt, Human
gaguccacaguucugaaacaugu

SEQ ID NO: 28536 - RNA, 25 nt, Human
gcaaaaacuauuuuaagacuuucug

SEQ ID NO: 28537 - RNA, 21 nt, Human
gaagagccuaucugucaucgc

SEQ ID NO: 28538 - RNA, 32 nt, Human; identical to SEQ ID NO: 5604

SEQ ID NO: 28539 - RNA, 22 nt, Human
auuuccucuccgcuugcaaccu

SEQ ID NO: 28540 - RNA, 23 nt, Human
ccggcucccgcccagccugugug

SEQ ID NO: 28541 - RNA, 28 nt, Human
gccaaguauucugccaauucacccugga

SEQ ID NO: 28542 - RNA, 27 nt, Human
accguaauuuacaguauaaauguaaua

SEQ ID NO: 28543 - RNA, 27 nt, Human
aucucuaguuggccagcgucuugcucu

SEQ ID NO: 28544 - RNA, 22 nt, Human
ccuccaucucucaccuuuuccu

SEQ ID NO: 28545 - RNA, 22 nt, Human
gucacccaggcugcaguguagu

SEQ ID NO: 28546 - RNA, 19 nt, Human
aggguggaagacgggggaa

SEQ ID NO: 28547 - RNA, 19 nt, Human
agccucuacagucacaaga

SEQ ID NO: 28548 - RNA, 25 nt, Human
ccuggcagggcucacacuccugggc

SEQ ID NO: 28549 - RNA, 26 nt, Human
ggaaggcaggcaugggguguggcccu

SEQ ID NO: 28550 - RNA, 20 nt, Human
cauucuacuugcucuggacc

SEQ ID NO: 28551 - RNA, 20 nt, Human
ucgggccaaaccccaagaca

SEQ ID NO: 28552 - RNA, 27 nt, Human
cccucugggaaccucccagagguccag

SEQ ID NO: 28553 - RNA, 19 nt, Human
ggccucucuggcugggugc

SEQ ID NO: 28554 - RNA, 21 nt, Human
guguggggcguggcagggggg

SEQ ID NO: 28555 - RNA, 23 nt, Human
ugaacuccugacccucaagugau

SEQ ID NO: 28556 - RNA, 20 nt, Human
ucugcagagccugagcugcu

SEQ ID NO: 28557 - RNA, 21 nt, Human
agcccuguggcuuccaccuca

SEQ ID NO: 28558 - RNA, 18 nt, Human
caccagccagcauggugg

SEQ ID NO: 28559 - RNA, 25 nt, Human
ccugaaaacugcuuggcauuugagu

SEQ ID NO: 28560 - RNA, 22 nt, Human
agaccagccuggucaacauagu

SEQ ID NO: 28561 - RNA, 28 nt, Human
agacucacugcaaguuccugcccaggag

SEQ ID NO: 28562 - RNA, 26 nt, Human
ccaauccuuuauagcuuuggagacgc

SEQ ID NO: 28563 - RNA, 23 nt, Human
ucaaaaacugggaccaaccaaag

SEQ ID NO: 28564 - RNA, 22 nt, Human
gcccagucuuccuccuugugcu

SEQ ID NO: 28565 - RNA, 22 nt, Human
uuccaguuuugagcagagguga

SEQ ID NO: 28566 - RNA, 23 nt, Human
cggaugcucacuccaaagucuca

SEQ ID NO: 28567 - RNA, 27 nt, Human
uggccagagcaauugacugggagcugg

SEQ ID NO: 28568 - RNA, 30 nt, Human
ucauucauucuuuaucauccuguguucugu

SEQ ID NO: 28569 - RNA, 20 nt, Human
cuguggcccagcugcccagc

SEQ ID NO: 28570 - RNA, 22 nt, Human
ucugugccuguuaugaaugaaa

SEQ ID NO: 28571 - RNA, 19 nt, Human
cccugcucucuccuuuccc

SEQ ID NO: 28572 - RNA, 27 nt, Human
caccaccucuuugggccuggcugggug

SEQ ID NO: 28573 - RNA, 20 nt, Human
ggcaaccaaauguggcuuga

SEQ ID NO: 28574 - RNA, 22 nt, Human
gaggcacugugcucggaaguua

SEQ ID NO: 28575 - RNA, 22 nt, Human
acugcaagcuccgccucucggg

SEQ ID NO: 28576 - RNA, 20 nt, Human
cccacuggggaccaggcugg

SEQ ID NO: 28577 - RNA, 23 nt, Human
gcaagaucaugaaggugugcaaa

SEQ ID NO: 28578 - RNA, 20 nt, Human
caaaugcaaaugcagaagac

SEQ ID NO: 28579 - RNA, 26 nt, Human
cugugucgcccagacuggagugcagu

SEQ ID NO: 28580 - RNA, 23 nt, Human
ccagcucuacuccaggcuuccac

SEQ ID NO: 28581 - RNA, 20 nt, Human
ucccuuuaaaccagauccug

SEQ ID NO: 28582 - RNA, 23 nt, Human
uugcccaggcugggagggcaaug

SEQ ID NO: 28583 - RNA, 22 nt, Human
cucugggcaugggguggacaug

SEQ ID NO: 28584 - RNA, 24 nt, Human
agagguggggaacaaguaaaagcu

SEQ ID NO: 28585 - RNA, 27 nt, Human
uuccaaaacacacaguuaccugguuca

SEQ ID NO: 28586 - RNA, 26 nt, Human
auggcuguguccacugcaauuggugu

SEQ ID NO: 28587 - RNA, 25 nt, Human
gccauuaugccuggcuaauuuuugu

SEQ ID NO: 28588 - RNA, 24 nt, Human
gcagccuggccacugccuagcugg

SEQ ID NO: 28589 - RNA, 28 nt, Human
aacuuuugacugaauuacaauuacuccu

SEQ ID NO: 28590 - RNA, 24 nt, Human
agugugucccaacacaguccuggg

SEQ ID NO: 28591 - RNA, 24 nt, Human
cuugcagaaucugaaugugucucc

SEQ ID NO: 28592 - RNA, 25 nt, Human
ugugagccaggcaggguagggauua

SEQ ID NO: 28593 - RNA, 22 nt, Human
aagugguugugauugcaaggau

SEQ ID NO: 28594 - RNA, 20 nt, Human
cuuugcugcauucugccucu

SEQ ID NO: 28595 - RNA, 22 nt, Human
cacugacugcuuacucuaccuu

SEQ ID NO: 28596 - RNA, 22 nt, Human
cacccaggcugcagugccaugc

SEQ ID NO: 28597 - RNA, 21 nt, Human
agcaagaagccaaaaguggga

SEQ ID NO: 28598 - RNA, 24 nt, Human
gcaucaguucugucaagcuucauu

SEQ ID NO: 28599 - RNA, 28 nt, Human
ccagugacuccggcagcggcgaugaggg

SEQ ID NO: 28600 - RNA, 22 nt, Human
augucccugggccagggucugu

SEQ ID NO: 28601 - RNA, 26 nt, Human
guugccuugcuagaguuuggagcagg

SEQ ID NO: 28602 - RNA, 27 nt, Human
cagccuuggcacacaggcacaagggcu

SEQ ID NO: 28603 - RNA, 27 nt, Human
cccuccuggucuguauccugggccuca

SEQ ID NO: 28604 - RNA, 21 nt, Human
caaggugggaguaucgcuuga

SEQ ID NO: 28605 - RNA, 24 nt, Human
cuccaccucacucuccugccuuga

SEQ ID NO: 28606 - RNA, 23 nt, Human
cggggaggggcacugagaugggc

SEQ ID NO: 28607 - RNA, 20 nt, Human
gacuggcuucacuuccuccg

SEQ ID NO: 28608 - RNA, 22 nt, Human
aggcugaggcacaagaaucacu

SEQ ID NO: 28609 - RNA, 25 nt, Human
ccugcugaugcugcccuggguccag

SEQ ID NO: 28610 - RNA, 21 nt, Human
ccuuugucaaaugguauuuuu

SEQ ID NO: 28611 - RNA, 21 nt, Human
ccuguagucccggcacuuugg

SEQ ID NO: 28612 - RNA, 20 nt, Human
ucaacgauuuggaagucaga

SEQ ID NO: 28613 - RNA, 23 nt, Human
ggcuuuggguugcaggaccucag

SEQ ID NO: 28614 - RNA, 22 nt, Human
uugccuaggcuggaaauaggau

SEQ ID NO: 28615 - RNA, 21 nt, Human
ccaaaaaguauuccacuggag

SEQ ID NO: 28616 - RNA, 24 nt, Human
cccaaaguguugggauuauaagcg

SEQ ID NO: 28617 - RNA, 22 nt, Human
gugcccaggccuguggguagug

SEQ ID NO: 28618 - RNA, 24 nt, Human
gcauccagcaagaacugcacaaga

SEQ ID NO: 28619 - RNA, 27 nt, Human
ccugggucuucccucucccugccucag

SEQ ID NO: 28620 - RNA, 19 nt, Human
agggacauguuggccaggc

SEQ ID NO: 28621 - RNA, 24 nt, Human
cugucacccagacuggagugcagg

SEQ ID NO: 28622 - RNA, 26 nt, Human
gccaggauggcggugugccgugacag

SEQ ID NO: 28623 - RNA, 29 nt, Human
ugcacuccagggcaucacauccuggggcu

SEQ ID NO: 28624 - RNA, 23 nt, Human
gcucugaacaaacacugaaucau

SEQ ID NO: 28625 - RNA, 25 nt, Human
ucuucuggcccuuagcuggugccac

SEQ ID NO: 28626 - RNA, 23 nt, Human
ggugcucacgccuguaauccuag

SEQ ID NO: 28627 - RNA, 30 nt, Human
cauuuugggagaaauaacuaaagcccgccu

SEQ ID NO: 28628 - RNA, 23 nt, Human
cuagcauaucagucacugggccc

SEQ ID NO: 28629 - RNA, 21 nt, Human
cucaggaggcugaggugggaa

SEQ ID NO: 28630 - RNA, 23 nt, Human
uugcaagaguuuaauuuuugaaa

SEQ ID NO: 28631 - RNA, 20 nt, Human
cuccuguaauuugcacuuuc

SEQ ID NO: 28632 - RNA, 22 nt, Human
ggucgagacaaugaaacaagac

SEQ ID NO: 28633 - RNA, 32 nt, Human
uuuuggggacuuuucucucuuuacccaccucc

SEQ ID NO: 28634 - RNA, 22 nt, Human
uaaagagaccaccuucacuugu

SEQ ID NO: 28635 - RNA, 26 nt, Human
gcccuuuaacuugucuucuaguuuag

SEQ ID NO: 28636 - RNA, 19 nt, Human
ccagacuggagugcagugg

SEQ ID NO: 28637 - RNA, 27 nt, Human
cagguuuagaggaccagugaguuggga

SEQ ID NO: 28638 - RNA, 22 nt, Human
acagcugcuuucuucuuacacc

SEQ ID NO: 28639 - RNA, 21 nt, Human
ggccagugccugcagccugcc

SEQ ID NO: 28640 - RNA, 19 nt, Human
cgccugacagcauaccuca

SEQ ID NO: 28641 - RNA, 22 nt, Human
ccggccucccugaggcgagggu

SEQ ID NO: 28642 - RNA, 22 nt, Human
uuucucggcccuggacugaggc

SEQ ID NO: 28643 - RNA, 24 nt, Human
acccaggcuggagugcaaugacgc

SEQ ID NO: 28644 - RNA, 21 nt, Human
gccuggggcagccuccuuccu

SEQ ID NO: 28645 - RNA, 21 nt, Human
cucagcccaggcagccagcuu

SEQ ID NO: 28646 - RNA, 25 nt, Human
ugggucacagaguuccacuuuuucc

SEQ ID NO: 28647 - RNA, 18 nt, Human
ucaagauguuuuaaucac

SEQ ID NO: 28648 - RNA, 25 nt, Human
cugaacuauaucuugacaaauauua

SEQ ID NO: 28649 - RNA, 20 nt, Human
ugcuucgaagucccucucuu

SEQ ID NO: 28650 - RNA, 23 nt, Human
caguucacugcagccucaaccuc

SEQ ID NO: 28651 - RNA, 25 nt, Human
uuucugaagaaagcagaagcucucu

SEQ ID NO: 28652 - RNA, 22 nt, Human
ugcaacaaaugaaauccacaug

SEQ ID NO: 28653 - RNA, 26 nt, Human
uugcaauuuauucuugcuucauucug

SEQ ID NO: 28654 - RNA, 22 nt, Human
ccaacauggcgaaaccccauuu

SEQ ID NO: 28655 - RNA, 23 nt, Human
ucgugacagccucugacucacca

SEQ ID NO: 28656 - RNA, 21 nt, Human
aauugcacuucacugcagcuu

SEQ ID NO: 28657 - RNA, 21 nt, Human
gccagccacaccacaggaucu

SEQ ID NO: 28658 - RNA, 21 nt, Human
cccugcagaggucgcgugcug

SEQ ID NO: 28659 - RNA, 24 nt, Human
ccuggguagaagggaaaagacugg

SEQ ID NO: 28660 - RNA, 22 nt, Human
aucuugacaaagccucuucugu

SEQ ID NO: 28661 - RNA, 23 nt, Human
uacucaggcagugcaguacucag

SEQ ID NO: 28662 - RNA, 21 nt, Human
agacccacaugggagucuccc

SEQ ID NO: 28663 - RNA, 19 nt, Human
guugcucaggcugaucuca

SEQ ID NO: 28664 - RNA, 23 nt, Human
ccuuccuccuccucuuccugacc

SEQ ID NO: 28665 - RNA, 27 nt, Human
agggaaagacgucagguuccuuuaauc

SEQ ID NO: 28666 - RNA, 22 nt, Human
cuaagucccuauucacugugcu

SEQ ID NO: 28667 - RNA, 25 nt, Human
uuuuuuaaaguaauguuuuuucuua

SEQ ID NO: 28668 - RNA, 22 nt, Human
ucauccagcucacucaucaaug

SEQ ID NO: 28669 - RNA, 28 nt, Human
gugagacgccaccauuccuggaaaccac

SEQ ID NO: 28670 - RNA, 21 nt, Human
gcucacaucugaaucuccuug

SEQ ID NO: 28671 - RNA, 27 nt, Human
cugugugacuuugggcaagccaagugc

SEQ ID NO: 28672 - RNA, 20 nt, Human
ugcccucgagccaaugagaa

SEQ ID NO: 28673 - RNA, 19 nt, Human
uacuuccugccaagcauuc

SEQ ID NO: 28674 - RNA, 21 nt, Human
ucgaaaucaaaccaccaggca

SEQ ID NO: 28675 - RNA, 20 nt, Human
ucuaagauacaaugaagcca

SEQ ID NO: 28676 - RNA, 22 nt, Human
gaccucccaggcucaagcgauc

SEQ ID NO: 28677 - RNA, 20 nt, Human
uucuguucuuucuggcagcu

SEQ ID NO: 28678 - RNA, 22 nt, Human
aauugcuuguuaaaauauuuua

SEQ ID NO: 28679 - RNA, 22 nt, Human
uccucauccuccuccuccucca

SEQ ID NO: 28680 - RNA, 21 nt, Human
uuuggagcugugcuuacuggc

SEQ ID NO: 28681 - RNA, 23 nt, Human
uaucacccaggcuggaguggagu

SEQ ID NO: 28682 - RNA, 27 nt, Human
gggagcacuggugugaacucacccugg

SEQ ID NO: 28683 - RNA, 25 nt, Human
cuccggucacucuugcuguggugcu

SEQ ID NO: 28684 - RNA, 21 nt, Human
agcuuucaaagaaaaaccaga

SEQ ID NO: 28685 - RNA, 26 nt, Human
gcauuuucacagcugacugaccacuc

SEQ ID NO: 28686 - RNA, 28 nt, Human
ggaggagggagagaucaggaaaaauaac

SEQ ID NO: 28687 - RNA, 20 nt, Human
ggaacagaucugaugaugcc

SEQ ID NO: 28688 - RNA, 23 nt, Human
guggagcagggucuucaccuuuu

SEQ ID NO: 28689 - RNA, 20 nt, Human
ccagggaugccaucuguggg

SEQ ID NO: 28690 - RNA, 24 nt, Human
ugccaaccagggauuaaagcuauu

SEQ ID NO: 28691 - RNA, 26 nt, Human
cugggcuuggaucuauccugaucugg

SEQ ID NO: 28692 - RNA, 19 nt, Human
uggugcugggacugagcca

SEQ ID NO: 28693 - RNA, 22 nt, Human
auaguggcaagaucauagcuca

SEQ ID NO: 28694 - RNA, 23 nt, Human
uaagaagcuaagaaaauauuucu

SEQ ID NO: 28695 - RNA, 22 nt, Human
auggaaauccuggagaauagua

SEQ ID NO: 28696 - RNA, 30 nt, Human
gggaccuggugggagagaggggacuuccag

SEQ ID NO: 28697 - RNA, 19 nt, Human
uaccagccagccuccagaa

SEQ ID NO: 28698 - RNA, 23 nt, Human
agcagaaaggauucagcauuuaa

SEQ ID NO: 28699 - RNA, 24 nt, Human
ggcaggagagggggaagaacucuc

SEQ ID NO: 28700 - RNA, 20 nt, Human
uggguaaggaaauggaauac

SEQ ID NO: 28701 - RNA, 26 nt, Human
ucuuuagagcucagcuuucugaggcc

SEQ ID NO: 28702 - RNA, 26 nt, Human
ggccuggaaauagugugauuagaaca

SEQ ID NO: 28703 - RNA, 22 nt, Human
gcgugugcgcuccagcccagcc

SEQ ID NO: 28704 - RNA, 25 nt, Human
caguggagcccguggucucaggccu

SEQ ID NO: 28705 - RNA, 26 nt, Human
cugccuggcuccacgugccuccuggu

SEQ ID NO: 28706 - RNA, 19 nt, Human
guuugaguuuugcagacuu

SEQ ID NO: 28707 - RNA, 22 nt, Human
agggauacuggagcuucuucau

SEQ ID NO: 28708 - RNA, 26 nt, Human
uacccuuuaaacugucacugcauaug

SEQ ID NO: 28709 - RNA, 30 nt, Human
ccuggugaccaaaguggcuccggucagcgc

SEQ ID NO: 28710 - RNA, 23 nt, Human
uuccagcaauucuucugccucag

SEQ ID NO: 28711 - RNA, 21 nt, Human
gaucuuccacugcaaauuuca

SEQ ID NO: 28712 - RNA, 27 nt, Human
ccuccacuccuucccaaaucugucucc

SEQ ID NO: 28713 - RNA, 27 nt, Human
gcugcauugacaggcagcccuaggcag

SEQ ID NO: 28714 - RNA, 20 nt, Human
aggcuguagaucagagguuc

SEQ ID NO: 28715 - RNA, 27 nt, Human
gauuacauugagccuauucagaaaaaa

SEQ ID NO: 28716 - RNA, 31 nt, Human
ggccucuucuggccagggccugugcugcagu

SEQ ID NO: 28717 - RNA, 23 nt, Human
uucaugccauucugccucagccu

SEQ ID NO: 28718 - RNA, 26 nt, Human
gggcaggguagagaggguauguccag

SEQ ID NO: 28719 - RNA, 27 nt, Human
gcccuggugguggcucgggaggcgaag

SEQ ID NO: 28720 - RNA, 22 nt, Human
gcuuaccuuggaaaggugggaa

SEQ ID NO: 28721 - RNA, 23 nt, Human
ucuccugccagagcucgggaucu

SEQ ID NO: 28722 - RNA, 21 nt, Human
cgggaggcggagguugcagug

SEQ ID NO: 28723 - RNA, 26 nt, Human
ggcgggacuccucccugggggugggg

SEQ ID NO: 28724 - RNA, 27 nt, Human
aaauguucuaaaauugugauggcggau

SEQ ID NO: 28725 - RNA, 26 nt, Human
uuggugcauaaaguuaaaaugcacau

SEQ ID NO: 28726 - RNA, 20 nt, Human
ugcaggugaguuugcaauga

SEQ ID NO: 28727 - RNA, 21 nt, Human
ggcagcucugagccgcgcuuu

SEQ ID NO: 28728 - RNA, 23 nt, Human
uugggguuuguuuuguuuugauu

SEQ ID NO: 28729 - RNA, 23 nt, Human
cuuuacuaccucuaccugcagaa

SEQ ID NO: 28730 - RNA, 19 nt, Human
gugcccaggagcggcgaug

SEQ ID NO: 28731 - RNA, 21 nt, Human
uguucugagaucaaaguggug

SEQ ID NO: 28732 - RNA, 25 nt, Human
gggcucaagugauccucccaccuca

SEQ ID NO: 28733 - RNA, 19 nt, Human
cccucuguccaaccacugu

SEQ ID NO: 28734 - RNA, 31 nt, Human
gagguguagggguggaaugagccgcggggaa

SEQ ID NO: 28735 - RNA, 23 nt, Human
ugucacccaggcuggaguguagu

SEQ ID NO: 28736 - RNA, 28 nt, Human
ggcaguucuggggguuccuguuccuccu

SEQ ID NO: 28737 - RNA, 23 nt, Human
uguuacccaggcuggagugcagu

SEQ ID NO: 28738 - RNA, 23 nt, Human
ugucacccagguuggagugcagu

SEQ ID NO: 28739 - RNA, 23 nt, Human
uguugcccaggcuggagugcggu

SEQ ID NO: 28740 - RNA, 24 nt, Human
agggucgagccuaggggagcuuga

SEQ ID NO: 28741 - RNA, 25 nt, Human
cauccagcaguccaagguauugaga

SEQ ID NO: 28742 - RNA, 24 nt, Human
cagcaugguucacuccagcauggg

SEQ ID NO: 28743 - RNA, 23 nt, Human
guuauaguucuaauauggagaug

SEQ ID NO: 28744 - RNA, 20 nt, Human
cugcuuucagugccugcugu

SEQ ID NO: 28745 - RNA, 22 nt, Human
gccauggcuuccaaaugccuca

SEQ ID NO: 28746 - RNA, 23 nt, Human
gacaggcugagagcaccucccca

SEQ ID NO: 28747 - RNA, 28 nt, Human
gcucuuaaguucuucccaaugaucugag

SEQ ID NO: 28748 - RNA, 22 nt, Human
cagggcacccaaaccucccuuc

SEQ ID NO: 28749 - RNA, 25 nt, Human
uacuuuuggguucacagaagcacag

SEQ ID NO: 28750 - RNA, 18 nt, Human
gcucacugcuucugcuuu

SEQ ID NO: 28751 - RNA, 21 nt, Human
gcaguguccaggagcggcaga

SEQ ID NO: 28752 - RNA, 20 nt, Human
gcuggguauuaccauguaaa

SEQ ID NO: 28753 - RNA, 21 nt, Human
aggugcuugggaacugcuggu

SEQ ID NO: 28754 - RNA, 26 nt, Human
ugcaccccuuccugggcacacgcugc

SEQ ID NO: 28755 - RNA, 20 nt, Human
ccucagacaguuugcuuauu

SEQ ID NO: 28756 - RNA, 19 nt, Human
ccuggcuggccaacuggug

SEQ ID NO: 28757 - RNA, 23 nt, Human
agagaaaaccaggagacacuccc

SEQ ID NO: 28758 - RNA, 25 nt, Human
ugcuccuagccugugcucugccagc

SEQ ID NO: 28759 - RNA, 20 nt, Human
cccucagccucucagugccu

SEQ ID NO: 28760 - RNA, 22 nt, Human
caucugucgcaccccuguauuu

SEQ ID NO: 28761 - RNA, 22 nt, Human
gcaucauuacaauacaguauuu

SEQ ID NO: 28762 - RNA, 23 nt, Human
accaguggagacuugcacaucug

SEQ ID NO: 28763 - RNA, 16 nt, Human
ucucccacugccucca

SEQ ID NO: 28764 - RNA, 27 nt, Human
gaggaagcaaaggguuuuguuuuggag

SEQ ID NO: 28765 - RNA, 22 nt, Human
gcucacugcagccucugccucc

SEQ ID NO: 28766 - RNA, 23 nt, Human
uccucccucaugagcacaggguc

SEQ ID NO: 28767 - RNA, 21 nt, Human
guuuacacaccuuugaaaauc

SEQ ID NO: 28768 - RNA, 20 nt, Human
ugcucuguguaccugcagca

SEQ ID NO: 28769 - RNA, 27 nt, Human
ggcaaagcucuuccauuuugagagaga

SEQ ID NO: 28770 - RNA, 26 nt, Human
ccuugcugccaggaagcuucggcccc

SEQ ID NO: 28771 - RNA, 19 nt, Human
gcuuaauccauuugagugc

SEQ ID NO: 28772 - RNA, 21 nt, Human
uugccaccauuuguagaccac

SEQ ID NO: 28773 - RNA, 28 nt, Human
uuacaucuuccucagccaucuuugugag

SEQ ID NO: 28774 - RNA, 25 nt, Human
uggaccaguguuugcuuagugucuu

SEQ ID NO: 28775 - RNA, 22 nt, Human
caggcaagagugcagugguaug

SEQ ID NO: 28776 - RNA, 22 nt, Human
ggaucagcucagacauauuuca

SEQ ID NO: 28777 - RNA, 28 nt, Human
cuuuccuaccuucuucaggcugccuaag

SEQ ID NO: 28778 - RNA, 24 nt, Human
uugucacccaggcuggagugcagu

SEQ ID NO: 28779 - RNA, 24 nt, Human
cugucaccuaggcuggagugcagu

SEQ ID NO: 28780 - RNA, 22 nt, Human
gccucaagaggccucagaacug

SEQ ID NO: 28781 - RNA, 23 nt, Human
uccaugguagcugggauguuagg

SEQ ID NO: 28782 - RNA, 21 nt, Human
cucgaguggggucaggugccu

SEQ ID NO: 28783 - RNA, 27 nt, Human
uaaccaaaaaauugcaauuuguuuaau

SEQ ID NO: 28784 - RNA, 26 nt, Human
ccaagcuauuaaacaaaaaguaugca

SEQ ID NO: 28785 - RNA, 27 nt, Human
ugugaucaaacugucaggcuuggguuc

SEQ ID NO: 28786 - RNA, 29 nt, Human
ucugcuuuuaaguuuuucucuuuuucaga

SEQ ID NO: 28787 - RNA, 27 nt, Human
ggucucgaugaucugaccucgugaucu

SEQ ID NO: 28788 - RNA, 23 nt, Human
ucaucacuuugauuucuaaucca

SEQ ID NO: 28789 - RNA, 22 nt, Human
aaggagucaggagccacuguga

SEQ ID NO: 28790 - RNA, 25 nt, Human
ucuugauaaagaagauucugugguc

SEQ ID NO: 28791 - RNA, 26 nt, Human
aaauuccugcaaaauuaccuacccca

SEQ ID NO: 28792 - RNA, 27 nt, Human
uuagaaacacaauucuaacuaaagaua

SEQ ID NO: 28793 - RNA, 27 nt, Human
acaugcugcugcuacugcuaacagcca

SEQ ID NO: 28794 - RNA, 27 nt, Human
gcccuacucucuuaugcauuaguauca

SEQ ID NO: 28795 - RNA, 20 nt, Human
uucauucuucauggcauccu

SEQ ID NO: 28796 - RNA, 27 nt, Human
ccuccucccucuuuuccucuggaugca

SEQ ID NO: 28797 - RNA, 20 nt, Human
agaggacgacuucaggaugc

SEQ ID NO: 28798 - RNA, 22 nt, Human
aucugcacgucacaccucuuuc

SEQ ID NO: 28799 - RNA, 22 nt, Human
cccuccuccuccuucuuugcca

SEQ ID NO: 28800 - RNA, 18 nt, Human
cggcaccgggcacauccu

SEQ ID NO: 28801 - RNA, 27 nt, Human
cagucucuguuucauggcaacacugga

SEQ ID NO: 28802 - RNA, 23 nt, Human
gaccuggugauccacccaccucg

SEQ ID NO: 28803 - RNA, 26 nt, Human
uagcagccauguggugggcaugugug

SEQ ID NO: 28804 - RNA, 20 nt, Human
ucaguguuuaugugcuauua

SEQ ID NO: 28805 - RNA, 23 nt, Human
acaaaagcggaagaugcugcagu

SEQ ID NO: 28806 - RNA, 18 nt, Human
gcucagauugaaaggagg

SEQ ID NO: 28807 - RNA, 22 nt, Human
ucagagcagaggggccaggacu

SEQ ID NO: 28808 - RNA, 23 nt, Human
uccuggcaguggggacugccugg

SEQ ID NO: 28809 - RNA, 21 nt, Human
aauccaugcaagugggagaaa

SEQ ID NO: 28810 - RNA, 25 nt, Human
cuaccaugcuccuuccuucaucccg

SEQ ID NO: 28811 - RNA, 24 nt, Human
ucaaagaaauaacaucauccauug

SEQ ID NO: 28812 - RNA, 17 nt, Human
guggaaagucagaggaa

SEQ ID NO: 28813 - RNA, 22 nt, Human
acaagugucuuauauaugcaga

SEQ ID NO: 28814 - RNA, 24 nt, Human
gagagggagguauggacugggggc

SEQ ID NO: 28815 - RNA, 27 nt, Human
cacuccaggcugggcagcaagagcaag

SEQ ID NO: 28816 - RNA, 25 nt, Human
uuguggccugcuugucccucuguug

SEQ ID NO: 28817 - RNA, 32 nt, Human
ccaacuucucagcauguuucucuccuuggacc

SEQ ID NO: 28818 - RNA, 25 nt, Human
uuucugccauaccccaugcccagcc

SEQ ID NO: 28819 - RNA, 19 nt, Human
agcauuguaaaagcauuuu

SEQ ID NO: 28820 - RNA, 19 nt, Human
aucaagugacuucugccca

SEQ ID NO: 28821 - RNA, 23 nt, Human
cacagcccaggccacagccaggg

SEQ ID NO: 28822 - RNA, 19 nt, Human
ccuggcagaggaagaagga

SEQ ID NO: 28823 - RNA, 19 nt, Human
auauaaucacugcugugau

SEQ ID NO: 28824 - RNA, 23 nt, Human
agcagaagaucgucaguauuuaa

SEQ ID NO: 28825 - RNA, 26 nt, Human
cuaggagaaccuggggguggauuugg

SEQ ID NO: 28826 - RNA, 22 nt, Human
uacuuccccucucuacuuccuc

SEQ ID NO: 28827 - RNA, 22 nt, Human
gccucucuguuacuuuuggccu

SEQ ID NO: 28828 - RNA, 19 nt, Human
ucucagccugccgcccagc

SEQ ID NO: 28829 - RNA, 22 nt, Human
agcuuugcucagaucagaucga

SEQ ID NO: 28830 - RNA, 26 nt, Human
auccuucagguccccacccucagcug

SEQ ID NO: 28831 - RNA, 27 nt, Human
uuaucuagaucuggguaauuucauguu

SEQ ID NO: 28832 - RNA, 22 nt, Human
caaaaacaccguggaugcugaa

SEQ ID NO: 28833 - RNA, 20 nt, Human
acacauuuggagaaaaguac

SEQ ID NO: 28834 - RNA, 22 nt, Human
gcgcgcaccuguaaucccagcu

SEQ ID NO: 28835 - RNA, 27 nt, Human
uucaguuaaucaaaugucauuuguuca

SEQ ID NO: 28836 - RNA, 21 nt, Human
acagggaggggaagagggggc

SEQ ID NO: 28837 - RNA, 16 nt, Human
ugcuucucccaccucu

SEQ ID NO: 28838 - RNA, 24 nt, Human
ggcuuugggguagcggcccugagc

SEQ ID NO: 28839 - RNA, 22 nt, Human
uuucuaaaacuccaucaaggcu

SEQ ID NO: 28840 - RNA, 28 nt, Human
uuuauuaggccuguaauuuugguucuug

SEQ ID NO: 28841 - RNA, 25 nt, Human
ugacuucuuugugguuucaaaucag

SEQ ID NO: 28842 - RNA, 22 nt, Human
caggagucagagguuucaguga

SEQ ID NO: 28843 - RNA, 24 nt, Human
ugucugugucguucucugugccac

SEQ ID NO: 28844 - RNA, 22 nt, Human
uuugggaagcuauggaggagga

SEQ ID NO: 28845 - RNA, 25 nt, Human
uggccuguuuuucuguaccugcugc

SEQ ID NO: 28846 - RNA, 20 nt, Human
agugagacuucuggagccag

SEQ ID NO: 28847 - RNA, 27 nt, Human
aguucagagagggggugugauuugccu

SEQ ID NO: 28848 - RNA, 20 nt, Human
ucucagccccaggacucagu

SEQ ID NO: 28849 - RNA, 23 nt, Human
ccuggcuggacccugcugccugu

SEQ ID NO: 28850 - RNA, 21 nt, Human
gcaaugacacaagaagagagu

SEQ ID NO: 28851 - RNA, 24 nt, Human
uggauuucaguucaaucaaacuuu

SEQ ID NO: 28852 - RNA, 24 nt, Human
gcagugucaugccuuggcguuuca

SEQ ID NO: 28853 - RNA, 23 nt, Human
aaggugaggcugagcugaaggaa

SEQ ID NO: 28854 - RNA, 24 nt, Human
guugggaggggcaggagguggggu

SEQ ID NO: 28855 - RNA, 27 nt, Human
cacuauguuacauacucuaauauagua

SEQ ID NO: 28856 - RNA, 21 nt, Human
uccaaugcugcaccacuugua

SEQ ID NO: 28857 - RNA, 23 nt, Human
uuagccugauucucuucagugaa

SEQ ID NO: 28858 - RNA, 22 nt, Human
ccaacugcagagccaccaggga

SEQ ID NO: 28859 - RNA, 22 nt, Human
ucugcagcccucagcagcugca

SEQ ID NO: 28860 - RNA, 27 nt, Human
aacacaaagagauauuuaggaaaaugc

SEQ ID NO: 28861 - RNA, 23 nt, Human
cauccucugcuugucauucugcu

SEQ ID NO: 28862 - RNA, 27 nt, Human
ggcuuuuucuaaccuuugucuuagcua

SEQ ID NO: 28863 - RNA, 21 nt, Human
aaagggucuucuuggcagcuu

SEQ ID NO: 28864 - RNA, 19 nt, Human
augaagaaaguaaaaccau

SEQ ID NO: 28865 - RNA, 21 nt, Human
aagagggagaucuggggcugu

SEQ ID NO: 28866 - RNA, 26 nt, Human
ccuguucucuuccacucuccuugcua

SEQ ID NO: 28867 - RNA, 20 nt, Human
cugacuucucccuauaagag

SEQ ID NO: 28868 - RNA, 25 nt, Human
uuccaagaaugccaucugauaaaaa

SEQ ID NO: 28869 - RNA, 25 nt, Human
caauccucgccucccuucugcucca

SEQ ID NO: 28870 - RNA, 18 nt, Human
gggcacuggcaauuagaa

SEQ ID NO: 28871 - RNA, 21 nt, Human
aucccagccugccugccucgg

SEQ ID NO: 28872 - RNA, 18 nt, Human
gcagaacagcuguggaga

SEQ ID NO: 28873 - RNA, 26 nt, Human
ccaggcuguaucccaugagccucagc

SEQ ID NO: 28874 - RNA, 24 nt, Human
ggggcagcccugccugcgggggag

SEQ ID NO: 28875 - RNA, 23 nt, Human
uagucaauaagaaaauauauucu

SEQ ID NO: 28876 - RNA, 21 nt, Human
guguuuaauaaaugauccuuu

SEQ ID NO: 28877 - RNA, 25 nt, Human
uaaccgacugcaccugcugucuuca

SEQ ID NO: 28878 - RNA, 19 nt, Human
cacuacccugagaucugca

SEQ ID NO: 28879 - RNA, 24 nt, Human
gggagcucuuugacucucguggga

SEQ ID NO: 28880 - RNA, 26 nt, Human
cuuauagcucauguaucuuuaggucu

SEQ ID NO: 28881 - RNA, 21 nt, Human
ucauugcagccuugacuucuc

SEQ ID NO: 28882 - RNA, 25 nt, Human
gucgcccaggcuggagugcaauggc

SEQ ID NO: 28883 - RNA, 27 nt, Human
uccuggagccuccucugggcagugcac

SEQ ID NO: 28884 - RNA, 21 nt, Human
cugagacuuacucaucuggaa

SEQ ID NO: 28885 - RNA, 27 nt, Human
uggcucacacuuguaaucccagcacuu

SEQ ID NO: 28886 - RNA, 31 nt, Human
acuauuuucagaaucugaauguaauuugugu

SEQ ID NO: 28887 - RNA, 23 nt, Human
cucuccucaguuuacaucuuguu

SEQ ID NO: 28888 - RNA, 26 nt, Human
ugcacgcaggacaucaacaaacacag

SEQ ID NO: 28889 - RNA, 21 nt, Human
uuaccaaaauaucaguaguaa

SEQ ID NO: 28890 - RNA, 23 nt, Human
ugugcuuguaaucccagcuacuc

SEQ ID NO: 28891 - RNA, 21 nt, Human
ucagauuaaagccucuguuuu

SEQ ID NO: 28892 - RNA, 17 nt, Human
auggaugucaaguguca

SEQ ID NO: 28893 - RNA, 21 nt, Human
gacuucucccgucucuagggc

SEQ ID NO: 28894 - RNA, 20 nt, Human
auguuuuaagauugcaccug

SEQ ID NO: 28895 - RNA, 24 nt, Human
aacccauuuuauuuccuguccuua

SEQ ID NO: 28896 - RNA, 27 nt, Human
uguuugaauucuuucaguagcuguuga

SEQ ID NO: 28897 - RNA, 22 nt, Human
gaacaggaagaggcagcuggug

SEQ ID NO: 28898 - RNA, 22 nt, Human
gucgccuguaaugccagcgcuu

SEQ ID NO: 28899 - RNA, 20 nt, Human
uuuauuuauaacaauguuaa

SEQ ID NO: 28900 - RNA, 24 nt, Human
aagauucauggaacuuagaaaaaa

SEQ ID NO: 28901 - RNA, 21 nt, Human
ucuccacugaggaugugagcc

SEQ ID NO: 28902 - RNA, 22 nt, Human
gucacccagucuggagugcagu

SEQ ID NO: 28903 - RNA, 25 nt, Human
ucugaacgugccucucucuugcuua

SEQ ID NO: 28904 - RNA, 22 nt, Human
gcaacagcuacaacaaugaaga

SEQ ID NO: 28905 - RNA, 24 nt, Human
ugccggucagagcuuaagaggacu

SEQ ID NO: 28906 - RNA, 21 nt, Human
ggcgcugugcagaggaaaggc

SEQ ID NO: 28907 - RNA, 19 nt, Human
aaacucaucauuuuaguca

SEQ ID NO: 28908 - RNA, 27 nt, Human
agaacuccaucagaaaaccaaagggug

SEQ ID NO: 28909 - RNA, 29 nt, Human
cggugagggguggagggaugucgcggaga

SEQ ID NO: 28910 - RNA, 20 nt, Human
acaaaccucaacaugugcca

SEQ ID NO: 28911 - RNA, 22 nt, Human
gcugggagaggguguugaguuc

SEQ ID NO: 28912 - RNA, 26 nt, Human
augcugacagucaugcagucugggag

SEQ ID NO: 28913 - RNA, 21 nt, Human
gaaccccaggcuggagugcag

SEQ ID NO: 28914 - RNA, 26 nt, Human
uaguacuccggcaggaugggccucgg

SEQ ID NO: 28915 - RNA, 24 nt, Human
cccugcucuuccaagguggggaca

SEQ ID NO: 28916 - RNA, 23 nt, Human
auaaucaaagcuaccugugguga

SEQ ID NO: 28917 - RNA, 22 nt, Human
auuuuugauaacagagcuauga

SEQ ID NO: 28918 - RNA, 21 nt, Human
cuaauccucccaaccaaccag

SEQ ID NO: 28919 - RNA, 21 nt, Human
uccuuuggcugaggagagugu

SEQ ID NO: 28920 - RNA, 27 nt, Human
gagaauuguuugaacccgggaggcaga

SEQ ID NO: 28921 - RNA, 27 nt, Human
agggaaaggcccugggaggggcucucu

SEQ ID NO: 28922 - RNA, 27 nt, Human
uuaggucuuugccuuccaagcacugua

SEQ ID NO: 28923 - RNA, 19 nt, Human
aucauacucaggucucccu

SEQ ID NO: 28924 - RNA, 22 nt, Human
aagcucagguucaaaguguugg

SEQ ID NO: 28925 - RNA, 20 nt, Human
accaucagcaaaaugccaga

SEQ ID NO: 28926 - RNA, 22 nt, Human
ccccugagggagggagcuguca

SEQ ID NO: 28927 - RNA, 23 nt, Human
cugggagggggcagccaagaagc

SEQ ID NO: 28928 - RNA, 22 nt, Human
ugagccaaccuuaaaccucuuc

SEQ ID NO: 28929 - RNA, 19 nt, Human
gcacagccaggagcguccg

SEQ ID NO: 28930 - RNA, 21 nt, Human
cucagcaccacucuugucccc

SEQ ID NO: 28931 - RNA, 22 nt, Human
gcccaggcugaagugcaguggg

SEQ ID NO: 28932 - RNA, 22 nt, Human
ucuccuggucguggaaggugcu

SEQ ID NO: 28933 - RNA, 24 nt, Human
caugagugguggcuaaccugacca

SEQ ID NO: 28934 - RNA, 19 nt, Human
augauccccucucuuccuc

SEQ ID NO: 28935 - RNA, 20 nt, Human
aaacauccuucaagaacucu

SEQ ID NO: 28936 - RNA, 24 nt, Human
agcagcagcagcagcagcacccgc

SEQ ID NO: 28937 - RNA, 26 nt, Human
ucugaaggccuucuaaaaccuucuga

SEQ ID NO: 28938 - RNA, 21 nt, Human
ggccucgggcacuccacuacc

SEQ ID NO: 28939 - RNA, 21 nt, Human
caggaggcuguggcagcugug

SEQ ID NO: 28940 - RNA, 22 nt, Human
cccacaguggacuggcagcagc

SEQ ID NO: 28941 - RNA, 27 nt, Human
gagaaucgcuugaaccugggaggcaga

SEQ ID NO: 28942 - RNA, 26 nt, Human
ugacucucuccccuacacccacuacc

SEQ ID NO: 28943 - RNA, 21 nt, Human
uccaggcccaugcacugagga

SEQ ID NO: 28944 - RNA, 27 nt, Human
cucccucuagcacuugcuaccucucuu

SEQ ID NO: 28945 - RNA, 27 nt, Human
ugcccagggcuggaggccccuagaaaa

SEQ ID NO: 28946 - RNA, 20 nt, Human
gcgcccaggccagugcugug

SEQ ID NO: 28947 - RNA, 26 nt, Human
acaaagcagcuaaaaaugacacagcu

SEQ ID NO: 28948 - RNA, 26 nt, Human
gaacuccagccaccacuuuccugugc

SEQ ID NO: 28949 - RNA, 22 nt, Human
guccuccucuucaggacaugcu

SEQ ID NO: 28950 - RNA, 22 nt, Human
acucacugcagagaucauguuc

SEQ ID NO: 28951 - RNA, 22 nt, Human
ucccuggguuggggaggcaggg

SEQ ID NO: 28952 - RNA, 23 nt, Human
gcuccucuaguaagaugcacuga

SEQ ID NO: 28953 - RNA, 23 nt, Human
ucucugcccuuccucuagccucu

SEQ ID NO: 28954 - RNA, 21 nt, Human
acagauggggccuugaaacgc

SEQ ID NO: 28955 - RNA, 22 nt, Human
aaagugcugggauuacaagaau

SEQ ID NO: 28956 - RNA, 21 nt, Human
agggaucuuccccugccccgc

SEQ ID NO: 28957 - RNA, 19 nt, Human
ucacuucaagacuaaugca

SEQ ID NO: 28958 - RNA, 19 nt, Human
caugagcccuuuuucucca

SEQ ID NO: 28959 - RNA, 20 nt, Human
uucacaguaauuauguucua

SEQ ID NO: 28960 - RNA, 27 nt, Human
gggaaguuggcuggugucccuugucuu

SEQ ID NO: 28961 - RNA, 22 nt, Human
gggacgggagagcagcgcacgc

SEQ ID NO: 28962 - RNA, 22 nt, Human
ggccucacaaagugcugggauu

SEQ ID NO: 28963 - RNA, 27 nt, Human
uucaaaccauuguggucuucaagcaac

SEQ ID NO: 28964 - RNA, 21 nt, Human
cgcccaggcuggagguuaaug

SEQ ID NO: 28965 - RNA, 27 nt, Human
acucaguguugaagcccaguguccuca

SEQ ID NO: 28966 - RNA, 22 nt, Human
aggaaacugacccucagcagcu

SEQ ID NO: 28967 - RNA, 24 nt, Human
ggaaaauggacauauucuuuuugg

SEQ ID NO: 28968 - RNA, 23 nt, Human
augugagaaagaaagcaggcuag

SEQ ID NO: 28969 - RNA, 26 nt, Human
aggaagaguagagcucugguccagcu

SEQ ID NO: 28970 - RNA, 32 nt, Human
ucacaccccugucccacccacacagcugcccu

SEQ ID NO: 28971 - RNA, 27 nt, Human
ucaucccuugugggcaccaccucuccc

SEQ ID NO: 28972 - RNA, 24 nt, Human
ugccugguuuugggcaaguuucuu

SEQ ID NO: 28973 - RNA, 18 nt, Human
agggaaagaaaggaggga

SEQ ID NO: 28974 - RNA, 22 nt, Human
gggcagugugggacugggggug

SEQ ID NO: 28975 - RNA, 26 nt, Human
gaguaugagaaagacguugccauaga

SEQ ID NO: 28976 - RNA, 19 nt, Human
gaacugucagucuuucuaa

SEQ ID NO: 28977 - RNA, 27 nt, Human
ccaguuucagcaaccgcuagguuucua

SEQ ID NO: 28978 - RNA, 22 nt, Human
gguguuccauugaacagcuuug

SEQ ID NO: 28979 - RNA, 28 nt, Human
gacugaugcuggaauuacuccuguaggu

SEQ ID NO: 28980 - RNA, 19 nt, Human
uuaagcugcaaaaauguau

SEQ ID NO: 28981 - RNA, 21 nt, Human
cuuaaaaugugcaguaauagc

SEQ ID NO: 28982 - RNA, 25 nt, Human
agccuugugaccugggaggcaggag

SEQ ID NO: 28983 - RNA, 21 nt, Human
caguuagcauuaaagcccugu

SEQ ID NO: 28984 - RNA, 18 nt, Human
ccucccuccucugcacca

SEQ ID NO: 28985 - RNA, 29 nt, Human
gccagacccuggccagcaugguuguccug

SEQ ID NO: 28986 - RNA, 21 nt, Human
caccuugcccagcccuggcca

SEQ ID NO: 28987 - RNA, 21 nt, Human
augaacaaauguaaaauuaua

SEQ ID NO: 28988 - RNA, 27 nt, Human
ugcagagacucugggcugcgcagcccc

SEQ ID NO: 28989 - RNA, 22 nt, Human
ggaucagcuaccuguuucugcc

SEQ ID NO: 28990 - RNA, 20 nt, Human
ugaacaaauuagauguuuca

SEQ ID NO: 28991 - RNA, 15 nt, Human
caguaccucuguggu

SEQ ID NO: 28992 - RNA, 20 nt, Human
ucuuuaauauugccuaaauc

SEQ ID NO: 28993 - RNA, 22 nt, Human
cacugcgcuccagccuggggga

SEQ ID NO: 28994 - RNA, 25 nt, Human
acccaggcuggagugcagugucgug

SEQ ID NO: 28995 - RNA, 23 nt, Human
gaggggagaccuuggcggacggc

SEQ ID NO: 28996 - RNA, 20 nt, Human
agacagggucucacucucau

SEQ ID NO: 28997 - RNA, 18 nt, Human
cggcugcagccauccccc

SEQ ID NO: 28998 - RNA, 23 nt, Human
guuccuacuguggcccagcugcc

SEQ ID NO: 28999 - RNA, 26 nt, Human
uacuauauguugcauaguauuuugca

SEQ ID NO: 29000 - RNA, 28 nt, Human
cucuuucagccucugcuggcauccugcu

SEQ ID NO: 29001 - RNA, 22 nt, Human
gagaucgcgccaucacacucca

SEQ ID NO: 29002 - RNA, 26 nt, Human
uccccaggcucuagugcaggaggaga

SEQ ID NO: 29003 - RNA, 21 nt, Human
aaucauaccccuaacauccag

SEQ ID NO: 29004 - RNA, 22 nt, Human
caaacauccuucuugaugcuuu

SEQ ID NO: 29005 - RNA, 23 nt, Human
gucuuccauuguucaguauuuuu

SEQ ID NO: 29006 - RNA, 22 nt, Human
uguuuuuagagacaggguccug

SEQ ID NO: 29007 - RNA, 21 nt, Human
ggcaggcggcggccccggugg

SEQ ID NO: 29008 - RNA, 24 nt, Human
gcagcuaacuuaucaucacacaac

SEQ ID NO: 29009 - RNA, 26 nt, Human
gcacacuucaccaucaacaugaauua

SEQ ID NO: 29010 - RNA, 26 nt, Human
agccccggaggcgccggacagagccg

SEQ ID NO: 29011 - RNA, 26 nt, Human
ggagacaaagcuaccacauguggaaa

SEQ ID NO: 29012 - RNA, 27 nt, Human
uuuaaggcauauuuaacaaaauuugaa

SEQ ID NO: 29013 - RNA, 23 nt, Human
caacauaguaagacccccaucuc

SEQ ID NO: 29014 - RNA, 19 nt, Human
cucccucucucucaucuua

SEQ ID NO: 29015 - RNA, 28 nt, Human
ggguguguuacucacuggcacgauggag

SEQ ID NO: 29016 - RNA, 22 nt, Human
uuuaacaacagccacucaccuu

SEQ ID NO: 29017 - RNA, 22 nt, Human
acugauacaaggaaaacuugca

SEQ ID NO: 29018 - RNA, 23 nt, Human
auuacaccacugcacuucagucu

SEQ ID NO: 29019 - RNA, 25 nt, Human
uccuccuccccucagccuuguggcc

SEQ ID NO: 29020 - RNA, 28 nt, Human
agggccccaacuacacacccccaagcca

SEQ ID NO: 29021 - RNA, 25 nt, Human
cccugaggagccucagcuuucccuc

SEQ ID NO: 29022 - RNA, 21 nt, Human
ggauuacaguugugagccacu

SEQ ID NO: 29023 - RNA, 22 nt, Human
cuaaucuuaaaacuacaaguug

SEQ ID NO: 29024 - RNA, 23 nt, Human
ucacuacccccaggagauauuca

SEQ ID NO: 29025 - RNA, 27 nt, Human
agaaugcuggguuuauagaugugagcc

SEQ ID NO: 29026 - RNA, 23 nt, Human
aacugguuaaguggcauguaaua

SEQ ID NO: 29027 - RNA, 29 nt, Human
agaggaggaagacggcgaggacgugcgag

SEQ ID NO: 29028 - RNA, 21 nt, Human
aaauucauauaucuuauuuca

SEQ ID NO: 29029 - RNA, 21 nt, Human
ccuccuggcccucgaugcuuc

SEQ ID NO: 29030 - RNA, 22 nt, Human
auguacacuguugaguuuucug

SEQ ID NO: 29031 - RNA, 27 nt, Human
gacuuaacacuucuuacgcaaugcuuc

SEQ ID NO: 29032 - RNA, 22 nt, Human
uugaggugucagagaaaaugaa

SEQ ID NO: 29033 - RNA, 24 nt, Human
guaggcaucaguaugucacucugg

SEQ ID NO: 29034 - RNA, 20 nt, Human
acauaaaaaggaaaucuguc

SEQ ID NO: 29035 - RNA, 25 nt, Human
gagaguuuggacaucucacucaaaa

SEQ ID NO: 29036 - RNA, 24 nt, Human
ugaaugcuccaaaggccaaacuuc

SEQ ID NO: 29037 - RNA, 19 nt, Human
caugaguuacacuggauga

SEQ ID NO: 29038 - RNA, 23 nt, Human
uuuuguaaaguguccacugcucg

SEQ ID NO: 29039 - RNA, 21 nt, Human
cagaggaaguuuguuuuuuaa

SEQ ID NO: 29040 - RNA, 23 nt, Human
ugucuggauuggccuccaugacc

SEQ ID NO: 29041 - RNA, 24 nt, Human
ggagacacaagaucaguaugugua

SEQ ID NO: 29042 - RNA, 20 nt, Human
uugcauuuuaucaaaugcau

SEQ ID NO: 29043 - RNA, 21 nt, Human
caccuccuggguucaggcgau

SEQ ID NO: 29044 - RNA, 22 nt, Human
ggggaaaggcgagcagcuggca

SEQ ID NO: 29045 - RNA, 24 nt, Human
cccuugaaguuguggaggagguga

SEQ ID NO: 29046 - RNA, 22 nt, Human
guacagccacucucccgggucu

SEQ ID NO: 29047 - RNA, 21 nt, Human
agcccuucuccugcugcucug

SEQ ID NO: 29048 - RNA, 23 nt, Human
caccgcgucgacgccuucacugc

SEQ ID NO: 29049 - RNA, 22 nt, Human
aacagcccaaacuguauacauu

SEQ ID NO: 29050 - RNA, 26 nt, Human
acuuuuaaaagcacguauuuaugucc

SEQ ID NO: 29051 - RNA, 27 nt, Human
ccugaacuuuccuuccugucacuguga

SEQ ID NO: 29052 - RNA, 27 nt, Human
uagccaucuuacuuggcuuuuuacuau

SEQ ID NO: 29053 - RNA, 25 nt, Human
ggggcaggaggaaugcaggagcagg

SEQ ID NO: 29054 - RNA, 25 nt, Human
gcuccauuuggcaccugcugagcca

SEQ ID NO: 29055 - RNA, 26 nt, Human
agaaaacaacaaaagaauuuuuguuu

SEQ ID NO: 29056 - RNA, 21 nt, Human
gcccauuccagccagguggaa

SEQ ID NO: 29057 - RNA, 26 nt, Human
uguccccagaguuucuugagggcugg

SEQ ID NO: 29058 - RNA, 22 nt, Human
ugugucugucauuucucuuuca

SEQ ID NO: 29059 - RNA, 24 nt, Human
uucugccugcuccaucgcgccagc

SEQ ID NO: 29060 - RNA, 22 nt, Human
auggcucgggguggagcuaggg

SEQ ID NO: 29061 - RNA, 26 nt, Human
cuggccugugggugaucccagcucuu

SEQ ID NO: 29062 - RNA, 21 nt, Human
ccuuugaccuuccccaaagga

SEQ ID NO: 29063 - RNA, 18 nt, Human
auagugggcuauuacagg

SEQ ID NO: 29064 - RNA, 23 nt, Human
uuugugaaagaaggagcaagaga

SEQ ID NO: 29065 - RNA, 25 nt, Human
agugucuguauuuucugauuuuuuc

SEQ ID NO: 29066 - RNA, 27 nt, Human
ccgcugcacucgcggccggcgaugcgg

SEQ ID NO: 29067 - RNA, 24 nt, Human
gggguagaggaagacgagacagga

SEQ ID NO: 29068 - RNA, 23 nt, Human
gguuucaucaacauaagaggcca

SEQ ID NO: 29069 - RNA, 25 nt, Human
gcucuuucuccuucuucccugaguc

SEQ ID NO: 29070 - RNA, 21 nt, Human
uguagggaguuuuccaggcag

SEQ ID NO: 29071 - RNA, 22 nt, Human
agggaugucaacgucaauauca

SEQ ID NO: 29072 - RNA, 22 nt, Human
cagcccccagacccuucuugaa

SEQ ID NO: 29073 - RNA, 21 nt, Human
ucaagugaucuaccugccucu

SEQ ID NO: 29074 - RNA, 26 nt, Human
aaaugagaagaugugaccugugccaa

SEQ ID NO: 29075 - RNA, 22 nt, Human
ggcuguaacucagcgaccuugg

SEQ ID NO: 29076 - RNA, 25 nt, Human
ccccaucucgggggcuugcugcacu

SEQ ID NO: 29077 - RNA, 20 nt, Human
agagaaugccuucuagaugc

SEQ ID NO: 29078 - RNA, 27 nt, Human
ccccacccuccaggguuagggggagca

SEQ ID NO: 29079 - RNA, 23 nt, Human
ugcugggcuucauaccuggguga

SEQ ID NO: 29080 - RNA, 19 nt, Human
uagugauagagugcaguga

SEQ ID NO: 29081 - RNA, 21 nt, Human
uucaaugauuaauugagggga

SEQ ID NO: 29082 - RNA, 20 nt, Human
aagaagcagaguaugagaga

SEQ ID NO: 29083 - RNA, 23 nt, Human
cgccaagucauccucccaccuca

SEQ ID NO: 29084 - RNA, 27 nt, Human
cucucucugccccaggaugaucuucug

SEQ ID NO: 29085 - RNA, 24 nt, Human
accaccuagaucauagcuugaacu

SEQ ID NO: 29086 - RNA, 20 nt, Human
cucccaggcuggagugcagu

SEQ ID NO: 29087 - RNA, 23 nt, Human
cauuagagaucugaaaacucauu

SEQ ID NO: 29088 - RNA, 24 nt, Human
cuagugucccuucagccugggcug

SEQ ID NO: 29089 - RNA, 23 nt, Human
ucaucccaggagaucuuuccuug

SEQ ID NO: 29090 - RNA, 27 nt, Human
cacaguggugcaggcacauuuccaagc

SEQ ID NO: 29091 - RNA, 27 nt, Human
uuggaaauuuugagcacccaagcucuu

SEQ ID NO: 29092 - RNA, 25 nt, Human
agugucacucauuuguaguaaaacu

SEQ ID NO: 29093 - RNA, 27 nt, Human
ccaaguuguggaagcacauuucuaaau

SEQ ID NO: 29094 - RNA, 28 nt, Human
agucuuuuccugugguguuaggucuuua

SEQ ID NO: 29095 - RNA, 23 nt, Human
aaugggguuucaccauguuagcc

SEQ ID NO: 29096 - RNA, 19 nt, Human
agaccuaggucagacuuuu

SEQ ID NO: 29097 - RNA, 28 nt, Human
ggucagggaagagagggguucuacccac

SEQ ID NO: 29098 - RNA, 20 nt, Human
uuccuaaccuuccaucaucc

SEQ ID NO: 29099 - RNA, 20 nt, Human
gaaaacacaaacaacaaagc

SEQ ID NO: 29100 - RNA, 21 nt, Human
uaccacccuuuucaauugcua

SEQ ID NO: 29101 - RNA, 27 nt, Human
acaugcugcuacugcuauuccauggau

SEQ ID NO: 29102 - RNA, 21 nt, Human
gagacagagaagggaaguagg

SEQ ID NO: 29103 - RNA, 23 nt, Human
ucuuucaugagcuugccuaaaau

SEQ ID NO: 29104 - RNA, 25 nt, Human
gagaauauggaacucaggaggcgga

SEQ ID NO: 29105 - RNA, 21 nt, Human
ccuccagcaccuucccucuca

SEQ ID NO: 29106 - RNA, 26 nt, Human
accagccugagcaacaugguaaaacc

SEQ ID NO: 29107 - RNA, 23 nt, Human
cucccaggaagcugaauccagca

SEQ ID NO: 29108 - RNA, 27 nt, Human
ggcagugguggcacgggagcaggcuag

SEQ ID NO: 29109 - RNA, 22 nt, Human
uugcucacucucuugcucacag

SEQ ID NO: 29110 - RNA, 22 nt, Human
gcuucccucccaaacuccauuu

SEQ ID NO: 29111 - RNA, 27 nt, Human
cugggaggcggagguugcggucagcug

SEQ ID NO: 29112 - RNA, 19 nt, Human
accaaccgcuccgccccgg

SEQ ID NO: 29113 - RNA, 21 nt, Human
gggugaggagggggcggcaag

SEQ ID NO: 29114 - RNA, 27 nt, Human
cccaaguagcugggacuauaggcacac

SEQ ID NO: 29115 - RNA, 23 nt, Human
gcuucuccagccuuucucccuca

SEQ ID NO: 29116 - RNA, 23 nt, Human
cuucagccucaaguucugagguc

SEQ ID NO: 29117 - RNA, 25 nt, Human
cccugcagaacggcugccuaauuua

SEQ ID NO: 29118 - RNA, 21 nt, Human
ccaccaagcccaucagaagga

SEQ ID NO: 29119 - RNA, 25 nt, Human
gcuucaggaaccucgaguacugugg

SEQ ID NO: 29120 - RNA, 21 nt, Human
cacccuaccugccuuuuauag

SEQ ID NO: 29121 - RNA, 21 nt, Human
aagcaaauuauguauuucaau

SEQ ID NO: 29122 - RNA, 20 nt, Human
cuaccugcuggacagccucc

SEQ ID NO: 29123 - RNA, 21 nt, Human
cauuuaucauuaaugcaagaa

SEQ ID NO: 29124 - RNA, 27 nt, Human
caggcccugggauuuugaacagcuccg

SEQ ID NO: 29125 - RNA, 25 nt, Human
ggccuggauuuaucauuggguuggg

SEQ ID NO: 29126 - RNA, 25 nt, Human
gaagaccucuuccugaaucacugga

SEQ ID NO: 29127 - RNA, 21 nt, Human
acugaccaucggcugccugug

SEQ ID NO: 29128 - RNA, 23 nt, Human
aaguggggcaaaaccuugcuaau

SEQ ID NO: 29129 - RNA, 21 nt, Human
augcuagguauaccuacagca

SEQ ID NO: 29130 - RNA, 20 nt, Human
ggucccucagcugcgaggcu

SEQ ID NO: 29131 - RNA, 25 nt, Human
cagacaaugccuucuccauuacuug

SEQ ID NO: 29132 - RNA, 25 nt, Human
uagcucucggucccacaguccucag

SEQ ID NO: 29133 - RNA, 27 nt, Human
gucacccacuccugggugcgugcagac

SEQ ID NO: 29134 - RNA, 32 nt, Human
ggaggaaguggaagggacaggagcacauaggu

SEQ ID NO: 29135 - RNA, 20 nt, Human
cuccugagagaguucuuuca

SEQ ID NO: 29136 - RNA, 22 nt, Human
ugucauugucuucuccaccggg

SEQ ID NO: 29137 - RNA, 24 nt, Human
cagucauggugucaagcacauuaa

SEQ ID NO: 29138 - RNA, 24 nt, Human
ugggggcucccagggcaaggguua

SEQ ID NO: 29139 - RNA, 23 nt, Human
ucacucuuaggcuuuuaaacaau

SEQ ID NO: 29140 - RNA, 18 nt, Human
ucaugcuggccuuggugg

SEQ ID NO: 29141 - RNA, 23 nt, Human
uuggacccagguaucugauuauu

SEQ ID NO: 29142 - RNA, 21 nt, Human
ugucagacaggcugggggccu

SEQ ID NO: 29143 - RNA, 27 nt, Human
ugauguuuacucucugggcacuguugu

SEQ ID NO: 29144 - RNA, 21 nt, Human
ucuacaauuaguagaucaugu

SEQ ID NO: 29145 - RNA, 20 nt, Human
accuuucccuucuaguuuug

SEQ ID NO: 29146 - RNA, 20 nt, Human
ugccauugccucucucggau

SEQ ID NO: 29147 - RNA, 15 nt, Human
ggccagcccaccucu

SEQ ID NO: 29148 - RNA, 24 nt, Human
aauucagaguacaguuugugcuau

SEQ ID NO: 29149 - RNA, 21 nt, Human
cagcaucaccucuagcccugg

SEQ ID NO: 29150 - RNA, 22 nt, Human
auugcuugagcccaagaggugg

SEQ ID NO: 29151 - RNA, 20 nt, Human
gcaaaccaauuuggggaaga

SEQ ID NO: 29152 - RNA, 21 nt, Human
gucugaacuccugacugucag

SEQ ID NO: 29153 - RNA, 27 nt, Human
uacugguaggcacuguccucugauuaa

SEQ ID NO: 29154 - RNA, 21 nt, Human
uccaggcccccaacuccgccc

SEQ ID NO: 29155 - RNA, 21 nt, Human
gggccagcucacccugcugag

SEQ ID NO: 29156 - RNA, 20 nt, Human
uugacccagguagggccacc

SEQ ID NO: 29157 - RNA, 23 nt, Human
gucacccaggcuugagugcagug

SEQ ID NO: 29158 - RNA, 24 nt, Human
gguuacugaucacuuaccuucuuc

SEQ ID NO: 29159 - RNA, 26 nt, Human
aguuugaauaguuagacauggaaauu

SEQ ID NO: 29160 - RNA, 15 nt, Human
agcauccccaccuca

SEQ ID NO: 29161 - RNA, 22 nt, Human
acuccuugaguuuuccugcugc

SEQ ID NO: 29162 - RNA, 22 nt, Human
acggucucaaucuaaaagcacu

SEQ ID NO: 29163 - RNA, 18 nt, Human
ccacaaacaccaucuuca

SEQ ID NO: 29164 - RNA, 26 nt, Human
ugacugccuuugaagcgcagcccucu

SEQ ID NO: 29165 - RNA, 27 nt, Human
ggcaaccauuuuuagaaggaaaaagga

SEQ ID NO: 29166 - RNA, 20 nt, Human
uuuucccccagaaauugguu

SEQ ID NO: 29167 - RNA, 23 nt, Human
acuccagccugggugacaagagu

SEQ ID NO: 29168 - RNA, 21 nt, Human
ugcugcugcugacucggagcc

SEQ ID NO: 29169 - RNA, 24 nt, Human
gcacuuccaagauggcaccagcau

SEQ ID NO: 29170 - RNA, 29 nt, Human
ccuuaggccuggcccuggucuccgagcgc

SEQ ID NO: 29171 - RNA, 22 nt, Human
cuggucucccuucuucuagaac

SEQ ID NO: 29172 - RNA, 22 nt, Human
cauuuguccaucaauauuauau

SEQ ID NO: 29173 - RNA, 26 nt, Human
cucggggacacaggccagcuccacag

SEQ ID NO: 29174 - RNA, 25 nt, Human
gugacggaccagcucacacaauguc

SEQ ID NO: 29175 - RNA, 25 nt, Human
aggagcagaggggugcggguaaacg

SEQ ID NO: 29176 - RNA, 28 nt, Human
cccaccccacccccuucagugcccacca

SEQ ID NO: 29177 - RNA, 26 nt, Human
cagcacagccuacagccgugcucagg

SEQ ID NO: 29178 - RNA, 23 nt, Human
ggaugccauggagacuggaagac

SEQ ID NO: 29179 - RNA, 27 nt, Human
cacuugagcccaauucaaagcugcagu

SEQ ID NO: 29180 - RNA, 22 nt, Human
acucugguuacccuugccucca

SEQ ID NO: 29181 - RNA, 22 nt, Human
ugccuccucugccccccugcag

SEQ ID NO: 29182 - RNA, 26 nt, Human
gcugcugcugcucuaucggccgccuc

SEQ ID NO: 29183 - RNA, 22 nt, Human
uggucagaauauaauacuucca

SEQ ID NO: 29184 - RNA, 20 nt, Human
ccuaguaauggauuacaggc

SEQ ID NO: 29185 - RNA, 24 nt, Human
gggacacugggcgccuccuccucc

SEQ ID NO: 29186 - RNA, 25 nt, Human
gcaacaguguucugagcccccaccu

SEQ ID NO: 29187 - RNA, 19 nt, Human
aaccuggaacaugacauug

SEQ ID NO: 29188 - RNA, 28 nt, Human
augcuguuucuggcugggcacgaugacu

SEQ ID NO: 29189 - RNA, 22 nt, Human
ugcauguggacacucagucaca

SEQ ID NO: 29190 - RNA, 25 nt, Human
gcuguccugaugaugagucauucca

SEQ ID NO: 29191 - RNA, 23 nt, Human
caacagugguuagaugaucuuug

SEQ ID NO: 29192 - RNA, 21 nt, Human
ugccuuucaaacuuuuuacug

SEQ ID NO: 29193 - RNA, 21 nt, Human
caggacuucccaggaccccuu

SEQ ID NO: 29194 - RNA, 20 nt, Human
ggguuagaguuuggagagag

SEQ ID NO: 29195 - RNA, 23 nt, Human
aacaaugaacagugacucaggga

SEQ ID NO: 29196 - RNA, 24 nt, Human
aaccugauggaacauuugcaccug

SEQ ID NO: 29197 - RNA, 19 nt, Human
uccugcucuccuugggaug

SEQ ID NO: 29198 - RNA, 20 nt, Human
uucuccucccuguuaucugc

SEQ ID NO: 29199 - RNA, 26 nt, Human
agaaaugcagcacagcuuucaagaua

SEQ ID NO: 29200 - RNA, 20 nt, Human
guauaucuuucaucuguaaa

SEQ ID NO: 29201 - RNA, 20 nt, Human
cugugucucuucaucuccgu

SEQ ID NO: 29202 - RNA, 22 nt, Human
ccagcagccuuuaauucuuggg

SEQ ID NO: 29203 - RNA, 23 nt, Human
uccagugauaagagauguugacu

SEQ ID NO: 29204 - RNA, 21 nt, Human
gucaaauuagcacaacaaaga

SEQ ID NO: 29205 - RNA, 26 nt, Human
uggauggaguuaaacuugaugccagu

SEQ ID NO: 29206 - RNA, 21 nt, Human
ggggguggggacggggguaac

SEQ ID NO: 29207 - RNA, 23 nt, Human
gcuaacauccaaacgacuguuug

SEQ ID NO: 29208 - RNA, 25 nt, Human
ccugugucacccuugugccuuagcc

SEQ ID NO: 29209 - RNA, 22 nt, Human
cugcaaccucugccuccugggu

SEQ ID NO: 29210 - RNA, 22 nt, Human
ccgcaaccucugccucccgggu

SEQ ID NO: 29211 - RNA, 22 nt, Human
cacccaggacgcugagcccagg

SEQ ID NO: 29212 - RNA, 19 nt, Human
gguuuuguuaauucuuuuc

SEQ ID NO: 29213 - RNA, 20 nt, Human
aaaagagaguaguuuugucu

SEQ ID NO: 29214 - RNA, 22 nt, Human
guugcccaggcuggucuugaac

SEQ ID NO: 29215 - RNA, 26 nt, Human
ccggcguuucgcuucucagccaugga

SEQ ID NO: 29216 - RNA, 25 nt, Human
cuuccugccacccuuugggcucaga

SEQ ID NO: 29217 - RNA, 27 nt, Human
auuaucacuuugggguucggccugugu

SEQ ID NO: 29218 - RNA, 21 nt, Human
cccagacgccacaggucauca

SEQ ID NO: 29219 - RNA, 18 nt, Human
agaauacaaucaaacuuu

SEQ ID NO: 29220 - RNA, 22 nt, Human
uugccauggacaccaguugcga

SEQ ID NO: 29221 - RNA, 23 nt, Human
gagacugucuggaaggcuuggaa

SEQ ID NO: 29222 - RNA, 31 nt, Human
gcaggugguagugggacaggacaauuggagc

SEQ ID NO: 29223 - RNA, 20 nt, Human
auccccugcaggcugagugc

SEQ ID NO: 29224 - RNA, 19 nt, Human
ccagcccucgucaccacag

SEQ ID NO: 29225 - RNA, 21 nt, Human
gcacuggaacccacagaccuc

SEQ ID NO: 29226 - RNA, 21 nt, Human
uuccuauuaauggaagaaggu

SEQ ID NO: 29227 - RNA, 22 nt, Human
cucccucaccaacauugcuugu

SEQ ID NO: 29228 - RNA, 25 nt, Human
agcaccuagcauuucagcagaggga

SEQ ID NO: 29229 - RNA, 20 nt, Human
auuucuccauucagcuggau

SEQ ID NO: 29230 - RNA, 19 nt, Human
ucgucuuucucccgggaac

SEQ ID NO: 29231 - RNA, 25 nt, Human
gcuucuacucuuucuauuacugccu

SEQ ID NO: 29232 - RNA, 22 nt, Human
uuuacuuagccgcuucugggag

SEQ ID NO: 29233 - RNA, 22 nt, Human
agcugaaggguuuuauuuacaa

SEQ ID NO: 29234 - RNA, 27 nt, Human
ucuagaagaaaacaucaggagaagaaa

SEQ ID NO: 29235 - RNA, 28 nt, Human
ucauagcucacaaaccuuccuugcuauu

SEQ ID NO: 29236 - RNA, 21 nt, Human
gaaaacuugcucucaaacuuc

SEQ ID NO: 29237 - RNA, 21 nt, Human
ccuagcagcuccuccuccucc

SEQ ID NO: 29238 - RNA, 19 nt, Human
cagggagaccuggcuuggg

SEQ ID NO: 29239 - RNA, 27 nt, Human
acugccucugccucccuggggcagagc

SEQ ID NO: 29240 - RNA, 24 nt, Human
ugccuggaucucacgagcacuuuc

SEQ ID NO: 29241 - RNA, 22 nt, Human
cauaaggucaggagaucaagac

SEQ ID NO: 29242 - RNA, 22 nt, Human
ggagaggagccggaauggaggg

SEQ ID NO: 29243 - RNA, 22 nt, Human
uuuccaauuauuccaucauuuc

SEQ ID NO: 29244 - RNA, 25 nt, Human
agcucucucgaagagaucuuacaga

SEQ ID NO: 29245 - RNA, 24 nt, Human
caccagccaauccaagcauuuucu

SEQ ID NO: 29246 - RNA, 21 nt, Human
agggaggauccugucuggccu

SEQ ID NO: 29247 - RNA, 26 nt, Human
gaugcuagacgaaaacccacauuacc

SEQ ID NO: 29248 - RNA, 21 nt, Human
ccucucugcaccugcgcucug

SEQ ID NO: 29249 - RNA, 18 nt, Human
ugcuggagacauaguugg

SEQ ID NO: 29250 - RNA, 25 nt, Human
aagcagguaaagcagucacugugaa

SEQ ID NO: 29251 - RNA, 21 nt, Human
uuuaaaaaauacagugugauu

SEQ ID NO: 29252 - RNA, 25 nt, Human
caggucaauagacagaaaguacauu

SEQ ID NO: 29253 - RNA, 23 nt, Human
uaaucagcuuaaaagcuauuuaa

SEQ ID NO: 29254 - RNA, 22 nt, Human
auacuuuuucaguugcugucuu

SEQ ID NO: 29255 - RNA, 23 nt, Human
agcgacuggcauacuauguggau

SEQ ID NO: 29256 - RNA, 23 nt, Human
ucugacacaaaagacgugccuua

SEQ ID NO: 29257 - RNA, 21 nt, Human
ccuguaauccagcuacucagg

SEQ ID NO: 29258 - RNA, 27 nt, Human
ucacccaggcaggcuccgucgcggagu

SEQ ID NO: 29259 - RNA, 21 nt, Human
gugccugucccugcucugccu

SEQ ID NO: 29260 - RNA, 19 nt, Human
ggcugagaaggaacaggga

SEQ ID NO: 29261 - RNA, 27 nt, Human
uggagaaugccuuuugaaacaauuuuc

SEQ ID NO: 29262 - RNA, 22 nt, Human
ccugguggcaccucucacccug

SEQ ID NO: 29263 - RNA, 25 nt, Human
gauccauggggcugaaggguaaauu

SEQ ID NO: 29264 - RNA, 26 nt, Human
cuccagccucccaccuccgcccgggc

SEQ ID NO: 29265 - RNA, 22 nt, Human
ucuagccucugcuggagugcag

SEQ ID NO: 29266 - RNA, 20 nt, Human
uuguaaaauuuaaauagcua

SEQ ID NO: 29267 - RNA, 23 nt, Human
ccagucgcgcagcgcugcaguga

SEQ ID NO: 29268 - RNA, 23 nt, Human
caaguuaaaaaggucuaugaucu

SEQ ID NO: 29269 - RNA, 22 nt, Human
uuggggcaggggcaggagggag

SEQ ID NO: 29270 - RNA, 20 nt, Human
agaauaugucuuaacuuuuu

SEQ ID NO: 29271 - RNA, 24 nt, Human
acugucucucugcacucugcugcu

SEQ ID NO: 29272 - RNA, 22 nt, Human
aaacagaaaaugauuuccacug

SEQ ID NO: 29273 - RNA, 25 nt, Human
gcccaggcaagagugcagugguaug

SEQ ID NO: 29274 - RNA, 20 nt, Human
ccuuuucuccccaccuccac

SEQ ID NO: 29275 - RNA, 20 nt, Human
ccuuguucucuaaguuccac

SEQ ID NO: 29276 - RNA, 27 nt, Human
ggggaaaggagagaccauggugugaau

SEQ ID NO: 29277 - RNA, 24 nt, Human
acccaggcuggagugcaauggcac

SEQ ID NO: 29278 - RNA, 22 nt, Human
ggaaguagaucuuuauggggaa

SEQ ID NO: 29279 - RNA, 24 nt, Human
gugggagggggcagcaggcggggc

SEQ ID NO: 29280 - RNA, 23 nt, Human
ggggcuuggaaaucaaauucagc

SEQ ID NO: 29281 - RNA, 25 nt, Human
ugcgcgucguuacuggccacaaguu

SEQ ID NO: 29282 - RNA, 22 nt, Human
ggucugacucuugcgaaucuca

SEQ ID NO: 29283 - RNA, 23 nt, Human
ugcuggagccauucauucagcaa

SEQ ID NO: 29284 - RNA, 22 nt, Human
uuuucacucccuccaucaagaa

SEQ ID NO: 29285 - RNA, 27 nt, Human
accucaagcuucauaguuauuuggcau

SEQ ID NO: 29286 - RNA, 21 nt, Human
ggaaaucaugauuucccugua

SEQ ID NO: 29287 - RNA, 22 nt, Human
cagugacccaggagcugacaca

SEQ ID NO: 29288 - RNA, 26 nt, Human
uccuguaauuugcacuuucucccaau

SEQ ID NO: 29289 - RNA, 31 nt, Human
gcuguguucccugucucaggucaagcagugg

SEQ ID NO: 29290 - RNA, 21 nt, Human
caugccuuaaucccagcacuu

SEQ ID NO: 29291 - RNA, 24 nt, Human
agagaaaaggggcuggaggaagau

SEQ ID NO: 29292 - RNA, 27 nt, Human
gcacuucaggaggccaaggugggaaga

SEQ ID NO: 29293 - RNA, 26 nt, Human
acccuccacauggacucccaccugca

SEQ ID NO: 29294 - RNA, 21 nt, Human
cugccuuaccccugcugcugc

SEQ ID NO: 29295 - RNA, 26 nt, Human
accugacaggccuucugggccuccaa

SEQ ID NO: 29296 - RNA, 32 nt, Human
ucguggcgacucgagcuccuggaacuugcuca

SEQ ID NO: 29297 - RNA, 20 nt, Human
acauguguaagacacugugc

SEQ ID NO: 29298 - RNA, 19 nt, Human
ugggugcauaucuucccag

SEQ ID NO: 29299 - RNA, 25 nt, Human
aaggggaagccaagguaggagccag

SEQ ID NO: 29300 - RNA, 24 nt, Human
gggggguuagagcaggaccacagc

SEQ ID NO: 29301 - RNA, 20 nt, Human
cucuucacuuccuccagaag

SEQ ID NO: 29302 - RNA, 23 nt, Human
aaccaucugauuggcuuucugag

SEQ ID NO: 29303 - RNA, 21 nt, Human
gagauggggcggggcuuggaa

SEQ ID NO: 29304 - RNA, 25 nt, Human
ucuggggcuugaggaagaugaguuu

SEQ ID NO: 29305 - RNA, 18 nt, Human
ccuccaacuccugguuca

SEQ ID NO: 29306 - RNA, 20 nt, Human
cuccuaggcuaaaugagaau

SEQ ID NO: 29307 - RNA, 27 nt, Human
gugguaccuagugacuuccaaccaaag

SEQ ID NO: 29308 - RNA, 26 nt, Human
agugccggccgcggaggguccuggcc

SEQ ID NO: 29309 - RNA, 25 nt, Human
uaaaucugaaaaugcuagugggaga

SEQ ID NO: 29310 - RNA, 29 nt, Human
aacuuuagacaacuuacuacuuugauguc

SEQ ID NO: 29311 - RNA, 21 nt, Human
agauaaaugauguaguugauc

SEQ ID NO: 29312 - RNA, 26 nt, Human
uccugccucagccuccagaauagcug

SEQ ID NO: 29313 - RNA, 27 nt, Human
ccauaggcagucccugggcaagggagg

SEQ ID NO: 29314 - RNA, 27 nt, Human
auccucuccuaccggcacccgcagacg

SEQ ID NO: 29315 - RNA, 26 nt, Human
cugcccagccugcucucccuaacccc

SEQ ID NO: 29316 - RNA, 23 nt, Human
gaacagcuccugagccaggugga

SEQ ID NO: 29317 - RNA, 24 nt, Human
ugaguaugucaccaagagugguag

SEQ ID NO: 29318 - RNA, 23 nt, Human
ccuucuagacugcucacagggcc

SEQ ID NO: 29319 - RNA, 21 nt, Human
gggguagggagagggaggagg

SEQ ID NO: 29320 - RNA, 27 nt, Human
ugccauccuuacagagcuaaguggaga

SEQ ID NO: 29321 - RNA, 27 nt, Human
ugaucauacccugagcacgacgaagca

SEQ ID NO: 29322 - RNA, 22 nt, Human
uaccuguaaugccagcacuuug

SEQ ID NO: 29323 - RNA, 17 nt, Human
cuucccuuaccaaggag

SEQ ID NO: 29324 - RNA, 23 nt, Human
gcugaaacuucucaaccagaaga

SEQ ID NO: 29325 - RNA, 22 nt, Human
ccaggaaacagccauguggguc

SEQ ID NO: 29326 - RNA, 26 nt, Human
aggcuaagcccaguucaaggcugcag

SEQ ID NO: 29327 - RNA, 24 nt, Human
gucuacaaagcaucugauuuugga

SEQ ID NO: 29328 - RNA, 18 nt, Human
agauggccaggguggcag

SEQ ID NO: 29329 - RNA, 21 nt, Human
ugagugggugggauggggaca

SEQ ID NO: 29330 - RNA, 23 nt, Human
cuuagcaaagggcugacuuucca

SEQ ID NO: 29331 - RNA, 25 nt, Human
uauuucuucccgcacaaauuccaca

SEQ ID NO: 29332 - RNA, 27 nt, Human
gacucuggcugaaggggugggcaugcu

SEQ ID NO: 29333 - RNA, 27 nt, Human
ugcacaucaccgaacgaugagagagga

SEQ ID NO: 29334 - RNA, 22 nt, Human
cugcccucucugugccuugguu

SEQ ID NO: 29335 - RNA, 27 nt, Human
ccuguucugcgcuguguacaaugugag

SEQ ID NO: 29336 - RNA, 24 nt, Human
uacaagauggagaaacaacaaaua

SEQ ID NO: 29337 - RNA, 25 nt, Human
ccucccaccucugugaccucaggcc

SEQ ID NO: 29338 - RNA, 27 nt, Human
cugcuucuuccacuuauacuuagucuc

SEQ ID NO: 29339 - RNA, 23 nt, Human
agugugaccccacugccaagugg

SEQ ID NO: 29340 - RNA, 21 nt, Human
cagcuggugccccaccugccu

SEQ ID NO: 29341 - RNA, 27 nt, Human
uuccucuggugcaaccagcaagucuuc

SEQ ID NO: 29342 - RNA, 21 nt, Human
cacugagaaccugcugagcaa

SEQ ID NO: 29343 - RNA, 21 nt, Human
cacuuccuuuccugagcagga

SEQ ID NO: 29344 - RNA, 27 nt, Human
ccugcaugugccccugccucuaccugu

SEQ ID NO: 29345 - RNA, 24 nt, Human
ccucauucugccaaagcuggacca

SEQ ID NO: 29346 - RNA, 24 nt, Human
gggaguaccacucuccccuccucc

SEQ ID NO: 29347 - RNA, 20 nt, Human
guggguggggguggggacgg

SEQ ID NO: 29348 - RNA, 21 nt, Human
gcugcugccuccagccucugg

SEQ ID NO: 29349 - RNA, 18 nt, Human
cagcccaggcuggagugc

SEQ ID NO: 29350 - RNA, 22 nt, Human
gucuccucaauuuuugucucag

SEQ ID NO: 29351 - RNA, 24 nt, Human
gcaguggugcaaucacagcucacu

SEQ ID NO: 29352 - RNA, 25 nt, Human
ccugcugccugcccaaacaccccac

SEQ ID NO: 29353 - RNA, 22 nt, Human
aacacaaaauaagagauuuucu

SEQ ID NO: 29354 - RNA, 28 nt, Human
aauguuuauggguguuuucuguuguuuu

SEQ ID NO: 29355 - RNA, 22 nt, Human
ggagggauggagggaggcaggc

SEQ ID NO: 29356 - RNA, 21 nt, Human
ccagccacauuacagauucac

SEQ ID NO: 29357 - RNA, 25 nt, Human
agguuguagcugugcucaggcuuca

SEQ ID NO: 29358 - RNA, 23 nt, Human
ucagcccacuacauagauagcuu

SEQ ID NO: 29359 - RNA, 20 nt, Human
agaugagaggcagaggcaga

SEQ ID NO: 29360 - RNA, 24 nt, Human
guggcugauucugaacaauugugg

SEQ ID NO: 29361 - RNA, 21 nt, Human
cccaccccuccuagugaacua

SEQ ID NO: 29362 - RNA, 23 nt, Human
uguucugaguccauucaaaugug

SEQ ID NO: 29363 - RNA, 21 nt, Human
ugaguccuucacuggcaugcc

SEQ ID NO: 29364 - RNA, 20 nt, Human
gcuuccugcacacuggacag

SEQ ID NO: 29365 - RNA, 21 nt, Human
aggaagacuggguugcaggga

SEQ ID NO: 29366 - RNA, 20 nt, Human
agagaugggguuuugccaug

SEQ ID NO: 29367 - RNA, 27 nt, Human
agcagggaggccaugugcucagccugg

SEQ ID NO: 29368 - RNA, 20 nt, Human
ccucuuccuacccugccucc

SEQ ID NO: 29369 - RNA, 27 nt, Human
gccagugcuuggcaggugcucagggaa

SEQ ID NO: 29370 - RNA, 24 nt, Human
auguuggucaggcucaggcugguc

SEQ ID NO: 29371 - RNA, 20 nt, Human
agccugcaaccucuugaccu

SEQ ID NO: 29372 - RNA, 26 nt, Human
guggcagagcacacaugugcacaggu

SEQ ID NO: 29373 - RNA, 24 nt, Human
ggagacuguuugaugugguacagg

SEQ ID NO: 29374 - RNA, 25 nt, Human
acccagacuggagugcaggggggca

SEQ ID NO: 29375 - RNA, 22 nt, Human
ugggccccacccauugccaagc

SEQ ID NO: 29376 - RNA, 31 nt, Human
guaaagcaccgagucaggugccugauacgca

SEQ ID NO: 29377 - RNA, 20 nt, Human
uacuuuuuauugagcacuuu

SEQ ID NO: 29378 - RNA, 22 nt, Human
uggugagaaacccaacaaaugc

SEQ ID NO: 29379 - RNA, 27 nt, Human
gugugcuucauucagggccauguggca

SEQ ID NO: 29380 - RNA, 20 nt, Human
ucaccugccccacugguugu

SEQ ID NO: 29381 - RNA, 21 nt, Human
ccuccuccaggccugccuccc

SEQ ID NO: 29382 - RNA, 22 nt, Human
gugugagccuccaugcccagcc

SEQ ID NO: 29383 - RNA, 26 nt, Human
cagccaaguugugacagucacugcau

SEQ ID NO: 29384 - RNA, 22 nt, Human
ugccaccgcacuucagccuggg

SEQ ID NO: 29385 - RNA, 27 nt, Human
uugcccaggcuggucucaaacuccugc

SEQ ID NO: 29386 - RNA, 20 nt, Human
guucucaaacucugagccca

SEQ ID NO: 29387 - RNA, 24 nt, Human
ugagauugauguguuuucacugga

SEQ ID NO: 29388 - RNA, 24 nt, Human
gggcaggccucccucagggccagg

SEQ ID NO: 29389 - RNA, 20 nt, Human
ucuacccgggucccugccug

SEQ ID NO: 29390 - RNA, 26 nt, Human
gguaucaaacuauguaauuuuguccu

SEQ ID NO: 29391 - RNA, 20 nt, Human
agugagcaagacaagacacu

SEQ ID NO: 29392 - RNA, 23 nt, Human
gcagaccccagaccgagcagagg

SEQ ID NO: 29393 - RNA, 30 nt, Human
caggagucuggagugcaauggcacgaucuc

SEQ ID NO: 29394 - RNA, 24 nt, Human
agaaccucucauacccucggugcu

SEQ ID NO: 29395 - RNA, 22 nt, Human
ucuccacuguuuguuuuacuuc

SEQ ID NO: 29396 - RNA, 20 nt, Human
cccuuaugcuauagccuggg

SEQ ID NO: 29397 - RNA, 22 nt, Human
ucucuuucucucucuagcuuuu

SEQ ID NO: 29398 - RNA, 20 nt, Human
gugguugcaugggcuuccug

SEQ ID NO: 29399 - RNA, 27 nt, Human
augucagcugcuuuauauacuaaaugc

SEQ ID NO: 29400 - RNA, 21 nt, Human
gcaccauucucccuucucucu

SEQ ID NO: 29401 - RNA, 20 nt, Human
cccaggcuggggugcagugg

SEQ ID NO: 29402 - RNA, 22 nt, Human
ggcagagccacuagggccucuc

SEQ ID NO: 29403 - RNA, 19 nt, Human
ucuuagauauacuagguag

SEQ ID NO: 29404 - RNA, 20 nt, Human
uuuaagaccacagugugaca

SEQ ID NO: 29405 - RNA, 22 nt, Human
ccuuugucuuauacauggcuuc

SEQ ID NO: 29406 - RNA, 22 nt, Human
cuaggaacaugguagaagugga

SEQ ID NO: 29407 - RNA, 22 nt, Human
uggggugagaggaugugagugg

SEQ ID NO: 29408 - RNA, 27 nt, Human
uauuacugaaagggagggguggagaug

SEQ ID NO: 29409 - RNA, 19 nt, Human
ucuccuugugugugucucu

SEQ ID NO: 29410 - RNA, 22 nt, Human
aguugaguuuuuaaucucacuu

SEQ ID NO: 29411 - RNA, 25 nt, Human
uuugaaggaggaaacugaugacaga

SEQ ID NO: 29412 - RNA, 28 nt, Human
agggcuucuuccucaggccagcucuucu

SEQ ID NO: 29413 - RNA, 21 nt, Human
uuuccagucgggggaguaaca

SEQ ID NO: 29414 - RNA, 21 nt, Human
gcgcagaugcuagcacaugcc

SEQ ID NO: 29415 - RNA, 21 nt, Human
aaaucauguuuuuaugcuucc

SEQ ID NO: 29416 - RNA, 25 nt, Human
cauuaugcuuuaauucugaggacca

SEQ ID NO: 29417 - RNA, 24 nt, Human
cguccugccccuuccuccuucaug

SEQ ID NO: 29418 - RNA, 22 nt, Human
gcugcaaccucccccuccuggg

SEQ ID NO: 29419 - RNA, 21 nt, Human
cagcauugugugugcagacuu

SEQ ID NO: 29420 - RNA, 23 nt, Human
gcugggaggagguggaugacuuc

SEQ ID NO: 29421 - RNA, 26 nt, Human
accagccucgguugacguggaugcgc

SEQ ID NO: 29422 - RNA, 26 nt, Human
gggagugagacauuuuugggagcaga

SEQ ID NO: 29423 - RNA, 22 nt, Human
uugugcagaauuaaagugcagu

SEQ ID NO: 29424 - RNA, 23 nt, Human
uuucugcaucaacuugacugggc

SEQ ID NO: 29425 - RNA, 21 nt, Human
acagccugggcaauaaaguga

SEQ ID NO: 29426 - RNA, 22 nt, Human
gauuacaggcgugagccaccgu

SEQ ID NO: 29427 - RNA, 23 nt, Human
uuuuggaacuuccuaauuuuggg

SEQ ID NO: 29428 - RNA, 24 nt, Human
ccuguucuccccucgucgguggcu

SEQ ID NO: 29429 - RNA, 20 nt, Human
cagcaauuccugcaaagggu

SEQ ID NO: 29430 - RNA, 25 nt, Human
ggggcuggagugugaggguccugca

SEQ ID NO: 29431 - RNA, 26 nt, Human
acaaguguccagcccucggugcugga

SEQ ID NO: 29432 - RNA, 22 nt, Human
ccaccuugcacuauuggacuuu

SEQ ID NO: 29433 - RNA, 22 nt, Human
cgcugccaggagaaugauggaa

SEQ ID NO: 29434 - RNA, 27 nt, Human
cgcugccucuugagcagccucgugccu

SEQ ID NO: 29435 - RNA, 22 nt, Human
aaggggcuggauugauggaggc

SEQ ID NO: 29436 - RNA, 23 nt, Human
ccaaucuuuggcuucccugggcc

SEQ ID NO: 29437 - RNA, 20 nt, Human
acagccugacacugggcuga

SEQ ID NO: 29438 - RNA, 22 nt, Human
auucuuuccuucucugaaagug

SEQ ID NO: 29439 - RNA, 20 nt, Human
ugauguuagaagacaaguag

SEQ ID NO: 29440 - RNA, 23 nt, Human
ugcuacagaauguuauuuuacau

SEQ ID NO: 29441 - RNA, 20 nt, Human
ucuuauugaaccucuagcuc

SEQ ID NO: 29442 - RNA, 29 nt, Human
gcuuuugguauuuguuuguagcuuuccug

SEQ ID NO: 29443 - RNA, 24 nt, Human
gcccaagcaaggggccuaugaggg

SEQ ID NO: 29444 - RNA, 22 nt, Human
aucaccuaggcuggagugcagc

SEQ ID NO: 29445 - RNA, 21 nt, Human
guccccaagugaggggagucc

SEQ ID NO: 29446 - RNA, 22 nt, Human
acugcagccuccaccucccagg

SEQ ID NO: 29447 - RNA, 22 nt, Human
gcaacaaaguuugcccccaccu

SEQ ID NO: 29448 - RNA, 20 nt, Human
acaauuccuguaaccuucua

SEQ ID NO: 29449 - RNA, 22 nt, Human
cuagcacaacaagaugaaauua

SEQ ID NO: 29450 - RNA, 27 nt, Human
aaaacauuugaacuugccuaguuagug

SEQ ID NO: 29451 - RNA, 21 nt, Human
ugcauacagagacagauauac

SEQ ID NO: 29452 - RNA, 21 nt, Human
guuauuuaauagcugugauca

SEQ ID NO: 29453 - RNA, 27 nt, Human
acugagucuguggacacuguggaaagc

SEQ ID NO: 29454 - RNA, 25 nt, Human
ugugggcagcaugcccagguuccuu

SEQ ID NO: 29455 - RNA, 23 nt, Human
aagggguuagucaagaagcugag

SEQ ID NO: 29456 - RNA, 20 nt, Human
uccccacccuccacucagcu

SEQ ID NO: 29457 - RNA, 23 nt, Human
caggcagcuagaagggccggugg

SEQ ID NO: 29458 - RNA, 25 nt, Human
acuccucuaacacuucccuccccug

SEQ ID NO: 29459 - RNA, 20 nt, Human
uccccaagccccucccccua

SEQ ID NO: 29460 - RNA, 18 nt, Human
guaaggaggggagagugc

SEQ ID NO: 29461 - RNA, 17 nt, Human
auccacccuccucagcc

SEQ ID NO: 29462 - RNA, 18 nt, Human
gaaauguuacauguagaa

SEQ ID NO: 29463 - RNA, 22 nt, Human
aggugaggagggugaggcucag

SEQ ID NO: 29464 - RNA, 22 nt, Human
uuuggcuuauuuuccaucccag

SEQ ID NO: 29465 - RNA, 21 nt, Human
uuuggagccgggcgcaguggc

SEQ ID NO: 29466 - RNA, 22 nt, Human
ccaggggagagguuggggcugg

SEQ ID NO: 29467 - RNA, 30 nt, Human
caugguacuaccccagccugggguccaucc

SEQ ID NO: 29468 - RNA, 22 nt, Human
gcccugcuuugggcugcccugg

SEQ ID NO: 29469 - RNA, 20 nt, Human
uuugguuuuguguaucugua

SEQ ID NO: 29470 - RNA, 23 nt, Human
uuugaucuucuaaucugugacga

SEQ ID NO: 29471 - RNA, 22 nt, Human
ucuucaccucuuuucucagcuc

SEQ ID NO: 29472 - RNA, 27 nt, Human
cuguuguuggcuucagagccagugguu

SEQ ID NO: 29473 - RNA, 24 nt, Human
gccuauuuauuggggaucugcauu

SEQ ID NO: 29474 - RNA, 24 nt, Human
ucaggcugggguaagccgggguuc

SEQ ID NO: 29475 - RNA, 24 nt, Human
uccucuggcuagagugggaagagg

SEQ ID NO: 29476 - RNA, 24 nt, Human
ggaggccaccugcagccuccaccc

SEQ ID NO: 29477 - RNA, 21 nt, Human
cagguauuuucaucaaguagc

SEQ ID NO: 29478 - RNA, 23 nt, Human
accccagguaaaaaagucucccu

SEQ ID NO: 29479 - RNA, 20 nt, Human
caguacccucacuuucuccc

SEQ ID NO: 29480 - RNA, 19 nt, Human
uuggugaggaggaggcaga

SEQ ID NO: 29481 - RNA, 24 nt, Human
uucagcaaauaugaaacaaaugug

SEQ ID NO: 29482 - RNA, 23 nt, Human
accuugcgauuugcacauauuga

SEQ ID NO: 29483 - RNA, 27 nt, Human
aguguugauuugugcugagaucaagag

SEQ ID NO: 29484 - RNA, 25 nt, Human
gucucuaaccacuccugggcuaagg

SEQ ID NO: 29485 - RNA, 21 nt, Human
gcagagcagagaagcucagcg

SEQ ID NO: 29486 - RNA, 21 nt, Human
cugccaggcuggaguggagug

SEQ ID NO: 29487 - RNA, 18 nt, Human
cccuccucuccccagacc

SEQ ID NO: 29488 - RNA, 22 nt, Human
uugcuauacagaaaaaccacau

SEQ ID NO: 29489 - RNA, 27 nt, Human
gcacagccuuccuccccagaggacccg

SEQ ID NO: 29490 - RNA, 24 nt, Human
ugccauacucuguuuuggcaccac

SEQ ID NO: 29491 - RNA, 26 nt, Human
uccuagaguuuuccaggggguucuga

SEQ ID NO: 29492 - RNA, 25 nt, Human
ucuccacugacucauucauuccuuc

SEQ ID NO: 29493 - RNA, 21 nt, Human
gcaccugucugugccucuggc

SEQ ID NO: 29494 - RNA, 25 nt, Human
uuuuagagugcacugagugcacuuu

SEQ ID NO: 29495 - RNA, 27 nt, Human
gugcucacaccucggcugcaugcaccc

SEQ ID NO: 29496 - RNA, 23 nt, Human
ggccagcccuagccaacauggug

SEQ ID NO: 29497 - RNA, 20 nt, Human
aaugccagcugagcauaggc

SEQ ID NO: 29498 - RNA, 23 nt, Human
gugaugcguaagacauugcagug

SEQ ID NO: 29499 - RNA, 22 nt, Human
ugcugaagaccucuuuuacuuu

SEQ ID NO: 29500 - RNA, 26 nt, Human
aacugauuaugaaacauacgauguua

SEQ ID NO: 29501 - RNA, 22 nt, Human
cccaaaaugcugggauuauagg

SEQ ID NO: 29502 - RNA, 22 nt, Human
gguuugagagacgccgugcccu

SEQ ID NO: 29503 - RNA, 21 nt, Human
cugaucaaaguuccgagaggc

SEQ ID NO: 29504 - RNA, 25 nt, Human
cugccucuucccucaauaguugccu

SEQ ID NO: 29505 - RNA, 22 nt, Human
caaggaagacccugagcaggac

SEQ ID NO: 29506 - RNA, 22 nt, Human
gcaccuuggcauagagcaccca

SEQ ID NO: 29507 - RNA, 26 nt, Human
cccuuuugagcccguccauucaucgg

SEQ ID NO: 29508 - RNA, 19 nt, Human
uuccuuuaugaugcuaguu

SEQ ID NO: 29509 - RNA, 27 nt, Human
gguaccacauuuuaacuuaccaugacu

SEQ ID NO: 29510 - RNA, 18 nt, Human
ggucggggauccccuuaa

SEQ ID NO: 29511 - RNA, 25 nt, Human
gcagccgccgcccgaccgcgccgag

SEQ ID NO: 29512 - RNA, 23 nt, Human
ugugacuuuccugaguuaacacu

SEQ ID NO: 29513 - RNA, 21 nt, Human
gcagugagauguagccuggcc

SEQ ID NO: 29514 - RNA, 22 nt, Human
acagcaugggccucaccuccuc

SEQ ID NO: 29515 - RNA, 22 nt, Human
acaucacauggcauguuuuguc

SEQ ID NO: 29516 - RNA, 21 nt, Human
caagauaggccaaaaugagua

SEQ ID NO: 29517 - RNA, 22 nt, Human
agaaaaguuucaccuguauuga

SEQ ID NO: 29518 - RNA, 23 nt, Human
gaaaagaguauguaguggcuucu

SEQ ID NO: 29519 - RNA, 24 nt, Human
cuacuugauuuacacuuccuaguc

SEQ ID NO: 29520 - RNA, 20 nt, Human
cauuucuaaauaaaaacugc

SEQ ID NO: 29521 - RNA, 24 nt, Human
aggccacauccacagucuccccca

SEQ ID NO: 29522 - RNA, 22 nt, Human
ugaacagauauuuuuaacuuaa

SEQ ID NO: 29523 - RNA, 23 nt, Human
ugcauuagugccugguuacuggg

SEQ ID NO: 29524 - RNA, 26 nt, Human
ucacauuuuccuauuaguggaggagg

SEQ ID NO: 29525 - RNA, 26 nt, Human
cucgcgccuucugcagacuccguggc

SEQ ID NO: 29526 - RNA, 27 nt, Human
ucagaaucugauaccaaagagacaggg

SEQ ID NO: 29527 - RNA, 20 nt, Human
cuaucuaggauauguugaua

SEQ ID NO: 29528 - RNA, 29 nt, Human
ugcauuccugggggcuggaggguggggug

SEQ ID NO: 29529 - RNA, 20 nt, Human
gguuucgaacucggcucaag

SEQ ID NO: 29530 - RNA, 20 nt, Human
gcaggcaaggucucccacug

SEQ ID NO: 29531 - RNA, 20 nt, Human
gacuugucucccagucgagg

SEQ ID NO: 29532 - RNA, 22 nt, Human
auuccagccugggugacagagu

SEQ ID NO: 29533 - RNA, 18 nt, Human
cugaguauuucacuggca

SEQ ID NO: 29534 - RNA, 20 nt, Human
cuccugggcuucuaucccug

SEQ ID NO: 29535 - RNA, 26 nt, Human
uccauguccuaagucuuuugauuuua

SEQ ID NO: 29536 - RNA, 22 nt, Human
cugagguaggagaauugcuuga

SEQ ID NO: 29537 - RNA, 22 nt, Human
cugaggcaggagaacugcuuga

SEQ ID NO: 29538 - RNA, 27 nt, Human
ggaaauguuaauguucagacugaaaau

SEQ ID NO: 29539 - RNA, 25 nt, Human
ccagaaagagcgauuuauggcuuug

SEQ ID NO: 29540 - RNA, 24 nt, Human
ccaggaggggaccagaggggaugc

SEQ ID NO: 29541 - RNA, 19 nt, Human
ucagcucuccaaguuccag

SEQ ID NO: 29542 - RNA, 25 nt, Human
ccguuuacuuccagaagauuggugg

SEQ ID NO: 29543 - RNA, 24 nt, Human
gcugaggacacuagaaccuggcuu

SEQ ID NO: 29544 - RNA, 23 nt, Human
cuagggaagggugguggagccag

SEQ ID NO: 29545 - RNA, 25 nt, Human
agcuaaaauguuucucucauuuacu

SEQ ID NO: 29546 - RNA, 20 nt, Human
aaaauuggaugcauaaagua

SEQ ID NO: 29547 - RNA, 20 nt, Human
uacagugugcauucucucca

SEQ ID NO: 29548 - RNA, 27 nt, Human
uuagagcucucuagaaucccacugacu

SEQ ID NO: 29549 - RNA, 21 nt, Human
uuucauugcagauaugggacu

SEQ ID NO: 29550 - RNA, 24 nt, Human
ugggugggaagagggccaucugcc

SEQ ID NO: 29551 - RNA, 26 nt, Human
ucacauuuacaaguagugaaggucca

SEQ ID NO: 29552 - RNA, 21 nt, Human
gggaggcagagguugcgguga

SEQ ID NO: 29553 - RNA, 21 nt, Human
aggaggcagagguugcaguga

SEQ ID NO: 29554 - RNA, 23 nt, Human
gagaggcucuggacagaugaaua

SEQ ID NO: 29555 - RNA, 25 nt, Human
uuacuguaaaaugcaaaaaaucuua

SEQ ID NO: 29556 - RNA, 26 nt, Human
aguugugccugaaaugaaucuuguuu

SEQ ID NO: 29557 - RNA, 21 nt, Human
ccucagacgccucuggaucca

SEQ ID NO: 29558 - RNA, 27 nt, Human
gcagauggggaagagcuggaaaccaag

SEQ ID NO: 29559 - RNA, 19 nt, Human
aaacuauuccauugaccuu

SEQ ID NO: 29560 - RNA, 21 nt, Human
gccuugauuuccucagcugcc

SEQ ID NO: 29561 - RNA, 22 nt, Human
gagugcuuuccuugugaugcgu

SEQ ID NO: 29562 - RNA, 21 nt, Human
ugagggagggagaggagggga

SEQ ID NO: 29563 - RNA, 21 nt, Human
gaggugagcaucagagccaga

SEQ ID NO: 29564 - RNA, 22 nt, Human
gaaauccugggcucaagugauc

SEQ ID NO: 29565 - RNA, 22 nt, Human
uggugugcagccucucaucuca

SEQ ID NO: 29566 - RNA, 21 nt, Human
cugccacccggguucaagcaa

SEQ ID NO: 29567 - RNA, 22 nt, Human
gccucuauuaauguauuuuuau

SEQ ID NO: 29568 - RNA, 23 nt, Human
gguggucugaagaagaaaaagaa

SEQ ID NO: 29569 - RNA, 23 nt, Human
gucaguuucacuggguaucugca

SEQ ID NO: 29570 - RNA, 22 nt, Human
cuugcacacaccuucuucuaca

SEQ ID NO: 29571 - RNA, 24 nt, Human
aguggaguugcugagucaaagauc

SEQ ID NO: 29572 - RNA, 22 nt, Human
aaagaguuuauuuuccaucuug

SEQ ID NO: 29573 - RNA, 19 nt, Human
ccagcucuacuauuuuugg

SEQ ID NO: 29574 - RNA, 19 nt, Human
aagaagaguuuacagacaa

SEQ ID NO: 29575 - RNA, 21 nt, Human
uuucugcugggccaaggcgcu

SEQ ID NO: 29576 - RNA, 29 nt, Human
ggaaggguccagagcaggagcuucuaucu

SEQ ID NO: 29577 - RNA, 24 nt, Human
ucucucucuuagcauccugccuua

SEQ ID NO: 29578 - RNA, 23 nt, Human
acacauuuuauuuuauuaugcau

SEQ ID NO: 29579 - RNA, 17 nt, Human
guaccuguuacacuuua

SEQ ID NO: 29580 - RNA, 20 nt, Human
gguguucuaaucaauguaca

SEQ ID NO: 29581 - RNA, 22 nt, Human
auugcuugaacccaggaggaag

SEQ ID NO: 29582 - RNA, 22 nt, Human
auugcuugaacacaggaggcag

SEQ ID NO: 29583 - RNA, 27 nt, Human
gagacuggagagcagccagcaggugcc

SEQ ID NO: 29584 - RNA, 24 nt, Human
agaaaacaaaacaaaauaaugcuu

SEQ ID NO: 29585 - RNA, 23 nt, Human
gccgccgccgccacugccacucc

SEQ ID NO: 29586 - RNA, 24 nt, Human
uacaacaacagcugagaucacuua

SEQ ID NO: 29587 - RNA, 27 nt, Human
uucaaguagcugggauuuuaaacuaga

SEQ ID NO: 29588 - RNA, 27 nt, Human
cacaggcaaagaggugcugcuuugcuu

SEQ ID NO: 29589 - RNA, 15 nt, Human
cugacucugggcguc

SEQ ID NO: 29590 - RNA, 25 nt, Human
agagagcugccucagaugauggacg

SEQ ID NO: 29591 - RNA, 26 nt, Human
gugcccagguggaguuagaaagucaa

SEQ ID NO: 29592 - RNA, 19 nt, Human
ccucccucugccuccucca

SEQ ID NO: 29593 - RNA, 26 nt, Human
agcccagcuuccauuucuauaaaaug

SEQ ID NO: 29594 - RNA, 19 nt, Human
ggaaaggguuugcuucuac

SEQ ID NO: 29595 - RNA, 26 nt, Human
aaucuuuuugaaaaucauuuccagac

SEQ ID NO: 29596 - RNA, 27 nt, Human
ucagccaggcuggaggcggcaggcggc

SEQ ID NO: 29597 - RNA, 22 nt, Human
gaacuccuggccuuaagugauc

SEQ ID NO: 29598 - RNA, 22 nt, Human
gaacuccuggccucaagugauu

SEQ ID NO: 29599 - RNA, 26 nt, Human
aguagaaauuauuccuuucagaguaa

SEQ ID NO: 29600 - RNA, 22 nt, Human
gcccagguggcugaccucugcu

SEQ ID NO: 29601 - RNA, 22 nt, Human
gucaucugcaugucuacucagc

SEQ ID NO: 29602 - RNA, 21 nt, Human
cccuggccccagccauccuga

SEQ ID NO: 29603 - RNA, 23 nt, Human
gcucaagcgauccuccugccuca

SEQ ID NO: 29604 - RNA, 21 nt, Human
cauggugucucacacguuuaa

SEQ ID NO: 29605 - RNA, 29 nt, Human
acugguaacaugugacaagcacaccacaa

SEQ ID NO: 29606 - RNA, 22 nt, Human
uucugaaauguacaucuuuaca

SEQ ID NO: 29607 - RNA, 21 nt, Human
ccuccugccgcugccugccau

SEQ ID NO: 29608 - RNA, 21 nt, Human
uccagagucaucucagcccug

SEQ ID NO: 29609 - RNA, 22 nt, Human
uguuagaaaaauagcugugaac

SEQ ID NO: 29610 - RNA, 23 nt, Human
cuucucuaucaucuugcaccccc

SEQ ID NO: 29611 - RNA, 26 nt, Human
aauccugucuuucugagcacacuuua

SEQ ID NO: 29612 - RNA, 20 nt, Human
uucagagaagucaguuggag

SEQ ID NO: 29613 - RNA, 21 nt, Human
uugcccaggcuggucucaaac

SEQ ID NO: 29614 - RNA, 25 nt, Human
ggagugugcugggacguugugugca

SEQ ID NO: 29615 - RNA, 23 nt, Human
ggaugaagccuaagccagcugag

SEQ ID NO: 29616 - RNA, 26 nt, Human
caggcgcagaggucccagccccaggc

SEQ ID NO: 29617 - RNA, 20 nt, Human
ccaaugauucccacucuguu

SEQ ID NO: 29618 - RNA, 21 nt, Human
cgaccucccgggcucagguga

SEQ ID NO: 29619 - RNA, 23 nt, Human
cccgccgcugcucccaccucugg

SEQ ID NO: 29620 - RNA, 24 nt, Human
gagcuaaauuauaauauuuuuguu

SEQ ID NO: 29621 - RNA, 22 nt, Human
uuauaggguacauauguuguca

SEQ ID NO: 29622 - RNA, 24 nt, Human
gcguggagguggagccugcggcug

SEQ ID NO: 29623 - RNA, 21 nt, Human
cuccucgggaccaggacuuca

SEQ ID NO: 29624 - RNA, 24 nt, Human
gucagggucccucaggcuucccuu

SEQ ID NO: 29625 - RNA, 18 nt, Human
ggccgaaggcagugcaag

SEQ ID NO: 29626 - RNA, 27 nt, Human
ucauccagccacugcccaaagccaucu

SEQ ID NO: 29627 - RNA, 27 nt, Human
accagccuggccaacaugguguaacgc

SEQ ID NO: 29628 - RNA, 20 nt, Human
cacaguuggcugagugccuu

SEQ ID NO: 29629 - RNA, 22 nt, Human
cacaucucuucaucuguauccu

SEQ ID NO: 29630 - RNA, 21 nt, Human
auaccugcagagauacacuuc

SEQ ID NO: 29631 - RNA, 20 nt, Human
ucuauucauuccuugccaug

SEQ ID NO: 29632 - RNA, 24 nt, Human
uugcccucaggccugugcccagca

SEQ ID NO: 29633 - RNA, 25 nt, Human
ggagguggagguugcauucaacuga

SEQ ID NO: 29634 - RNA, 22 nt, Human
acuugaagcuguggaagauggu

SEQ ID NO: 29635 - RNA, 22 nt, Human
cacacugagacaagcucaggcc

SEQ ID NO: 29636 - RNA, 18 nt, Human
aaccacagccaucaugcc

SEQ ID NO: 29637 - RNA, 23 nt, Human
ccccuguccucgcccugccuccu

SEQ ID NO: 29638 - RNA, 22 nt, Human
acacaccugcuccaauuucccc

SEQ ID NO: 29639 - RNA, 25 nt, Human
aggcagcagcgcagcgggcgcgccg

SEQ ID NO: 29640 - RNA, 23 nt, Human
cccacccaggccguggggccagg

SEQ ID NO: 29641 - RNA, 26 nt, Human
gcccccucaggucgcuggagugcacc

SEQ ID NO: 29642 - RNA, 19 nt, Human
gacagaauaugaccaccuu

SEQ ID NO: 29643 - RNA, 22 nt, Human
uauuaaaaucaagcacuugaua

SEQ ID NO: 29644 - RNA, 23 nt, Human
acagugccccaaauggaaaaaag

SEQ ID NO: 29645 - RNA, 27 nt, Human
ucuugccucacugcaacgccugccucu

SEQ ID NO: 29646 - RNA, 21 nt, Human
cagccccuguccucaccucuc

SEQ ID NO: 29647 - RNA, 24 nt, Human
gcuguauucuucuuugguggagau

SEQ ID NO: 29648 - RNA, 26 nt, Human
ugaaaugcuacauuuccaaggugaag

SEQ ID NO: 29649 - RNA, 25 nt, Human
aggaauuugaacauuuuaucuuugg

SEQ ID NO: 29650 - RNA, 21 nt, Human
aaucuuauuuuuaagcacuuu

SEQ ID NO: 29651 - RNA, 19 nt, Human
ccucagaagauaaaaagaa

SEQ ID NO: 29652 - RNA, 20 nt, Human
ccaaaacacauuuaccagca

SEQ ID NO: 29653 - RNA, 23 nt, Human
ccagagacuagugggccucucug

SEQ ID NO: 29654 - RNA, 20 nt, Human
caauucugcauguauucaua

SEQ ID NO: 29655 - RNA, 22 nt, Human
gagcccaggaggcugaggcugc

SEQ ID NO: 29656 - RNA, 21 nt, Human
uuccagggagcuucuaccugg

SEQ ID NO: 29657 - RNA, 21 nt, Human
agcucuggcauccccaccuca

SEQ ID NO: 29658 - RNA, 22 nt, Human
uggauuuauuccaaaauugcuu

SEQ ID NO: 29659 - RNA, 22 nt, Human
gaagcaguuccagaaggaccau

SEQ ID NO: 29660 - RNA, 21 nt, Human
cuaguuccuuugacauuccau

SEQ ID NO: 29661 - RNA, 25 nt, Human
ucgaaaugaaauaauguacugugug

SEQ ID NO: 29662 - RNA, 22 nt, Human
caaugccacauuuuacugugac

SEQ ID NO: 29663 - RNA, 24 nt, Human
gccagagggccagcaggcuccugg

SEQ ID NO: 29664 - RNA, 26 nt, Human
cacuccugccuccaccucugacucuu

SEQ ID NO: 29665 - RNA, 22 nt, Human
uaacagaauuugguuuguacuu

SEQ ID NO: 29666 - RNA, 22 nt, Human
uuagauuuuaccggucuguaaa

SEQ ID NO: 29667 - RNA, 23 nt, Human
ccugugcaccguaguggccaugg

SEQ ID NO: 29668 - RNA, 26 nt, Human
auucucugguuuuggaucaggcacag

SEQ ID NO: 29669 - RNA, 24 nt, Human
acccaggcuggagugcaaugggca

SEQ ID NO: 29670 - RNA, 26 nt, Human
uggagguucuggaugaaggcugaaca

SEQ ID NO: 29671 - RNA, 17 nt, Human
gccauccuucaccagag

SEQ ID NO: 29672 - RNA, 24 nt, Human
ggcaggagaggagucgggacacua

SEQ ID NO: 29673 - RNA, 20 nt, Human
agaaagccucucagugugga

SEQ ID NO: 29674 - RNA, 22 nt, Human
agagugugggcuggcuguugug

SEQ ID NO: 29675 - RNA, 27 nt, Human
uucucuuuuuuauccuuaauguuaauc

SEQ ID NO: 29676 - RNA, 27 nt, Human
gcacaggaagcuguaucauuuacaggu

SEQ ID NO: 29677 - RNA, 24 nt, Human
cagacugaugaaaugcacucagaa

SEQ ID NO: 29678 - RNA, 22 nt, Human
acgaccucggcucacugcagcc

SEQ ID NO: 29679 - RNA, 21 nt, Human
uuauguuaauguaugugcucc

SEQ ID NO: 29680 - RNA, 21 nt, Human
ccagccgccuccuccgcgcag

SEQ ID NO: 29681 - RNA, 22 nt, Human
acauuuauuucuggaagugugu

SEQ ID NO: 29682 - RNA, 21 nt, Human
caagcgauccuccugccucag

SEQ ID NO: 29683 - RNA, 22 nt, Human
acaccugcaaucccagcacuuu

SEQ ID NO: 29684 - RNA, 23 nt, Human
uauucauuuauccuguacaauca

SEQ ID NO: 29685 - RNA, 29 nt, Human
cuguguauuuauuuaaaacucuggugaua

SEQ ID NO: 29686 - RNA, 21 nt, Human
ugcugcugggccucugccuug

SEQ ID NO: 29687 - RNA, 24 nt, Human
uuagaucauauucuaguauguucu

SEQ ID NO: 29688 - RNA, 19 nt, Human
uugccaggcuggugcaaag

SEQ ID NO: 29689 - RNA, 27 nt, Human
cugggaggcggcagaaugcagccagag

SEQ ID NO: 29690 - RNA, 27 nt, Human
uauuuuuuaaaaccuggaccuuucugg

SEQ ID NO: 29691 - RNA, 24 nt, Human
ucucugcacccagcuccucucugc

SEQ ID NO: 29692 - RNA, 19 nt, Human
cggaagagacaagcaagca

SEQ ID NO: 29693 - RNA, 21 nt, Human
ggaaacaggcuccaagaggcu

SEQ ID NO: 29694 - RNA, 26 nt, Human
aaagagacuggagcaucugacucaca

SEQ ID NO: 29695 - RNA, 20 nt, Human
aucagugugaauuacagcaa

SEQ ID NO: 29696 - RNA, 27 nt, Human
cccugcagagggccugguuucaggaga

SEQ ID NO: 29697 - RNA, 26 nt, Human
gcgggucccugagcuggaagccggag

SEQ ID NO: 29698 - RNA, 22 nt, Human
caggcagcaggggcugcuguga

SEQ ID NO: 29699 - RNA, 21 nt, Human
gagccauuugguggcgcugcu

SEQ ID NO: 29700 - RNA, 22 nt, Human
gugccaggugaaggaggcucca

SEQ ID NO: 29701 - RNA, 21 nt, Human
augacuuucccacagagacug

SEQ ID NO: 29702 - RNA, 20 nt, Human
ccagaacccagccuccuggg

SEQ ID NO: 29703 - RNA, 22 nt, Human
ugugcugugauguugagagcug

SEQ ID NO: 29704 - RNA, 22 nt, Human
ggccagggaggugcggagcagc

SEQ ID NO: 29705 - RNA, 21 nt, Human
guccaaugccugcaugcugcu

SEQ ID NO: 29706 - RNA, 25 nt, Human
gcgaucuaggcucacugcaacuucc

SEQ ID NO: 29707 - RNA, 26 nt, Human
cuauaguaaggaggaggagaaggggg

SEQ ID NO: 29708 - RNA, 26 nt, Human
ccuccaggcuucuccccagguuuguu

SEQ ID NO: 29709 - RNA, 22 nt, Human
caacagcaagcccaagauuccg

SEQ ID NO: 29710 - RNA, 21 nt, Human
cucaccaaaacccagccuugc

SEQ ID NO: 29711 - RNA, 23 nt, Human
cuggucccuuguauccccugcag

SEQ ID NO: 29712 - RNA, 21 nt, Human
ccaucccaucuccugcccucu

SEQ ID NO: 29713 - RNA, 24 nt, Human
ugucuguguccuuguauaaggagc

SEQ ID NO: 29714 - RNA, 25 nt, Human
gcuuccauugaggagcccaggcugg

SEQ ID NO: 29715 - RNA, 27 nt, Human
caguuuacagaagcaacuuagugccuu

SEQ ID NO: 29716 - RNA, 25 nt, Human
gcaagugccugugucccuguccuuc

SEQ ID NO: 29717 - RNA, 19 nt, Human
guuccaacaccugccucca

SEQ ID NO: 29718 - RNA, 20 nt, Human
cuuuucuauuuaugaagauu

SEQ ID NO: 29719 - RNA, 22 nt, Human
cccaggaagggagggagcugag

SEQ ID NO: 29720 - RNA, 21 nt, Human
ucugcccaacuagccucaacu

SEQ ID NO: 29721 - RNA, 28 nt, Human
agccccagguguggugacuuagaccuag

SEQ ID NO: 29722 - RNA, 26 nt, Human
cccaccccagguccugcagucuggcu

SEQ ID NO: 29723 - RNA, 23 nt, Human
gguccuggcagggucaggcuggg

SEQ ID NO: 29724 - RNA, 23 nt, Human
uccucuugguggguguggccagc

SEQ ID NO: 29725 - RNA, 26 nt, Human
gaggaagagcuagaaauccaguagca

SEQ ID NO: 29726 - RNA, 26 nt, Human
gccgugcucgcgcccuccuccuggcc

SEQ ID NO: 29727 - RNA, 20 nt, Human
ggccggguccccauggggag

SEQ ID NO: 29728 - RNA, 27 nt, Human
gcuggauaguucucuguuguggggguu

SEQ ID NO: 29729 - RNA, 23 nt, Human
ucaaguuugggucugugcugcug

SEQ ID NO: 29730 - RNA, 30 nt, Human
ugcgggucguggggaccaagcacauugguc

SEQ ID NO: 29731 - RNA, 20 nt, Human
agagaauccuuaauauugcu

SEQ ID NO: 29732 - RNA, 26 nt, Human
ggcacucagagauccagcaggugcug

SEQ ID NO: 29733 - RNA, 26 nt, Human
gcagcccagagcuccagagaaaaaga

SEQ ID NO: 29734 - RNA, 27 nt, Human
ccagugcacuccaggcuggacgacaga

SEQ ID NO: 29735 - RNA, 24 nt, Human
ugagggaggggauaaagaggaagc

SEQ ID NO: 29736 - RNA, 21 nt, Human
gcgccgccucccagaguucag

SEQ ID NO: 29737 - RNA, 22 nt, Human
uuuauccuugcucccuuuugga

SEQ ID NO: 29738 - RNA, 21 nt, Human
ccauucucuucaacuaaauca

SEQ ID NO: 29739 - RNA, 20 nt, Human
aagaaaaaauaaauacauuu

SEQ ID NO: 29740 - RNA, 20 nt, Human
cgacuuuaguuuggccaggu

SEQ ID NO: 29741 - RNA, 22 nt, Human
ggaggccgagacgggaggauca

SEQ ID NO: 29742 - RNA, 21 nt, Human
uguggauuugagcucugugau

SEQ ID NO: 29743 - RNA, 24 nt, Human
cagcugcuguggggugcagaggca

SEQ ID NO: 29744 - RNA, 19 nt, Human
caugcacacaggugcacag

SEQ ID NO: 29745 - RNA, 22 nt, Human
ggauacuuguucaggguugcca

SEQ ID NO: 29746 - RNA, 23 nt, Human
ccaguauaaaauaccaaugcaac

SEQ ID NO: 29747 - RNA, 21 nt, Human
ucuacccucauuaacaauuag

SEQ ID NO: 29748 - RNA, 22 nt, Human
cagaaagagcucuccagaagcc

SEQ ID NO: 29749 - RNA, 23 nt, Human
gcaguagcaucaccaucuguaaa

SEQ ID NO: 29750 - RNA, 23 nt, Human
gcuuccuugauaauucugugggc

SEQ ID NO: 29751 - RNA, 24 nt, Human
cucuuuaauugcuaaccauccugc

SEQ ID NO: 29752 - RNA, 26 nt, Human
ugaaguuuaggaauccuuuggugcca

SEQ ID NO: 29753 - RNA, 25 nt, Human
gugaaccccccagugcccccguggg

SEQ ID NO: 29754 - RNA, 21 nt, Human
aaacuauuugucauuguuaca

SEQ ID NO: 29755 - RNA, 25 nt, Human
gguuggaccagagugauguccucuc

SEQ ID NO: 29756 - RNA, 25 nt, Human
ggaggugggcgagggggaccgaggc

SEQ ID NO: 29757 - RNA, 20 nt, Human
gggggaaggagggaggcuga

SEQ ID NO: 29758 - RNA, 22 nt, Human
cccacccacacagcugccgcag

SEQ ID NO: 29759 - RNA, 21 nt, Human
aagagggggagggagaaacgc

SEQ ID NO: 29760 - RNA, 22 nt, Human
uguuggugcugaccuccaggcc

SEQ ID NO: 29761 - RNA, 18 nt, Human
ccauuuuucacuagcgac

SEQ ID NO: 29762 - RNA, 29 nt, Human
ggacccagggagaguguggggacaggaca

SEQ ID NO: 29763 - RNA, 21 nt, Human
cccuauguguggggaggggag

SEQ ID NO: 29764 - RNA, 22 nt, Human
gcaaauaacagaaaacccagca

SEQ ID NO: 29765 - RNA, 26 nt, Human
ccuugucacugaacccugaucuagac

SEQ ID NO: 29766 - RNA, 22 nt, Human
cuucccaacuuacucuagguca

SEQ ID NO: 29767 - RNA, 25 nt, Human
ggagcccccacccuguuccugcugc

SEQ ID NO: 29768 - RNA, 23 nt, Human
agcugguuagaggcugggaggac

SEQ ID NO: 29769 - RNA, 21 nt, Human
aggcuucucccuucuuucugg

SEQ ID NO: 29770 - RNA, 25 nt, Human
gucuggcuugcccccucccugggcc

SEQ ID NO: 29771 - RNA, 23 nt, Human
cacaguuucagcacucaaccuca

SEQ ID NO: 29772 - RNA, 22 nt, Human
aguucagcugcuucucuugccu

SEQ ID NO: 29773 - RNA, 21 nt, Human
ccaaguuauacccaaccccag

SEQ ID NO: 29774 - RNA, 22 nt, Human
ucaguaugugaaaccaccauuu

SEQ ID NO: 29775 - RNA, 25 nt, Human
ggggcggcugccucacucccuaccu

SEQ ID NO: 29776 - RNA, 22 nt, Human
uuaauaugguguacauucuucc

SEQ ID NO: 29777 - RNA, 25 nt, Human
acaucuggucucuuccuucacugcu

SEQ ID NO: 29778 - RNA, 20 nt, Human
ggacauggcccugccccuau

SEQ ID NO: 29779 - RNA, 22 nt, Human
cugcacccucuuucuguuggcu

SEQ ID NO: 29780 - RNA, 24 nt, Human
gccagccucaguugaugccuuccc

SEQ ID NO: 29781 - RNA, 27 nt, Human
uccuagaccauauuuucaagucaucuu

SEQ ID NO: 29782 - RNA, 22 nt, Human
caaacuaaccucacgugaagug

SEQ ID NO: 29783 - RNA, 20 nt, Human
ggcagcgcccuuccucucca

SEQ ID NO: 29784 - RNA, 27 nt, Human
ggaggcugaggcaagcagguuguuuga

SEQ ID NO: 29785 - RNA, 27 nt, Human
gugcaacuuaugaagacacugcagcuu

SEQ ID NO: 29786 - RNA, 20 nt, Human
gauacuugccagucucucca

SEQ ID NO: 29787 - RNA, 23 nt, Human
gucaccgaggcuggagugcagug

SEQ ID NO: 29788 - RNA, 25 nt, Human
uucucucucagaguacaagcucuca

SEQ ID NO: 29789 - RNA, 26 nt, Human
ccuacgcgcagcuccugcagguggcu

SEQ ID NO: 29790 - RNA, 20 nt, Human
ugugaaccccugcacccaac

SEQ ID NO: 29791 - RNA, 19 nt, Human
aacuauucacccuaccuca

SEQ ID NO: 29792 - RNA, 21 nt, Human
aagacagugcugagauuggaa

SEQ ID NO: 29793 - RNA, 21 nt, Human
cuccccucggcacccccggcc

SEQ ID NO: 29794 - RNA, 22 nt, Human
gaguuugaaaggacuaugcugc

SEQ ID NO: 29795 - RNA, 25 nt, Human
cgccgccgccucguucacgcacccc

SEQ ID NO: 29796 - RNA, 23 nt, Human
gcccccagccccggggugagucc

SEQ ID NO: 29797 - RNA, 23 nt, Human
aaagaaauacaaaguuguaaaag

SEQ ID NO: 29798 - RNA, 20 nt, Human
cuauuguucuuuacugacua

SEQ ID NO: 29799 - RNA, 25 nt, Human
ugcaaagacccgggagcuggcgggg

SEQ ID NO: 29800 - RNA, 23 nt, Human
cuuccuguguacucuuuauuucu

SEQ ID NO: 29801 - RNA, 26 nt, Human
ggcucagagcagagacuugugaauuc

SEQ ID NO: 29802 - RNA, 22 nt, Human
cagaaaugcugcagaguauaua

SEQ ID NO: 29803 - RNA, 23 nt, Human
aagcucugguguaugcuacagca

SEQ ID NO: 29804 - RNA, 27 nt, Human
cuuuucuuugcccuccugauucuuggc

SEQ ID NO: 29805 - RNA, 25 nt, Human
cucuaguauucacuugagucuuccu

SEQ ID NO: 29806 - RNA, 15 nt, Human
cuucccuucuagccc

SEQ ID NO: 29807 - RNA, 15 nt, Human
acucccuuacagccc

SEQ ID NO: 29808 - RNA, 17 nt, Human
acggauucugguggggu

SEQ ID NO: 29809 - RNA, 22 nt, Human
ucagcucuccaucugucucugc

SEQ ID NO: 29810 - RNA, 20 nt, Human
ucaguguacacgucuggacc

SEQ ID NO: 29811 - RNA, 21 nt, Human
aucucagacccugcuuaggau

SEQ ID NO: 29812 - RNA, 24 nt, Human
uuuuuucugggucaguaaauaaca

SEQ ID NO: 29813 - RNA, 19 nt, Human
uggaaugucagaagacuga

SEQ ID NO: 29814 - RNA, 20 nt, Human
gcugccucccccucucagcc

SEQ ID NO: 29815 - RNA, 24 nt, Human
aguuuaaugcugugucucugucag

SEQ ID NO: 29816 - RNA, 22 nt, Human
ccucccgccucagccugcccag

SEQ ID NO: 29817 - RNA, 20 nt, Human
agcuccucaaucauagccaa

SEQ ID NO: 29818 - RNA, 23 nt, Human
gucagcgcgagccgcugcaguga

SEQ ID NO: 29819 - RNA, 20 nt, Human
cuagaaguccucuguggucu

SEQ ID NO: 29820 - RNA, 20 nt, Human
ucuucucccuggcaaggcuc

SEQ ID NO: 29821 - RNA, 27 nt, Human
cacuggucucucucauuacagccuggg

SEQ ID NO: 29822 - RNA, 22 nt, Human
agcuaauuuuugcauuuuuacu

SEQ ID NO: 29823 - RNA, 20 nt, Human
ugcccaggcuugagugcaau

SEQ ID NO: 29824 - RNA, 21 nt, Human
ggaaagggaggauuugcuuag

SEQ ID NO: 29825 - RNA, 23 nt, Human
accacgcccggcuaauuuuuugu

SEQ ID NO: 29826 - RNA, 27 nt, Human
cccucuccucucccccagguuggggcu

SEQ ID NO: 29827 - RNA, 21 nt, Human
aaaauugugaauucuguuguu

SEQ ID NO: 29828 - RNA, 21 nt, Human
cccucuugcacuuucucucca

SEQ ID NO: 29829 - RNA, 20 nt, Human
cuggcugccaagauaccuuc

SEQ ID NO: 29830 - RNA, 19 nt, Human
uuuugccauguggcgccau

SEQ ID NO: 29831 - RNA, 27 nt, Human
ccccaaaagaugccgcgucaguucgag

SEQ ID NO: 29832 - RNA, 29 nt, Human
gugggaucaggcagcagagcuuuuuuccc

SEQ ID NO: 29833 - RNA, 29 nt, Human
acuguccagguggagacugagcaaaggaa

SEQ ID NO: 29834 - RNA, 22 nt, Human
auuuuugcugaguccugcagcc

SEQ ID NO: 29835 - RNA, 25 nt, Human
aaggcagcaaggcccgagcagcuga

SEQ ID NO: 29836 - RNA, 27 nt, Human
uaccauguuaaagaggcgucuuguauu

SEQ ID NO: 29837 - RNA, 28 nt, Human
uugucccaggcugggcagaggucaggag

SEQ ID NO: 29838 - RNA, 21 nt, Human
aucugaaaacuggaauaagaa

SEQ ID NO: 29839 - RNA, 21 nt, Human
ggggugagggccaaaggcuau

SEQ ID NO: 29840 - RNA, 26 nt, Human
gaaccacaguugaaaccugcuuuuau

SEQ ID NO: 29841 - RNA, 31 nt, Human
gccucugugucacccacuccugggugcgugc

SEQ ID NO: 29842 - RNA, 22 nt, Human
ugucugucagucagucucuccc

SEQ ID NO: 29843 - RNA, 24 nt, Human
gccuuucuucuccuuguagggguc

SEQ ID NO: 29844 - RNA, 22 nt, Human
ggcuuccuggaaucaaaaugug

SEQ ID NO: 29845 - RNA, 24 nt, Human
guguccugucuuccuuccuccuca

SEQ ID NO: 29846 - RNA, 25 nt, Human
ccaggucuccucgaccuccauacac

SEQ ID NO: 29847 - RNA, 21 nt, Human
ugucccucuuugccuguguga

SEQ ID NO: 29848 - RNA, 22 nt, Human
acugcaaccuccgccuccuggg

SEQ ID NO: 29849 - RNA, 23 nt, Human
uuuacuauauguugaccauucca

SEQ ID NO: 29850 - RNA, 23 nt, Human
uuuaagucccugucaccucuucc

SEQ ID NO: 29851 - RNA, 22 nt, Human
ccucucuguccugccucaggcc

SEQ ID NO: 29852 - RNA, 26 nt, Human
accagcccuggggcugggccccccag

SEQ ID NO: 29853 - RNA, 26 nt, Human
uucgacauccgucauugcugcugcua

SEQ ID NO: 29854 - RNA, 22 nt, Human
gcucacaccuguaaucccagca

SEQ ID NO: 29855 - RNA, 28 nt, Human
cucggaacugcugaccccaggaauuuac

SEQ ID NO: 29856 - RNA, 18 nt, Human
caccgcacacgugcacac

SEQ ID NO: 29857 - RNA, 22 nt, Human
ggagggggcaucuucugacagc

SEQ ID NO: 29858 - RNA, 23 nt, Human
ugucugcucucuccuugcucaac

SEQ ID NO: 29859 - RNA, 27 nt, Human
aacgauaccagagucacuauguggucc

SEQ ID NO: 29860 - RNA, 21 nt, Human
ggucaucggugugcaguauug

SEQ ID NO: 29861 - RNA, 20 nt, Human
ggcugugagggagaggguca

SEQ ID NO: 29862 - RNA, 20 nt, Human
uuucaugagaguaguuuaca

SEQ ID NO: 29863 - RNA, 22 nt, Human
caaaacucucggugaaugaacc

SEQ ID NO: 29864 - RNA, 20 nt, Human
uaccccuaacauccaggaga

SEQ ID NO: 29865 - RNA, 21 nt, Human
ggaaggugggaagcagaugac

SEQ ID NO: 29866 - RNA, 21 nt, Human
uuaagcugccaauuguagcac

SEQ ID NO: 29867 - RNA, 21 nt, Human
ccagcaaugccugcuaaaugc

SEQ ID NO: 29868 - RNA, 22 nt, Human
guucuuuucuccccuugagguc

SEQ ID NO: 29869 - RNA, 26 nt, Human
ucucccaccauguccacugugagaau

SEQ ID NO: 29870 - RNA, 18 nt, Human
guaacaaaagcuucaucc

SEQ ID NO: 29871 - RNA, 23 nt, Human
gcuuuucucuucugucaacccca

SEQ ID NO: 29872 - RNA, 23 nt, Human
uuuaaaaaauguuguuagcuugg

SEQ ID NO: 29873 - RNA, 18 nt, Human
gccuucauauaugccuua

SEQ ID NO: 29874 - RNA, 23 nt, Human
ggcuccaccaaauuagugccucu

SEQ ID NO: 29875 - RNA, 24 nt, Human
uuuucugaauccuuaugcucuuuu

SEQ ID NO: 29876 - RNA, 21 nt, Human
aacccaguuagaugcaauuug

SEQ ID NO: 29877 - RNA, 24 nt, Human
ucucugccucugguugaccuuaca

SEQ ID NO: 29878 - RNA, 27 nt, Human
uugaagaaggaacugaggcccagaaag

SEQ ID NO: 29879 - RNA, 22 nt, Human
gguguuucaagguucuguucag

SEQ ID NO: 29880 - RNA, 20 nt, Human
uaaaucagcaaaacaccaga

SEQ ID NO: 29881 - RNA, 22 nt, Human
aaagggaggcucucuuaagagc

SEQ ID NO: 29882 - RNA, 27 nt, Human
acaaagaugggugaaggcuggcaugau

SEQ ID NO: 29883 - RNA, 22 nt, Human
cugaggcaggagaaucacucga

SEQ ID NO: 29884 - RNA, 19 nt, Human
aacuccugccugcccucca

SEQ ID NO: 29885 - RNA, 22 nt, Human
uucagaccccuggguacauggu

SEQ ID NO: 29886 - RNA, 19 nt, Human
gucucugcauuuggagauu

SEQ ID NO: 29887 - RNA, 26 nt, Human
uggcuuggccucccaaagcgcuggga

SEQ ID NO: 29888 - RNA, 20 nt, Human
aacagcuucugagcuuugga

SEQ ID NO: 29889 - RNA, 20 nt, Human
ugccauagaguuuaacacaa

SEQ ID NO: 29890 - RNA, 20 nt, Human
aaauccgcuuuucugccaca

SEQ ID NO: 29891 - RNA, 27 nt, Human
ucauucuauuggaaggagguguaacgg

SEQ ID NO: 29892 - RNA, 23 nt, Human
ccagucucuccuccgucuuccag

SEQ ID NO: 29893 - RNA, 25 nt, Human
gucggucucggagccccuuguggca

SEQ ID NO: 29894 - RNA, 21 nt, Human
aauuaguacagaaauauccau

SEQ ID NO: 29895 - RNA, 27 nt, Human
cccucacucuccccgucuccauggucc

SEQ ID NO: 29896 - RNA, 27 nt, Human
ggggcagcugugcuggcuuaugcucuu

SEQ ID NO: 29897 - RNA, 19 nt, Human
uugcacagggagugcagga

SEQ ID NO: 29898 - RNA, 22 nt, Human
cccugcucuguucccugggaca

SEQ ID NO: 29899 - RNA, 22 nt, Human
cuuggggucccuccaccugggg

SEQ ID NO: 29900 - RNA, 26 nt, Human
ggcaucugagucuccuaacccaagau

SEQ ID NO: 29901 - RNA, 22 nt, Human
cagggaggggagggguccaggc

SEQ ID NO: 29902 - RNA, 24 nt, Human
uaucugaaaaauguugaaagccua

SEQ ID NO: 29903 - RNA, 27 nt, Human
ggcuguggucucucugcuuuaaauccu

SEQ ID NO: 29904 - RNA, 22 nt, Human
gagucccaggcugagccucagu

SEQ ID NO: 29905 - RNA, 26 nt, Human
agccaucuugguaaauuuccccaaca

SEQ ID NO: 29906 - RNA, 27 nt, Human
ugcagcuccccugggcuccgcggccag

SEQ ID NO: 29907 - RNA, 21 nt, Human
gggucugcagugcagcauuaa

SEQ ID NO: 29908 - RNA, 25 nt, Human
ccuauuuauuaaauuuaaaaagcuu

SEQ ID NO: 29909 - RNA, 25 nt, Human
uuguuccaguacuauggagugcuca

SEQ ID NO: 29910 - RNA, 21 nt, Human
uggacuaaaaucacacuccuc

SEQ ID NO: 29911 - RNA, 26 nt, Human
cuccggccaaaugcugggcucaggcc

SEQ ID NO: 29912 - RNA, 26 nt, Human
cacccagguugcugucggcaggcuga

SEQ ID NO: 29913 - RNA, 21 nt, Human
aggagguggaaacugcagaga

SEQ ID NO: 29914 - RNA, 19 nt, Human
uacucuguuccucuuccca

SEQ ID NO: 29915 - RNA, 22 nt, Human
ugucacacaggcuggagugcag

SEQ ID NO: 29916 - RNA, 21 nt, Human
cuuucaaagugguccccuggg

SEQ ID NO: 29917 - RNA, 22 nt, Human
ccacuguacuccagccuggaca

SEQ ID NO: 29918 - RNA, 25 nt, Human
cccuguuccuugcccaccucaggcc

SEQ ID NO: 29919 - RNA, 23 nt, Human
gucccaggcugggcagaggucag

SEQ ID NO: 29920 - RNA, 19 nt, Human
aucuguaccuucuuugcua

SEQ ID NO: 29921 - RNA, 20 nt, Human
uuuccucuuguuugucaucu

SEQ ID NO: 29922 - RNA, 22 nt, Human
aacuaguagaaccuucuuuccu

SEQ ID NO: 29923 - RNA, 23 nt, Human
ucccagugguguuucuuaagguu

SEQ ID NO: 29924 - RNA, 27 nt, Human
ggcucgcugcaaccuucacccuucacc

SEQ ID NO: 29925 - RNA, 21 nt, Human
gcccucugcugauucgcugca

SEQ ID NO: 29926 - RNA, 24 nt, Human
aaagcucugaaaguagugaguuuc

SEQ ID NO: 29927 - RNA, 27 nt, Human
cucuccaaaauaaaaucaaauaaagga

SEQ ID NO: 29928 - RNA, 24 nt, Human
agaguucucuguccuacugcucuc

SEQ ID NO: 29929 - RNA, 28 nt, Human
gcgcuccaacccgcagccuccuccugcc

SEQ ID NO: 29930 - RNA, 22 nt, Human
gguuuuucugugucaaugugau

SEQ ID NO: 29931 - RNA, 26 nt, Human
accaccccacguagcugcucacacca

SEQ ID NO: 29932 - RNA, 19 nt, Human
gcugccuccagccuggugg

SEQ ID NO: 29933 - RNA, 23 nt, Human
aguauuuuugaaaaaguuucuuc

SEQ ID NO: 29934 - RNA, 20 nt, Human
gauggcaucuguucucucca

SEQ ID NO: 29935 - RNA, 20 nt, Human
cccugcucauuccucacgcc

SEQ ID NO: 29936 - RNA, 23 nt, Human
gcaucacagucacaugcccauuc

SEQ ID NO: 29937 - RNA, 30 nt, Human
cugggagcagaggugaggccagaaaguugu

SEQ ID NO: 29938 - RNA, 28 nt, Human
cuuuguuuuuggacaaaagagucuaaca

SEQ ID NO: 29939 - RNA, 22 nt, Human
acugcccugcaggagugggugg

SEQ ID NO: 29940 - RNA, 19 nt, Human
uggauucauggcuguuuau

SEQ ID NO: 29941 - RNA, 21 nt, Human
acagagcauugaaucuguacc

SEQ ID NO: 29942 - RNA, 21 nt, Human
cugugccgaccaacccccagg

SEQ ID NO: 29943 - RNA, 24 nt, Human
ggacuccugagaauuccuguuaca

SEQ ID NO: 29944 - RNA, 21 nt, Human
gggaggcagagguugcaguga

SEQ ID NO: 29945 - RNA, 21 nt, Human
uuagauugaugugcacugcau

SEQ ID NO: 29946 - RNA, 22 nt, Human
ggauacuuggauuuaguuucag

SEQ ID NO: 29947 - RNA, 27 nt, Human
aaaugucccuccucagaaacaggcucc

SEQ ID NO: 29948 - RNA, 21 nt, Human
ugaucauauccaggauuuuua

SEQ ID NO: 29949 - RNA, 22 nt, Human
cgggagguggcaguugcaggga

SEQ ID NO: 29950 - RNA, 24 nt, Human
acauuuuucuuuaaaaagcaaaac

SEQ ID NO: 29951 - RNA, 23 nt, Human
gcugcaucuugagcagugaccug

SEQ ID NO: 29952 - RNA, 26 nt, Human
cucugccucccagguucaagcacuuc

SEQ ID NO: 29953 - RNA, 20 nt, Human
gcucuauacucucuggcucc

SEQ ID NO: 29954 - RNA, 21 nt, Human
uggcuuggaaaagcaggcuag

SEQ ID NO: 29955 - RNA, 25 nt, Human
ggagaaguugagcuuccauuuugag

SEQ ID NO: 29956 - RNA, 24 nt, Human
ucucccaugagauuuugucuuucu

SEQ ID NO: 29957 - RNA, 24 nt, Human
gugacaucuuuggucauuucccuc

SEQ ID NO: 29958 - RNA, 23 nt, Human
ugucgccaggcuggaguguagug

SEQ ID NO: 29959 - RNA, 20 nt, Human
gaucauuguuagauauuuca

SEQ ID NO: 29960 - RNA, 22 nt, Human
cacccacauacauuucugccag

SEQ ID NO: 29961 - RNA, 28 nt, Human
ggggcagggagaggagugacugagcuuc

SEQ ID NO: 29962 - RNA, 22 nt, Human
cccaucccacacaaacccaauu

SEQ ID NO: 29963 - RNA, 20 nt, Human
ugugggguggaccugggaca

SEQ ID NO: 29964 - RNA, 27 nt, Human
ggguggaucacuugaguucaggaguuc

SEQ ID NO: 29965 - RNA, 27 nt, Human
cucuaucuaugucguggcuaauauugg

SEQ ID NO: 29966 - RNA, 21 nt, Human
aggccugaggcaaggaucgcg

SEQ ID NO: 29967 - RNA, 21 nt, Human
ggcuuuuugccgcucuaccuc

SEQ ID NO: 29968 - RNA, 19 nt, Human
cucuccccuaaucacacac

SEQ ID NO: 29969 - RNA, 23 nt, Human
guggcgagcccagcugcccagcc

SEQ ID NO: 29970 - RNA, 25 nt, Human
aggccacagcagccgcaguccugaa

SEQ ID NO: 29971 - RNA, 22 nt, Human
gaggacacagagguagcagaau

SEQ ID NO: 29972 - RNA, 22 nt, Human
gcugaugcuucugagaaagucu

SEQ ID NO: 29973 - RNA, 26 nt, Human
gguacugccugcuguuuucuaagcau

SEQ ID NO: 29974 - RNA, 22 nt, Human
uaugugccaggcacuguguagg

SEQ ID NO: 29975 - RNA, 20 nt, Human
agucagugucugccccugag

SEQ ID NO: 29976 - RNA, 21 nt, Human
cuuguucuuucuuucucuuca

SEQ ID NO: 29977 - RNA, 21 nt, Human
uggauggagggcaggagcucc

SEQ ID NO: 29978 - RNA, 21 nt, Human
ucuggcacccaggcaugaagc

SEQ ID NO: 29979 - RNA, 23 nt, Human
ggauuucaugucuuccuccagca

SEQ ID NO: 29980 - RNA, 24 nt, Human
uggaaggcagugggggaguuggga

SEQ ID NO: 29981 - RNA, 18 nt, Human
gagcaccuagcuacuuca

SEQ ID NO: 29982 - RNA, 26 nt, Human
ucugacccuucuacauuugagggccc

SEQ ID NO: 29983 - RNA, 21 nt, Human
ccagagcagggagccuggggg

SEQ ID NO: 29984 - RNA, 21 nt, Human
agcagcugaguuucccaggga

SEQ ID NO: 29985 - RNA, 32 nt, Human
gcacugcuuuuucauuguuugcacugcuguca

SEQ ID NO: 29986 - RNA, 21 nt, Human
acauauucuuaaugacauuuc

SEQ ID NO: 29987 - RNA, 22 nt, Human
acucacacuuguaaucccagca

SEQ ID NO: 29988 - RNA, 20 nt, Human
uccaucugguuuucucucca

SEQ ID NO: 29989 - RNA, 26 nt, Human
uccaucuguccaucccaacagcaaga

SEQ ID NO: 29990 - RNA, 23 nt, Human
cagauaaugcuacuuuauuuaua

SEQ ID NO: 29991 - RNA, 27 nt, Human
aggugccuccugacacaccugcagccu

SEQ ID NO: 29992 - RNA, 23 nt, Human
acuguuccuccacuccauuuagc

SEQ ID NO: 29993 - RNA, 23 nt, Human
gggugagguaagagacagccucc

SEQ ID NO: 29994 - RNA, 23 nt, Human
uguggguggacgugguuggugau

SEQ ID NO: 29995 - RNA, 25 nt, Human
cgcccagcggcccugcgucuuccca

SEQ ID NO: 29996 - RNA, 20 nt, Human
cucuccaaagggucgggagg

SEQ ID NO: 29997 - RNA, 22 nt, Human
cugaagccugggccaggcucuc

SEQ ID NO: 29998 - RNA, 23 nt, Human
agaaccucuucuuccuucuuggc

SEQ ID NO: 29999 - RNA, 26 nt, Human
auuucuagagaaagaaaguauuuuag

SEQ ID NO: 30000 - RNA, 23 nt, Human
gcuaagcugauagauuuaaauac

SEQ ID NO: 30001 - RNA, 23 nt, Human
cuccugagaaaaaggaaagauga

SEQ ID NO: 30002 - RNA, 26 nt, Human
cuuguccuggcccuucagucugcucc

SEQ ID NO: 30003 - RNA, 26 nt, Human
gccaucaaaaugaggccugugaaaua

SEQ ID NO: 30004 - RNA, 21 nt, Human
guccacccucccccaggggcc

SEQ ID NO: 30005 - RNA, 23 nt, Human
gaggggaaggaauggaccuguga

SEQ ID NO: 30006 - RNA, 27 nt, Human
ucacugacacuccagacuaaagcagag

SEQ ID NO: 30007 - RNA, 27 nt, Human
uucgggaggcugagacaggagaaucgc

SEQ ID NO: 30008 - RNA, 22 nt, Human
accagggccagccucugucuca

SEQ ID NO: 30009 - RNA, 22 nt, Human
aaaugaacaucuauaaaaugua

SEQ ID NO: 30010 - RNA, 24 nt, Human
ggagcugcaaacugcagagcccag

SEQ ID NO: 30011 - RNA, 22 nt, Human
ugccuguauugccugcaugcug

SEQ ID NO: 30012 - RNA, 23 nt, Human
ggaagggauuaaagaggguggga

SEQ ID NO: 30013 - RNA, 20 nt, Human
ccacagcuggugcucagcug

SEQ ID NO: 30014 - RNA, 22 nt, Human
aauucagagguaacagcgccug

SEQ ID NO: 30015 - RNA, 23 nt, Human
agaaacauggcaucuuucacugc

SEQ ID NO: 30016 - RNA, 20 nt, Human
uuccaagcuggcuuuuccca

SEQ ID NO: 30017 - RNA, 26 nt, Human
uuauuuaucaaaauguagccuuuggg

SEQ ID NO: 30018 - RNA, 22 nt, Human
cccucugcucaggccucccuag

SEQ ID NO: 30019 - RNA, 26 nt, Human
gccuucaucagaacucuuccuccucc

SEQ ID NO: 30020 - RNA, 22 nt, Human
aggcacccgccacagugccugg

SEQ ID NO: 30021 - RNA, 25 nt, Human
ggaagacaagagaguagccucucca

SEQ ID NO: 30022 - RNA, 22 nt, Human
ccuucauucucuuacauuugug

SEQ ID NO: 30023 - RNA, 25 nt, Human
aggucagagggucugggcagaggag

SEQ ID NO: 30024 - RNA, 27 nt, Human
ugccucccaauccuaguagcugggagu

SEQ ID NO: 30025 - RNA, 24 nt, Human
aggcgggcggaucacuugagguca

SEQ ID NO: 30026 - RNA, 21 nt, Human
uaucuggaggggagagaagga

SEQ ID NO: 30027 - RNA, 22 nt, Human
uucgccuguaaucccaacacuu

SEQ ID NO: 30028 - RNA, 23 nt, Human
gcugaucugagucugccugcagc

SEQ ID NO: 30029 - RNA, 22 nt, Human
aggccaaggcaggagaauugcu

SEQ ID NO: 30030 - RNA, 26 nt, Human
ugccucuuugcuaacagcaacaucug

SEQ ID NO: 30031 - RNA, 24 nt, Human
cacuucaccuccauccucugucuc

SEQ ID NO: 30032 - RNA, 25 nt, Human
auucuuguucuuugcaccucucucu

SEQ ID NO: 30033 - RNA, 27 nt, Human
ccauuuuuaaaguagaagaggguuuua

SEQ ID NO: 30034 - RNA, 22 nt, Human
agccucccaaguagcuuggacu

SEQ ID NO: 30035 - RNA, 14 nt, Human
cugccccagacaca

SEQ ID NO: 30036 - RNA, 20 nt, Human
cacagcugagcaccgugccg

SEQ ID NO: 30037 - RNA, 20 nt, Human
gggcugagaacccugcguga

SEQ ID NO: 30038 - RNA, 22 nt, Human
ugggaggucgaggcugcaguga

SEQ ID NO: 30039 - RNA, 22 nt, Human
uaggaggucaaggcugcaguga

SEQ ID NO: 30040 - RNA, 21 nt, Human
cuuugccacagaaaauggagg

SEQ ID NO: 30041 - RNA, 26 nt, Human
aggccucugcuggagagacaccagcu

SEQ ID NO: 30042 - RNA, 27 nt, Human
cgccacugcacuccggccugaugacag

SEQ ID NO: 30043 - RNA, 23 nt, Human
cuucugcugaaggacagaacauu

SEQ ID NO: 30044 - RNA, 21 nt, Human
uccagccugggcaacacagcg

SEQ ID NO: 30045 - RNA, 27 nt, Human
ucuucccucagcuuuguacaucagcac

SEQ ID NO: 30046 - RNA, 28 nt, Human
agccucacugcgccagccuccccgcccg

SEQ ID NO: 30047 - RNA, 24 nt, Human
cuggcccagggccagagcccagcu

SEQ ID NO: 30048 - RNA, 24 nt, Human
ucccccaugugccugucacgcucu

SEQ ID NO: 30049 - RNA, 23 nt, Human
uuccgugucuucaguucugucca

SEQ ID NO: 30050 - RNA, 19 nt, Human
acugcuuacacugcacucu

SEQ ID NO: 30051 - RNA, 27 nt, Human
agcuagcaguuuguccagccucuaaca

SEQ ID NO: 30052 - RNA, 25 nt, Human
ccaagcagcuggccaacauguguag

SEQ ID NO: 30053 - RNA, 22 nt, Human
ccagaaagugaaaaaugcagcg

SEQ ID NO: 30054 - RNA, 24 nt, Human
uucuuaccuuuuccagugcugcug

SEQ ID NO: 30055 - RNA, 23 nt, Human
cggagagggggugggggagccag

SEQ ID NO: 30056 - RNA, 18 nt, Human
ccagcccagaaggaaagg

SEQ ID NO: 30057 - RNA, 27 nt, Human
uucuccuccuccccucagccuuguggc

SEQ ID NO: 30058 - RNA, 30 nt, Human
cugagugagcugaagagugaggauaugagu

SEQ ID NO: 30059 - RNA, 20 nt, Human
caccugcacuccauccagcu

SEQ ID NO: 30060 - RNA, 27 nt, Human
cauucccacgucuucuugcugcagccu

SEQ ID NO: 30061 - RNA, 23 nt, Human
ucucuucuaaaagagaagugggu

SEQ ID NO: 30062 - RNA, 21 nt, Human
cuagaagcagccggcacagga

SEQ ID NO: 30063 - RNA, 27 nt, Human
cacugcacccggcccuugccucauguu

SEQ ID NO: 30064 - RNA, 24 nt, Human
aacuucaggcagaacauccauuca

SEQ ID NO: 30065 - RNA, 25 nt, Human
aggagagaauaaaauuaccugugca

SEQ ID NO: 30066 - RNA, 20 nt, Human
ucacccagggacuccaguuc

SEQ ID NO: 30067 - RNA, 26 nt, Human
ccagccugggcaacauagcaaaaucc

SEQ ID NO: 30068 - RNA, 21 nt, Human
cuccccucagcccaucuugcu

SEQ ID NO: 30069 - RNA, 23 nt, Human
ccuccacccccuccaacucugcu

SEQ ID NO: 30070 - RNA, 26 nt, Human
cuccucugcucuccaucauaacugcu

SEQ ID NO: 30071 - RNA, 22 nt, Human
ggucaugugcaugaaaugagga

SEQ ID NO: 30072 - RNA, 27 nt, Human
caguguaccaacgaauucaccaaccag

SEQ ID NO: 30073 - RNA, 23 nt, Human
gccucccaguuuccccuccugcc

SEQ ID NO: 30074 - RNA, 21 nt, Human
ugagcuuccugccugccugua

SEQ ID NO: 30075 - RNA, 26 nt, Human
uacauuugcccuuucucuuccuucua

SEQ ID NO: 30076 - RNA, 26 nt, Human
ccucaucugcuggcauuuuguggggu

SEQ ID NO: 30077 - RNA, 27 nt, Human
gggccugaggagagggagcugugggcc

SEQ ID NO: 30078 - RNA, 21 nt, Human
gucuuuuucugaucuuccuca

SEQ ID NO: 30079 - RNA, 29 nt, Human
ugcacuccaggcugggugacagagcgaga

SEQ ID NO: 30080 - RNA, 21 nt, Human
cuggucgggucaagagucggg

SEQ ID NO: 30081 - RNA, 22 nt, Human
gccuugugauggacccaggagg

SEQ ID NO: 30082 - RNA, 20 nt, Human
gcugaccuugaagcauuguu

SEQ ID NO: 30083 - RNA, 27 nt, Human
caccacaaggcuauuuuucccccugca

SEQ ID NO: 30084 - RNA, 23 nt, Human
gggacuuuuacucgcuucuuuug

SEQ ID NO: 30085 - RNA, 26 nt, Human
gagagugagggaaagggccuggccgg

SEQ ID NO: 30086 - RNA, 23 nt, Human
guagcagcuguguuugaguuucu

SEQ ID NO: 30087 - RNA, 22 nt, Human
gccuauaauccuagcacuuuga

SEQ ID NO: 30088 - RNA, 21 nt, Human
ccuguggccccacccugggcc

SEQ ID NO: 30089 - RNA, 22 nt, Human
ccugggagggaguuuagaaaga

SEQ ID NO: 30090 - RNA, 21 nt, Human
ggaugagucuuccugccugaa

SEQ ID NO: 30091 - RNA, 22 nt, Human
cccacugcagggagugaacugc

SEQ ID NO: 30092 - RNA, 29 nt, Human
accgcaccguggcuggaguccugagcagc

SEQ ID NO: 30093 - RNA, 21 nt, Human
ccaccaugacccucuuccuca

SEQ ID NO: 30094 - RNA, 19 nt, Human
gccuucguccuccuggccc

SEQ ID NO: 30095 - RNA, 21 nt, Human
aaccucucugaucuugugcuc

SEQ ID NO: 30096 - RNA, 25 nt, Human
uggguauuuaaacaauaaaugugca

SEQ ID NO: 30097 - RNA, 22 nt, Human
ugauucaaagccaauacucuua

SEQ ID NO: 30098 - RNA, 22 nt, Human
gaccagcccagccaacauggcg

SEQ ID NO: 30099 - RNA, 23 nt, Human
aaagcuguauuguuugguacaua

SEQ ID NO: 30100 - RNA, 27 nt, Human
acaggcagucucacaagcacgcagcac

SEQ ID NO: 30101 - RNA, 28 nt, Human
guuuuuggagagaaauucaggagcaccu

SEQ ID NO: 30102 - RNA, 17 nt, Human
ccucauuccugggacua

SEQ ID NO: 30103 - RNA, 27 nt, Human
cacaggcucucacaagaucagaacccc

SEQ ID NO: 30104 - RNA, 21 nt, Human
aauucagaagaaagugucucu

SEQ ID NO: 30105 - RNA, 22 nt, Human
gggaggcggagcuugcagugag

SEQ ID NO: 30106 - RNA, 22 nt, Human
gggcggcggagauugcagugag

SEQ ID NO: 30107 - RNA, 23 nt, Human
uaucccuguggagucaaggauuc

SEQ ID NO: 30108 - RNA, 24 nt, Human
cagccaucaugacaaauccuugaa

SEQ ID NO: 30109 - RNA, 19 nt, Human
ccuccacccaccugcccca

SEQ ID NO: 30110 - RNA, 26 nt, Human
ggagagggcgccggagaggaggcggc

SEQ ID NO: 30111 - RNA, 24 nt, Human
ccccucacuggguucggaggagag

SEQ ID NO: 30112 - RNA, 17 nt, Human
cugccagggccugucuc

SEQ ID NO: 30113 - RNA, 22 nt, Human
uuuuguuguuguuguuguugcu

SEQ ID NO: 30114 - RNA, 28 nt, Human
gcauuuguaaauaaacuugcugaugcau

SEQ ID NO: 30115 - RNA, 22 nt, Human
uacucaguaagacagugcagug

SEQ ID NO: 30116 - RNA, 21 nt, Human
gcaaggcauggagccugcacu

SEQ ID NO: 30117 - RNA, 24 nt, Human
acuggguggagcuguggcaggggg

SEQ ID NO: 30118 - RNA, 22 nt, Human
uggcucacguauguaaucccag

SEQ ID NO: 30119 - RNA, 27 nt, Human
caagcgccggcccugcccgcagcggca

SEQ ID NO: 30120 - RNA, 19 nt, Human
aaccuauagguuauuuugu

SEQ ID NO: 30121 - RNA, 22 nt, Human
aaacucccauaucauauaaaau

SEQ ID NO: 30122 - RNA, 21 nt, Human
ucgcacacacccccugccuua

SEQ ID NO: 30123 - RNA, 26 nt, Human
agaugcugggguugcagccacgagca

SEQ ID NO: 30124 - RNA, 22 nt, Human
ugcauuuggcuggagcccggug

SEQ ID NO: 30125 - RNA, 22 nt, Human
cacuguacccagucucaaaggc

SEQ ID NO: 30126 - RNA, 19 nt, Human
uccaagaaacugaaugaau

SEQ ID NO: 30127 - RNA, 26 nt, Human
gggacccccucaccauccagugggcc

SEQ ID NO: 30128 - RNA, 22 nt, Human
gugcuggcuggucacugccaga

SEQ ID NO: 30129 - RNA, 21 nt, Human
ccaacgcagcagccauccugc

SEQ ID NO: 30130 - RNA, 20 nt, Human
cuggcagcaaggcuugaggc

SEQ ID NO: 30131 - RNA, 20 nt, Human
cuguggguagaggaaagagu

SEQ ID NO: 30132 - RNA, 20 nt, Human
cgcucagccuggagugcagu

SEQ ID NO: 30133 - RNA, 27 nt, Human
ggaggauugaggaggaucagaucaaua

SEQ ID NO: 30134 - RNA, 23 nt, Human
guugcccaggcuggagcgcagug

SEQ ID NO: 30135 - RNA, 27 nt, Human
cacugcacuucagcuugggcaacagag

SEQ ID NO: 30136 - RNA, 26 nt, Human
agucuuagggacuugaaaauguauca

SEQ ID NO: 30137 - RNA, 27 nt, Human
uaggcagcacuagcgacauugcagucu

SEQ ID NO: 30138 - RNA, 22 nt, Human
ucaugaucuacauagauuugga

SEQ ID NO: 30139 - RNA, 18 nt, Human
gaugacacaagacacucc

SEQ ID NO: 30140 - RNA, 22 nt, Human
uugcugcaggaggaaaguuuaa

SEQ ID NO: 30141 - RNA, 19 nt, Human
agaggcgagaaucgcagga

SEQ ID NO: 30142 - RNA, 24 nt, Human
ggcaggggcuuccuggugcuggag

SEQ ID NO: 30143 - RNA, 24 nt, Human
aaggccuugcucacucacucacuc

SEQ ID NO: 30144 - RNA, 25 nt, Human
aguguugaggggguuguaccugcca

SEQ ID NO: 30145 - RNA, 20 nt, Human
acugcugcucccugccccuc

SEQ ID NO: 30146 - RNA, 24 nt, Human
ggucugggugcccggaggcagcag

SEQ ID NO: 30147 - RNA, 25 nt, Human
ggaagaggaaugggagccacgcgcg

SEQ ID NO: 30148 - RNA, 20 nt, Human
uugaugguuugcugcauuaa

SEQ ID NO: 30149 - RNA, 24 nt, Human
ugagcuucccagagucccauuucc

SEQ ID NO: 30150 - RNA, 19 nt, Human
cuucccucugggccuguuc

SEQ ID NO: 30151 - RNA, 26 nt, Human
uucagcgauuuccaguccacugugag

SEQ ID NO: 30152 - RNA, 26 nt, Human
ggagggugggcagggauacucaggga

SEQ ID NO: 30153 - RNA, 27 nt, Human
uagucauugugucuuggcuggaaugaa

SEQ ID NO: 30154 - RNA, 20 nt, Human
augacugcacaguagagcaa

SEQ ID NO: 30155 - RNA, 25 nt, Human
cagaaguaggcauggaaaagacuuc

SEQ ID NO: 30156 - RNA, 24 nt, Human
uaagugugugugggugugagagca

SEQ ID NO: 30157 - RNA, 25 nt, Human
auagcagccucacacuggcgucugg

SEQ ID NO: 30158 - RNA, 27 nt, Human
cccugggcaccucccugcagucaucuc

SEQ ID NO: 30159 - RNA, 19 nt, Human
uuugcuugcuuugaaguag

SEQ ID NO: 30160 - RNA, 21 nt, Human
ccacuucuuuucaucuguacc

SEQ ID NO: 30161 - RNA, 20 nt, Human
gaaggaggagcaagagccag

SEQ ID NO: 30162 - RNA, 27 nt, Human
auacucuuguuuuugauaaagcauuuu

SEQ ID NO: 30163 - RNA, 23 nt, Human
ucaagacgaaaaccugcaaugac

SEQ ID NO: 30164 - RNA, 15 nt, Human
gucaaaccacuguua

SEQ ID NO: 30165 - RNA, 26 nt, Human
ucuuguaaucauguuaccauuacaaa

SEQ ID NO: 30166 - RNA, 27 nt, Human
ggagagggagacaaugaccuggagggu

SEQ ID NO: 30167 - RNA, 19 nt, Human
cacuguccagccuggaggg

SEQ ID NO: 30168 - RNA, 22 nt, Human
gguuauguaauaaaauauuuua

SEQ ID NO: 30169 - RNA, 24 nt, Human
gggugcuuccgagagugugcaggu

SEQ ID NO: 30170 - RNA, 20 nt, Human
caggagggaaaggcagaaug

SEQ ID NO: 30171 - RNA, 27 nt, Human
ggagagggauacaagagaggagauggg

SEQ ID NO: 30172 - RNA, 22 nt, Human
ccgaguagcugggaccacaggg

SEQ ID NO: 30173 - RNA, 22 nt, Human
cccaggaguucgaggugcaguu

SEQ ID NO: 30174 - RNA, 24 nt, Human
cuguucccagacacacuuauucug

SEQ ID NO: 30175 - RNA, 27 nt, Human
uaaaugaugugaucuguacaaguaugu

SEQ ID NO: 30176 - RNA, 23 nt, Human
ccccagucccuuucucuggcccu

SEQ ID NO: 30177 - RNA, 25 nt, Human
ucaagagccauuuaauaaauauggc

SEQ ID NO: 30178 - RNA, 22 nt, Human
agggaggcgcuccugggaccgu

SEQ ID NO: 30179 - RNA, 25 nt, Human
ugaggccugcagcugacagcuuuga

SEQ ID NO: 30180 - RNA, 26 nt, Human
uaacuugccauuucuuuauauggaac

SEQ ID NO: 30181 - RNA, 20 nt, Human
ccugucucuuccugccugug

SEQ ID NO: 30182 - RNA, 19 nt, Human
cuccgccucuccaccagcc

SEQ ID NO: 30183 - RNA, 27 nt, Human
ccugggcaacagagcgagacuccaucu

SEQ ID NO: 30184 - RNA, 23 nt, Human
cuccugcucucucuccuccagcg

SEQ ID NO: 30185 - RNA, 18 nt, Human
ucuccagcccucccagcc

SEQ ID NO: 30186 - RNA, 21 nt, Human
gcaaauggcccuggcuucauu

SEQ ID NO: 30187 - RNA, 21 nt, Human
uuucugagccucuuguuuuuc

SEQ ID NO: 30188 - RNA, 23 nt, Human
ccgucccucguuccauggcccag

SEQ ID NO: 30189 - RNA, 22 nt, Human
auggggcagaguuucuguguau

SEQ ID NO: 30190 - RNA, 19 nt, Human
uucuaauucucucuuuugg

SEQ ID NO: 30191 - RNA, 22 nt, Human
ggcucacugcaaccucuuccuc

SEQ ID NO: 30192 - RNA, 23 nt, Human
uucugggcuaucuuagcuaacuu

SEQ ID NO: 30193 - RNA, 21 nt, Human
acacaccaugcccacauacaa

SEQ ID NO: 30194 - RNA, 23 nt, Human
gcacagguucccuggcacuggua

SEQ ID NO: 30195 - RNA, 23 nt, Human
caugccuguaaugccagcuacuc

SEQ ID NO: 30196 - RNA, 21 nt, Human
aacuccuggacucaagcaauc

SEQ ID NO: 30197 - RNA, 23 nt, Human
aacagugucccugcugucuugcu

SEQ ID NO: 30198 - RNA, 23 nt, Human
ugccuugguucuuccuagugccu

SEQ ID NO: 30199 - RNA, 23 nt, Human
gggccuagacucuguaacaucac

SEQ ID NO: 30200 - RNA, 23 nt, Human
uuguaaccuuuauuucaugaagg

SEQ ID NO: 30201 - RNA, 20 nt, Human
gcugagcucuguucucucca

SEQ ID NO: 30202 - RNA, 20 nt, Human
guuauagggaguuguuuucu

SEQ ID NO: 30203 - RNA, 20 nt, Human
ucccuugccccaggccaggu

SEQ ID NO: 30204 - RNA, 32 nt, Human
ggcagagaacguucagcaccuuuguuccuccc

SEQ ID NO: 30205 - RNA, 20 nt, Human
acccuagugugaaaucgggg

SEQ ID NO: 30206 - RNA, 24 nt, Human
cugagcuugguucaucugcuuucu

SEQ ID NO: 30207 - RNA, 24 nt, Human
cagcucuucugaguggggagucuu

SEQ ID NO: 30208 - RNA, 22 nt, Human
cccugcacuccagccugggcuu

SEQ ID NO: 30209 - RNA, 20 nt, Human
gcugagcccccuccuuggcu

SEQ ID NO: 30210 - RNA, 27 nt, Human
caaagucacuuccucgucuccuccucc

SEQ ID NO: 30211 - RNA, 24 nt, Human
cucuaauucuguaauauaucaagg

SEQ ID NO: 30212 - RNA, 20 nt, Human
cuuauuacccugacaaauag

SEQ ID NO: 30213 - RNA, 21 nt, Human
gucuucagucuccugacuuag

SEQ ID NO: 30214 - RNA, 24 nt, Human
aaccugacggaaucagaagcuaca

SEQ ID NO: 30215 - RNA, 25 nt, Human
agcuaggacagagcaccugaccuca

SEQ ID NO: 30216 - RNA, 26 nt, Human
aaaggcucagccuggccagggccaga

SEQ ID NO: 30217 - RNA, 21 nt, Human
uucacacaggaauuugguuua

SEQ ID NO: 30218 - RNA, 21 nt, Human
ugcugcuucccagccuggcuu

SEQ ID NO: 30219 - RNA, 20 nt, Human
guuacauuuaccaagagagc

SEQ ID NO: 30220 - RNA, 25 nt, Human
cgggacccagucaaaccccauucag

SEQ ID NO: 30221 - RNA, 22 nt, Human
ucauuuguaacaggucacuucc

SEQ ID NO: 30222 - RNA, 27 nt, Human
ugaccaacauggagauauccugucucu

SEQ ID NO: 30223 - RNA, 21 nt, Human
gaguccuggcaugggaaugaa

SEQ ID NO: 30224 - RNA, 23 nt, Human
accagucuuuuuguauuuauugu

SEQ ID NO: 30225 - RNA, 23 nt, Human
ggggugggggagcaggagaaagc

SEQ ID NO: 30226 - RNA, 19 nt, Human
cuggggacuuucucaucgg

SEQ ID NO: 30227 - RNA, 22 nt, Human
ugaaaccaguauuuaagcuuua

SEQ ID NO: 30228 - RNA, 24 nt, Human
ccuuguacagcaaucuccuccucc

SEQ ID NO: 30229 - RNA, 22 nt, Human
cuccuauuuauucucauacuuu

SEQ ID NO: 30230 - RNA, 18 nt, Human
ccuuucucugucauccca

SEQ ID NO: 30231 - RNA, 21 nt, Human
ccugccccacacuccccgccu

SEQ ID NO: 30232 - RNA, 19 nt, Human
uucuccuuagcuucuggcu

SEQ ID NO: 30233 - RNA, 18 nt, Human
guccccucagcggaggcc

SEQ ID NO: 30234 - RNA, 21 nt, Human
ccuccacucuuacagaacuug

SEQ ID NO: 30235 - RNA, 26 nt, Human
gcuaucucgccauucccuuuaaauac

SEQ ID NO: 30236 - RNA, 27 nt, Human
aacacccuugguggcuuaugggucccc

SEQ ID NO: 30237 - RNA, 20 nt, Human
aggcugcuggagugcagugg

SEQ ID NO: 30238 - RNA, 22 nt, Human
guggcgcuguguucacuuucca

SEQ ID NO: 30239 - RNA, 18 nt, Human
cacacuccagugucaacc

SEQ ID NO: 30240 - RNA, 22 nt, Human
cacugcacccuagcuugggugg

SEQ ID NO: 30241 - RNA, 25 nt, Human
aggaggagaaagggugucugcugcc

SEQ ID NO: 30242 - RNA, 22 nt, Human
cagacucuucucuccuggucuc

SEQ ID NO: 30243 - RNA, 23 nt, Human
auuccugaaauucuuuuauguga

SEQ ID NO: 30244 - RNA, 27 nt, Human
uuugcuuagaagaaagugaguuccuug

SEQ ID NO: 30245 - RNA, 22 nt, Human
ggagagaagauccugucccucc

SEQ ID NO: 30246 - RNA, 24 nt, Human
cccccagcccucaggccagugcca

SEQ ID NO: 30247 - RNA, 19 nt, Human
cuggggcaauaacguuuaa

SEQ ID NO: 30248 - RNA, 20 nt, Human
cccaacaaaacccauaccua

SEQ ID NO: 30249 - RNA, 20 nt, Human
auucacaaccuccauuuuca

SEQ ID NO: 30250 - RNA, 23 nt, Human
cagcuugauccuggaggucuuuu

SEQ ID NO: 30251 - RNA, 27 nt, Human
augugguucggaugugaaauaaccagu

SEQ ID NO: 30252 - RNA, 25 nt, Human
auguaccaggaugguuucugcuuag

SEQ ID NO: 30253 - RNA, 22 nt, Human
aaaggugacccugaucccaaac

SEQ ID NO: 30254 - RNA, 26 nt, Human
ugcagugagugcugcucauguccucc

SEQ ID NO: 30255 - RNA, 20 nt, Human
uggaaucuuauggcaaccaa

SEQ ID NO: 30256 - RNA, 22 nt, Human
ccgggagauggcgcuugcagug

SEQ ID NO: 30257 - RNA, 22 nt, Human
ccaggggcucugcgacacaagg

SEQ ID NO: 30258 - RNA, 22 nt, Human
gauuaaacuagguuugguuccu

SEQ ID NO: 30259 - RNA, 22 nt, Human
uaugcccacgcuggagugcagu

SEQ ID NO: 30260 - RNA, 22 nt, Human
uuguccaggcuggagugcaaua

SEQ ID NO: 30261 - RNA, 25 nt, Human
aaaagagaaguuucuuuucugguuu

SEQ ID NO: 30262 - RNA, 28 nt, Human
aguuucugagucggcacccuggugugac

SEQ ID NO: 30263 - RNA, 23 nt, Human
agaaguuagaggggggcgggcga

SEQ ID NO: 30264 - RNA, 21 nt, Human
cuuggacauuuagugacuguu

SEQ ID NO: 30265 - RNA, 23 nt, Human
aucagcaucuggccaacauagug

SEQ ID NO: 30266 - RNA, 25 nt, Human
uuagagcuuccgagaauagcuccac

SEQ ID NO: 30267 - RNA, 26 nt, Human
ucucaacaaagcuaagaggugcuuga

SEQ ID NO: 30268 - RNA, 22 nt, Human
gaugaaauaaggagaaacccca

SEQ ID NO: 30269 - RNA, 21 nt, Human
ugcaccacugcauagcacaga

SEQ ID NO: 30270 - RNA, 21 nt, Human
uuugaagcuguauacugugug

SEQ ID NO: 30271 - RNA, 19 nt, Human
gcugcaaaagcaaaaagaa

SEQ ID NO: 30272 - RNA, 24 nt, Human
aaauguucaguuuaauuagcuuug

SEQ ID NO: 30273 - RNA, 27 nt, Human
gcacagcuguguguggaagccacgggc

SEQ ID NO: 30274 - RNA, 20 nt, Human
ccagaucuacucccuguagg

SEQ ID NO: 30275 - RNA, 24 nt, Human
ugcuucuggaagggccaaugcguu

SEQ ID NO: 30276 - RNA, 22 nt, Human
cugcagccuugaacuccugggc

SEQ ID NO: 30277 - RNA, 20 nt, Human
uucggucuuugaaacugaca

SEQ ID NO: 30278 - RNA, 25 nt, Human
gcuacacugaccucuugcggucuug

SEQ ID NO: 30279 - RNA, 25 nt, Human
gcuuaauuauagcacuuuauuuuua

SEQ ID NO: 30280 - RNA, 19 nt, Human
agagguuucagcauuccca

SEQ ID NO: 30281 - RNA, 21 nt, Human
gccagaccucaggucuucacu

SEQ ID NO: 30282 - RNA, 20 nt, Human
guccaggcucggagcgcggc

SEQ ID NO: 30283 - RNA, 19 nt, Human
cccagccugccaagcagcg

SEQ ID NO: 30284 - RNA, 22 nt, Human
ucuuuguagacuguuccuguuu

SEQ ID NO: 30285 - RNA, 27 nt, Human
cuggcuauuuuugugucauuuauucaa

SEQ ID NO: 30286 - RNA, 27 nt, Human
ugcacacacacucacaugcucucacuc

SEQ ID NO: 30287 - RNA, 27 nt, Human
cuuacuuccuguuccuccucauucugc

SEQ ID NO: 30288 - RNA, 24 nt, Human
gcuguaaccucugucuuggcaggg

SEQ ID NO: 30289 - RNA, 20 nt, Human
cccaaggagcagcagcggag

SEQ ID NO: 30290 - RNA, 21 nt, Human
agaauggaguccucaugaccu

SEQ ID NO: 30291 - RNA, 26 nt, Human
agaauguccccaccaauccccgccac

SEQ ID NO: 30292 - RNA, 26 nt, Human
ccugguguauuuucgauauuucagga

SEQ ID NO: 30293 - RNA, 25 nt, Human
auggauauaagagaaaaaugccuuu

SEQ ID NO: 30294 - RNA, 21 nt, Human
ucuguuggcaaaaauaucuuu

SEQ ID NO: 30295 - RNA, 20 nt, Human
uaucugugcgugaaacacac

SEQ ID NO: 30296 - RNA, 23 nt, Human
ugagaucaggcgccaucuguaaa

SEQ ID NO: 30297 - RNA, 22 nt, Human
cugcaaccuccaacucccuggu

SEQ ID NO: 30298 - RNA, 21 nt, Human
gaacuguugcccagcaccuua

SEQ ID NO: 30299 - RNA, 23 nt, Human
ggagguggguguggguggaaggg

SEQ ID NO: 30300 - RNA, 26 nt, Human
cugguuuguucccugugucauuucaa

SEQ ID NO: 30301 - RNA, 23 nt, Human
gccuaucugacuucauacauccc

SEQ ID NO: 30302 - RNA, 24 nt, Human
guccccaaaccaacugcagagaag

SEQ ID NO: 30303 - RNA, 25 nt, Human
cuuaauaaacaauuuaggacaguca

SEQ ID NO: 30304 - RNA, 17 nt, Human
cucagcccugcccuguc

SEQ ID NO: 30305 - RNA, 26 nt, Human
ccauuuuuucccagagaagaggagaa

SEQ ID NO: 30306 - RNA, 25 nt, Human
gacuaggguggugaagucacuugcc

SEQ ID NO: 30307 - RNA, 24 nt, Human
gcucuucugcugaccucagauacc

SEQ ID NO: 30308 - RNA, 23 nt, Human
gccuccaggagucgcuguguugg

SEQ ID NO: 30309 - RNA, 17 nt, Human
ccuaaauguucccuuga

SEQ ID NO: 30310 - RNA, 29 nt, Human
guggagucuauuguacacuguggaaaaau

SEQ ID NO: 30311 - RNA, 26 nt, Human
gugcaugucuuaguugcuguucccuc

SEQ ID NO: 30312 - RNA, 27 nt, Human
uugacuucucaacccagccugaagucc

SEQ ID NO: 30313 - RNA, 32 nt, Human
ucauggcuucaucucuaucuuuacuuucucuu

SEQ ID NO: 30314 - RNA, 25 nt, Human
aacaucugucaucuuccuugguuua

SEQ ID NO: 30315 - RNA, 24 nt, Human
cccuucccagcccccuccagggcc

SEQ ID NO: 30316 - RNA, 27 nt, Human
cugugugauucuggggaagucccggcc

SEQ ID NO: 30317 - RNA, 22 nt, Human
gccaaauuguugacacuucuuu

SEQ ID NO: 30318 - RNA, 22 nt, Human
auggggaaaucagaagcuuuga

SEQ ID NO: 30319 - RNA, 18 nt, Human
cgcacccagcaugcagcu

SEQ ID NO: 30320 - RNA, 27 nt, Human
ucugaacuauuugcuuucucuucaaga

SEQ ID NO: 30321 - RNA, 27 nt, Human
ggccugagcauccagaccugagcggga

SEQ ID NO: 30322 - RNA, 19 nt, Human
acagugaauugaaaccauu

SEQ ID NO: 30323 - RNA, 22 nt, Human
ggaccacuccaguguuagguaa

SEQ ID NO: 30324 - RNA, 23 nt, Human
gugugggaaaugcugaaagcacc

SEQ ID NO: 30325 - RNA, 22 nt, Human
aagaauacaacuugauacuuuu

SEQ ID NO: 30326 - RNA, 29 nt, Human
gcuccucucacaggcuggggacagaggug

SEQ ID NO: 30327 - RNA, 27 nt, Human
ggucucaaucuccugaccucauauucc

SEQ ID NO: 30328 - RNA, 18 nt, Human
gggagguggagggaggga

SEQ ID NO: 30329 - RNA, 23 nt, Human
caccaaccagacccuuggaaagg

SEQ ID NO: 30330 - RNA, 25 nt, Human
gccuaggcuggagugcaguggcgug

SEQ ID NO: 30331 - RNA, 22 nt, Human
ucauuuucauuaccagguuuca

SEQ ID NO: 30332 - RNA, 26 nt, Human
ccagccuuugggcagcaggucacccc

SEQ ID NO: 30333 - RNA, 25 nt, Human
cugagcugguuaaaaggaacacugg

SEQ ID NO: 30334 - RNA, 20 nt, Human
guggcccagggaagugcaca

SEQ ID NO: 30335 - RNA, 27 nt, Human
cuggguggguggggaugccuguuuaca

SEQ ID NO: 30336 - RNA, 23 nt, Human
agggggaggagagggaaccccag

SEQ ID NO: 30337 - RNA, 20 nt, Human
ccuggccucauuuaaaacaa

SEQ ID NO: 30338 - RNA, 20 nt, Human
aagagugaggaagaagcaga

SEQ ID NO: 30339 - RNA, 27 nt, Human
ggacuggagggggcggagccucccucg

SEQ ID NO: 30340 - RNA, 22 nt, Human
aggcacuaggacgucugccuuu

SEQ ID NO: 30341 - RNA, 22 nt, Human
acccaggcuggcagaucauggu

SEQ ID NO: 30342 - RNA, 29 nt, Human
aacggacuuaaccucauuucucuuucaga

SEQ ID NO: 30343 - RNA, 20 nt, Human
gcccccagcucagucaagcc

SEQ ID NO: 30344 - RNA, 27 nt, Human
auggcagaugcacaaauugugcaguga

SEQ ID NO: 30345 - RNA, 19 nt, Human
gggaaaacccgcucucuca

SEQ ID NO: 30346 - RNA, 27 nt, Human
aauugagacuuuuucuuugcuuguuug

SEQ ID NO: 30347 - RNA, 27 nt, Human
uggcucacaccuguaaucccaacauuu

SEQ ID NO: 30348 - RNA, 24 nt, Human
uuuuguugcucugcucuuuacauu

SEQ ID NO: 30349 - RNA, 23 nt, Human
cagcuuuuuaucuuucucucgac

SEQ ID NO: 30350 - RNA, 23 nt, Human
cuuuccccuccagcccccaauca

SEQ ID NO: 30351 - RNA, 21 nt, Human
auagagcuggucucacugugg

SEQ ID NO: 30352 - RNA, 21 nt, Human
ggcagcuucaguucuagagaa

SEQ ID NO: 30353 - RNA, 22 nt, Human
ugcucacugcaaccucugccuc

SEQ ID NO: 30354 - RNA, 26 nt, Human
aggcaguuccguuaaggguuuuuguu

SEQ ID NO: 30355 - RNA, 26 nt, Human
uugagacagagucucgcucugucgcc

SEQ ID NO: 30356 - RNA, 26 nt, Human
uugagacagagucucacucugucacc

SEQ ID NO: 30357 - RNA, 20 nt, Human
aucaaggccugagcaaccaa

SEQ ID NO: 30358 - RNA, 31 nt, Human
caccauuggaccccacccagccuggaucuac

SEQ ID NO: 30359 - RNA, 20 nt, Human
aggacuccuacacacucucu

SEQ ID NO: 30360 - RNA, 20 nt, Human
acuucugcagaccuaucaca

SEQ ID NO: 30361 - RNA, 24 nt, Human
cucagaggcagcugcuccaugcag

SEQ ID NO: 30362 - RNA, 24 nt, Human
cgcuacauuguguguauuuuuugu

SEQ ID NO: 30363 - RNA, 16 nt, Human
auagggguaacuggaa

SEQ ID NO: 30364 - RNA, 24 nt, Human
aagggggucacugggucucauaga

SEQ ID NO: 30365 - RNA, 25 nt, Human
agaagacaccaaguggauucugcuu

SEQ ID NO: 30366 - RNA, 27 nt, Human
gagucagcauggagagccccugcuaau

SEQ ID NO: 30367 - RNA, 27 nt, Human
cugcaggggccuggaggaaucacuggg

SEQ ID NO: 30368 - RNA, 23 nt, Human
gggcuguuugccuuucgugaaca

SEQ ID NO: 30369 - RNA, 25 nt, Human
acagauuccuguuguguaauaacag

SEQ ID NO: 30370 - RNA, 22 nt, Human
gcucacgccuguaauccuaaca

SEQ ID NO: 30371 - RNA, 26 nt, Human
aaaacuuuuguaaauuauugaugauu

SEQ ID NO: 30372 - RNA, 22 nt, Human
gcaguggggcccagcagcacag

SEQ ID NO: 30373 - RNA, 23 nt, Human
ucucagacuguacaugcauuaaa

SEQ ID NO: 30374 - RNA, 24 nt, Human
caggagccuggccuguaacuuaua

SEQ ID NO: 30375 - RNA, 27 nt, Human
ugaguugagcaagcaauuccuuuauuu

SEQ ID NO: 30376 - RNA, 18 nt, Human
ugucuggcaucaccaaga

SEQ ID NO: 30377 - RNA, 20 nt, Human
auuguucuaguaaaacugga

SEQ ID NO: 30378 - RNA, 22 nt, Human
uggcucaugccuauaaucccag

SEQ ID NO: 30379 - RNA, 30 nt, Human
ccaacgcacaacaggaaacugggaaucuca

SEQ ID NO: 30380 - RNA, 22 nt, Human
augcagcugcgcucuuagugcu

SEQ ID NO: 30381 - RNA, 22 nt, Human
gcgaucuuggcucacugcaacu

SEQ ID NO: 30382 - RNA, 22 nt, Human
uguguuccuccaaauuuucuag

SEQ ID NO: 30383 - RNA, 26 nt, Human
gguggaggucggggaugaggcagcag

SEQ ID NO: 30384 - RNA, 22 nt, Human
cugcugucugcccucucugguc

SEQ ID NO: 30385 - RNA, 28 nt, Human
cucucagagaccuuuccccacccccuuc

SEQ ID NO: 30386 - RNA, 26 nt, Human
cuacuuccugccuggucuccugcccc

SEQ ID NO: 30387 - RNA, 25 nt, Human
acugguacugcuguaaugagccaag

SEQ ID NO: 30388 - RNA, 20 nt, Human
aaucagaagaugaaugaaug

SEQ ID NO: 30389 - RNA, 22 nt, Human
agccuccacacguucagcucuc

SEQ ID NO: 30390 - RNA, 23 nt, Human
gucuucccaguugagacugcugg

SEQ ID NO: 30391 - RNA, 22 nt, Human
ucgcuugagccugggagguuga

SEQ ID NO: 30392 - RNA, 22 nt, Human
cucacagccauuucuguuccca

SEQ ID NO: 30393 - RNA, 28 nt, Human
ggggcgugucagcaggccuuucgauccc

SEQ ID NO: 30394 - RNA, 25 nt, Human
acaaagccuuaagcaaauuuuguau

SEQ ID NO: 30395 - RNA, 20 nt, Human
ugugagccagcuugagaaca

SEQ ID NO: 30396 - RNA, 19 nt, Human
caugccuuuugagggcuga

SEQ ID NO: 30397 - RNA, 25 nt, Human
gcugucugucauuuaccuacuucuu

SEQ ID NO: 30398 - RNA, 28 nt, Human
uugccccaggcuggucucgaacuccugg

SEQ ID NO: 30399 - RNA, 21 nt, Human
gaagaauuuugcaggugggag

SEQ ID NO: 30400 - RNA, 21 nt, Human
aaucauuuucuuucucucugc

SEQ ID NO: 30401 - RNA, 22 nt, Human
ugucucugaugcacguguguuu

SEQ ID NO: 30402 - RNA, 22 nt, Human
auggguuuuguuaggggugggg

SEQ ID NO: 30403 - RNA, 22 nt, Human
gggauuacagguguaagccacc

SEQ ID NO: 30404 - RNA, 21 nt, Human
gccucucuugacgucugccug

SEQ ID NO: 30405 - RNA, 22 nt, Human
cacugcacuccagccuggguaa

SEQ ID NO: 30406 - RNA, 22 nt, Human
cacuacacuccagccuggguga

SEQ ID NO: 30407 - RNA, 22 nt, Human
cacugcacuccaaccuggguga

SEQ ID NO: 30408 - RNA, 22 nt, Human
caccgcacuccagccugggcaa

SEQ ID NO: 30409 - RNA, 20 nt, Human
ggcauucacaccacccccca

SEQ ID NO: 30410 - RNA, 22 nt, Human
aaacuauuaaaaagggaauuca

SEQ ID NO: 30411 - RNA, 20 nt, Human
ucccuguucuccagccuagg

SEQ ID NO: 30412 - RNA, 21 nt, Human
uccaagcugcucgcgcacgcu

SEQ ID NO: 30413 - RNA, 20 nt, Human
gaguggugaccaugaaguag

SEQ ID NO: 30414 - RNA, 26 nt, Human
cugucuaccucacagaaauguuaaac

SEQ ID NO: 30415 - RNA, 22 nt, Human
ggucuggaagaaauggaugaga

SEQ ID NO: 30416 - RNA, 28 nt, Human
ugcaugauuucucugggcuugcugucuu

SEQ ID NO: 30417 - RNA, 22 nt, Human
agggagaggacauuucccacug

SEQ ID NO: 30418 - RNA, 22 nt, Human
cucaaguagcugggacuacagg

SEQ ID NO: 30419 - RNA, 22 nt, Human
uccuugcagccuuugauuucuc

SEQ ID NO: 30420 - RNA, 30 nt, Human
ucuccuuauucugcugaaugcaggauaaac

SEQ ID NO: 30421 - RNA, 23 nt, Human
aacuuuacaaaaucuauugacuu

SEQ ID NO: 30422 - RNA, 25 nt, Human
ccaaauuuuaauauuccagaagaac

SEQ ID NO: 30423 - RNA, 20 nt, Human
uucuccugccuuugccucca

SEQ ID NO: 30424 - RNA, 26 nt, Human
ucuccuccuccuucccacaggccggc

SEQ ID NO: 30425 - RNA, 25 nt, Human
gaggguuggggcuguggauuuagcu

SEQ ID NO: 30426 - RNA, 24 nt, Human
cccaggagauugaggcugcaguga

SEQ ID NO: 30427 - RNA, 27 nt, Human
uuguccucaaggucauccuggagaugg

SEQ ID NO: 30428 - RNA, 23 nt, Human
gcgauggcuacagcaauggucag

SEQ ID NO: 30429 - RNA, 26 nt, Human
gagcacggggcugaucaagccaucca

SEQ ID NO: 30430 - RNA, 23 nt, Human
cacuugcuccucccucuacccuc

SEQ ID NO: 30431 - RNA, 19 nt, Human
ucugaacuuggguugugcc

SEQ ID NO: 30432 - RNA, 21 nt, Human
gggacuccaguucacaggcca

SEQ ID NO: 30433 - RNA, 26 nt, Human
uucauucuccguugucauugacuuca

SEQ ID NO: 30434 - RNA, 26 nt, Human
cuccuggguugagcuguugccucagu

SEQ ID NO: 30435 - RNA, 28 nt, Human
uacauuuacacauuuacacuuaucuaau

SEQ ID NO: 30436 - RNA, 21 nt, Human
ccccaacaccagcaauuaugc

SEQ ID NO: 30437 - RNA, 26 nt, Human
ugguacagaucuuuuucugucuauca

SEQ ID NO: 30438 - RNA, 22 nt, Human
uaaacuucagaauaugagccaa

SEQ ID NO: 30439 - RNA, 27 nt, Human
ugccuguaaaucucauuuguauuuuca

SEQ ID NO: 30440 - RNA, 23 nt, Human
gcucucauguguaauguuuucua

SEQ ID NO: 30441 - RNA, 23 nt, Human
cgugccuguaaucccagcuacuc

SEQ ID NO: 30442 - RNA, 23 nt, Human
caugccugugaucccagcuacuc

SEQ ID NO: 30443 - RNA, 21 nt, Human
ggcggcggcggcaaugcugga

SEQ ID NO: 30444 - RNA, 25 nt, Human
ggcuggggcagugggcaugggcagg

SEQ ID NO: 30445 - RNA, 22 nt, Human
gacucacugcaaguuccugccc

SEQ ID NO: 30446 - RNA, 24 nt, Human
ucauuaaaaaauuggaguucaccc

SEQ ID NO: 30447 - RNA, 20 nt, Human
acacucugccuggccuugag

SEQ ID NO: 30448 - RNA, 22 nt, Human
cccucuccucugucuccagaag

SEQ ID NO: 30449 - RNA, 22 nt, Human
aggagaugaugugauggaacac

SEQ ID NO: 30450 - RNA, 22 nt, Human
cucauuucuuaugaaucuuucc

SEQ ID NO: 30451 - RNA, 22 nt, Human
cacuacuguacuccagccaggg

SEQ ID NO: 30452 - RNA, 22 nt, Human
uuauuuauuaaaaauguucuca

SEQ ID NO: 30453 - RNA, 21 nt, Human
gaggagacuuggucacuguga

SEQ ID NO: 30454 - RNA, 19 nt, Human
aauaugugaacacugcaaa

SEQ ID NO: 30455 - RNA, 24 nt, Human
aaaccuucauucuuacuaguuuca

SEQ ID NO: 30456 - RNA, 19 nt, Human
ccacacccaugucaacauc

SEQ ID NO: 30457 - RNA, 25 nt, Human
gugcauugggaugguuuuccaggca

SEQ ID NO: 30458 - RNA, 25 nt, Human
gucuuucuccuccugacuggugguc

SEQ ID NO: 30459 - RNA, 19 nt, Human
gcccaggcuggacugcagu

SEQ ID NO: 30460 - RNA, 20 nt, Human
cuucccucgcccaccugccu

SEQ ID NO: 30461 - RNA, 27 nt, Human
uaggcagcagcuuuuaauacaggguag

SEQ ID NO: 30462 - RNA, 22 nt, Human
auuaaagucacagaaugacaga

SEQ ID NO: 30463 - RNA, 22 nt, Human
gcuuguuuccaccuccugggcc

SEQ ID NO: 30464 - RNA, 26 nt, Human
cauccagcgagagaguuucaaaagca

SEQ ID NO: 30465 - RNA, 24 nt, Human
cccucugcacuuuguuuacuuguu

SEQ ID NO: 30466 - RNA, 22 nt, Human
uucucucuugcccugucucuca

SEQ ID NO: 30467 - RNA, 21 nt, Human
ugaccucaucauuaauaagug

SEQ ID NO: 30468 - RNA, 27 nt, Human
ccacugcacuccacucugggcaacaga

SEQ ID NO: 30469 - RNA, 20 nt, Human
uuaaaaccacugucuuguca

SEQ ID NO: 30470 - RNA, 22 nt, Human
ggaggugggguguuugggaggc

SEQ ID NO: 30471 - RNA, 21 nt, Human
ugugggccuaguguugccaga

SEQ ID NO: 30472 - RNA, 18 nt, Human
ggaggugcccacagcagg

SEQ ID NO: 30473 - RNA, 28 nt, Human
ccuggccuuucacuccaguucuggguga

SEQ ID NO: 30474 - RNA, 27 nt, Human
agcagauucaauggcucacauucuuuc

SEQ ID NO: 30475 - RNA, 28 nt, Human
ccuccccuggcccuccuuucuggcucag

SEQ ID NO: 30476 - RNA, 27 nt, Human
ugggaggucaaggcugcagugaaccau

SEQ ID NO: 30477 - RNA, 20 nt, Human
uuuuuuaaauaaucuuuuug

SEQ ID NO: 30478 - RNA, 22 nt, Human
gcaaaacuaauauuuauuuucu

SEQ ID NO: 30479 - RNA, 22 nt, Human
cagcucuguaaccaguccuguc

SEQ ID NO: 30480 - RNA, 27 nt, Human
ccuuguaaucuaacuuugucacuguga

SEQ ID NO: 30481 - RNA, 22 nt, Human
aggcugaggcaagagaauugcu

SEQ ID NO: 30482 - RNA, 21 nt, Human
ugugaggcugggacagaggga

SEQ ID NO: 30483 - RNA, 31 nt, Human
gacucgccaccacucugugcaccuucuugag

SEQ ID NO: 30484 - RNA, 21 nt, Human
ugccugugggccucucuggca

SEQ ID NO: 30485 - RNA, 23 nt, Human
aaauuguauuucaaccacaucca

SEQ ID NO: 30486 - RNA, 27 nt, Human
gaaggucuggaacuccccucccucccu

SEQ ID NO: 30487 - RNA, 25 nt, Human
gugaacaaacuacacaagucaucua

SEQ ID NO: 30488 - RNA, 22 nt, Human
gacuaacagcagaaucuaccuc

SEQ ID NO: 30489 - RNA, 22 nt, Human
cuccuccccucuccuaucagcc

SEQ ID NO: 30490 - RNA, 21 nt, Human
agcuugguggagagggcugaa

SEQ ID NO: 30491 - RNA, 23 nt, Human
gucgcccuggcuggagugcaaug

SEQ ID NO: 30492 - RNA, 21 nt, Human
cgcgcugagcaggcccggccg

SEQ ID NO: 30493 - RNA, 24 nt, Human
acacagccaaccuuucccagcccc

SEQ ID NO: 30494 - RNA, 19 nt, Human
gcaaucagguaguguugcu

SEQ ID NO: 30495 - RNA, 22 nt, Human
ggcggcggaggagccaggugag

SEQ ID NO: 30496 - RNA, 21 nt, Human
uuuaacaccuuccucguguua

SEQ ID NO: 30497 - RNA, 23 nt, Human
ggcuggaaaguaagggaagcaga

SEQ ID NO: 30498 - RNA, 15 nt, Human
ccuccucuguguguc

SEQ ID NO: 30499 - RNA, 27 nt, Human
ccugaaaugguaauuguagcauuucag

SEQ ID NO: 30500 - RNA, 19 nt, Human
ccacuuugcuauauacaga

SEQ ID NO: 30501 - RNA, 20 nt, Human
uuaaaugcaaaaacuccuuu

SEQ ID NO: 30502 - RNA, 27 nt, Human
ugguggagguaguucuuuggcagcggg

SEQ ID NO: 30503 - RNA, 19 nt, Human
caccggcgggagugcagcg

SEQ ID NO: 30504 - RNA, 26 nt, Human
ccugcaggcugaggaagucucuucuc

SEQ ID NO: 30505 - RNA, 22 nt, Human
ucaggaagaaagggaaauugca

SEQ ID NO: 30506 - RNA, 22 nt, Human
gggaggcucucccucucucuca

SEQ ID NO: 30507 - RNA, 21 nt, Human
ggaggcuaaaucaguguuuga

SEQ ID NO: 30508 - RNA, 23 nt, Human
uaucuguuuuuaaagcaccgagg

SEQ ID NO: 30509 - RNA, 20 nt, Human
ccugugccugaucugugugu

SEQ ID NO: 30510 - RNA, 22 nt, Human
gcuuuauuuccuuccucucuga

SEQ ID NO: 30511 - RNA, 23 nt, Human
uucgucugugggcaccagcacuu

SEQ ID NO: 30512 - RNA, 21 nt, Human
caccuccagauuccggcuucu

SEQ ID NO: 30513 - RNA, 23 nt, Human
aacuguacuaaucccuuucccca

SEQ ID NO: 30514 - RNA, 23 nt, Human
ggcugagaaggguggagcuuggc

SEQ ID NO: 30515 - RNA, 22 nt, Human
gcgugagccacugcucguggcc

SEQ ID NO: 30516 - RNA, 22 nt, Human
cucuaauuuuuaaguauuuuug

SEQ ID NO: 30517 - RNA, 23 nt, Human
aggcccucgaggcucagcagagc

SEQ ID NO: 30518 - RNA, 24 nt, Human
ccccucuccccaucccuguuauag

SEQ ID NO: 30519 - RNA, 23 nt, Human
aucugagcccauuucccuucucu

SEQ ID NO: 30520 - RNA, 21 nt, Human
ugggccacauugcauaugccu

SEQ ID NO: 30521 - RNA, 19 nt, Human
cugccagaauccaggcugg

SEQ ID NO: 30522 - RNA, 24 nt, Human
agggacccuuagaucacaucacuc

SEQ ID NO: 30523 - RNA, 25 nt, Human
ccauggcaauuuaaccacauuugga

SEQ ID NO: 30524 - RNA, 22 nt, Human
cuggauguggcccaggaggggu

SEQ ID NO: 30525 - RNA, 22 nt, Human
ggcugugugacggcugccugaa

SEQ ID NO: 30526 - RNA, 19 nt, Human
cgccuccuuucccuguguc

SEQ ID NO: 30527 - RNA, 19 nt, Human
uucuaaacuuuuuaucccu

SEQ ID NO: 30528 - RNA, 26 nt, Human
ggugccugccuugcuucuuccuucug

SEQ ID NO: 30529 - RNA, 26 nt, Human
gcucuaauuuuuguuuucuuuggcua

SEQ ID NO: 30530 - RNA, 22 nt, Human
cagcgcuccgguggaaugaauc

SEQ ID NO: 30531 - RNA, 23 nt, Human
uuuguauuucaaagaaggugcug

SEQ ID NO: 30532 - RNA, 21 nt, Human
aacaggaacagcuggagugga

SEQ ID NO: 30533 - RNA, 18 nt, Human
caggcugaacugcaguga

SEQ ID NO: 30534 - RNA, 23 nt, Human
ucuaaacacgaggaaacauuauu

SEQ ID NO: 30535 - RNA, 21 nt, Human
cagaauuaaaguagauuuuaa

SEQ ID NO: 30536 - RNA, 27 nt, Human
auaaaaaugaaugucaaaauguguaca

SEQ ID NO: 30537 - RNA, 23 nt, Human
ucuucucuucuuuaugauguuca

SEQ ID NO: 30538 - RNA, 26 nt, Human
uccagugaugccacugagauggcacc

SEQ ID NO: 30539 - RNA, 20 nt, Human
guuauauuuaaagcuuuuca

SEQ ID NO: 30540 - RNA, 22 nt, Human
aacagcauggccaguaaacuga

SEQ ID NO: 30541 - RNA, 25 nt, Human
gcgugggaccaugccaggcacaaaa

SEQ ID NO: 30542 - RNA, 26 nt, Human
cccugccuccaugccagcaucugggg

SEQ ID NO: 30543 - RNA, 22 nt, Human
caaccugggaggcagagguugc

SEQ ID NO: 30544 - RNA, 24 nt, Human
ccgcuggcccaggucuccucucca

SEQ ID NO: 30545 - RNA, 23 nt, Human
gagaauuuuggacaauuggaaag

SEQ ID NO: 30546 - RNA, 26 nt, Human
caccauggacuuccagcaucgccccg

SEQ ID NO: 30547 - RNA, 19 nt, Human
ucucuagcuguuacuccag

SEQ ID NO: 30548 - RNA, 21 nt, Human
ucugagcuucucaagacuccu

SEQ ID NO: 30549 - RNA, 21 nt, Human
aucaccccaccaccgucacuu

SEQ ID NO: 30550 - RNA, 28 nt, Human
gcugccaccgcuuccugccugucauuug

SEQ ID NO: 30551 - RNA, 21 nt, Human
gggaaacaccaaaagcaaaga

SEQ ID NO: 30552 - RNA, 19 nt, Human
ccauuuuucugguaugaau

SEQ ID NO: 30553 - RNA, 27 nt, Human
agggauccgacuugaauuuucccacug

SEQ ID NO: 30554 - RNA, 23 nt, Human
gacuacuggcugaaggcgagccc

SEQ ID NO: 30555 - RNA, 23 nt, Human
agcccaugcugaggcugcagugg

SEQ ID NO: 30556 - RNA, 23 nt, Human
uucagacuccagcugugaagaga

SEQ ID NO: 30557 - RNA, 25 nt, Human
ccggccugugccagcuugcagagcu

SEQ ID NO: 30558 - RNA, 21 nt, Human
uucugcuucucucuucucuca

SEQ ID NO: 30559 - RNA, 23 nt, Human
gccuuucacaguccccuccugcc

SEQ ID NO: 30560 - RNA, 19 nt, Human
ucacagcugugaagaucug

SEQ ID NO: 30561 - RNA, 31 nt, Human
gucaguccuuuggaaaccagcaggucugaaa

SEQ ID NO: 30562 - RNA, 22 nt, Human
gaucaugucuguaauccuagca

SEQ ID NO: 30563 - RNA, 21 nt, Human
cuccugccucucuccucucuc

SEQ ID NO: 30564 - RNA, 20 nt, Human
uaaagaauuuggaaggcaaa

SEQ ID NO: 30565 - RNA, 25 nt, Human
gaacccaggccagagccugaaauau

SEQ ID NO: 30566 - RNA, 24 nt, Human
uagagcauuguuguccuucacugc

SEQ ID NO: 30567 - RNA, 24 nt, Human
gugccccaggcuagcucuucuacc

SEQ ID NO: 30568 - RNA, 20 nt, Human
cuucccuugccuauuugcug

SEQ ID NO: 30569 - RNA, 24 nt, Human
cguugcugagcaaacauguugcug

SEQ ID NO: 30570 - RNA, 24 nt, Human
gccugcuccugaaaagcucucugg

SEQ ID NO: 30571 - RNA, 22 nt, Human
ggcugggcaaggaggccacgug

SEQ ID NO: 30572 - RNA, 26 nt, Human
cagcaaaugcccagcccaggcaaauu

SEQ ID NO: 30573 - RNA, 18 nt, Human
acggggagaaaaggucau

SEQ ID NO: 30574 - RNA, 31 nt, Human
accuccucuacuuuaacugugcucucaggug

SEQ ID NO: 30575 - RNA, 19 nt, Human
gacuuggaaggccgcuucu

SEQ ID NO: 30576 - RNA, 20 nt, Human
cugccucuucgcgggguguc

SEQ ID NO: 30577 - RNA, 22 nt, Human
uuggguggggagaagaggcaga

SEQ ID NO: 30578 - RNA, 23 nt, Human
uuaccuuucuugcucaacagcua

SEQ ID NO: 30579 - RNA, 22 nt, Human
acaccuguaaucccagcacuuu

SEQ ID NO: 30580 - RNA, 24 nt, Human
agaaggcgggaggcuggaguagag

SEQ ID NO: 30581 - RNA, 22 nt, Human
accaugucgcuggaccauugug

SEQ ID NO: 30582 - RNA, 25 nt, Human
cccuguuacccccaggaucucuguu

SEQ ID NO: 30583 - RNA, 22 nt, Human
gagcuagacgguuuccuuccuc

SEQ ID NO: 30584 - RNA, 20 nt, Human
gcccugggccuaucccauga

SEQ ID NO: 30585 - RNA, 22 nt, Human
cccaccagcucuauucuuugcc

SEQ ID NO: 30586 - RNA, 22 nt, Human
agacuggagugcagugguggga

SEQ ID NO: 30587 - RNA, 31 nt, Human
uuaucuuaaaagagcuugcucugucuaccuu

SEQ ID NO: 30588 - RNA, 27 nt, Human
ggaggcugagggcggagaggcgcaucg

SEQ ID NO: 30589 - RNA, 22 nt, Human
caguggugggcaaaguuguagg

SEQ ID NO: 30590 - RNA, 23 nt, Human
accaugccaggcuaauuuuuggu

SEQ ID NO: 30591 - RNA, 26 nt, Human
auuugaacaaaaagauaaaucuucac

SEQ ID NO: 30592 - RNA, 23 nt, Human
ugaccccagcaggaugucuaaua

SEQ ID NO: 30593 - RNA, 22 nt, Human
acccuuuacugacuugagcucc

SEQ ID NO: 30594 - RNA, 24 nt, Human
ggaugcuguugccaagacugcaaa

SEQ ID NO: 30595 - RNA, 26 nt, Human
aagugcugggauuacaggcgcgagcc

SEQ ID NO: 30596 - RNA, 27 nt, Human
acaucugccuuuuccacaagcuuuuca

SEQ ID NO: 30597 - RNA, 26 nt, Human
cagcgcuucuucuuucuugguuugau

SEQ ID NO: 30598 - RNA, 21 nt, Human
gcaacagacucucacagggca

SEQ ID NO: 30599 - RNA, 27 nt, Human
gcuguaacugccaggcucucuuugccc

SEQ ID NO: 30600 - RNA, 26 nt, Human
aaaaccugcaguuuuguuuguacuuu

SEQ ID NO: 30601 - RNA, 19 nt, Human
caucauuccucagcuacua

SEQ ID NO: 30602 - RNA, 19 nt, Human
agguuuggauuggagaggg

SEQ ID NO: 30603 - RNA, 24 nt, Human
aaaguacucuuucaggagggacua

SEQ ID NO: 30604 - RNA, 27 nt, Human
cccuccugagucccggccugaaggagg

SEQ ID NO: 30605 - RNA, 22 nt, Human
agccccagccacccaucaaauc

SEQ ID NO: 30606 - RNA, 23 nt, Human
aaauguccccuugauggggaauc

SEQ ID NO: 30607 - RNA, 23 nt, Human
agaaguuaggcagguccuaggga

SEQ ID NO: 30608 - RNA, 21 nt, Human
aauaaagugccuucugggcuu

SEQ ID NO: 30609 - RNA, 20 nt, Human
agagaacugaacuguggaaa

SEQ ID NO: 30610 - RNA, 21 nt, Human
cacuacccaugggggguuggg

SEQ ID NO: 30611 - RNA, 22 nt, Human
agcaucuccaccugccaucuca

SEQ ID NO: 30612 - RNA, 19 nt, Human
cccagaaaacacauuucug

SEQ ID NO: 30613 - RNA, 26 nt, Human
agaauuuugcuucuguuuuguguuua

SEQ ID NO: 30614 - RNA, 21 nt, Human
guuggaagugugacucaaucu

SEQ ID NO: 30615 - RNA, 24 nt, Human
gcuggggcaaagaugauuaccuuc

SEQ ID NO: 30616 - RNA, 21 nt, Human
acuccaagccuggccccacca

SEQ ID NO: 30617 - RNA, 25 nt, Human
acccaggcuugagugcaguggugcg

SEQ ID NO: 30618 - RNA, 30 nt, Human
caugcugcaucuuaaccuuuuguauuuauu

SEQ ID NO: 30619 - RNA, 24 nt, Human
cuguaguugcccccuaccucuccc

SEQ ID NO: 30620 - RNA, 27 nt, Human
ccuaccccuuccaaccuucccugcuuc

SEQ ID NO: 30621 - RNA, 22 nt, Human
ugucucccuaaauaaaaccagc

SEQ ID NO: 30622 - RNA, 24 nt, Human
ccacaucucacuucugcuuccuca

SEQ ID NO: 30623 - RNA, 19 nt, Human
cuucccuucugugugaccg

SEQ ID NO: 30624 - RNA, 27 nt, Human
ccugaguaggugggauuacagaugccc

SEQ ID NO: 30625 - RNA, 23 nt, Human
cucugcucuuggaggagaugggg

SEQ ID NO: 30626 - RNA, 23 nt, Human
cagggcugcacagccagguguga

SEQ ID NO: 30627 - RNA, 27 nt, Human
gccucgaacuccugggcucaagcaauc

SEQ ID NO: 30628 - RNA, 23 nt, Human
cuuuaaaacuuuguuuucaggca

SEQ ID NO: 30629 - RNA, 27 nt, Human
cucagcaccugcuuccugcuccugcac

SEQ ID NO: 30630 - RNA, 27 nt, Human
ggcaugccacagggauucuccuccuuc

SEQ ID NO: 30631 - RNA, 24 nt, Human
aggggcaguuuuagcagcacuuuu

SEQ ID NO: 30632 - RNA, 21 nt, Human
ccacagcugcgcacacagcug

SEQ ID NO: 30633 - RNA, 27 nt, Human
ggacccggcagcccgagcaggagccgu

SEQ ID NO: 30634 - RNA, 20 nt, Human
aucaggaaugagucaaucag

SEQ ID NO: 30635 - RNA, 31 nt, Human
cccagcauggaccuggugacucuccacaggg

SEQ ID NO: 30636 - RNA, 22 nt, Human
ucuuuugccagagaaacugagg

SEQ ID NO: 30637 - RNA, 20 nt, Human
aacuuccagcccugucugcu

SEQ ID NO: 30638 - RNA, 20 nt, Human
acacagucuugagcugucca

SEQ ID NO: 30639 - RNA, 27 nt, Human
cuuaccucccaccuuugguccuaaguc

SEQ ID NO: 30640 - RNA, 23 nt, Human
aaauguucauggaacuagcucuu

SEQ ID NO: 30641 - RNA, 18 nt, Human
gcuauaaaaauguccuug

SEQ ID NO: 30642 - RNA, 21 nt, Human
cucauggagucgauguuuagc

SEQ ID NO: 30643 - RNA, 21 nt, Human
ggccgcagacuccuguccgca

SEQ ID NO: 30644 - RNA, 24 nt, Human
ugccauugggaccacgaagggaau

SEQ ID NO: 30645 - RNA, 19 nt, Human
gugcuaccccuugcccagg

SEQ ID NO: 30646 - RNA, 19 nt, Human
uggaagcuucucucugagc

SEQ ID NO: 30647 - RNA, 24 nt, Human
uucaaguuuacuccuucuguuuug

SEQ ID NO: 30648 - RNA, 26 nt, Human
ggggcagcaaugcugaaggacacagc

SEQ ID NO: 30649 - RNA, 26 nt, Human
gggaccccccaccaccaccaucugcc

SEQ ID NO: 30650 - RNA, 27 nt, Human
gaccgcuuguuuuucuccuuuuggugu

SEQ ID NO: 30651 - RNA, 22 nt, Human
ugggauuacaagaaugagccac

SEQ ID NO: 30652 - RNA, 23 nt, Human
uccucugagcugaguuugaggcc

SEQ ID NO: 30653 - RNA, 22 nt, Human
gacgugcagaaaaaugggugaa

SEQ ID NO: 30654 - RNA, 22 nt, Human
aacccaaugaguagugaaggga

SEQ ID NO: 30655 - RNA, 20 nt, Human
gguguugccauuucucugcu

SEQ ID NO: 30656 - RNA, 19 nt, Human
ccggccggcaguugcagug

SEQ ID NO: 30657 - RNA, 22 nt, Human
guugcccaggcuggagcgcagu

SEQ ID NO: 30658 - RNA, 27 nt, Human
aucucccaccccagagaacgaggauuu

SEQ ID NO: 30659 - RNA, 26 nt, Human
uccucuccacacagugcucaaggcca

SEQ ID NO: 30660 - RNA, 23 nt, Human
cgggcuucucgccccucaguggu

SEQ ID NO: 30661 - RNA, 23 nt, Human
uccaguuucaaucuaacugugaa

SEQ ID NO: 30662 - RNA, 21 nt, Human
gugucaacccagccaugggga

SEQ ID NO: 30663 - RNA, 19 nt, Human
gcucagccacuagucauca

SEQ ID NO: 30664 - RNA, 27 nt, Human
gucucccaucggaaggcagcacuggau

SEQ ID NO: 30665 - RNA, 28 nt, Human
gugacucacaccuguaauuccagcacuu

SEQ ID NO: 30666 - RNA, 19 nt, Human
ucucucucaaggccacucg

SEQ ID NO: 30667 - RNA, 24 nt, Human
aucuucuagggagugacccaucua

SEQ ID NO: 30668 - RNA, 27 nt, Human
gccaggauuugagucucugcaugacau

SEQ ID NO: 30669 - RNA, 18 nt, Human
cugcuuccuguuggcugg

SEQ ID NO: 30670 - RNA, 23 nt, Human
gcugguggcuugggacaucagug

SEQ ID NO: 30671 - RNA, 22 nt, Human
gggaggcacccggccggcugga

SEQ ID NO: 30672 - RNA, 26 nt, Human
gggcuucagucuuccuuuauuuauaa

SEQ ID NO: 30673 - RNA, 30 nt, Human
uguugugcuuguaaauacacagugaaauug

SEQ ID NO: 30674 - RNA, 25 nt, Human
uagacauuucagacacuccucagca

SEQ ID NO: 30675 - RNA, 27 nt, Human
ggcugcugcuuccaguauccugccuuc

SEQ ID NO: 30676 - RNA, 25 nt, Human
agucauuuuucuuucuugucccauu

SEQ ID NO: 30677 - RNA, 27 nt, Human
acagcauuucaagcgucacuuuauuuc

SEQ ID NO: 30678 - RNA, 22 nt, Human
gggguguucaccucucuucuca

SEQ ID NO: 30679 - RNA, 25 nt, Human
cacuccagccugggugacagagcca

SEQ ID NO: 30680 - RNA, 26 nt, Human
cuguaaucccagucacugggaagccg

SEQ ID NO: 30681 - RNA, 23 nt, Human
gccugucugcccuccuggaugcu

SEQ ID NO: 30682 - RNA, 27 nt, Human
ucugcagcuccuccccuugggcaggcu

SEQ ID NO: 30683 - RNA, 27 nt, Human
ccccaaaacgugcauggauaugugcca

SEQ ID NO: 30684 - RNA, 26 nt, Human
ucuguauaggugacagcugcuuauaa

SEQ ID NO: 30685 - RNA, 22 nt, Human
ugccuccugaguagcugggauu

SEQ ID NO: 30686 - RNA, 22 nt, Human
uucagccuuccaugugcugccg

SEQ ID NO: 30687 - RNA, 25 nt, Human
gcugagacauucuucaccuccuugg

SEQ ID NO: 30688 - RNA, 31 nt, Human
ccagagagcacugcacuuccccaaaacggaa

SEQ ID NO: 30689 - RNA, 27 nt, Human
uccugcagggacuaggucuugcauuuu

SEQ ID NO: 30690 - RNA, 25 nt, Human
cccuagccuucucccacagcugccu

SEQ ID NO: 30691 - RNA, 21 nt, Human
cgugccuguuuuaugugcaca

SEQ ID NO: 30692 - RNA, 25 nt, Human
ggcuggggugcugucuuccacugac

SEQ ID NO: 30693 - RNA, 19 nt, Human
uucuuauaacauaaccuca

SEQ ID NO: 30694 - RNA, 22 nt, Human
cuuuauaguuuuaucauaaucc

SEQ ID NO: 30695 - RNA, 22 nt, Human
ucuguuguuugguucagggauu

SEQ ID NO: 30696 - RNA, 19 nt, Human
gauucugguuaucucuuua

SEQ ID NO: 30697 - RNA, 27 nt, Human
ggagcaguagcuggagggaccuugucu

SEQ ID NO: 30698 - RNA, 19 nt, Human
ggagacacagguguggaaa

SEQ ID NO: 30699 - RNA, 20 nt, Human
ccagaaggagcugaguuugg

SEQ ID NO: 30700 - RNA, 25 nt, Human
cuuccucccucauuccaccuuccca

SEQ ID NO: 30701 - RNA, 20 nt, Human
ggaggagacagggacgcagg

SEQ ID NO: 30702 - RNA, 24 nt, Human
ucuguccugucugauucucuuagg

SEQ ID NO: 30703 - RNA, 28 nt, Human
acuguccuuuaaacuccaguggcuggcc

SEQ ID NO: 30704 - RNA, 21 nt, Human
ugcuguugccucucuuugaca

SEQ ID NO: 30705 - RNA, 25 nt, Human
guuguuguuuuuugagauggagucu

SEQ ID NO: 30706 - RNA, 21 nt, Human
gccaggcauggugguguguga

SEQ ID NO: 30707 - RNA, 18 nt, Human
aggguacaccucccucca

SEQ ID NO: 30708 - RNA, 21 nt, Human
agcagccaaagacaaguauca

SEQ ID NO: 30709 - RNA, 21 nt, Human
ugggaacacuggcagacugug

SEQ ID NO: 30710 - RNA, 29 nt, Human
aagccccagaggaccagagcccccagccu

SEQ ID NO: 30711 - RNA, 20 nt, Human
agacugcauuuaucuuguca

SEQ ID NO: 30712 - RNA, 22 nt, Human
augauucaguuaccucccacug

SEQ ID NO: 30713 - RNA, 19 nt, Human
gacuucaugcagccggagc

SEQ ID NO: 30714 - RNA, 21 nt, Human
uucucuuuaggugacuguuua

SEQ ID NO: 30715 - RNA, 22 nt, Human
ccuaguagcugggacuacaggc

SEQ ID NO: 30716 - RNA, 22 nt, Human
ucucccauggcuuugugcugcu

SEQ ID NO: 30717 - RNA, 18 nt, Human
ugaagucgaggcugcagu

SEQ ID NO: 30718 - RNA, 30 nt, Human
acauucuagucccugacucgccagaugcau

SEQ ID NO: 30719 - RNA, 21 nt, Human
auggugggugggugggaugag

SEQ ID NO: 30720 - RNA, 26 nt, Human
ucgggaggcugaggcaggagaauagc

SEQ ID NO: 30721 - RNA, 18 nt, Human
gcgcccuuaccuucccca

SEQ ID NO: 30722 - RNA, 20 nt, Human
aggacuuuugguuuuuauau

SEQ ID NO: 30723 - RNA, 20 nt, Human
gggggccauggcggagccag

SEQ ID NO: 30724 - RNA, 20 nt, Human
ugaaggggcagaaauucgga

SEQ ID NO: 30725 - RNA, 25 nt, Human
uugcuggucuucucaguucauuucc

SEQ ID NO: 30726 - RNA, 21 nt, Human
cagggacaaggagguugcuga

SEQ ID NO: 30727 - RNA, 22 nt, Human
cuuaauguucaaaaugacuugg

SEQ ID NO: 30728 - RNA, 23 nt, Human
ugcccagcuuggagugccacgug

SEQ ID NO: 30729 - RNA, 22 nt, Human
ucacuccacacccucuggccuu

SEQ ID NO: 30730 - RNA, 20 nt, Human
cuccccagacccagccuugc

SEQ ID NO: 30731 - RNA, 26 nt, Human
cguggacugauaggacaucuuuucgu

SEQ ID NO: 30732 - RNA, 21 nt, Human
auccugggcacauucuuuucu

SEQ ID NO: 30733 - RNA, 31 nt, Human
cacaaucagaagacaggagcugcagaacaga

SEQ ID NO: 30734 - RNA, 22 nt, Human
ccgggaggcagagggaguagug

SEQ ID NO: 30735 - RNA, 20 nt, Human
cucccucugcuugcuuucca

SEQ ID NO: 30736 - RNA, 24 nt, Human
gcacagcucccggcgggugcucug

SEQ ID NO: 30737 - RNA, 29 nt, Human
cuucuuagggcccucucccugccccagcu

SEQ ID NO: 30738 - RNA, 21 nt, Human
aucccuugggcuuuggauuug

SEQ ID NO: 30739 - RNA, 19 nt, Human
gggcuccuccugcccucca

SEQ ID NO: 30740 - RNA, 22 nt, Human
ggggcuccuuucuccagccagc

SEQ ID NO: 30741 - RNA, 22 nt, Human
gggugagguccaaagaggagag

SEQ ID NO: 30742 - RNA, 23 nt, Human
uguaguguuuauauaauuuuaug

SEQ ID NO: 30743 - RNA, 24 nt, Human
ccaugauuaaccacuucagcugac

SEQ ID NO: 30744 - RNA, 16 nt, Human
cagcagccucugaggu

SEQ ID NO: 30745 - RNA, 25 nt, Human
gugucaggcugggguuagugagcag

SEQ ID NO: 30746 - RNA, 23 nt, Human
gggguguggucucucagcuguuc

SEQ ID NO: 30747 - RNA, 27 nt, Human
ggaggcugcaccuacugaggaucucgg

SEQ ID NO: 30748 - RNA, 18 nt, Human
uuauuagcagacacugcu

SEQ ID NO: 30749 - RNA, 19 nt, Human
gggcccucagggcugggga

SEQ ID NO: 30750 - RNA, 20 nt, Human
aggcucagguucugaggaag

SEQ ID NO: 30751 - RNA, 20 nt, Human
aagauauaacuuccccaagu

SEQ ID NO: 30752 - RNA, 24 nt, Human
cagcucuuuuuaaaaaacagcuuc

SEQ ID NO: 30753 - RNA, 22 nt, Human
cuuaaaaagguguuuugucugg

SEQ ID NO: 30754 - RNA, 24 nt, Human
gaguuuugacgucuuuuuacuuga

SEQ ID NO: 30755 - RNA, 23 nt, Human
aaggcugaaaccucggaggaaca

SEQ ID NO: 30756 - RNA, 21 nt, Human
gauagaucauuguucucucca

SEQ ID NO: 30757 - RNA, 27 nt, Human
gauuucuguuguuucugcugacugugu

SEQ ID NO: 30758 - RNA, 22 nt, Human
ccuaugggcuuccgcacaugcc

SEQ ID NO: 30759 - RNA, 20 nt, Human
ggcccuccugcuccuugcag

SEQ ID NO: 30760 - RNA, 28 nt, Human
cugugagcaaagugucuuccgauuagca

SEQ ID NO: 30761 - RNA, 26 nt, Human
ucucugcuugacaacaaaagucaggg

SEQ ID NO: 30762 - RNA, 23 nt, Human
caggaugggagaugaggagaagc

SEQ ID NO: 30763 - RNA, 19 nt, Human
gucuggcuucuuucacuua

SEQ ID NO: 30764 - RNA, 27 nt, Human
acugcaaccucugccucccgaguucaa

SEQ ID NO: 30765 - RNA, 22 nt, Human
cgaggcaccaugaucagagaga

SEQ ID NO: 30766 - RNA, 26 nt, Human
gaaacuucagaacauguguauguauu

SEQ ID NO: 30767 - RNA, 23 nt, Human
accuuguuagaagagguggcccc

SEQ ID NO: 30768 - RNA, 25 nt, Human
ggugggcuguaugaaguagcauuuu

SEQ ID NO: 30769 - RNA, 26 nt, Human
ugcccagguugcacaggagugggaug

SEQ ID NO: 30770 - RNA, 22 nt, Human
cagaauuaagguuuguuuucca

SEQ ID NO: 30771 - RNA, 21 nt, Human
ccacuccugcguuccugucca

SEQ ID NO: 30772 - RNA, 20 nt, Human
ggccugugcgaucccacccg

SEQ ID NO: 30773 - RNA, 22 nt, Human
cucuagagaaauaagaucuuuu

SEQ ID NO: 30774 - RNA, 29 nt, Human
cccagggauaaaaacagagaucauugucu

SEQ ID NO: 30775 - RNA, 19 nt, Human
ucagaggggccucuguggg

SEQ ID NO: 30776 - RNA, 22 nt, Human
cgcgcuguucuuugcagcagug

SEQ ID NO: 30777 - RNA, 26 nt, Human
ugccgccaccgcaucgcgcagcucuu

SEQ ID NO: 30778 - RNA, 22 nt, Human
gucacccaggcugcaguucacu

SEQ ID NO: 30779 - RNA, 19 nt, Human
uuccucuuggguucuugaa

SEQ ID NO: 30780 - RNA, 26 nt, Human
gccuuucucggcccuggacugaggcu

SEQ ID NO: 30781 - RNA, 26 nt, Human
agccuaggguaggggcacugcugcaa

SEQ ID NO: 30782 - RNA, 24 nt, Human
ccaaaugguuacauugugcugcua

SEQ ID NO: 30783 - RNA, 21 nt, Human
ucagcaauuccugcaaagggu

SEQ ID NO: 30784 - RNA, 22 nt, Human
uugaccagcucugggguuugua

SEQ ID NO: 30785 - RNA, 22 nt, Human
ugccuaggcuggagugcaguga

SEQ ID NO: 30786 - RNA, 28 nt, Human
ccugcuucugcugcccugaugcgucuac

SEQ ID NO: 30787 - RNA, 22 nt, Human
uuacugaggggggagugcagca

SEQ ID NO: 30788 - RNA, 22 nt, Human
uggugggugccuguaauuccag

SEQ ID NO: 30789 - RNA, 22 nt, Human
aggcuggagugcaauggcacgu

SEQ ID NO: 30790 - RNA, 20 nt, Human
uugucaaggagagugcaguc

SEQ ID NO: 30791 - RNA, 18 nt, Human
uccugugucaugaccuca

SEQ ID NO: 30792 - RNA, 20 nt, Human
guuauguuugacagaaggca

SEQ ID NO: 30793 - RNA, 28 nt, Human
ccaccucugcuaguuccagacaccucca

SEQ ID NO: 30794 - RNA, 20 nt, Human
cacccaggcuggaaugcagu

SEQ ID NO: 30795 - RNA, 22 nt, Human
gcucacugcagccuuguccucc

SEQ ID NO: 30796 - RNA, 23 nt, Human
ccauguugaugugccucucaguu

SEQ ID NO: 30797 - RNA, 26 nt, Human
aagucauggagccugaagggugccua

SEQ ID NO: 30798 - RNA, 24 nt, Human
ucccuaucuaacacuuuugcucug

SEQ ID NO: 30799 - RNA, 21 nt, Human
guuaggaagagagagaacugg

SEQ ID NO: 30800 - RNA, 20 nt, Human
uuguacauauaccaaaaaga

SEQ ID NO: 30801 - RNA, 24 nt, Human
gguucgagcuaggaucccacugcc

SEQ ID NO: 30802 - RNA, 14 nt, Human
uuuccacugccucc

SEQ ID NO: 30803 - RNA, 24 nt, Human
gugaggcacucccauacaaaggaa

SEQ ID NO: 30804 - RNA, 22 nt, Human
gguccuauccaugccccuuacu

SEQ ID NO: 30805 - RNA, 20 nt, Human
aauuuuaaaaauacuuuuua

SEQ ID NO: 30806 - RNA, 21 nt, Human
uauuuuauaaaugaacagggu

SEQ ID NO: 30807 - RNA, 24 nt, Human
gaaaagauaaccugcagaauggga

SEQ ID NO: 30808 - RNA, 22 nt, Human
gaugugagaaacuucuuuucuu

SEQ ID NO: 30809 - RNA, 22 nt, Human
uccacugcacgcuggugcuggg

SEQ ID NO: 30810 - RNA, 26 nt, Human
ucuccaccggcgcgaucugcucgucc

SEQ ID NO: 30811 - RNA, 26 nt, Human
cacaaaccagcuucugguuucuucug

SEQ ID NO: 30812 - RNA, 22 nt, Human
uaaugauuugggagauuuuuuc

SEQ ID NO: 30813 - RNA, 26 nt, Human
uagccucuuucuugcguuucuuuuua

SEQ ID NO: 30814 - RNA, 18 nt, Human
ccucccuggcacugaggc

SEQ ID NO: 30815 - RNA, 21 nt, Human
gccacucagagacuucaccua

SEQ ID NO: 30816 - RNA, 27 nt, Human
ucagcacugccugcucccauccugugu

SEQ ID NO: 30817 - RNA, 22 nt, Human
gcucacugcacccuccgccucu

SEQ ID NO: 30818 - RNA, 26 nt, Human
acaguuucauugauugacucuaccuc

SEQ ID NO: 30819 - RNA, 20 nt, Human
acggcuuuucugacacucca

SEQ ID NO: 30820 - RNA, 20 nt, Human
ucuuccucuuuaucuaacua

SEQ ID NO: 30821 - RNA, 25 nt, Human
ccagguggacuguggcagaucaaua

SEQ ID NO: 30822 - RNA, 20 nt, Human
uagagcuggaguggggcugg

SEQ ID NO: 30823 - RNA, 27 nt, Human
ccacuccacuccaggcugccggcaccu

SEQ ID NO: 30824 - RNA, 21 nt, Human
aauuccauguggaugucacca

SEQ ID NO: 30825 - RNA, 22 nt, Human
caauacaaugcauucuugagug

SEQ ID NO: 30826 - RNA, 22 nt, Human
ccaucucucuggcccucuaccc

SEQ ID NO: 30827 - RNA, 23 nt, Human
gguggaggucccgagugggcggg

SEQ ID NO: 30828 - RNA, 19 nt, Human
aacuccaugggcucuggga

SEQ ID NO: 30829 - RNA, 25 nt, Human
gaggccgugugaagacagaggcaga

SEQ ID NO: 30830 - RNA, 27 nt, Human
ccaggaggcagcaucuccagagcuggc

SEQ ID NO: 30831 - RNA, 23 nt, Human
gugccuggcugauucagcauuuu

SEQ ID NO: 30832 - RNA, 25 nt, Human
agggguggggagaaggggaggaggc

SEQ ID NO: 30833 - RNA, 25 nt, Human
agucuguuggcagacuggagugcaa

SEQ ID NO: 30834 - RNA, 25 nt, Human
caccugaggucaggaguuuugagac

SEQ ID NO: 30835 - RNA, 24 nt, Human
gcuuccuuauuccuuacuauggga

SEQ ID NO: 30836 - RNA, 28 nt, Human
gagccauccguggcccuguaccggcugc

SEQ ID NO: 30837 - RNA, 23 nt, Human
uuuuauucaagaugaguuggacc

SEQ ID NO: 30838 - RNA, 26 nt, Human
cugcucuguucccugggacacccccg

SEQ ID NO: 30839 - RNA, 21 nt, Human
augggagaaaggggguagggu

SEQ ID NO: 30840 - RNA, 23 nt, Human
gggaaggagaaaaccagcaaagg

SEQ ID NO: 30841 - RNA, 23 nt, Human
ccaguuuccugugugcaugucau

SEQ ID NO: 30842 - RNA, 27 nt, Human
ggagaauugguugaccuaaauggaacc

SEQ ID NO: 30843 - RNA, 23 nt, Human
ugucgcccaggcuggagugcagg

SEQ ID NO: 30844 - RNA, 22 nt, Human
cgccucaugcacugaccacagc

SEQ ID NO: 30845 - RNA, 23 nt, Human
cccagccucagaccccacccagc

SEQ ID NO: 30846 - RNA, 23 nt, Human
gcaaaccaggcugcagguggggu

SEQ ID NO: 30847 - RNA, 28 nt, Human
gcuuuacugccuuccuccuuauccuaca

SEQ ID NO: 30848 - RNA, 20 nt, Human
uuguaacaucaagucaagag

SEQ ID NO: 30849 - RNA, 27 nt, Human
gguuauuuggaaaguguguauuuaacu

SEQ ID NO: 30850 - RNA, 21 nt, Human
gcuccuccgcagaagguuggu

SEQ ID NO: 30851 - RNA, 20 nt, Human
aguagugucuucucucucca

SEQ ID NO: 30852 - RNA, 20 nt, Human
gccguacuuugcuaacugug

SEQ ID NO: 30853 - RNA, 26 nt, Human
gcccaggcuggugucaaacuccuggg

SEQ ID NO: 30854 - RNA, 26 nt, Human
ucacccaggcuggcagaucaugguag

SEQ ID NO: 30855 - RNA, 22 nt, Human
ucccuguggagaugaacauucu

SEQ ID NO: 30856 - RNA, 26 nt, Human
cugcucuaucacguggugcucuccga

SEQ ID NO: 30857 - RNA, 27 nt, Human
gccucuuguuuuccaucuucauggccu

SEQ ID NO: 30858 - RNA, 27 nt, Human
ugcagugagcugagauugcacuccagc

SEQ ID NO: 30859 - RNA, 23 nt, Human
accuggcucccccugcugguguc

SEQ ID NO: 30860 - RNA, 26 nt, Human
gcgacuucucaagcuuuugaaugggu

SEQ ID NO: 30861 - RNA, 26 nt, Human
aggaauagcaaaauuccuguguucaa

SEQ ID NO: 30862 - RNA, 26 nt, Human
ucauuucucuucccccuuuuuggcau

SEQ ID NO: 30863 - RNA, 28 nt, Human
cuguuuuacuuuauaccucucuauuccu

SEQ ID NO: 30864 - RNA, 23 nt, Human
ccugaagccuccaugcccaggcc

SEQ ID NO: 30865 - RNA, 27 nt, Human
ccccugccucgaggacugauacugcag

SEQ ID NO: 30866 - RNA, 22 nt, Human
caaauaccuguuuugaauaaag

SEQ ID NO: 30867 - RNA, 20 nt, Human
guguuucaggcacuaaagca

SEQ ID NO: 30868 - RNA, 23 nt, Human
gcucaccuuuuuaugaucugcca

SEQ ID NO: 30869 - RNA, 23 nt, Human
uggaugacauaauuggaaaaagc

SEQ ID NO: 30870 - RNA, 25 nt, Human
gcugcuggggggacaaccauaagca

SEQ ID NO: 30871 - RNA, 22 nt, Human
cccuaguagcugggacuacagg

SEQ ID NO: 30872 - RNA, 22 nt, Human
aggaccaggagaaaucaacagg

SEQ ID NO: 30873 - RNA, 23 nt, Human
cgccgccgagacccaggcugaag

SEQ ID NO: 30874 - RNA, 22 nt, Human
gauuacaggcgugauccaccac

SEQ ID NO: 30875 - RNA, 24 nt, Human
uucuaggaauaccagucacauagu

SEQ ID NO: 30876 - RNA, 22 nt, Human
gaccagccuggucaacauagug

SEQ ID NO: 30877 - RNA, 27 nt, Human
ccauugcacuccagccuagauaacaag

SEQ ID NO: 30878 - RNA, 21 nt, Human
caagccccuggaaaagggagc

SEQ ID NO: 30879 - RNA, 22 nt, Human
aucuggcuguugaguugacggg

SEQ ID NO: 30880 - RNA, 25 nt, Human
ucuucccuguugccuagaagggcuc

SEQ ID NO: 30881 - RNA, 23 nt, Human
ggacaagcaguccuuacuuuggg

SEQ ID NO: 30882 - RNA, 22 nt, Human
uaauauacaaacuucuacuuuc

SEQ ID NO: 30883 - RNA, 20 nt, Human
ggguccugccuucgacacca

SEQ ID NO: 30884 - RNA, 27 nt, Human
ucugcucccugcaagcuccgccucccg

SEQ ID NO: 30885 - RNA, 22 nt, Human
gcccaggcuggaguacaguggu

SEQ ID NO: 30886 - RNA, 22 nt, Human
gcccagacuggagugcaguggu

SEQ ID NO: 30887 - RNA, 24 nt, Human
cuggacagcuacggcgccgaaaga

SEQ ID NO: 30888 - RNA, 29 nt, Human
uaccagguuuuacacuugcaucucuaaua

SEQ ID NO: 30889 - RNA, 21 nt, Human
uaagauaaaauuccacaaaaa

SEQ ID NO: 30890 - RNA, 22 nt, Human
gucccuugaucucucauacuuu

SEQ ID NO: 30891 - RNA, 22 nt, Human
gaggagacuuggucacugugaa

SEQ ID NO: 30892 - RNA, 27 nt, Human
cuggaguggcuggauguggagcaccgc

SEQ ID NO: 30893 - RNA, 27 nt, Human
ggucucgaucuccugaccucgugaugg

SEQ ID NO: 30894 - RNA, 25 nt, Human
cuggccuggccugugccgccccugc

SEQ ID NO: 30895 - RNA, 19 nt, Human
ucucucugugucugugcca

SEQ ID NO: 30896 - RNA, 24 nt, Human
cuggcugcagagcaucccugggag

SEQ ID NO: 30897 - RNA, 22 nt, Human
gggggugccucacgaagcaucc

SEQ ID NO: 30898 - RNA, 22 nt, Human
gcccaggcuggagugcaaugac

SEQ ID NO: 30899 - RNA, 21 nt, Human
aggacucgggaucuucaucgg

SEQ ID NO: 30900 - RNA, 24 nt, Human
uccuccuccauccuucauucuuca

SEQ ID NO: 30901 - RNA, 25 nt, Human
acccaggcuggagugcaguagcgcg

SEQ ID NO: 30902 - RNA, 25 nt, Human
ucuccauccuucauccuccauuggu

SEQ ID NO: 30903 - RNA, 21 nt, Human
aguucccagcuaucuccccug

SEQ ID NO: 30904 - RNA, 23 nt, Human
gccauuggcaccagaaauuacaa

SEQ ID NO: 30905 - RNA, 22 nt, Human
uaugaggguccucucuggcacu

SEQ ID NO: 30906 - RNA, 20 nt, Human
cagaagagaauccaccugca

SEQ ID NO: 30907 - RNA, 18 nt, Human
acaaagaagauggaagau

SEQ ID NO: 30908 - RNA, 27 nt, Human
gccccaucaugggccugaaaggcagag

SEQ ID NO: 30909 - RNA, 23 nt, Human
ggaggcuggaagcugggagguca

SEQ ID NO: 30910 - RNA, 31 nt, Human
ucuacauggcaucuuuccuuaccucuaugug

SEQ ID NO: 30911 - RNA, 26 nt, Human
gacuagggaggguagcaccugccuca

SEQ ID NO: 30912 - RNA, 20 nt, Human
gccugcgccuuuccuccucc

SEQ ID NO: 30913 - RNA, 20 nt, Human
uuagugagaggugaagccag

SEQ ID NO: 30914 - RNA, 24 nt, Human
cuugccgacucguuggagaacaau

SEQ ID NO: 30915 - RNA, 25 nt, Human
ugguuacucacaccuguaaucccag

SEQ ID NO: 30916 - RNA, 22 nt, Human
ccacaauagacaucaucguuug

SEQ ID NO: 30917 - RNA, 20 nt, Human
ccagccuggugacagaguga

SEQ ID NO: 30918 - RNA, 28 nt, Human
ccugagcaggaagcccguuuccugggau

SEQ ID NO: 30919 - RNA, 32 nt, Human
cccuuucugcccuccugcuccagccccacuuc

SEQ ID NO: 30920 - RNA, 21 nt, Human
auuuguccagugccccaucau

SEQ ID NO: 30921 - RNA, 29 nt, Human
ucauauaucaaaucaucucuuuaaccuaa

SEQ ID NO: 30922 - RNA, 20 nt, Human
agaguauuuuguuuggcaga

SEQ ID NO: 30923 - RNA, 20 nt, Human
ggccucccugaacauaggaa

SEQ ID NO: 30924 - RNA, 22 nt, Human
uacaagcaccagccaccaugcc

SEQ ID NO: 30925 - RNA, 27 nt, Human
uccugcacugugucucccacacugaga

SEQ ID NO: 30926 - RNA, 28 nt, Human
uggcagggguggggguugcuaaggaaag

SEQ ID NO: 30927 - RNA, 24 nt, Human
cugcagugggggucgcugggggug

SEQ ID NO: 30928 - RNA, 22 nt, Human
gaccagccuguccaacauggug

SEQ ID NO: 30929 - RNA, 22 nt, Human
uggaagaagaaaaauucccaga

SEQ ID NO: 30930 - RNA, 21 nt, Human
uaaugggcuucuuuaaauucu

SEQ ID NO: 30931 - RNA, 29 nt, Human
gccuggagucagcaaccagccucuacagc

SEQ ID NO: 30932 - RNA, 23 nt, Human
ugugcauaaaccuagauauacca

SEQ ID NO: 30933 - RNA, 15 nt, Human
cuucccuuuaggaca

SEQ ID NO: 30934 - RNA, 22 nt, Human
ggcuccauuaggauuugccccu

SEQ ID NO: 30935 - RNA, 24 nt, Human
ucugggcaucacggcagugucacg

SEQ ID NO: 30936 - RNA, 26 nt, Human
uuugcuccuguucugucacuugucau

SEQ ID NO: 30937 - RNA, 20 nt, Human
cucgugauccgccugccucu

SEQ ID NO: 30938 - RNA, 17 nt, Human
agccucuccacucaugu

SEQ ID NO: 30939 - RNA, 27 nt, Human
ugccuguaaucccagcuacgcaggagg

SEQ ID NO: 30940 - RNA, 22 nt, Human
aguaauuuuguguuuucuugag

SEQ ID NO: 30941 - RNA, 26 nt, Human
cugcugucugacacuguccuguugau

SEQ ID NO: 30942 - RNA, 27 nt, Human
auuucuucuuuuuaauacacuuaacuc

SEQ ID NO: 30943 - RNA, 25 nt, Human
gcggguggagggcccugagguggca

SEQ ID NO: 30944 - RNA, 21 nt, Human
gcagugagccaagaucauacc

SEQ ID NO: 30945 - RNA, 21 nt, Human
gcagugagcuaagaucacacc

SEQ ID NO: 30946 - RNA, 21 nt, Human
gcagugagcugagaucacgcc

SEQ ID NO: 30947 - RNA, 27 nt, Human
cucuuucauggccguggugucuuccag

SEQ ID NO: 30948 - RNA, 21 nt, Human
gcacuguagggcugggcgcag

SEQ ID NO: 30949 - RNA, 26 nt, Human
caagccccuuaguccccaagccccuc

SEQ ID NO: 30950 - RNA, 24 nt, Human
aggaaaggagggaaaguuccagca

SEQ ID NO: 30951 - RNA, 22 nt, Human
cuguccugauccugguccugaa

SEQ ID NO: 30952 - RNA, 22 nt, Human
auggaaagugagugccuacaga

SEQ ID NO: 30953 - RNA, 19 nt, Human
aggaccuucccaucuggga

SEQ ID NO: 30954 - RNA, 19 nt, Human
ccacaaccuugcaguauuu

SEQ ID NO: 30955 - RNA, 19 nt, Human
guugccuugguccuagcca

SEQ ID NO: 30956 - RNA, 22 nt, Human
aguggcacgaucuuggcucacu

SEQ ID NO: 30957 - RNA, 30 nt, Human
gcuaugccugucgaauucaccaucccagcc

SEQ ID NO: 30958 - RNA, 21 nt, Human
guccuccugggcccugaggcc

SEQ ID NO: 30959 - RNA, 25 nt, Human
uacuggcaauacuccagccugguga

SEQ ID NO: 30960 - RNA, 23 nt, Human
gggugagggagacuggggccugg

SEQ ID NO: 30961 - RNA, 23 nt, Human
cuccugccucagccucccaagca

SEQ ID NO: 30962 - RNA, 26 nt, Human
cgucaugccggggauaguggagcugc

SEQ ID NO: 30963 - RNA, 24 nt, Human
ccuggcaaggccuggugagagcca

SEQ ID NO: 30964 - RNA, 20 nt, Human
ggaugcacacauuagaguag

SEQ ID NO: 30965 - RNA, 24 nt, Human
ccuggccagcugcucagaccagcu

SEQ ID NO: 30966 - RNA, 25 nt, Human
ugcccuauccuggaagaugggggcc

SEQ ID NO: 30967 - RNA, 22 nt, Human
uuccagcgauucuccugccuca

SEQ ID NO: 30968 - RNA, 22 nt, Human
uuuacucagcaugacuguagau

SEQ ID NO: 30969 - RNA, 25 nt, Human
gggcaccaggcccacccaacugaag

SEQ ID NO: 30970 - RNA, 24 nt, Human
uucucaaauauccuugauuuugga

SEQ ID NO: 30971 - RNA, 21 nt, Human
agcucugaccagacuugcugu

SEQ ID NO: 30972 - RNA, 25 nt, Human
ggagguggagguugcaguaagcuga

SEQ ID NO: 30973 - RNA, 17 nt, Human
ugcucuccuccaccuca

SEQ ID NO: 30974 - RNA, 22 nt, Human
gcaaauuagacaaaacccagaa

SEQ ID NO: 30975 - RNA, 21 nt, Human
agaaggaggggacagaggagc

SEQ ID NO: 30976 - RNA, 26 nt, Human
ggggugggggccagaggauucagggc

SEQ ID NO: 30977 - RNA, 27 nt, Human
accagcccagccaacauggcaaaaccc

SEQ ID NO: 30978 - RNA, 20 nt, Human
gcaagcuggcgaacagcccu

SEQ ID NO: 30979 - RNA, 24 nt, Human
gccuuccugcaaccuuugcggcuc

SEQ ID NO: 30980 - RNA, 22 nt, Human
caggaguuugaugaugcaaagu

SEQ ID NO: 30981 - RNA, 22 nt, Human
uggggagaaaccuacagaauac

SEQ ID NO: 30982 - RNA, 22 nt, Human
ccuggcuggcccugggggcugc

SEQ ID NO: 30983 - RNA, 19 nt, Human
acauucuucuauuuugcca

SEQ ID NO: 30984 - RNA, 22 nt, Human
aaggaugaacaauuauauuuau

SEQ ID NO: 30985 - RNA, 19 nt, Human
gugggguagggaggagugu

SEQ ID NO: 30986 - RNA, 20 nt, Human
aauagaguggucuguguuau

SEQ ID NO: 30987 - RNA, 19 nt, Human
ggucccuacucaacaaaau

SEQ ID NO: 30988 - RNA, 23 nt, Human
ugcagccucugccacccagauuc

SEQ ID NO: 30989 - RNA, 22 nt, Human
aggcugagagaggagauuugcu

SEQ ID NO: 30990 - RNA, 25 nt, Human
ugcaucccuccucugcucuccauca

SEQ ID NO: 30991 - RNA, 19 nt, Human
guggagcucugagaauaca

SEQ ID NO: 30992 - RNA, 21 nt, Human
ugaacaaauuuucuggugcua

SEQ ID NO: 30993 - RNA, 27 nt, Human
ccugaaacagagcaugcuuuccagaaa

SEQ ID NO: 30994 - RNA, 23 nt, Human
guuuuuccuguaccgggucaugg

SEQ ID NO: 30995 - RNA, 19 nt, Human
cccagaagguucucuugua

SEQ ID NO: 30996 - RNA, 21 nt, Human
caggucagugcucagaugugu

SEQ ID NO: 30997 - RNA, 21 nt, Human
cgguucgggucgcagagccag

SEQ ID NO: 30998 - RNA, 26 nt, Human
uugccucccuuccuccgcuccccuuu

SEQ ID NO: 30999 - RNA, 17 nt, Human
gggcuccucccaccucc

SEQ ID NO: 31000 - RNA, 20 nt, Human
ggagaggggagcuguguagu

SEQ ID NO: 31001 - RNA, 26 nt, Human
ggcaccuguaaucccagcuacucggg

SEQ ID NO: 31002 - RNA, 22 nt, Human
cucaaacaccgucagaugcauu

SEQ ID NO: 31003 - RNA, 20 nt, Human
cuugcuuguucugagggugg

SEQ ID NO: 31004 - RNA, 22 nt, Human
uguuccucuuccagcugucccc

SEQ ID NO: 31005 - RNA, 27 nt, Human
ccacugcacucaaccuuaagaccuacu

SEQ ID NO: 31006 - RNA, 18 nt, Human
cugcucccucucucuguc

SEQ ID NO: 31007 - RNA, 19 nt, Human
cccagucccuucucuccag

SEQ ID NO: 31008 - RNA, 26 nt, Human
gagacauuucuggauccaggccaggu

SEQ ID NO: 31009 - RNA, 20 nt, Human
ucucuaaaggaagaaauaca

SEQ ID NO: 31010 - RNA, 22 nt, Human
ggccuccuaaagugcugggauc

SEQ ID NO: 31011 - RNA, 19 nt, Human
guuccauucucaccuaucc

SEQ ID NO: 31012 - RNA, 22 nt, Human
agugacucugugcuugucuguu

SEQ ID NO: 31013 - RNA, 26 nt, Human
gacuauucaacauaaauugaaucuuu

SEQ ID NO: 31014 - RNA, 23 nt, Human
gguaggcaaaggugggaggauca

SEQ ID NO: 31015 - RNA, 29 nt, Human
ccggggggcgcggagguuggagagaggag

SEQ ID NO: 31016 - RNA, 25 nt, Human
ggcuagaagcccuacagcugccuuc

SEQ ID NO: 31017 - RNA, 19 nt, Human
ccacgaguucaaggcugca

SEQ ID NO: 31018 - RNA, 23 nt, Human
auucacaagccuccuguaccuca

SEQ ID NO: 31019 - RNA, 20 nt, Human
cacauuuuuugcagcuuuaa

SEQ ID NO: 31020 - RNA, 19 nt, Human
ccagcacuuugggaagccg

SEQ ID NO: 31021 - RNA, 22 nt, Human
aggcuagaaucaaaaacaaguu

SEQ ID NO: 31022 - RNA, 22 nt, Human
ccaacaugguaaaacuccauuu

SEQ ID NO: 31023 - RNA, 27 nt, Human
agcacauaauuacuaccuuccccuugg

SEQ ID NO: 31024 - RNA, 23 nt, Human
acuauuuaaaugagacaaucaua

SEQ ID NO: 31025 - RNA, 16 nt, Human
ucaagacgcggagcag

SEQ ID NO: 31026 - RNA, 22 nt, Human
ggacucagcucugucugcucaa

SEQ ID NO: 31027 - RNA, 22 nt, Human
ucuuauuuucaagagaauuuau

SEQ ID NO: 31028 - RNA, 22 nt, Human
agaccagccuggacaacacagu

SEQ ID NO: 31029 - RNA, 22 nt, Human
gccuccugaauuaacuaucauc

SEQ ID NO: 31030 - RNA, 21 nt, Human
ggcaggaccuagcuguuguaa

SEQ ID NO: 31031 - RNA, 19 nt, Human
gcagacagaccaggaacac

SEQ ID NO: 31032 - RNA, 23 nt, Human
cucuuagguaccaccucauggag

SEQ ID NO: 31033 - RNA, 20 nt, Human
cccccuccuggggugcagug

SEQ ID NO: 31034 - RNA, 22 nt, Human
ucugucacccaggcugcagugu

SEQ ID NO: 31035 - RNA, 25 nt, Human
gacuccagacugaauuuuaauucaa

SEQ ID NO: 31036 - RNA, 24 nt, Human
ucuaggguuuuccaaugugacuaa

SEQ ID NO: 31037 - RNA, 21 nt, Human
acuagaauggagguagaaaga

SEQ ID NO: 31038 - RNA, 25 nt, Human
uccagaccccauauuccucagacuc

SEQ ID NO: 31039 - RNA, 22 nt, Human
ccugaguagcugggaugacagg

SEQ ID NO: 31040 - RNA, 23 nt, Human
aggaaauacuuugcauaaauuaa

SEQ ID NO: 31041 - RNA, 27 nt, Human
ggaggcugaggacugcaagaggagagc

SEQ ID NO: 31042 - RNA, 27 nt, Human
augccugaggaaauacauuuuucuuaa

SEQ ID NO: 31043 - RNA, 22 nt, Human
accacuccucauguaaucuuug

SEQ ID NO: 31044 - RNA, 26 nt, Human
caucucucuuccagcugcuucaggga

SEQ ID NO: 31045 - RNA, 20 nt, Human
cacuccacuuuuuaacucgu

SEQ ID NO: 31046 - RNA, 27 nt, Human
gaaaugcugccauuagcagguuucuug

SEQ ID NO: 31047 - RNA, 27 nt, Human
ugcuucaaaguauugcuggcaaguggc

SEQ ID NO: 31048 - RNA, 24 nt, Human
ucagcgggcguggaggucgcggcg

SEQ ID NO: 31049 - RNA, 22 nt, Human
ccuuggccucugcuaaggugua

SEQ ID NO: 31050 - RNA, 25 nt, Human
uguaaccuugaauuaggcagugguu

SEQ ID NO: 31051 - RNA, 26 nt, Human
ugcugccucuugaaugcagggacaaa

SEQ ID NO: 31052 - RNA, 21 nt, Human
agcucccgagcagcuaggacu

SEQ ID NO: 31053 - RNA, 24 nt, Human
ucuaugacucuugucuccuccucc

SEQ ID NO: 31054 - RNA, 27 nt, Human
gccccuggcugagugugcuggagugag

SEQ ID NO: 31055 - RNA, 18 nt, Human
uuugugugcauguguaua

SEQ ID NO: 31056 - RNA, 22 nt, Human
cgauuaguucuaaaaucuuauu

SEQ ID NO: 31057 - RNA, 25 nt, Human
uuauccuguauaccuccuccagcca

SEQ ID NO: 31058 - RNA, 23 nt, Human
gucacccaggcuggagugcagua

SEQ ID NO: 31059 - RNA, 25 nt, Human
cuugucucccaggcuggagugcaau

SEQ ID NO: 31060 - RNA, 25 nt, Human
cucucaugcuguuucucuguuugcu

SEQ ID NO: 31061 - RNA, 23 nt, Human
aggccugggaugcagugauguga

SEQ ID NO: 31062 - RNA, 22 nt, Human
acccuuccugauuauucaccuu

SEQ ID NO: 31063 - RNA, 24 nt, Human
gggaggguggcuuugcuguuguug

SEQ ID NO: 31064 - RNA, 20 nt, Human
cagaccugcacccagucaca

SEQ ID NO: 31065 - RNA, 21 nt, Human
gggcucccacccucugcuccu

SEQ ID NO: 31066 - RNA, 27 nt, Human
gaggggucaguagcagaagcagaggga

SEQ ID NO: 31067 - RNA, 22 nt, Human
gcuagaugcuuuccuaaaucag

SEQ ID NO: 31068 - RNA, 21 nt, Human
acugaggcuuaggccucucug

SEQ ID NO: 31069 - RNA, 23 nt, Human
ccugaggcugccccggccgccug

SEQ ID NO: 31070 - RNA, 20 nt, Human
guggauuugagcucugugau

SEQ ID NO: 31071 - RNA, 22 nt, Human
gggagguugugguugcagugag

SEQ ID NO: 31072 - RNA, 23 nt, Human
gcugcccaggcuagagugcagug

SEQ ID NO: 31073 - RNA, 21 nt, Human
agcacacaccauauuucaaau

SEQ ID NO: 31074 - RNA, 24 nt, Human
uuccaguuuucaggcaguuauuuu

SEQ ID NO: 31075 - RNA, 24 nt, Human
gagcucagguaacguuggaucuua

SEQ ID NO: 31076 - RNA, 22 nt, Human
ucacaucuuuuaaucuugaaga

SEQ ID NO: 31077 - RNA, 26 nt, Human
ccacuggguuacagaaucacagcccu

SEQ ID NO: 31078 - RNA, 24 nt, Human
ugcugcuccugggccugcugcugc

SEQ ID NO: 31079 - RNA, 20 nt, Human
auauguauacauauuacaca

SEQ ID NO: 31080 - RNA, 26 nt, Human
uucuugaauuuaaucugggcacuuug

SEQ ID NO: 31081 - RNA, 27 nt, Human
gcugcugcuuagcuugcaccuugucac

SEQ ID NO: 31082 - RNA, 24 nt, Human
ggguguguuuguggacaaauaaau

SEQ ID NO: 31083 - RNA, 27 nt, Human
gccagugcuguuucccggccuccagac

SEQ ID NO: 31084 - RNA, 18 nt, Human
agacuuuuguucuguuuu

SEQ ID NO: 31085 - RNA, 21 nt, Human
agacaggggcgaccugugauu

SEQ ID NO: 31086 - RNA, 25 nt, Human
aucuaauuugaguuccuuuaaagau

SEQ ID NO: 31087 - RNA, 26 nt, Human
acucacuguguauucucuuggagccu

SEQ ID NO: 31088 - RNA, 24 nt, Human
ccagguuuucccuaagaagauguu

SEQ ID NO: 31089 - RNA, 24 nt, Human
ucccaaaucugucagcaucuggcu

SEQ ID NO: 31090 - RNA, 21 nt, Human
uaauaauaagaaaaaggccau

SEQ ID NO: 31091 - RNA, 24 nt, Human
ugccucucuaagugggucaguauc

SEQ ID NO: 31092 - RNA, 19 nt, Human
agcugggugugguggugca

SEQ ID NO: 31093 - RNA, 23 nt, Human
cgcuuccggacccgggaucagag

SEQ ID NO: 31094 - RNA, 20 nt, Human
ccuccugaaccacuggcccc

SEQ ID NO: 31095 - RNA, 27 nt, Human
cugguucaagcgauucuccugccucag

SEQ ID NO: 31096 - RNA, 21 nt, Human
caaccugacuuccucugccac

SEQ ID NO: 31097 - RNA, 27 nt, Human
gaggaagaagacacauuccuaguuccc

SEQ ID NO: 31098 - RNA, 22 nt, Human
acauguauauacacacagacac

SEQ ID NO: 31099 - RNA, 24 nt, Human
uguccagccccucaguauuaccau

SEQ ID NO: 31100 - RNA, 20 nt, Human
cuccuaucuucugaauucua

SEQ ID NO: 31101 - RNA, 22 nt, Human
caucacacuccagccuaggcga

SEQ ID NO: 31102 - RNA, 23 nt, Human
cacccaggcugggaauugcagug

SEQ ID NO: 31103 - RNA, 18 nt, Human
ccucuuugaccucacccc

SEQ ID NO: 31104 - RNA, 21 nt, Human
uacucugcuacuauguccuca

SEQ ID NO: 31105 - RNA, 24 nt, Human
uuggcugcgccgccugugcauuug

SEQ ID NO: 31106 - RNA, 22 nt, Human
aauuacaggguuagcaaaaaga

SEQ ID NO: 31107 - RNA, 27 nt, Human
aaaagagauagcaucuucuuuggcaca

SEQ ID NO: 31108 - RNA, 20 nt, Human
ggaugaagccuaagccagcu

SEQ ID NO: 31109 - RNA, 21 nt, Human
cugcccagggaggaggccuug

SEQ ID NO: 31110 - RNA, 27 nt, Human
cuggcugucugccucuagaacucucca

SEQ ID NO: 31111 - RNA, 22 nt, Human
caguaacuuaaggaaugaucau

SEQ ID NO: 31112 - RNA, 27 nt, Human
gccgcaucuucuccaucuggcagggug

SEQ ID NO: 31113 - RNA, 20 nt, Human
uuugcucugugcugacugug

SEQ ID NO: 31114 - RNA, 20 nt, Human
ccaagcccagcccuaggagg

SEQ ID NO: 31115 - RNA, 27 nt, Human
ggaccucaacgggcaaaguugugcaca

SEQ ID NO: 31116 - RNA, 21 nt, Human
uguuuucuaguugcuuccuca

SEQ ID NO: 31117 - RNA, 26 nt, Human
cagaggugugugugaggcugccagaa

SEQ ID NO: 31118 - RNA, 22 nt, Human
gaccugugcuucuuuacuccaa

SEQ ID NO: 31119 - RNA, 23 nt, Human
uguuccccugcccuccuuucuca

SEQ ID NO: 31120 - RNA, 24 nt, Human
ucugccugccgccugccugccugc

SEQ ID NO: 31121 - RNA, 21 nt, Human
agacucacccacccucucccu

SEQ ID NO: 31122 - RNA, 22 nt, Human
gcaccaaaaaugugaaaaagaa

SEQ ID NO: 31123 - RNA, 21 nt, Human
ugaggggaccaaagccaccaa

SEQ ID NO: 31124 - RNA, 27 nt, Human
cagaagccaagcugcuucccgccuaga

SEQ ID NO: 31125 - RNA, 24 nt, Human
agauccuuguguuuaucagaaagg

SEQ ID NO: 31126 - RNA, 21 nt, Human
gucgcccaggcgccccgcaau

SEQ ID NO: 31127 - RNA, 20 nt, Human
gaaugaauggagaaaugcca

SEQ ID NO: 31128 - RNA, 26 nt, Human
gggacccccuccccauguggaucugc

SEQ ID NO: 31129 - RNA, 24 nt, Human
uucucucuugcauagauacaauca

SEQ ID NO: 31130 - RNA, 29 nt, Human
gaccaccucccugcccuguccuccagcuu

SEQ ID NO: 31131 - RNA, 22 nt, Human
ccgguggcggcgcggaggcaga

SEQ ID NO: 31132 - RNA, 27 nt, Human
uugggguaauauuuaaaaugagagaca

SEQ ID NO: 31133 - RNA, 22 nt, Human
ggccugccaaagugcugggauu

SEQ ID NO: 31134 - RNA, 22 nt, Human
gagccccagagucagcucgugu

SEQ ID NO: 31135 - RNA, 21 nt, Human
gaaguuaaagguuacuuugga

SEQ ID NO: 31136 - RNA, 22 nt, Human
auacaggcauacacaugcacgc

SEQ ID NO: 31137 - RNA, 20 nt, Human
ccaagagaaaggguguauug

SEQ ID NO: 31138 - RNA, 21 nt, Human
aagcugcugggugcgaaggca

SEQ ID NO: 31139 - RNA, 21 nt, Human
gcagugagccuugaucacgcc

SEQ ID NO: 31140 - RNA, 28 nt, Human
gggaaggagagaaaauggcggcggagcc

SEQ ID NO: 31141 - RNA, 31 nt, Human; identical to SEQ ID NO: 6419

SEQ ID NO: 31142 - RNA, 23 nt, Human
ccuuuccuuuguagucucuggca

SEQ ID NO: 31143 - RNA, 27 nt, Human
ugccuguaaucccagcacuuggggagg

SEQ ID NO: 31144 - RNA, 23 nt, Human
gccuggggacaguggagcauaug

SEQ ID NO: 31145 - RNA, 21 nt, Human
gggaggcauuuugaagauaga

SEQ ID NO: 31146 - RNA, 26 nt, Human
gagggagagguuuuuauugagcuugu

SEQ ID NO: 31147 - RNA, 19 nt, Human
guucuugucucuggccaga

SEQ ID NO: 31148 - RNA, 26 nt, Human
gaagaccucuggcuuuccuggaacac

SEQ ID NO: 31149 - RNA, 27 nt, Human
augagacaaagcugacuguucacacug

SEQ ID NO: 31150 - RNA, 26 nt, Human
gugaccacaugggccuguuuucaggg

SEQ ID NO: 31151 - RNA, 23 nt, Human
ccaaugucauauccaccaggacc

SEQ ID NO: 31152 - RNA, 21 nt, Human
cgacaccuccgcgggcacuca

SEQ ID NO: 31153 - RNA, 20 nt, Human
cuugccucggcuccugcugc

SEQ ID NO: 31154 - RNA, 21 nt, Human
gaaccuccaccccuccagugg

SEQ ID NO: 31155 - RNA, 26 nt, Human
cugcuugugcggcgaugaucuguuug

SEQ ID NO: 31156 - RNA, 21 nt, Human
ccuccuccugcucccggggcg

SEQ ID NO: 31157 - RNA, 20 nt, Human
gugcucuucaucaacuaaua

SEQ ID NO: 31158 - RNA, 22 nt, Human
agagaugucuucugggagccac

SEQ ID NO: 31159 - RNA, 21 nt, Human
agagccacugcugacucccac

SEQ ID NO: 31160 - RNA, 21 nt, Human
ccucuacugagucccuuagcc

SEQ ID NO: 31161 - RNA, 26 nt, Human
ccucuguugccaggcuagagugcagu

SEQ ID NO: 31162 - RNA, 23 nt, Human
ccucucaucgucuuuuaguucca

SEQ ID NO: 31163 - RNA, 30 nt, Human
agaggggaggggccuagggagccgcaccuu

SEQ ID NO: 31164 - RNA, 25 nt, Human
gacuggguagagguauguuugugaa

SEQ ID NO: 31165 - RNA, 25 nt, Human
ggggcaccccucugccuuggugugc

SEQ ID NO: 31166 - RNA, 21 nt, Human
cucuccucuauucuccauguc

SEQ ID NO: 31167 - RNA, 27 nt, Human
cuugcccccaccuugccccaggaaagg

SEQ ID NO: 31168 - RNA, 21 nt, Human
ccauauuuucaaggggugaaa

SEQ ID NO: 31169 - RNA, 24 nt, Human
cagucccacaacacugccaaaaau

SEQ ID NO: 31170 - RNA, 24 nt, Human
gaggacccgcagagguggcagcgg

SEQ ID NO: 31171 - RNA, 24 nt, Human
guucgugcugcaagugaucuguaa

SEQ ID NO: 31172 - RNA, 24 nt, Human
agauccccagccccuccucccuca

SEQ ID NO: 31173 - RNA, 25 nt, Human
cuacaucuguguuuuugcagugcca

SEQ ID NO: 31174 - RNA, 23 nt, Human
gcacuccucugggcugcucucaa

SEQ ID NO: 31175 - RNA, 21 nt, Human
cacccaggcuguggugcagua

SEQ ID NO: 31176 - RNA, 22 nt, Human
ugucuccaugggacgaucccag

SEQ ID NO: 31177 - RNA, 17 nt, Human
gaagaauugccuggaaa

SEQ ID NO: 31178 - RNA, 30 nt, Human
gggaacaagggaagagagagcaggagcugg

SEQ ID NO: 31179 - RNA, 22 nt, Human
aggaaagaggagauaaugugga

SEQ ID NO: 31180 - RNA, 26 nt, Human
cuuguaaauuacaucugucaugguuu

SEQ ID NO: 31181 - RNA, 26 nt, Human
ugugagauauauaaauacacauacac

SEQ ID NO: 31182 - RNA, 19 nt, Human
cggcuucuccccgcgggag

SEQ ID NO: 31183 - RNA, 27 nt, Human
agagugcugggauuacaauugugagcc

SEQ ID NO: 31184 - RNA, 22 nt, Human
agaggaucuuggcaucacccac

SEQ ID NO: 31185 - RNA, 25 nt, Human
augcagcuugcacacccaucaucuu

SEQ ID NO: 31186 - RNA, 27 nt, Human
cagcccaggucagcuguuacuuucuuu

SEQ ID NO: 31187 - RNA, 20 nt, Human
cgccaaggcuggagugcagu

SEQ ID NO: 31188 - RNA, 22 nt, Human
ucaacaugguguaaccccaucu

SEQ ID NO: 31189 - RNA, 21 nt, Human
caaguauuuaagccuaaagau

SEQ ID NO: 31190 - RNA, 22 nt, Human
cccuccacuccagaguugggug

SEQ ID NO: 31191 - RNA, 22 nt, Human
uagugcgcuccagccugggcaa

SEQ ID NO: 31192 - RNA, 25 nt, Human
cugccaaacgacugggaaaccaaaa

SEQ ID NO: 31193 - RNA, 23 nt, Human
cuuacucccuucccuucuacucu

SEQ ID NO: 31194 - RNA, 22 nt, Human
gacccugcuaaccacaaaaggg

SEQ ID NO: 31195 - RNA, 22 nt, Human
cccaaugcucuggagccacaag

SEQ ID NO: 31196 - RNA, 19 nt, Human
cugucuuggcuuucgugcu

SEQ ID NO: 31197 - RNA, 21 nt, Human
ccuguaauuccagcacuuugg

SEQ ID NO: 31198 - RNA, 21 nt, Human
ucuguaaucccagcacuuugg

SEQ ID NO: 31199 - RNA, 23 nt, Human
ggcuucugcuucugaccuucucc

SEQ ID NO: 31200 - RNA, 21 nt, Human
cucaggguagacaaccucagc

SEQ ID NO: 31201 - RNA, 23 nt, Human
ucauuuucagacuuuguacuuca

SEQ ID NO: 31202 - RNA, 20 nt, Human
gcgggcgucacguguguuca

SEQ ID NO: 31203 - RNA, 26 nt, Human
ccuuucuccuugagcucuuugacucc

SEQ ID NO: 31204 - RNA, 23 nt, Human
uuucugcugagaaccaaacugcu

SEQ ID NO: 31205 - RNA, 21 nt, Human
ccuguaauccuagcacuuugg

SEQ ID NO: 31206 - RNA, 26 nt, Human
gaccaaaauauacaugcagacuuguu

SEQ ID NO: 31207 - RNA, 27 nt, Human
uuguuggguauauuucucugucauuca

SEQ ID NO: 31208 - RNA, 22 nt, Human
aaacccagaaagaagaguggcu

SEQ ID NO: 31209 - RNA, 20 nt, Human
gucucaguuucacuuucaca

SEQ ID NO: 31210 - RNA, 22 nt, Human
ccggggaauguguagccuucag

SEQ ID NO: 31211 - RNA, 21 nt, Human
ugugucccucuaugagggccc

SEQ ID NO: 31212 - RNA, 20 nt, Human
uacuucagacauuuagagca

SEQ ID NO: 31213 - RNA, 27 nt, Human
acugcaucgggacuuuuuaauucuuca

SEQ ID NO: 31214 - RNA, 23 nt, Human
agugggaggagagggcagagguc

SEQ ID NO: 31215 - RNA, 27 nt, Human
accagccuggccaacauggcaaaaccc

SEQ ID NO: 31216 - RNA, 21 nt, Human
uuuccuguucagcauucuuag

SEQ ID NO: 31217 - RNA, 27 nt, Human
cagagcccagacccuggaggaaauccu

SEQ ID NO: 31218 - RNA, 20 nt, Human
ggcucgaggguggucugagc

SEQ ID NO: 31219 - RNA, 23 nt, Human
uggcauagagucaccuguuaugu

SEQ ID NO: 31220 - RNA, 26 nt, Human
cauuccuucuuuccuuccugccuuuu

SEQ ID NO: 31221 - RNA, 27 nt, Human
gcugcuugugaugagagccuccacacu

SEQ ID NO: 31222 - RNA, 23 nt, Human
cccaguggggacagggaggggga

SEQ ID NO: 31223 - RNA, 28 nt, Human
ccugcccacuuggccucagucuccccac

SEQ ID NO: 31224 - RNA, 25 nt, Human
agauuucucaugacgaguuaaugca

SEQ ID NO: 31225 - RNA, 24 nt, Human
ccagugcggcugccagguuccugu

SEQ ID NO: 31226 - RNA, 22 nt, Human
gaggcauuccuuaguuuccuca

SEQ ID NO: 31227 - RNA, 27 nt, Human
gggccugggacaguggcugcucuugac

SEQ ID NO: 31228 - RNA, 22 nt, Human
ccaaaaguuggccugaaacccu

SEQ ID NO: 31229 - RNA, 24 nt, Human
cuguuccaaccuccugcucuggga

SEQ ID NO: 31230 - RNA, 22 nt, Human
cacugcacuccagucuggguga

SEQ ID NO: 31231 - RNA, 22 nt, Human
cacuguacuccagccuggguga

SEQ ID NO: 31232 - RNA, 23 nt, Human
gcucaauaaaagaaucugauacu

SEQ ID NO: 31233 - RNA, 22 nt, Human
uccuucucagcacuuucccaug

SEQ ID NO: 31234 - RNA, 20 nt, Human
uccgcccaggcugggugcag

SEQ ID NO: 31235 - RNA, 25 nt, Human
agaaggaggaaguggaagggacagg

SEQ ID NO: 31236 - RNA, 23 nt, Human
cuguauuuuuaaauucugcuccu

SEQ ID NO: 31237 - RNA, 27 nt, Human
ucagcuugaaccugcuuccuggcucac

SEQ ID NO: 31238 - RNA, 18 nt, Human
cugaauguuugugucugu

SEQ ID NO: 31239 - RNA, 21 nt, Human
agaagcugaagaggagaucca

SEQ ID NO: 31240 - RNA, 23 nt, Human
gggggaugucuugagauguauua

SEQ ID NO: 31241 - RNA, 19 nt, Human
cuuggucuaggucucucca

SEQ ID NO: 31242 - RNA, 21 nt, Human
uucccaggcacucucuuuugg

SEQ ID NO: 31243 - RNA, 20 nt, Human
gaguucuccuuguacuugaa

SEQ ID NO: 31244 - RNA, 22 nt, Human
aggcugagguggcagaauagcu

SEQ ID NO: 31245 - RNA, 27 nt, Human
ugaucauaccaaacauuuccuaaacuc

SEQ ID NO: 31246 - RNA, 21 nt, Human
acuucuauauaugaaugucuu

SEQ ID NO: 31247 - RNA, 25 nt, Human
aggacagcugugguuugucacucug

SEQ ID NO: 31248 - RNA, 21 nt, Human
cuugcagaaaccacgagaaca

SEQ ID NO: 31249 - RNA, 27 nt, Human
agauuccugccuccccacuuugguuca

SEQ ID NO: 31250 - RNA, 24 nt, Human
ggaagaaaacagucauaugcugaa

SEQ ID NO: 31251 - RNA, 21 nt, Human
ugugauuucaaaauuaggcua

SEQ ID NO: 31252 - RNA, 21 nt, Human
cccaggagggcaggggcauug

SEQ ID NO: 31253 - RNA, 26 nt, Human
uggaaaugacuagagaggcagaggag

SEQ ID NO: 31254 - RNA, 27 nt, Human
gaccugacaggacaaccuaggggcagg

SEQ ID NO: 31255 - RNA, 21 nt, Human
aagaagcucuugaccaaguau

SEQ ID NO: 31256 - RNA, 21 nt, Human
ggguagcacuacuaaaaguuu

SEQ ID NO: 31257 - RNA, 14 nt, Human
agggucucacaaga

SEQ ID NO: 31258 - RNA, 29 nt, Human
cccucccuucucaccucuggagcugugcu

SEQ ID NO: 31259 - RNA, 19 nt, Human
ugugacugugaauugaaau

SEQ ID NO: 31260 - RNA, 21 nt, Human
cugccugguacugauaguagu

SEQ ID NO: 31261 - RNA, 27 nt, Human
ugacgcuugugacagugccucuuccag

SEQ ID NO: 31262 - RNA, 25 nt, Human
gcccaggcuggagugcaaugacaca

SEQ ID NO: 31263 - RNA, 18 nt, Human
aaaaaugaucaaaacaaa

SEQ ID NO: 31264 - RNA, 22 nt, Human
ccuguaaucccaguuacuuggg

SEQ ID NO: 31265 - RNA, 24 nt, Human
gcugcucuuaugccauuuguuuau

SEQ ID NO: 31266 - RNA, 22 nt, Human
ggaaagggggagaguugcccuu

SEQ ID NO: 31267 - RNA, 23 nt, Human
cuggaaggaagagguugcaguga

SEQ ID NO: 31268 - RNA, 22 nt, Human
ucucuugaauuucuaguuagca

SEQ ID NO: 31269 - RNA, 20 nt, Human
agcaagaagugggugggaga

SEQ ID NO: 31270 - RNA, 27 nt, Human
gucucuugaccuuuucuuaccuugcaa

SEQ ID NO: 31271 - RNA, 18 nt, Human
uuuacugacccuggggcu

SEQ ID NO: 31272 - RNA, 23 nt, Human
cagacagcugugauuauuuuuua

SEQ ID NO: 31273 - RNA, 24 nt, Human
acagcucucccucugugcugggcu

SEQ ID NO: 31274 - RNA, 19 nt, Human
gcucuugcaguccaaaggg

SEQ ID NO: 31275 - RNA, 17 nt, Human
gaagggaaaauauccau

SEQ ID NO: 31276 - RNA, 20 nt, Human
aaauggucuucaacaucuuu

SEQ ID NO: 31277 - RNA, 27 nt, Human
uguacugauaaaauacucuagccuggg

SEQ ID NO: 31278 - RNA, 23 nt, Human
uuuguuuaguuaaggugugcagu

SEQ ID NO: 31279 - RNA, 22 nt, Human
aguugguggaggcuucagggaa

SEQ ID NO: 31280 - RNA, 24 nt, Human
aaacucauuuuuauuuuauucuca

SEQ ID NO: 31281 - RNA, 26 nt, Human
uguuacccagcccggggcaggugcag

SEQ ID NO: 31282 - RNA, 17 nt, Human
guauuuauuucauucca

SEQ ID NO: 31283 - RNA, 25 nt, Human
gcccaggcuggagugcaauggcgcg

SEQ ID NO: 31284 - RNA, 25 nt, Human
acccaggcuggagugcaauggcgca

SEQ ID NO: 31285 - RNA, 28 nt, Human
ccugugucugcugagauucugcaaagag

SEQ ID NO: 31286 - RNA, 22 nt, Human
acauuucucaccaacuuucuua

SEQ ID NO: 31287 - RNA, 22 nt, Human
uuccucuuuaagaaaaaggaca

SEQ ID NO: 31288 - RNA, 23 nt, Human
gaaacuggauauuuuuagcacga

SEQ ID NO: 31289 - RNA, 24 nt, Human
gaccuguuucuuguaacuggguuc

SEQ ID NO: 31290 - RNA, 20 nt, Human
uccccacagccucugcugau

SEQ ID NO: 31291 - RNA, 27 nt, Human
uccagaaggagacaggcagagcugcuc

SEQ ID NO: 31292 - RNA, 27 nt, Human
ucacccaggaggauggcaaagagaguc

SEQ ID NO: 31293 - RNA, 30 nt, Human
cccuucgucugugggcaccagcacuucauu

SEQ ID NO: 31294 - RNA, 24 nt, Human
cccccaggccucaggcccagcacc

SEQ ID NO: 31295 - RNA, 22 nt, Human
cucuggucuggggaucaccuca

SEQ ID NO: 31296 - RNA, 24 nt, Human
aaccuauaaauuuguuucuuccaa

SEQ ID NO: 31297 - RNA, 20 nt, Human
ugccuguccaugcucuuugu

SEQ ID NO: 31298 - RNA, 22 nt, Human
augacagcuguagucauaucug

SEQ ID NO: 31299 - RNA, 23 nt, Human
cucccaggcugcuggagugcagu

SEQ ID NO: 31300 - RNA, 26 nt, Human
cgggaugucagcagacacacauggca

SEQ ID NO: 31301 - RNA, 25 nt, Human
aaucucucugaauccauuacuccau

SEQ ID NO: 31302 - RNA, 27 nt, Human
uacagaaguccuacuugacaaucacau

SEQ ID NO: 31303 - RNA, 24 nt, Human
aaagggagacagcuugcagauggc

SEQ ID NO: 31304 - RNA, 27 nt, Human
agugacaagugagccugcuucugucaa

SEQ ID NO: 31305 - RNA, 20 nt, Human
ucuuccguggggcauugauu

SEQ ID NO: 31306 - RNA, 23 nt, Human
gaccacaccccaaugccuuccca

SEQ ID NO: 31307 - RNA, 23 nt, Human
gggccucacucuccaccccuuca

SEQ ID NO: 31308 - RNA, 26 nt, Human
cacccuaccugccccccuggcuugag

SEQ ID NO: 31309 - RNA, 22 nt, Human
acuguuucccuuugauucucca

SEQ ID NO: 31310 - RNA, 23 nt, Human
cuuccucugaacaacaugaucuu

SEQ ID NO: 31311 - RNA, 24 nt, Human
cugucacccgagcuggagugcagu

SEQ ID NO: 31312 - RNA, 27 nt, Human
ucagcaucugaccaucugugacuauaa

SEQ ID NO: 31313 - RNA, 21 nt, Human
aaguuguauuaaaaauagaua

SEQ ID NO: 31314 - RNA, 26 nt, Human
agccccgcucugggcaccaccugccu

SEQ ID NO: 31315 - RNA, 23 nt, Human
aauaugcugcaacaaaauguaga

SEQ ID NO: 31316 - RNA, 21 nt, Human
agucaucuuagcuuuccacag

SEQ ID NO: 31317 - RNA, 20 nt, Human
cccacccggaaaccccaccu

SEQ ID NO: 31318 - RNA, 22 nt, Human
ggacaucccagcuggaguucaa

SEQ ID NO: 31319 - RNA, 26 nt, Human
cuggcauugggaggccaguuacugga

SEQ ID NO: 31320 - RNA, 19 nt, Human
uaucacugcagccugcuuu

SEQ ID NO: 31321 - RNA, 21 nt, Human
cuugggaugucugagaucagu

SEQ ID NO: 31322 - RNA, 22 nt, Human
gggcugaggugggcgaaucaug

SEQ ID NO: 31323 - RNA, 22 nt, Human
ugccuccaguaguaguauggca

SEQ ID NO: 31324 - RNA, 19 nt, Human
agucaucuuucccucacag

SEQ ID NO: 31325 - RNA, 22 nt, Human
ugcccccaggcuuuuuugcugu

SEQ ID NO: 31326 - RNA, 29 nt, Human
gcccuuguccccuccccuccuccccagcc

SEQ ID NO: 31327 - RNA, 26 nt, Human
ugguggaggucugaaugugaggcugg

SEQ ID NO: 31328 - RNA, 20 nt, Human
gccuacuucucaccugggcc

SEQ ID NO: 31329 - RNA, 22 nt, Human
gcacuucuggaacugugcuucu

SEQ ID NO: 31330 - RNA, 27 nt, Human
ggggugagggacaccagggaaugaccc

SEQ ID NO: 31331 - RNA, 27 nt, Human
gaguagcugggauuacaggugcccacc

SEQ ID NO: 31332 - RNA, 23 nt, Human
ugcuuuauggacacaaaaccaga

SEQ ID NO: 31333 - RNA, 21 nt, Human
ugagggaggcagaaaggccac

SEQ ID NO: 31334 - RNA, 20 nt, Human
gcaggccucccugaaacacu

SEQ ID NO: 31335 - RNA, 24 nt, Human
uagggaggcugaggcaggagaauc

SEQ ID NO: 31336 - RNA, 26 nt, Human
aggagcaaaggcugagaacacuguga

SEQ ID NO: 31337 - RNA, 22 nt, Human
cuccuggccuauccgcugccag

SEQ ID NO: 31338 - RNA, 25 nt, Human
aggccuucucuugaggccugugcuc

SEQ ID NO: 31339 - RNA, 32 nt, Human
gcugcuucccucaccugccugccugucucccu

SEQ ID NO: 31340 - RNA, 20 nt, Human
ucccacccucaccauuugca

SEQ ID NO: 31341 - RNA, 20 nt, Human
gggguggggccucagaugcu

SEQ ID NO: 31342 - RNA, 27 nt, Human
uucauaggcaaaaucugacaagacuga

SEQ ID NO: 31343 - RNA, 21 nt, Human
guuuacuugcuagaaaccauu

SEQ ID NO: 31344 - RNA, 23 nt, Human
gccuccaaacaacacugaauuug

SEQ ID NO: 31345 - RNA, 31 nt, Human
uugcuguuuaucagguugguuuagugauaau

SEQ ID NO: 31346 - RNA, 21 nt, Human
cucuguuuucucuugccaaag

SEQ ID NO: 31347 - RNA, 22 nt, Human
gcugggcugugagaaugagcug

SEQ ID NO: 31348 - RNA, 21 nt, Human
ccauuucucaaacccaccucg

SEQ ID NO: 31349 - RNA, 26 nt, Human
cggagcugcugcuucuacuuuggcug

SEQ ID NO: 31350 - RNA, 21 nt, Human
ucuuuuuucuuuuuuaaagac

SEQ ID NO: 31351 - RNA, 23 nt, Human
ggucccucaaagcuucuguggcu

SEQ ID NO: 31352 - RNA, 27 nt, Human
ccguacccucacccuuuucagcaaaga

SEQ ID NO: 31353 - RNA, 22 nt, Human
auugugaaggguuuacugcucc

SEQ ID NO: 31354 - RNA, 26 nt, Human
ccauuuuaaugaugaggaaacugagu

SEQ ID NO: 31355 - RNA, 23 nt, Human
ccauccuucuccaugacucugaa

SEQ ID NO: 31356 - RNA, 20 nt, Human
aucuucuuccaaauguacug

SEQ ID NO: 31357 - RNA, 23 nt, Human
cuuucuguugucuaccucaggcc

SEQ ID NO: 31358 - RNA, 27 nt, Human
ccacugcacuccagccucagcaauaga

SEQ ID NO: 31359 - RNA, 24 nt, Human
ccuuuuaccuuuaauuuuccugga

SEQ ID NO: 31360 - RNA, 25 nt, Human
ucagguguuuccguaccacagcagg

SEQ ID NO: 31361 - RNA, 21 nt, Human
ccaucauuccuucucuuguua

SEQ ID NO: 31362 - RNA, 27 nt, Human
ugucuuuggaaaauuacaacacugccu

SEQ ID NO: 31363 - RNA, 19 nt, Human
ggcuguguggacuugggga

SEQ ID NO: 31364 - RNA, 21 nt, Human
gauuucauaaggaaaaccacu

SEQ ID NO: 31365 - RNA, 22 nt, Human
gaguauuguaaauuuuacuggc

SEQ ID NO: 31366 - RNA, 22 nt, Human
caccacugcacuccggccuagg

SEQ ID NO: 31367 - RNA, 26 nt, Human
gacuccuggccuucuaugcccucuau

SEQ ID NO: 31368 - RNA, 27 nt, Human
uagcacaugcuuuugaaaaucugugau

SEQ ID NO: 31369 - RNA, 22 nt, Human
gacuuaaaugccuucuuaucca

SEQ ID NO: 31370 - RNA, 26 nt, Human
acaguacaucugaaaguaggaguuuu

SEQ ID NO: 31371 - RNA, 20 nt, Human
gaagcauuuguuucuacuuu

SEQ ID NO: 31372 - RNA, 27 nt, Human
agcaucuucagcacuuaccgauccaga

SEQ ID NO: 31373 - RNA, 25 nt, Human
guccccagccccaugaccuuccuuc

SEQ ID NO: 31374 - RNA, 24 nt, Human
agggaaaggcaggucuuucuggaa

SEQ ID NO: 31375 - RNA, 24 nt, Human
cagccucuccucugucucuccucg

SEQ ID NO: 31376 - RNA, 23 nt, Human
aaccuauauguuauaauauccaa

SEQ ID NO: 31377 - RNA, 19 nt, Human
cuccugcuccuuguuuucc

SEQ ID NO: 31378 - RNA, 21 nt, Human
ccucugggcccugcaggaggc

SEQ ID NO: 31379 - RNA, 21 nt, Human
ccugcugcgucucccuuccaa

SEQ ID NO: 31380 - RNA, 22 nt, Human
gcaccucucugggaaaacccag

SEQ ID NO: 31381 - RNA, 28 nt, Human
ggcccuccugcccagcugcucuugucag

SEQ ID NO: 31382 - RNA, 24 nt, Human
agcaagagacacuauuaccaaaga

SEQ ID NO: 31383 - RNA, 19 nt, Human
cucuaugcccgagucucaa

SEQ ID NO: 31384 - RNA, 22 nt, Human
aagcaacuagcugggcacagug

SEQ ID NO: 31385 - RNA, 20 nt, Human
cugaggccuugguucaugca

SEQ ID NO: 31386 - RNA, 26 nt, Human
agggacaaacuuuucccaaacccgau

SEQ ID NO: 31387 - RNA, 22 nt, Human
ugucuccaugcaacauucaaag

SEQ ID NO: 31388 - RNA, 22 nt, Human
ucugugggaggaaggaggcagg

SEQ ID NO: 31389 - RNA, 23 nt, Human
gucuuuggccuuuguuuagcuuu

SEQ ID NO: 31390 - RNA, 25 nt, Human
cuuaaaucucuuguauggcaaccaa

SEQ ID NO: 31391 - RNA, 24 nt, Human
gucuccugcccccacaccuggccc

SEQ ID NO: 31392 - RNA, 18 nt, Human
aguuuuuugcuuugucuu

SEQ ID NO: 31393 - RNA, 22 nt, Human
gugcacagaccacacagcacac

SEQ ID NO: 31394 - RNA, 22 nt, Human
gcgcaggcaaagagaagauggu

SEQ ID NO: 31395 - RNA, 22 nt, Human
ggcugggugucuggugccugga

SEQ ID NO: 31396 - RNA, 27 nt, Human
ccagcagcugcccaggacacagugcag

SEQ ID NO: 31397 - RNA, 17 nt, Human
cugccccugccuguguc

SEQ ID NO: 31398 - RNA, 23 nt, Human
cccugccucaguuuaccugcaca

SEQ ID NO: 31399 - RNA, 25 nt, Human
ucccaugagccucagcauccuggca

SEQ ID NO: 31400 - RNA, 22 nt, Human
uucaucaucagguaccuccucc

SEQ ID NO: 31401 - RNA, 27 nt, Human
uggccaacaugaugaaaccuugucuuu

SEQ ID NO: 31402 - RNA, 22 nt, Human
auugcuugaacccgggaggcgg

SEQ ID NO: 31403 - RNA, 23 nt, Human
ccaggaggcggagcuugcaguga

SEQ ID NO: 31404 - RNA, 24 nt, Human
cauucccuugauggucucaagcua

SEQ ID NO: 31405 - RNA, 20 nt, Human
acaguggguucuagcuuuga

SEQ ID NO: 31406 - RNA, 26 nt, Human
uuguucugccuguccuagucuccuuu

SEQ ID NO: 31407 - RNA, 21 nt, Human
uucucucuagccauugauuua

SEQ ID NO: 31408 - RNA, 26 nt, Human
cccaguaaggucaugugcuuccaccc

SEQ ID NO: 31409 - RNA, 23 nt, Human
uuccauaaugcuacugucucacu

SEQ ID NO: 31410 - RNA, 22 nt, Human
aucuguguucuaacuuauuuau

SEQ ID NO: 31411 - RNA, 24 nt, Human
uuugaauaaauuaaagcucuuaga

SEQ ID NO: 31412 - RNA, 23 nt, Human
ugguauuuauaaucaaugcugaa

SEQ ID NO: 31413 - RNA, 26 nt, Human
gcugcugaagccagggcaugggauua

SEQ ID NO: 31414 - RNA, 24 nt, Human
cccuggcucccugucccugggcuc

SEQ ID NO: 31415 - RNA, 22 nt, Human
cauugguuuuuaaauuuuuugu

SEQ ID NO: 31416 - RNA, 22 nt, Human
cacaucucagggaacugacccu

SEQ ID NO: 31417 - RNA, 21 nt, Human
acuguaaccucaaacucuggg

SEQ ID NO: 31418 - RNA, 28 nt, Human
gggaaaugagacuugcucucuggccuuu

SEQ ID NO: 31419 - RNA, 25 nt, Human
auuccaguguauuuucuguguuguu

SEQ ID NO: 31420 - RNA, 21 nt, Human
gcucacugcaagcuccgccuc

SEQ ID NO: 31421 - RNA, 22 nt, Human
ugggagccccgcagaugagguc

SEQ ID NO: 31422 - RNA, 20 nt, Human
gccugcucccuguagggucc

SEQ ID NO: 31423 - RNA, 24 nt, Human
aggaaaugagaaugacagccuuuu

SEQ ID NO: 31424 - RNA, 20 nt, Human
ccagguggcaggauguccug

SEQ ID NO: 31425 - RNA, 20 nt, Human
cagaauaaagcaaggcuccc

SEQ ID NO: 31426 - RNA, 30 nt, Human
ugucaaaaaacuucuucacugaaguuauac

SEQ ID NO: 31427 - RNA, 26 nt, Human
gccuucagaagaggcuaaaauaucca

SEQ ID NO: 31428 - RNA, 21 nt, Human
cauucagcagagugcgagugg

SEQ ID NO: 31429 - RNA, 29 nt, Human
auagccgccuccgccucugcccgccuccg

SEQ ID NO: 31430 - RNA, 26 nt, Human
uucaaacuuugagugacauuuagucc

SEQ ID NO: 31431 - RNA, 20 nt, Human
ccuguacuguguucuucaca

SEQ ID NO: 31432 - RNA, 28 nt, Human
ucuuggauuugaggagaguuuaugaauc

SEQ ID NO: 31433 - RNA, 23 nt, Human
guuacuucuccccuggguccucc

SEQ ID NO: 31434 - RNA, 19 nt, Human
cccuauacaacuuggcuuc

SEQ ID NO: 31435 - RNA, 17 nt, Human
cuuuguggcaggugccg

SEQ ID NO: 31436 - RNA, 22 nt, Human
cuggcccaggcuagagugcagu

SEQ ID NO: 31437 - RNA, 19 nt, Human
aaggaagguggugggggug

SEQ ID NO: 31438 - RNA, 21 nt, Human
cggagucucgcucugucgcca

SEQ ID NO: 31439 - RNA, 21 nt, Human
cggagucucacucugucacca

SEQ ID NO: 31440 - RNA, 25 nt, Human
gaaacuuaagcuaaagucuguuaua

SEQ ID NO: 31441 - RNA, 19 nt, Human
uccccaggugaacauggcu

SEQ ID NO: 31442 - RNA, 19 nt, Human
gcacagccccacaggcccu

SEQ ID NO: 31443 - RNA, 20 nt, Human
aguguaccucaaaaggggcc

SEQ ID NO: 31444 - RNA, 21 nt, Human
cgucuucaucucccugccauc

SEQ ID NO: 31445 - RNA, 22 nt, Human
ucucaguucugaaaauagauca

SEQ ID NO: 31446 - RNA, 20 nt, Human
agcccagccucucccugcca

SEQ ID NO: 31447 - RNA, 24 nt, Human
uucaguuccccaggcuccuccucc

SEQ ID NO: 31448 - RNA, 26 nt, Human
gguuguaaagcuacuuuauuagauau

SEQ ID NO: 31449 - RNA, 21 nt, Human
aaaccaccauggcacauguau

SEQ ID NO: 31450 - RNA, 27 nt, Human
aagagccucaauaaggacacccuggcg

SEQ ID NO: 31451 - RNA, 22 nt, Human
uauguuauuucuugcucuguua

SEQ ID NO: 31452 - RNA, 27 nt, Human
guugcccaggcuggagugcagaggugc

SEQ ID NO: 31453 - RNA, 27 nt, Human
acugagucuggacggcagaguggaggg

SEQ ID NO: 31454 - RNA, 22 nt, Human
ugcaguuggcugagaagaggaa

SEQ ID NO: 31455 - RNA, 23 nt, Human
aucacaccacugcacuccggccu

SEQ ID NO: 31456 - RNA, 26 nt, Human
gguuccccucacucccuuuuuuguca

SEQ ID NO: 31457 - RNA, 29 nt, Human
uggaaagaggaacagcugucuaucccuuc

SEQ ID NO: 31458 - RNA, 21 nt, Human
uagcuuuuuccuggaaaagcc

SEQ ID NO: 31459 - RNA, 29 nt, Human
ucacccaaauagcugagugcaguccuugc

SEQ ID NO: 31460 - RNA, 22 nt, Human
ggcugcaucacuaugugcccca

SEQ ID NO: 31461 - RNA, 20 nt, Human
uuuccauuugcuaucauguc

SEQ ID NO: 31462 - RNA, 26 nt, Human
uacuauauccauaucuauagauuuca

SEQ ID NO: 31463 - RNA, 27 nt, Human
agguacuugagggggacuggaggccgu

SEQ ID NO: 31464 - RNA, 23 nt, Human
gcgucucucacccaugcgacucg

SEQ ID NO: 31465 - RNA, 20 nt, Human
uuacuaauuugggcuuuuca

SEQ ID NO: 31466 - RNA, 20 nt, Human
acucacugaccuacuaguuu

SEQ ID NO: 31467 - RNA, 23 nt, Human
cucuccucaugucuccucauguc

SEQ ID NO: 31468 - RNA, 23 nt, Human
ggaugacucuguucacacccaau

SEQ ID NO: 31469 - RNA, 23 nt, Human
acucuuucuuugcaacagcagug

SEQ ID NO: 31470 - RNA, 22 nt, Human
guucuuaguuguaugucaucuc

SEQ ID NO: 31471 - RNA, 20 nt, Human
agagccacagccaccucuac

SEQ ID NO: 31472 - RNA, 31 nt, Human
uuuacccauuucccuuccccaaaccaugugc

SEQ ID NO: 31473 - RNA, 21 nt, Human
uuuccucuccuccaccauggu

SEQ ID NO: 31474 - RNA, 22 nt, Human
gcggcaagaccucucccccucg

SEQ ID NO: 31475 - RNA, 22 nt, Human
acuugagucuuuccacugggac

SEQ ID NO: 31476 - RNA, 20 nt, Human
cuuggaggcagcuugggagg

SEQ ID NO: 31477 - RNA, 24 nt, Human
ccuccuaccacaccacaccaggcc

SEQ ID NO: 31478 - RNA, 19 nt, Human
cuuaauguaucuggcauuu

SEQ ID NO: 31479 - RNA, 24 nt, Human
gagagggaguagagugaagccagc

SEQ ID NO: 31480 - RNA, 27 nt, Human
ccacugcacaccagcccagcucccgug

SEQ ID NO: 31481 - RNA, 15 nt, Human
acuaucuccuggccu

SEQ ID NO: 31482 - RNA, 25 nt, Human
acaccugagcccugccccacccugc

SEQ ID NO: 31483 - RNA, 20 nt, Human
aacuguacagauuuuuguau

SEQ ID NO: 31484 - RNA, 22 nt, Human
ucuuaaucugcaccuuucucca

SEQ ID NO: 31485 - RNA, 23 nt, Human
ugcuaaaacaacacgauuuacau

SEQ ID NO: 31486 - RNA, 23 nt, Human
acccaccgcaaccucauccccuc

SEQ ID NO: 31487 - RNA, 20 nt, Human
caccacacuggagggcacac

SEQ ID NO: 31488 - RNA, 24 nt, Human
uuacaucuuguugguaccuuucua

SEQ ID NO: 31489 - RNA, 27 nt, Human
ggggugaggguggcacccaggcagcug

SEQ ID NO: 31490 - RNA, 22 nt, Human
cacaggcaucuucaguuauugc

SEQ ID NO: 31491 - RNA, 22 nt, Human
cgaguuaguaaacaugagcgau

SEQ ID NO: 31492 - RNA, 24 nt, Human
agaaucuaaagggguauuagccag

SEQ ID NO: 31493 - RNA, 27 nt, Human
cucauuucuuaccauuuuauuccccuc

SEQ ID NO: 31494 - RNA, 20 nt, Human
uucccuagucaccagcuggu

SEQ ID NO: 31495 - RNA, 19 nt, Human
caucacuacaaaaagaagg

SEQ ID NO: 31496 - RNA, 24 nt, Human
gcacagccucaccccugcaggcgg

SEQ ID NO: 31497 - RNA, 27 nt, Human
ucugggagcgggcaguuggcgacccug

SEQ ID NO: 31498 - RNA, 26 nt, Human
acugccucugcucucuugucuucaga

SEQ ID NO: 31499 - RNA, 25 nt, Human
uauuucuugccaacaaauggcuaga

SEQ ID NO: 31500 - RNA, 27 nt, Human
ccuaagguaggcaggguauuuccuagu

SEQ ID NO: 31501 - RNA, 24 nt, Human
acugccuggguccuggcgccuggc

SEQ ID NO: 31502 - RNA, 21 nt, Human
acugcuugacccaggaacaag

SEQ ID NO: 31503 - RNA, 22 nt, Human
ugccagaauugaaccaacccaa

SEQ ID NO: 31504 - RNA, 19 nt, Human
caucucuucacaggcaugg

SEQ ID NO: 31505 - RNA, 20 nt, Human
cuuaagaggucgugguuccu

SEQ ID NO: 31506 - RNA, 21 nt, Human
cuuugauagccaccuccuagg

SEQ ID NO: 31507 - RNA, 20 nt, Human
ccacuugucuuaacucugaa

SEQ ID NO: 31508 - RNA, 19 nt, Human
cucuggaguguaagcacaa

SEQ ID NO: 31509 - RNA, 21 nt, Human
gccuuugccagcauguucaac

SEQ ID NO: 31510 - RNA, 26 nt, Human
uuuucugcugugaaaaugaaaaaaua

SEQ ID NO: 31511 - RNA, 21 nt, Human
gucuaacugccuuuccuucua

SEQ ID NO: 31512 - RNA, 27 nt, Human
uggggcaggcaggaggcagugggcuuc

SEQ ID NO: 31513 - RNA, 21 nt, Human
gaucauguuucuccaguauua

SEQ ID NO: 31514 - RNA, 25 nt, Human
agccuccuaugugugacuuaugacu

SEQ ID NO: 31515 - RNA, 26 nt, Human
aagugauccuaagaauguacaguuga

SEQ ID NO: 31516 - RNA, 21 nt, Human
ucuacuuuaaugucucuuucg

SEQ ID NO: 31517 - RNA, 26 nt, Human
gaggcugaggcagaagaaucgcuuga

SEQ ID NO: 31518 - RNA, 22 nt, Human
ccaguuaaugccugaaaccgcu

SEQ ID NO: 31519 - RNA, 25 nt, Human
uacugauuaaaaugucaauguaauc

SEQ ID NO: 31520 - RNA, 27 nt, Human
ucugggaguugagagcucugccagggu

SEQ ID NO: 31521 - RNA, 22 nt, Human
ccuucuuuccuggacuuaacuc

SEQ ID NO: 31522 - RNA, 19 nt, Human
uggguggaauggggcugaa

SEQ ID NO: 31523 - RNA, 24 nt, Human
caggacaucacaaggaccaaaaag

SEQ ID NO: 31524 - RNA, 22 nt, Human
gagcaagacuucgucucaaaau

SEQ ID NO: 31525 - RNA, 20 nt, Human
uuugagaccauugcauucug

SEQ ID NO: 31526 - RNA, 22 nt, Human
agccucccaagcaccugggauu

SEQ ID NO: 31527 - RNA, 22 nt, Human
gccuauaaucccagcauguuga

SEQ ID NO: 31528 - RNA, 25 nt, Human
ucggguggggagggagggcgcaggc

SEQ ID NO: 31529 - RNA, 23 nt, Human
ccaggcagcugccaagcacuccc

SEQ ID NO: 31530 - RNA, 18 nt, Human
gugaugcauucugccuuc

SEQ ID NO: 31531 - RNA, 19 nt, Human
gugaccagagggguuugug

SEQ ID NO: 31532 - RNA, 22 nt, Human
ggccugagcgcuccugccgcag

SEQ ID NO: 31533 - RNA, 21 nt, Human
gccgucuacuggaaaaaucga

SEQ ID NO: 31534 - RNA, 19 nt, Human
gcuauagaauacacuaugu

SEQ ID NO: 31535 - RNA, 20 nt, Human
ccagcacugccguauugcca

SEQ ID NO: 31536 - RNA, 21 nt, Human
ugccuacaucuucucucuucc

SEQ ID NO: 31537 - RNA, 22 nt, Human
uaaucagacaccagcugagugg

SEQ ID NO: 31538 - RNA, 20 nt, Human
ggugcaaaaaggaaaaagaa

SEQ ID NO: 31539 - RNA, 21 nt, Human
aagcuggcaaucugcaccuug

SEQ ID NO: 31540 - RNA, 19 nt, Human
caugcuguccacugugugg

SEQ ID NO: 31541 - RNA, 22 nt, Human
ucucacugccucucggugaccu

SEQ ID NO: 31542 - RNA, 22 nt, Human
ggaauguagacuguauauguuu

SEQ ID NO: 31543 - RNA, 19 nt, Human
ggcugcacuggaacaacac

SEQ ID NO: 31544 - RNA, 22 nt, Human
cucaugcaccuggauuaacuca

SEQ ID NO: 31545 - RNA, 27 nt, Human
uugcugaagcuucauccuuugcucuca

SEQ ID NO: 31546 - RNA, 25 nt, Human
uucccagagacaggaaaauccucug

SEQ ID NO: 31547 - RNA, 20 nt, Human
ccgucuccugcucuggacuu

SEQ ID NO: 31548 - RNA, 27 nt, Human
auacauacaaccuauguaauuuuuaaa

SEQ ID NO: 31549 - RNA, 16 nt, Human
cuucccuuucuaauca

SEQ ID NO: 31550 - RNA, 23 nt, Human
guugcccaggcuggucgugaacu

SEQ ID NO: 31551 - RNA, 22 nt, Human
aguaugucagcaccuuuucuca

SEQ ID NO: 31552 - RNA, 26 nt, Human
uuuaaaaaacaauuuuauuggccuuu

SEQ ID NO: 31553 - RNA, 22 nt, Human
uuuuaguaaaaaaggaacauga

SEQ ID NO: 31554 - RNA, 24 nt, Human
cauguagcuacaaauauuaaagga

SEQ ID NO: 31555 - RNA, 23 nt, Human
aaccaaugcuagaauuucuugcu

SEQ ID NO: 31556 - RNA, 23 nt, Human
uggggcccaggaaguggggaaga

SEQ ID NO: 31557 - RNA, 25 nt, Human
caccccugcuccagccucgauuugg

SEQ ID NO: 31558 - RNA, 19 nt, Human
cuucccuuuggagaugcug

SEQ ID NO: 31559 - RNA, 20 nt, Human
agugcuuggccuggcagugg

SEQ ID NO: 31560 - RNA, 27 nt, Human
ccagcacuuccggccugaccccugucc

SEQ ID NO: 31561 - RNA, 22 nt, Human
gguggaucacuggaggucaggu

SEQ ID NO: 31562 - RNA, 24 nt, Human
agaucugauuuauuuauuuugguu

SEQ ID NO: 31563 - RNA, 27 nt, Human
ggcugggauaaagacuucugcagaaga

SEQ ID NO: 31564 - RNA, 22 nt, Human
uuuucuauucuuuucccuugac

SEQ ID NO: 31565 - RNA, 25 nt, Human
cguagaauugcaggucucuguacag

SEQ ID NO: 31566 - RNA, 20 nt, Human
uuuauuguuuuuaaaaugaa

SEQ ID NO: 31567 - RNA, 31 nt, Human
acuguccuuccucucuggacuguaagaauau

SEQ ID NO: 31568 - RNA, 19 nt, Human
acccacgcuggagugcugu

SEQ ID NO: 31569 - RNA, 23 nt, Human
ugaggccauuuucagacaaguua

SEQ ID NO: 31570 - RNA, 19 nt, Human
acugcccuuuaauacacuc

SEQ ID NO: 31571 - RNA, 23 nt, Human
agggccgcggcucacaccugagc

SEQ ID NO: 31572 - RNA, 21 nt, Human
aacccuguuucuuuggugccu

SEQ ID NO: 31573 - RNA, 31 nt, Human
ugccuguaugagcguaugagcaugugcaugc

SEQ ID NO: 31574 - RNA, 21 nt, Human
ucuuccuuuuguucucacugc

SEQ ID NO: 31575 - RNA, 27 nt, Human
aacugauuugcaauaaaaaugauacug

SEQ ID NO: 31576 - RNA, 20 nt, Human
cuaucuagauaucuugugca

SEQ ID NO: 31577 - RNA, 25 nt, Human
ucuguacagaugaugcuacccaauu

SEQ ID NO: 31578 - RNA, 21 nt, Human
ccgcugcccacagccuagcag

SEQ ID NO: 31579 - RNA, 21 nt, Human
aauguacugcacuugaugcca

SEQ ID NO: 31580 - RNA, 24 nt, Human
aguauuuuuuaauaauccgccccc

SEQ ID NO: 31581 - RNA, 20 nt, Human
cucuuaauacucaccaauaa

SEQ ID NO: 31582 - RNA, 27 nt, Human
ggaacuccagguccuuuauuacugccu

SEQ ID NO: 31583 - RNA, 22 nt, Human
aacaugccaaauauaacuuucu

SEQ ID NO: 31584 - RNA, 24 nt, Human
aucgccuaccugugccugcgugua

SEQ ID NO: 31585 - RNA, 26 nt, Human
cccccacugccuuugaccugccuccc

SEQ ID NO: 31586 - RNA, 27 nt, Human
ccagaagcaacagaggugccaggccuc

SEQ ID NO: 31587 - RNA, 23 nt, Human
auugcaucacugcacuccaaccu

SEQ ID NO: 31588 - RNA, 21 nt, Human
gaagcagcucaagggcaggag

SEQ ID NO: 31589 - RNA, 20 nt, Human
agagaaauuggcuuucugag

SEQ ID NO: 31590 - RNA, 25 nt, Human
gcauugguggccacaccaccuccuu

SEQ ID NO: 31591 - RNA, 22 nt, Human
aaaugauuguaguaaucugcau

SEQ ID NO: 31592 - RNA, 30 nt, Human
ugguggcaaacgccuguaaucccaacuacu

SEQ ID NO: 31593 - RNA, 19 nt, Human
acccuuuagcuuuguuuug

SEQ ID NO: 31594 - RNA, 27 nt, Human
agcuggguugagaaaagucuguuacag

SEQ ID NO: 31595 - RNA, 22 nt, Human
ccaccgugccuggccuauuuua

SEQ ID NO: 31596 - RNA, 21 nt, Human
cucccuggcccuguaggcugu

SEQ ID NO: 31597 - RNA, 21 nt, Human
uaaucuuucuccacuguucua

SEQ ID NO: 31598 - RNA, 22 nt, Human
aggccagggagcaguggcugag

SEQ ID NO: 31599 - RNA, 27 nt, Human
ggaugaugagggagaucaagaaaaagc

SEQ ID NO: 31600 - RNA, 25 nt, Human
ucuucucaaaaucuagcaaaggaag

SEQ ID NO: 31601 - RNA, 23 nt, Human
aucuagcuauuuuaauagauaga

SEQ ID NO: 31602 - RNA, 23 nt, Human
guuagucugguuggaaaccaaga

SEQ ID NO: 31603 - RNA, 23 nt, Human
ccugugucuugcaauggcagccu

SEQ ID NO: 31604 - RNA, 23 nt, Human
aucgugccacugcacuccaggcu

SEQ ID NO: 31605 - RNA, 21 nt, Human
ccaaauuagugaaccaaaaau

SEQ ID NO: 31606 - RNA, 21 nt, Human
gccuuugaucauuucuggacc

SEQ ID NO: 31607 - RNA, 24 nt, Human
gcgcacacccaggcagcccucugc

SEQ ID NO: 31608 - RNA, 26 nt, Human
aggaggucaaguugagcccagacaau

SEQ ID NO: 31609 - RNA, 21 nt, Human
cugcccccgggggccuguggc

SEQ ID NO: 31610 - RNA, 23 nt, Human
auccauugcugaauucgauagga

SEQ ID NO: 31611 - RNA, 27 nt, Human
ucaucuugcaggcuggaagcaccaggg

SEQ ID NO: 31612 - RNA, 22 nt, Human
gcagccgccgccuauguggacc

SEQ ID NO: 31613 - RNA, 27 nt, Human
ccagccaccccaaagcccuccuccucc

SEQ ID NO: 31614 - RNA, 23 nt, Human
cuucagccggcccuggagugcgg

SEQ ID NO: 31615 - RNA, 18 nt, Human
aaccaaacuaacagugcu

SEQ ID NO: 31616 - RNA, 23 nt, Human
ugccaaaacaguguugccauuuu

SEQ ID NO: 31617 - RNA, 20 nt, Human
ccaggcaaucaaaaugagug

SEQ ID NO: 31618 - RNA, 22 nt, Human
uugagcucucacucagugccuu

SEQ ID NO: 31619 - RNA, 27 nt, Human
cagccauccaauugguuuuaggucuug

SEQ ID NO: 31620 - RNA, 27 nt, Human
gaggaagaggaggcuugaggcccaggg

SEQ ID NO: 31621 - RNA, 25 nt, Human
agcacagccagacuugcuuccugca

SEQ ID NO: 31622 - RNA, 27 nt, Human
cuuaacagaugaggaaacugaggccua

SEQ ID NO: 31623 - RNA, 27 nt, Human
ggucaucuucccuaucacacaaaugau

SEQ ID NO: 31624 - RNA, 22 nt, Human
ugauuagagaccagaucagaua

SEQ ID NO: 31625 - RNA, 20 nt, Human
ggggugagauaagcggccau

SEQ ID NO: 31626 - RNA, 24 nt, Human
ugucucccaggcugaagugcagug

SEQ ID NO: 31627 - RNA, 20 nt, Human
ugaacuccugaccuugugau

SEQ ID NO: 31628 - RNA, 22 nt, Human
ugaaacuuaucugauggcauuu

SEQ ID NO: 31629 - RNA, 20 nt, Human
gaauauaacauuuuauguca

SEQ ID NO: 31630 - RNA, 19 nt, Human
cugaaugcacucauccccu

SEQ ID NO: 31631 - RNA, 26 nt, Human
acucugaaggaacgguugcaguccau

SEQ ID NO: 31632 - RNA, 20 nt, Human
guagcagaguccagugccuu

SEQ ID NO: 31633 - RNA, 23 nt, Human
ccuguucugccccagcuguuccu

SEQ ID NO: 31634 - RNA, 21 nt, Human
cccagcucuccccucugcacc

SEQ ID NO: 31635 - RNA, 25 nt, Human
gcccugcucccugcccuccugggca

SEQ ID NO: 31636 - RNA, 22 nt, Human
uggugguggccuguaaucccag

SEQ ID NO: 31637 - RNA, 25 nt, Human
cuccccagccagccgcugaccucuc

SEQ ID NO: 31638 - RNA, 21 nt, Human
uacccuuugguuuguugacug

SEQ ID NO: 31639 - RNA, 20 nt, Human
accucaggauauucuuuucu

SEQ ID NO: 31640 - RNA, 22 nt, Human
uuccuggauggauucccgccau

SEQ ID NO: 31641 - RNA, 21 nt, Human
gcucuguggaggggcccuccg

SEQ ID NO: 31642 - RNA, 24 nt, Human
auacacagaagggaaaaugugcac

SEQ ID NO: 31643 - RNA, 24 nt, Human
cccucuaguuuuuucuuccuuguc

SEQ ID NO: 31644 - RNA, 21 nt, Human
ccuagcagcccucccugcugc

SEQ ID NO: 31645 - RNA, 24 nt, Human
uuugcugaaauacauuauggucaa

SEQ ID NO: 31646 - RNA, 19 nt, Human
ccagcuuuucucucuuacg

SEQ ID NO: 31647 - RNA, 31 nt, Human
cuugucccaauacaagaaugccaaaggagga

SEQ ID NO: 31648 - RNA, 22 nt, Human
acuguacugauuuacuggcgca

SEQ ID NO: 31649 - RNA, 27 nt, Human
aggaauucccuggaaaagggaaaugug

SEQ ID NO: 31650 - RNA, 26 nt, Human
uuccucaggcgguggcuggaggcugc

SEQ ID NO: 31651 - RNA, 22 nt, Human
gcaaguagcugggauuacaggc

SEQ ID NO: 31652 - RNA, 22 nt, Human
gcgaucuggguucacugcaacc

SEQ ID NO: 31653 - RNA, 21 nt, Human
ggcuccauacaaccucuucca

SEQ ID NO: 31654 - RNA, 27 nt, Human
uuuuccuccucugcgcuccauuccugg

SEQ ID NO: 31655 - RNA, 22 nt, Human
aaagugcuaagauuacaggcgu

SEQ ID NO: 31656 - RNA, 22 nt, Human
gagcgagacuuugucccaaaac

SEQ ID NO: 31657 - RNA, 21 nt, Human
aggggaauguggaagcucagg

SEQ ID NO: 31658 - RNA, 19 nt, Human
cucuucucacccaggcugg

SEQ ID NO: 31659 - RNA, 24 nt, Human
acugaguuucuucuuuggaaacca

SEQ ID NO: 31660 - RNA, 27 nt, Human
ucauggaccugagggauuuuuaccugu

SEQ ID NO: 31661 - RNA, 20 nt, Human
cccugcaagcgcucagucuc

SEQ ID NO: 31662 - RNA, 22 nt, Human
ucuccuccuccuuccucuuggu

SEQ ID NO: 31663 - RNA, 27 nt, Human
cucugguucagcugaaacaguccugga

SEQ ID NO: 31664 - RNA, 26 nt, Human
gcccccagcagcagccguccaucguc

SEQ ID NO: 31665 - RNA, 17 nt, Human
cccccaugacacaccuu

SEQ ID NO: 31666 - RNA, 25 nt, Human
aggagaucaagcaagggcugccuuu

SEQ ID NO: 31667 - RNA, 22 nt, Human
ggagcugagcgcuucugcucug

SEQ ID NO: 31668 - RNA, 21 nt, Human
gaaaugagaaaccccuaggga

SEQ ID NO: 31669 - RNA, 22 nt, Human
uauaaagacauuuccaccaagu

SEQ ID NO: 31670 - RNA, 21 nt, Human
augacuuugcuucugugcaca

SEQ ID NO: 31671 - RNA, 27 nt, Human
cugcccaggcccuuguucccggcagug

SEQ ID NO: 31672 - RNA, 21 nt, Human
caucuguuauucaccauguaa

SEQ ID NO: 31673 - RNA, 23 nt, Human
cuguuucuguuccuguguucaua

SEQ ID NO: 31674 - RNA, 22 nt, Human
aaaugcacaucucauggcagcu

SEQ ID NO: 31675 - RNA, 22 nt, Human
uuggcauuuguguuauuauuuu

SEQ ID NO: 31676 - RNA, 20 nt, Human
uuauuagcaggucugcucag

SEQ ID NO: 31677 - RNA, 21 nt, Human
gggggcccuuccagacugggg

SEQ ID NO: 31678 - RNA, 30 nt, Human
ccaaaaauucacugaccaaccaaccaaacu

SEQ ID NO: 31679 - RNA, 21 nt, Human
acuuuuccggacaaguuuaua

SEQ ID NO: 31680 - RNA, 22 nt, Human
cagaagcugguggcuguggaga

SEQ ID NO: 31681 - RNA, 20 nt, Human
ugaccuuuuaagugaaaauc

SEQ ID NO: 31682 - RNA, 22 nt, Human
uggucucaaacuccugggcuca

SEQ ID NO: 31683 - RNA, 21 nt, Human
guccccagcccucuucauguu

SEQ ID NO: 31684 - RNA, 27 nt, Human
agccucaaacuccugggcucaagcaau

SEQ ID NO: 31685 - RNA, 22 nt, Human
auuggcuuugcuggaguaugau

SEQ ID NO: 31686 - RNA, 22 nt, Human
acuggcacugccuucucugccg

SEQ ID NO: 31687 - RNA, 21 nt, Human
caggaauaaaagaaaaguaga

SEQ ID NO: 31688 - RNA, 22 nt, Human
gagugacacucugucucaaaaa

SEQ ID NO: 31689 - RNA, 24 nt, Human
gaggaaugaaaacaaagugaagua

SEQ ID NO: 31690 - RNA, 22 nt, Human
agcggggagagcacgggguagc

SEQ ID NO: 31691 - RNA, 24 nt, Human
agcucacuuguauucuguugacuu

SEQ ID NO: 31692 - RNA, 22 nt, Human
cuaaaugaauuaucacugugua

SEQ ID NO: 31693 - RNA, 27 nt, Human
agguggacuacgccgaaaaugagggga

SEQ ID NO: 31694 - RNA, 16 nt, Human
cuguccuuccugggcc

SEQ ID NO: 31695 - RNA, 23 nt, Human
cagacacaaagagacaaagcuuu

SEQ ID NO: 31696 - RNA, 22 nt, Human
ccaacagugaugaugcauggag

SEQ ID NO: 31697 - RNA, 27 nt, Human
uuagaaaagauguuuuccaugaggauc

SEQ ID NO: 31698 - RNA, 24 nt, Human
cauucagcuaaauucacauuugcc

SEQ ID NO: 31699 - RNA, 23 nt, Human
ggcccugucagcuggaacuggac

SEQ ID NO: 31700 - RNA, 19 nt, Human
ccccacucugggcuugugc

SEQ ID NO: 31701 - RNA, 27 nt, Human
uccagaagcugcagcaagagguacagc

SEQ ID NO: 31702 - RNA, 23 nt, Human
ucucuguggucuccauccugacu

SEQ ID NO: 31703 - RNA, 25 nt, Human
cuaccucuguucugccuguccucgc

SEQ ID NO: 31704 - RNA, 24 nt, Human
ccugcugcaauccaucccuuccuc

SEQ ID NO: 31705 - RNA, 21 nt, Human
ccgcccucugacacacaugcc

SEQ ID NO: 31706 - RNA, 27 nt, Human
cccaaguagcugggacuacaguugugc

SEQ ID NO: 31707 - RNA, 19 nt, Human
gaaaugaggcuggguggga

SEQ ID NO: 31708 - RNA, 24 nt, Human
cguuugggggaggucacacacguu

SEQ ID NO: 31709 - RNA, 20 nt, Human
uguacugccauacuacuucu

SEQ ID NO: 31710 - RNA, 26 nt, Human
agcuuuccaugacccgggagcaugag

SEQ ID NO: 31711 - RNA, 22 nt, Human
aaggucuccccugcucccuacc

SEQ ID NO: 31712 - RNA, 21 nt, Human
accacucucucagccacagaa

SEQ ID NO: 31713 - RNA, 19 nt, Human
ccugcccauugccugcuug

SEQ ID NO: 31714 - RNA, 20 nt, Human
gcaggcgaacagagcucucu

SEQ ID NO: 31715 - RNA, 20 nt, Human
cucuggccucccaccaggaa

SEQ ID NO: 31716 - RNA, 22 nt, Human
uccccaggaacaguagagaugg

SEQ ID NO: 31717 - RNA, 20 nt, Human
uuuaacaaaaaaggccauga

SEQ ID NO: 31718 - RNA, 23 nt, Human
cacaaacccuacaaauauaaaga

SEQ ID NO: 31719 - RNA, 27 nt, Human
gaggaagaggacucaaaagucuggccu

SEQ ID NO: 31720 - RNA, 26 nt, Human
acauccuuuuuuccagccucugggaa

SEQ ID NO: 31721 - RNA, 23 nt, Human
agggaaagguaaauacaagugaa

SEQ ID NO: 31722 - RNA, 30 nt, Human
gcugcaguaagcuaugaucaugccacugca

SEQ ID NO: 31723 - RNA, 20 nt, Human
guuaugucauuuaaagacau

SEQ ID NO: 31724 - RNA, 20 nt, Human
acccuggagcuaauucccac

SEQ ID NO: 31725 - RNA, 22 nt, Human
ccucagcaggaaccuguacugg

SEQ ID NO: 31726 - RNA, 20 nt, Human
ucaacucccagugugcccau

SEQ ID NO: 31727 - RNA, 25 nt, Human
ucauccagaaaagaaaaacacgaga

SEQ ID NO: 31728 - RNA, 22 nt, Human
uuuccugagauuuauuuuaucc

SEQ ID NO: 31729 - RNA, 25 nt, Human
uccuguggucuccgcaccucuccag

SEQ ID NO: 31730 - RNA, 22 nt, Human
ccaaauagcugggaccacaggu

SEQ ID NO: 31731 - RNA, 18 nt, Human
ugcccccacucagcauuu

SEQ ID NO: 31732 - RNA, 27 nt, Human
gugccuggccccagucuuaucugugcc

SEQ ID NO: 31733 - RNA, 27 nt, Human
acagucagucaggaugacacuucggca

SEQ ID NO: 31734 - RNA, 23 nt, Human
ugugccagcaugcuuccuccaca

SEQ ID NO: 31735 - RNA, 25 nt, Human
gaguuugugcuauagcuaggugugg

SEQ ID NO: 31736 - RNA, 22 nt, Human
ugcagugagcugagaucacguc

SEQ ID NO: 31737 - RNA, 23 nt, Human
cugaguuccacugggguaagggg

SEQ ID NO: 31738 - RNA, 24 nt, Human
ccagggaaagagaaaacucgcccu

SEQ ID NO: 31739 - RNA, 23 nt, Human
agaggagggauggccaagggugg

SEQ ID NO: 31740 - RNA, 23 nt, Human
augcuggagugcaguggcgcgau

SEQ ID NO: 31741 - RNA, 19 nt, Human
cuuauuuucaaaaauguga

SEQ ID NO: 31742 - RNA, 22 nt, Human
aucggggcgacaauagcucacu

SEQ ID NO: 31743 - RNA, 21 nt, Human
auuuauucuguuacuagauca

SEQ ID NO: 31744 - RNA, 26 nt, Human
aaaauacacagccaccucuguccagg

SEQ ID NO: 31745 - RNA, 18 nt, Human
cacagagaccucucuggg

SEQ ID NO: 31746 - RNA, 27 nt, Human
cacuuccuggcucuuguuuaaaacagu

SEQ ID NO: 31747 - RNA, 21 nt, Human
cagaaaugccacacuugugug

SEQ ID NO: 31748 - RNA, 24 nt, Human
gaagaauugcuuuaaccuuggagg

SEQ ID NO: 31749 - RNA, 20 nt, Human
ugaaugaucauuuagucaga

SEQ ID NO: 31750 - RNA, 22 nt, Human
gcgcucugugggccucugaggg

SEQ ID NO: 31751 - RNA, 22 nt, Human
ccccaaccccagacacaggggu

SEQ ID NO: 31752 - RNA, 24 nt, Human
caggcagcuccagcuguuaccuga

SEQ ID NO: 31753 - RNA, 24 nt, Human
gcggguccaggacaucugagggcu

SEQ ID NO: 31754 - RNA, 26 nt, Human
cagggaaaugaagacaggagaacugc

SEQ ID NO: 31755 - RNA, 22 nt, Human
uuuugcagaagaacacuguugu

SEQ ID NO: 31756 - RNA, 24 nt, Human
guaaggauucauggauaaaaugaa

SEQ ID NO: 31757 - RNA, 19 nt, Human
aagggucuucuuggcagcu

SEQ ID NO: 31758 - RNA, 16 nt, Human
accauaaaaaguauca

SEQ ID NO: 31759 - RNA, 22 nt, Human
cgcauugggaacuugcuggaac

SEQ ID NO: 31760 - RNA, 19 nt, Human
agacaggguucauugaaaa

SEQ ID NO: 31761 - RNA, 25 nt, Human
cuggguccuugggccuggccagucu

SEQ ID NO: 31762 - RNA, 23 nt, Human
ggccuugaauccaccucuuguuu

SEQ ID NO: 31763 - RNA, 22 nt, Human
cacuuaaagaacuuaagcaauu

SEQ ID NO: 31764 - RNA, 23 nt, Human
augaagauggaccauggcaggau

SEQ ID NO: 31765 - RNA, 21 nt, Human
augccuugccagugugucuua

SEQ ID NO: 31766 - RNA, 22 nt, Human
gccuguaucccagcuacucagg

SEQ ID NO: 31767 - RNA, 22 nt, Human
gucacccaggcuggagugaucu

SEQ ID NO: 31768 - RNA, 21 nt, Human
gcucacugcagccuccacuuc

SEQ ID NO: 31769 - RNA, 22 nt, Human
ucugcuccaucagaccucuucc

SEQ ID NO: 31770 - RNA, 26 nt, Human
ccucugccuccuggguuuaagcaauu

SEQ ID NO: 31771 - RNA, 27 nt, Human
cuccaucuuccacgaaaugggccauuc

SEQ ID NO: 31772 - RNA, 23 nt, Human
guggggaccucagaacacuguga

SEQ ID NO: 31773 - RNA, 21 nt, Human
uaagcacaugaaaaauacuca

SEQ ID NO: 31774 - RNA, 21 nt, Human
ccucccugucaccugccuccu

SEQ ID NO: 31775 - RNA, 26 nt, Human
uuugcauacacuagaaaaugccuuca

SEQ ID NO: 31776 - RNA, 22 nt, Human
uugagucuaucaaucaacuuau

SEQ ID NO: 31777 - RNA, 25 nt, Human
uggguagaaagauggggcauauuca

SEQ ID NO: 31778 - RNA, 20 nt, Human
cccccuguaccucaggcugu

SEQ ID NO: 31779 - RNA, 23 nt, Human
aguuagaauuuuguuauuuucaa

SEQ ID NO: 31780 - RNA, 21 nt, Human
acugugcugaauucugcaaug

SEQ ID NO: 31781 - RNA, 22 nt, Human
auaccagccuguuuagcagugu

SEQ ID NO: 31782 - RNA, 23 nt, Human
cccagcaucagggucacuguggc

SEQ ID NO: 31783 - RNA, 22 nt, Human
cuguacgagaaaaacaaaaagg

SEQ ID NO: 31784 - RNA, 27 nt, Human
cucacugccccacugugcuccugggcc

SEQ ID NO: 31785 - RNA, 27 nt, Human
uugcccaggcuggagugcauuggcgcg

SEQ ID NO: 31786 - RNA, 23 nt, Human
cugaggcuuuagaaauguggaca

SEQ ID NO: 31787 - RNA, 19 nt, Human
ccaguagcuaugaccugcc

SEQ ID NO: 31788 - RNA, 24 nt, Human
cugccuggcucgcuggucucucga

SEQ ID NO: 31789 - RNA, 27 nt, Human
ugaaaacagugucuugagcucuaaagu

SEQ ID NO: 31790 - RNA, 24 nt, Human
ggagagggcagugcaaugggaagu

SEQ ID NO: 31791 - RNA, 22 nt, Human
gugugcaugauuguauauggaa

SEQ ID NO: 31792 - RNA, 22 nt, Human
ggauacuuaacaaauacauuca

SEQ ID NO: 31793 - RNA, 22 nt, Human
gcauagcaaaauauuucugcuu

SEQ ID NO: 31794 - RNA, 22 nt, Human
cuucccuuccccucaccuggaa

SEQ ID NO: 31795 - RNA, 23 nt, Human
agcagcuggggcugggggcacag

SEQ ID NO: 31796 - RNA, 17 nt, Human
aaguaaaauguucuuca

SEQ ID NO: 31797 - RNA, 21 nt, Human
ccucgcuaaaagacaguagau

SEQ ID NO: 31798 - RNA, 22 nt, Human
guauuguucauccagcaaccag

SEQ ID NO: 31799 - RNA, 26 nt, Human
gcuugcugagcccuuugcuccccugg

SEQ ID NO: 31800 - RNA, 24 nt, Human
ucugcagcuggggacacaacugcc

SEQ ID NO: 31801 - RNA, 27 nt, Human
acacagacagaauccaaaugcaugugc

SEQ ID NO: 31802 - RNA, 22 nt, Human
agccucuucaugaauuacagcu

SEQ ID NO: 31803 - RNA, 23 nt, Human
guuuucuuuucuggcuuguguuu

SEQ ID NO: 31804 - RNA, 28 nt, Human
ccaugacaguucauucagggccgauggg

SEQ ID NO: 31805 - RNA, 21 nt, Human
auguauauguguacacaugcc

SEQ ID NO: 31806 - RNA, 25 nt, Human
aaccugagcacuccuccugcugaag

SEQ ID NO: 31807 - RNA, 23 nt, Human
uggcccgacagcauucugagguu

SEQ ID NO: 31808 - RNA, 22 nt, Human
cgcacugggauccugcuggaac

SEQ ID NO: 31809 - RNA, 21 nt, Human
cacuccagaagaacugcggca

SEQ ID NO: 31810 - RNA, 21 nt, Human
gugggugguaggguacguggc

SEQ ID NO: 31811 - RNA, 22 nt, Human
cagaguuaaguggcuguccucg

SEQ ID NO: 31812 - RNA, 24 nt, Human
uacacagcaagagcaugugugugc

SEQ ID NO: 31813 - RNA, 22 nt, Human
ccuucuccuggguccaagcaau

SEQ ID NO: 31814 - RNA, 27 nt, Human
guugcccaggcuggagugcaacggcac

SEQ ID NO: 31815 - RNA, 22 nt, Human
aguggcacaaucucagcucacu

SEQ ID NO: 31816 - RNA, 27 nt, Human
cacugcauuccagccuggcgacagagu

SEQ ID NO: 31817 - RNA, 20 nt, Human
ugccagacugcugcacgggu

SEQ ID NO: 31818 - RNA, 22 nt, Human
gccuuucugccucacaucagcc

SEQ ID NO: 31819 - RNA, 27 nt, Human
agcauuuucucaccuggauaaagccca

SEQ ID NO: 31820 - RNA, 23 nt, Human
gggcugcggcuccauccucggcu

SEQ ID NO: 31821 - RNA, 22 nt, Human
ugacaagacugcugcaaacuuc

SEQ ID NO: 31822 - RNA, 20 nt, Human
acguggugucucacucugaa

SEQ ID NO: 31823 - RNA, 25 nt, Human
gcaaaacucuuucccaauucagucg

SEQ ID NO: 31824 - RNA, 23 nt, Human
ggugugaggacacgauaugcugg

SEQ ID NO: 31825 - RNA, 27 nt, Human
gccagguaguguaguaucaggagugga

SEQ ID NO: 31826 - RNA, 25 nt, Human
uucucgcuucuguccuccguuuagu

SEQ ID NO: 31827 - RNA, 20 nt, Human
ugaaaucccacauccuccca

SEQ ID NO: 31828 - RNA, 24 nt, Human
gcagggcugggggguggucugugc

SEQ ID NO: 31829 - RNA, 30 nt, Human
uaaccaaaacucagguaacaaccauuagcu

SEQ ID NO: 31830 - RNA, 22 nt, Human
gcaugucuucuguucuuuuccc

SEQ ID NO: 31831 - RNA, 21 nt, Human
uggccccaaaccagagaaugu

SEQ ID NO: 31832 - RNA, 23 nt, Human
ugguggaggugggcauuggcggg

SEQ ID NO: 31833 - RNA, 21 nt, Human
ugcagcugaucauagcucacu

SEQ ID NO: 31834 - RNA, 20 nt, Human
gugcagcugcugggcacgcc

SEQ ID NO: 31835 - RNA, 24 nt, Human
agccaugucguccauccugccuuu

SEQ ID NO: 31836 - RNA, 26 nt, Human
gggagaaaggaaugggagcccagaca

SEQ ID NO: 31837 - RNA, 21 nt, Human
gaaugcuagcaggcugugggg

SEQ ID NO: 31838 - RNA, 22 nt, Human
ccuccuggcuccugggcuggga

SEQ ID NO: 31839 - RNA, 22 nt, Human
cccccugcuccagcuugcccug

SEQ ID NO: 31840 - RNA, 22 nt, Human
gcucacugcaagcucugcgucc

SEQ ID NO: 31841 - RNA, 22 nt, Human
aauuauuggaauaucacacuuu

SEQ ID NO: 31842 - RNA, 19 nt, Human
caccaaaucaucugccugu

SEQ ID NO: 31843 - RNA, 21 nt, Human
uucagcuuucuucagcugcca

SEQ ID NO: 31844 - RNA, 21 nt, Human
agucugugcugggaggcaggg

SEQ ID NO: 31845 - RNA, 27 nt, Human
ugcccugcuuaaaucaggggcacuuca

SEQ ID NO: 31846 - RNA, 24 nt, Human
ggauaucuuggcuuugccacacac

SEQ ID NO: 31847 - RNA, 22 nt, Human
gcacuaagaaugccagugaccu

SEQ ID NO: 31848 - RNA, 27 nt, Human
aguucccucuuuguuucugcuucauuu

SEQ ID NO: 31849 - RNA, 23 nt, Human
acacagguggggacugggcacag

SEQ ID NO: 31850 - RNA, 21 nt, Human
ccagagaaaagagccucagca

SEQ ID NO: 31851 - RNA, 23 nt, Human
acugcaggaagaucccagcccua

SEQ ID NO: 31852 - RNA, 23 nt, Human
aaaaggagaaaagaaauuaugua

SEQ ID NO: 31853 - RNA, 22 nt, Human
aaaccuguaaucccagcacuuu

SEQ ID NO: 31854 - RNA, 23 nt, Human
caggaaggcacaagguagcugug

SEQ ID NO: 31855 - RNA, 17 nt, Human
caggaugaagcauuuac

SEQ ID NO: 31856 - RNA, 20 nt, Human
uuucuaaccauuggaaauca

SEQ ID NO: 31857 - RNA, 26 nt, Human
caacagcagcugaacuguuguaacca

SEQ ID NO: 31858 - RNA, 21 nt, Human
ugucauuucauguccuguguc

SEQ ID NO: 31859 - RNA, 22 nt, Human
gcggaucuccuccuccuuucca

SEQ ID NO: 31860 - RNA, 25 nt, Human
cucuccccucugcccuguauauaau

SEQ ID NO: 31861 - RNA, 18 nt, Human
uucacugucuccauucca

SEQ ID NO: 31862 - RNA, 29 nt, Human
guucuuaacugcaacauauuauuucgucu

SEQ ID NO: 31863 - RNA, 22 nt, Human
gggccugaggagagggagcugu

SEQ ID NO: 31864 - RNA, 21 nt, Human
acccaaaccaccacaggugcu

SEQ ID NO: 31865 - RNA, 27 nt, Human
gagaguugagccgcugugaggcgaggc

SEQ ID NO: 31866 - RNA, 20 nt, Human
gaggggaagggagcccccag

SEQ ID NO: 31867 - RNA, 23 nt, Human
gucugcguucccuccccugggcc

SEQ ID NO: 31868 - RNA, 22 nt, Human
ucccugcugcuuucucuaccuc

SEQ ID NO: 31869 - RNA, 23 nt, Human
uucuuggcugggucaacucugcu

SEQ ID NO: 31870 - RNA, 20 nt, Human
aagcccaggcaugguggugc

SEQ ID NO: 31871 - RNA, 16 nt, Human
acaggggcagugccuu

SEQ ID NO: 31872 - RNA, 26 nt, Human
ggagagaaggacaugugcuauugaac

SEQ ID NO: 31873 - RNA, 23 nt, Human
ccuaacccuacccagccugcugc

SEQ ID NO: 31874 - RNA, 21 nt, Human
aagauucauacuagagagaaa

SEQ ID NO: 31875 - RNA, 23 nt, Human
gggcuucaaccacucgccgagga

SEQ ID NO: 31876 - RNA, 20 nt, Human
ugggaggugccagucauuga

SEQ ID NO: 31877 - RNA, 23 nt, Human
ugccucagucggccugcgcuccu

SEQ ID NO: 31878 - RNA, 19 nt, Human
gaucuucccgaugaccuca

SEQ ID NO: 31879 - RNA, 20 nt, Human
ggcgcuucuccaaugcucug

SEQ ID NO: 31880 - RNA, 20 nt, Human
uccucggccucaccauucca

SEQ ID NO: 31881 - RNA, 22 nt, Human
cagggacugacaaaagacuuga

SEQ ID NO: 31882 - RNA, 25 nt, Human
cuggguggaaagcgguuuggaugaa

SEQ ID NO: 31883 - RNA, 27 nt, Human
uccuucugguccaggccuuggaggaaa

SEQ ID NO: 31884 - RNA, 29 nt, Human
gaccuuuagguauuacacaagaccagugc

SEQ ID NO: 31885 - RNA, 27 nt, Human
cgccacugcacuccagucuggucggca

SEQ ID NO: 31886 - RNA, 27 nt, Human
ggucaucuggaacuguucauauaaaca

SEQ ID NO: 31887 - RNA, 27 nt, Human
acgcugguacuuuagcccugggcucga

SEQ ID NO: 31888 - RNA, 22 nt, Human
acaacauggugagaccucgucu

SEQ ID NO: 31889 - RNA, 19 nt, Human
aagagguggaacaugugaa

SEQ ID NO: 31890 - RNA, 18 nt, Human
uguuuuuaaaaugucuua

SEQ ID NO: 31891 - RNA, 20 nt, Human
aaucagacaucacagaugca

SEQ ID NO: 31892 - RNA, 23 nt, Human
ggcaggagaagugagaaaaccac

SEQ ID NO: 31893 - RNA, 21 nt, Human
gcagugagccaagauugcgcc

SEQ ID NO: 31894 - RNA, 31 nt, Human
gcuguggcccucuguguaugccugggauccu

SEQ ID NO: 31895 - RNA, 26 nt, Human
gcucagaaugggaaaauauccauagc

SEQ ID NO: 31896 - RNA, 20 nt, Human
guccgauggcuccuggccgc

SEQ ID NO: 31897 - RNA, 23 nt, Human
cuguuccaaccuccugcucuggg

SEQ ID NO: 31898 - RNA, 27 nt, Human
gugaagugccuggcacagugucuggua

SEQ ID NO: 31899 - RNA, 21 nt, Human
ucucuaucucuggacacucca

SEQ ID NO: 31900 - RNA, 25 nt, Human
augucauuuuuacggaaacccuuuc

SEQ ID NO: 31901 - RNA, 27 nt, Human
ggagaauggguuccuguggagaaaaau

SEQ ID NO: 31902 - RNA, 20 nt, Human
ggcaucugcauuacccaagc

SEQ ID NO: 31903 - RNA, 25 nt, Human
cuugucacccaggcuggagugcagu

SEQ ID NO: 31904 - RNA, 24 nt, Human
uauucagauccuaucuucauuuga

SEQ ID NO: 31905 - RNA, 27 nt, Human
uucuaggaauaccagucacauaguuuu

SEQ ID NO: 31906 - RNA, 22 nt, Human
gaucagauucugggggcucaga

SEQ ID NO: 31907 - RNA, 27 nt, Human
aucucugagggagacauugcaccuggc

SEQ ID NO: 31908 - RNA, 19 nt, Human
cacugcacuggagcuuuga

SEQ ID NO: 31909 - RNA, 25 nt, Human
uugucaucagcccugccuguuuugc

SEQ ID NO: 31910 - RNA, 20 nt, Human
aguguuuucacagguucucc

SEQ ID NO: 31911 - RNA, 20 nt, Human
gccucccaggcuggggcagu

SEQ ID NO: 31912 - RNA, 21 nt, Human
aguccaaacucugauuuacau

SEQ ID NO: 31913 - RNA, 20 nt, Human
agccccaucccuguccucau

SEQ ID NO: 31914 - RNA, 21 nt, Human
gacgguguacuuacugccuug

SEQ ID NO: 31915 - RNA, 21 nt, Human
agccccguccccacagcuguc

SEQ ID NO: 31916 - RNA, 26 nt, Human
cccugcacucagcccuguggccccuu

SEQ ID NO: 31917 - RNA, 21 nt, Human
ccaucacccaccucuggagcu

SEQ ID NO: 31918 - RNA, 22 nt, Human
ugcccaggcuggagugcauugg

SEQ ID NO: 31919 - RNA, 25 nt, Human
gagaaaaauauauacuaaacaaaaa

SEQ ID NO: 31920 - RNA, 22 nt, Human
aagucaacugagacugagacug

SEQ ID NO: 31921 - RNA, 24 nt, Human
agcagggaacugcagguggauucu

SEQ ID NO: 31922 - RNA, 22 nt, Human
agcacagauuucaccucugucu

SEQ ID NO: 31923 - RNA, 22 nt, Human
caaacuccugggcucaagugau

SEQ ID NO: 31924 - RNA, 22 nt, Human
ggaacuggaugggcugcaguga

SEQ ID NO: 31925 - RNA, 27 nt, Human
uucucucucgccucuccuccgccucug

SEQ ID NO: 31926 - RNA, 22 nt, Human
cugagggugccucaggagcagu

SEQ ID NO: 31927 - RNA, 23 nt, Human
ugcuuuauaagauggguucaccu

SEQ ID NO: 31928 - RNA, 22 nt, Human
acacacacagaugugggcuuug

SEQ ID NO: 31929 - RNA, 18 nt, Human
ucucccaugucuugcucu

SEQ ID NO: 31930 - RNA, 20 nt, Human
guuuggauaugacuugcucg

SEQ ID NO: 31931 - RNA, 21 nt, Human
agcuaauguuuuauuuuuugu

SEQ ID NO: 31932 - RNA, 20 nt, Human
acagccaaguacaagugcaa

SEQ ID NO: 31933 - RNA, 25 nt, Human
aggccaggaccaagggcagaggggu

SEQ ID NO: 31934 - RNA, 23 nt, Human
cuguguggcccuggccgagucgu

SEQ ID NO: 31935 - RNA, 26 nt, Human
gugacuucuuuugaguuagguuaaua

SEQ ID NO: 31936 - RNA, 22 nt, Human
gggcagcccaagguugcauggg

SEQ ID NO: 31937 - RNA, 22 nt, Human
augauaguguauaugcuaacug

SEQ ID NO: 31938 - RNA, 25 nt, Human
agagccucgucccucccucacugaa

SEQ ID NO: 31939 - RNA, 22 nt, Human
cuucuggccucugcugaaugca

SEQ ID NO: 31940 - RNA, 23 nt, Human
ccgggaagcggagcuugcaguga

SEQ ID NO: 31941 - RNA, 25 nt, Human
cagaagguuuaaucacuucauccca

SEQ ID NO: 31942 - RNA, 26 nt, Human
gcuggguggaggccacgggacaccuc

SEQ ID NO: 31943 - RNA, 23 nt, Human
ccacuagcaccaucccagagcug

SEQ ID NO: 31944 - RNA, 23 nt, Human
caaguagcugggguuacaggcau

SEQ ID NO: 31945 - RNA, 21 nt, Human
aggacuuuuauuauuuuucac

SEQ ID NO: 31946 - RNA, 18 nt, Human
ucauuuuucuuagagaac

SEQ ID NO: 31947 - RNA, 23 nt, Human
cucauaacuucuccccaucccag

SEQ ID NO: 31948 - RNA, 21 nt, Human
acugccuccucccuggcugca

SEQ ID NO: 31949 - RNA, 23 nt, Human
gagugugaccagaguagacucgg

SEQ ID NO: 31950 - RNA, 21 nt, Human
ugaucuuccccaucaggcugg

SEQ ID NO: 31951 - RNA, 23 nt, Human
cagaccuguuuuuauuugcucaa

SEQ ID NO: 31952 - RNA, 20 nt, Human
ugccuguagcggcguuguug

SEQ ID NO: 31953 - RNA, 21 nt, Human
uacugccugaguugugccucu

SEQ ID NO: 31954 - RNA, 23 nt, Human
agggguggcuguuggaggaaggg

SEQ ID NO: 31955 - RNA, 23 nt, Human
guccccucaccuccucuaagguu

SEQ ID NO: 31956 - RNA, 21 nt, Human
uccagccugggcagcagagcg

SEQ ID NO: 31957 - RNA, 24 nt, Human
ugaucuguaauuuguagcucuucc

SEQ ID NO: 31958 - RNA, 20 nt, Human
uggacugcaggcugcaguga

SEQ ID NO: 31959 - RNA, 22 nt, Human
gccucuuaagccugcucccuca

SEQ ID NO: 31960 - RNA, 23 nt, Human
cuuuuucuguauauagugaccuu

SEQ ID NO: 31961 - RNA, 18 nt, Human
ucaaugcuaacuaaucaa

SEQ ID NO: 31962 - RNA, 20 nt, Human
caaggcaccuucuuaaaaga

SEQ ID NO: 31963 - RNA, 24 nt, Human
ucacccaggcucugcucaggcugg

SEQ ID NO: 31964 - RNA, 23 nt, Human
cuuaagaggagggucgggcucgg

SEQ ID NO: 31965 - RNA, 21 nt, Human
cgcucaggcuggagugcagug

SEQ ID NO: 31966 - RNA, 27 nt, Human
ucaggaggcugaggcaggagaauggcg

SEQ ID NO: 31967 - RNA, 23 nt, Human
acaggugggaagaugggaaugag

SEQ ID NO: 31968 - RNA, 22 nt, Human
accagccucccaaaauacuggg

SEQ ID NO: 31969 - RNA, 25 nt, Human
uuugcuggcgagaguccugucugcu

SEQ ID NO: 31970 - RNA, 18 nt, Human
caguucuauccuggugcc

SEQ ID NO: 31971 - RNA, 26 nt, Human
ugagccaagaucgugccauugcacuc

SEQ ID NO: 31972 - RNA, 27 nt, Human
gagguacugaggaaaagcaauaugggu

SEQ ID NO: 31973 - RNA, 22 nt, Human
gagcccccugucuccuccauca

SEQ ID NO: 31974 - RNA, 24 nt, Human
uuuuccucucuuacugcagcacuc

SEQ ID NO: 31975 - RNA, 22 nt, Human
guccacaagagucucagucgcc

SEQ ID NO: 31976 - RNA, 21 nt, Human
agcggggacuagagccgggga

SEQ ID NO: 31977 - RNA, 26 nt, Human
gguccucucagcccugccugcccugg

SEQ ID NO: 31978 - RNA, 22 nt, Human
accauguaugaaaauccagugg

SEQ ID NO: 31979 - RNA, 20 nt, Human
uucuuuuuugagacaggguc

SEQ ID NO: 31980 - RNA, 21 nt, Human
aguaaaauuauacugugugug

SEQ ID NO: 31981 - RNA, 24 nt, Human
cugaguauccucccaaaggugaca

SEQ ID NO: 31982 - RNA, 24 nt, Human
ggcaaguuggccucucuguuguaa

SEQ ID NO: 31983 - RNA, 19 nt, Human
aaggaugaauagaauucau

SEQ ID NO: 31984 - RNA, 21 nt, Human
cagugacugucagacaucuuc

SEQ ID NO: 31985 - RNA, 21 nt, Human
ugccuguaauccuagcacuuu

SEQ ID NO: 31986 - RNA, 21 nt, Human
auccuagcccaccaguuguca

SEQ ID NO: 31987 - RNA, 27 nt, Human
gugcaagcucuggccggcgcugcccac

SEQ ID NO: 31988 - RNA, 21 nt, Human
gcaguaggaccaccagugugg

SEQ ID NO: 31989 - RNA, 19 nt, Human
ucagcaucugcugcccuga

SEQ ID NO: 31990 - RNA, 19 nt, Human
cuagagaucaccaagcaga

SEQ ID NO: 31991 - RNA, 22 nt, Human
gccgucugaacuggaguggagu

SEQ ID NO: 31992 - RNA, 27 nt, Human
ggcauuuuccacaccuguccacuccuu

SEQ ID NO: 31993 - RNA, 22 nt, Human
cagagucuugcucugucaccca

SEQ ID NO: 31994 - RNA, 22 nt, Human
cggagucuugcucugucgccca

SEQ ID NO: 31995 - RNA, 25 nt, Human
agccuccacugccgcugccaccuca

SEQ ID NO: 31996 - RNA, 21 nt, Human
gugaggaagagguugcaguga

SEQ ID NO: 31997 - RNA, 23 nt, Human
cacaagagauagaaacaaucaua

SEQ ID NO: 31998 - RNA, 19 nt, Human
ccuuaugccuucuucuuca

SEQ ID NO: 31999 - RNA, 27 nt, Human
ugacuccugguugccuuuucccagcca

SEQ ID NO: 32000 - RNA, 24 nt, Human
cuugccuggccucaccuggccagc

SEQ ID NO: 32001 - RNA, 22 nt, Human
ucauccuuagaaaucagugccc

SEQ ID NO: 32002 - RNA, 22 nt, Human
cugcaaccuccaucuccuggau

SEQ ID NO: 32003 - RNA, 27 nt, Human
aaggggaugagugcagggcagagguga

SEQ ID NO: 32004 - RNA, 24 nt, Human
cuuauuuuccaaguauuuacugaa

SEQ ID NO: 32005 - RNA, 21 nt, Human
auguuugcaccugugcauuuu

SEQ ID NO: 32006 - RNA, 21 nt, Human
ugaggcaccuuagaagggaga

SEQ ID NO: 32007 - RNA, 24 nt, Human
ucaggugggcagaggcuggcagug

SEQ ID NO: 32008 - RNA, 22 nt, Human
cuguaaaauuauagacuugcuc

SEQ ID NO: 32009 - RNA, 22 nt, Human
gaugccuaguacaaaugcucuu

SEQ ID NO: 32010 - RNA, 24 nt, Human
gauggacuccagccugccuggcag

SEQ ID NO: 32011 - RNA, 22 nt, Human
uacugacuuuuuaaauuuuuua

SEQ ID NO: 32012 - RNA, 19 nt, Human
uuccagagucaucuaccug

SEQ ID NO: 32013 - RNA, 16 nt, Human
caguucuguccuggcc

SEQ ID NO: 32014 - RNA, 25 nt, Human
aggaggaugucggggugaagggugg

SEQ ID NO: 32015 - RNA, 25 nt, Human
uuacugcacucagauuuaagccuua

SEQ ID NO: 32016 - RNA, 27 nt, Human
ccaggaggcugggcggaggugggcagg

SEQ ID NO: 32017 - RNA, 27 nt, Human
gagcccuguuugggcucaggagauaga

SEQ ID NO: 32018 - RNA, 25 nt, Human
gcugucauucugucauugcugcuac

SEQ ID NO: 32019 - RNA, 25 nt, Human
ccucuauucuguuucuuccuccuca

SEQ ID NO: 32020 - RNA, 21 nt, Human
gaacaguguuuggccaugugu

SEQ ID NO: 32021 - RNA, 26 nt, Human
aaucucacauacugaauacuagucaa

SEQ ID NO: 32022 - RNA, 18 nt, Human
agagacaaaauuccacug

SEQ ID NO: 32023 - RNA, 23 nt, Human
cuguugggggaugugcgcauguu

SEQ ID NO: 32024 - RNA, 28 nt, Human
uccagaugagucagucucuugggaagug

SEQ ID NO: 32025 - RNA, 22 nt, Human
aggccgaggcaggcugaucacg

SEQ ID NO: 32026 - RNA, 18 nt, Human
agaugcuauucuuucuga

SEQ ID NO: 32027 - RNA, 19 nt, Human
ggggcugaggccugcugga

SEQ ID NO: 32028 - RNA, 20 nt, Human
aagggagggggcgcuggagc

SEQ ID NO: 32029 - RNA, 22 nt, Human
agcacgccugcuggcagaggua

SEQ ID NO: 32030 - RNA, 23 nt, Human
ucucgaacuucugaccucaggug

SEQ ID NO: 32031 - RNA, 23 nt, Human
uuucgaacuccugaccucaggug

SEQ ID NO: 32032 - RNA, 23 nt, Human
ugccauccagcuuuggugcaaug

SEQ ID NO: 32033 - RNA, 23 nt, Human
gauuaaugacuggcuacagagua

SEQ ID NO: 32034 - RNA, 21 nt, Human
uagauauccuauuaauggcag

SEQ ID NO: 32035 - RNA, 20 nt, Human
ugcccaggcuggugugcaau

SEQ ID NO: 32036 - RNA, 20 nt, Human
gacauuuuucuccucaguag

SEQ ID NO: 32037 - RNA, 27 nt, Human
gcacuaugcccuuuaaaucaugcuggu

SEQ ID NO: 32038 - RNA, 22 nt, Human
cacaggccauuaugccuggcua

SEQ ID NO: 32039 - RNA, 22 nt, Human
cagccaucuuagauuucuuugu

SEQ ID NO: 32040 - RNA, 22 nt, Human
agcuauaaucucagcacuuugg

SEQ ID NO: 32041 - RNA, 21 nt, Human
caucagagaccccagccuggg

SEQ ID NO: 32042 - RNA, 21 nt, Human
cagcaaacaagcuaccccugc

SEQ ID NO: 32043 - RNA, 17 nt, Human
guucuuugcaagaaggu

SEQ ID NO: 32044 - RNA, 18 nt, Human
aggcagcagcagcggugg

SEQ ID NO: 32045 - RNA, 21 nt, Human
ucaagccucuuaauuuuaaac

SEQ ID NO: 32046 - RNA, 21 nt, Human
ggccugcggguuccuguugac

SEQ ID NO: 32047 - RNA, 27 nt, Human
guugcaacccugcugcgugggcuucaa

SEQ ID NO: 32048 - RNA, 26 nt, Human
agaaaugcucuugcuuccucaacuuu

SEQ ID NO: 32049 - RNA, 22 nt, Human
caccucccggguucaagugauu

SEQ ID NO: 32050 - RNA, 20 nt, Human
cauaauccucuccaacugga

SEQ ID NO: 32051 - RNA, 25 nt, Human
cugucucccaggcugaagugcagug

SEQ ID NO: 32052 - RNA, 22 nt, Human
uaugugcgcucuguaaagugau

SEQ ID NO: 32053 - RNA, 25 nt, Human
gacuugugggcuuuugcacacuggc

SEQ ID NO: 32054 - RNA, 20 nt, Human
caguguuaacagaagacuga

SEQ ID NO: 32055 - RNA, 27 nt, Human
gaggauugcguugacgagacucuuauu

SEQ ID NO: 32056 - RNA, 28 nt, Human
augucaauuauaggaaaacauaguugga

SEQ ID NO: 32057 - RNA, 25 nt, Human
gugauggcaacgguggccuggauuc

SEQ ID NO: 32058 - RNA, 21 nt, Human
uuugagccuuaguuuuuucau

SEQ ID NO: 32059 - RNA, 23 nt, Human
aaguccccguggagguucuguau

SEQ ID NO: 32060 - RNA, 22 nt, Human
accgaggcuggagugcaaugac

SEQ ID NO: 32061 - RNA, 26 nt, Human
ccucucacagcuacccagcacaugcc

SEQ ID NO: 32062 - RNA, 27 nt, Human
cuccgcugcgccucagcugugggggcc

SEQ ID NO: 32063 - RNA, 22 nt, Human
guuccugaacauugcacugaua

SEQ ID NO: 32064 - RNA, 24 nt, Human
ccucguccucccccugccagugcc

SEQ ID NO: 32065 - RNA, 22 nt, Human
gucacccaggcuggggcgcaau

SEQ ID NO: 32066 - RNA, 24 nt, Human
cugggagguggcugucuccuagug

SEQ ID NO: 32067 - RNA, 22 nt, Human
gggaggcggagguuguggugag

SEQ ID NO: 32068 - RNA, 27 nt, Human
acaugugugaacacguguuucugucgu

SEQ ID NO: 32069 - RNA, 23 nt, Human
gcugcugcugcugcugccucccc

SEQ ID NO: 32070 - RNA, 22 nt, Human
ucugagcucugcugcaucuguc

SEQ ID NO: 32071 - RNA, 28 nt, Human
ccuccuucuccccugccggugcacaggc

SEQ ID NO: 32072 - RNA, 22 nt, Human
uucacagcuucauuuuuguuuc

SEQ ID NO: 32073 - RNA, 23 nt, Human
gcagagagccaagcaucuucccu

SEQ ID NO: 32074 - RNA, 28 nt, Human
augaguaguacagauucuccucuaauuc

SEQ ID NO: 32075 - RNA, 27 nt, Human
ucucggccacugaggagcuacagcccu

SEQ ID NO: 32076 - RNA, 25 nt, Human
uccccagggugacauacagaagggg

SEQ ID NO: 32077 - RNA, 27 nt, Human
gggagagaggggacuuccaggguccuu

SEQ ID NO: 32078 - RNA, 21 nt, Human
ucuaggguuuucuuucauuuu

SEQ ID NO: 32079 - RNA, 20 nt, Human
aauuaaaaagacacuuuuac

SEQ ID NO: 32080 - RNA, 26 nt, Human
gagaguccugggugugaggaacaccu

SEQ ID NO: 32081 - RNA, 27 nt, Human
uguugccuaggcuggaaauaggauuuu

SEQ ID NO: 32082 - RNA, 20 nt, Human
cuucggaaaugccucacaua

SEQ ID NO: 32083 - RNA, 23 nt, Human
cugagccccaagaccccgggggc

SEQ ID NO: 32084 - RNA, 27 nt, Human
ucuccacugccacccuuucuacucaag

SEQ ID NO: 32085 - RNA, 25 nt, Human
augccauucgguaacacccacaaca

SEQ ID NO: 32086 - RNA, 21 nt, Human
cacagauuguuucuauacaaa

SEQ ID NO: 32087 - RNA, 22 nt, Human
gauggcaucugccuucaggggg

SEQ ID NO: 32088 - RNA, 22 nt, Human
ucaccucaccaguugcauguuc

SEQ ID NO: 32089 - RNA, 31 nt, Human
cagagcaucugacugcccugccuuggaggag

SEQ ID NO: 32090 - RNA, 25 nt, Human
agagcagcugcucacacaggaggcc

SEQ ID NO: 32091 - RNA, 26 nt, Human
agguauuuuaagacagaaagagagag

SEQ ID NO: 32092 - RNA, 19 nt, Human
cucgcugggcccaggcugg

SEQ ID NO: 32093 - RNA, 18 nt, Human
ccccugcuugaacacuga

SEQ ID NO: 32094 - RNA, 22 nt, Human
ucaagccaccagugguuuaaua

SEQ ID NO: 32095 - RNA, 21 nt, Human
cuggccucugugccgccugcu

SEQ ID NO: 32096 - RNA, 20 nt, Human
guacacaagcccagcagguc

SEQ ID NO: 32097 - RNA, 21 nt, Human
cggcuccccucagccugcucc

SEQ ID NO: 32098 - RNA, 22 nt, Human
ucagcccauuaggcaggaaaag

SEQ ID NO: 32099 - RNA, 23 nt, Human
uagugugcagagguguaccaggg

SEQ ID NO: 32100 - RNA, 20 nt, Human
uccugcuucucucucaggcc

SEQ ID NO: 32101 - RNA, 24 nt, Human
aucccuguucauuguaagcacuuu

SEQ ID NO: 32102 - RNA, 22 nt, Human
aaccuguuacuucuagggcuuc

SEQ ID NO: 32103 - RNA, 20 nt, Human
gggagagaagcaggagucgg

SEQ ID NO: 32104 - RNA, 27 nt, Human
aacagggggcaaagauuaaucuaccuu

SEQ ID NO: 32105 - RNA, 20 nt, Human
agcaggaaacccucaaaccc

SEQ ID NO: 32106 - RNA, 21 nt, Human
gggcaucucuccccugcucca

SEQ ID NO: 32107 - RNA, 27 nt, Human
cuuccuuucuuuccucugggaggaaug

SEQ ID NO: 32108 - RNA, 22 nt, Human
agcucacugcagguucagccuu

SEQ ID NO: 32109 - RNA, 21 nt, Human
uuuuaaauugaguuugagacu

SEQ ID NO: 32110 - RNA, 21 nt, Human
ggcaugaaacauuaacacagc

SEQ ID NO: 32111 - RNA, 24 nt, Human
aggcucuccuugcuccuggccuug

SEQ ID NO: 32112 - RNA, 19 nt, Human
ccuucgcucucccccagcc

SEQ ID NO: 32113 - RNA, 28 nt, Human
cccaggcaggaagccuuucgccggcaga

SEQ ID NO: 32114 - RNA, 22 nt, Human
gccccauagaaaacaaucugcc

SEQ ID NO: 32115 - RNA, 21 nt, Human
gcuuuuccuuuguuuuuauga

SEQ ID NO: 32116 - RNA, 20 nt, Human
aaugcauaaagcuucacugg

SEQ ID NO: 32117 - RNA, 25 nt, Human
ucccugguguggucagccucucuca

SEQ ID NO: 32118 - RNA, 22 nt, Human
cacagcccaggcucaccccaag

SEQ ID NO: 32119 - RNA, 21 nt, Human
gcuggcucuggggucccagug

SEQ ID NO: 32120 - RNA, 21 nt, Human
ccuuucucccucugccugacc

SEQ ID NO: 32121 - RNA, 29 nt, Human
acgauaaucacaccuuuucccccgucuuu

SEQ ID NO: 32122 - RNA, 17 nt, Human
caacacugcagcauuuu

SEQ ID NO: 32123 - RNA, 23 nt, Human
auacuauauaucuguaaaaugca

SEQ ID NO: 32124 - RNA, 26 nt, Human
ccuggacuuguucucagagguaucag

SEQ ID NO: 32125 - RNA, 27 nt, Human
aaagcagcucuggaugagaugggaccu

SEQ ID NO: 32126 - RNA, 25 nt, Human
uuacauguagagauuugagugcagu

SEQ ID NO: 32127 - RNA, 26 nt, Human
gggaagagaagaccuagagcagacgc

SEQ ID NO: 32128 - RNA, 22 nt, Human
ugcagauacuucauuuucuuag

SEQ ID NO: 32129 - RNA, 25 nt, Human
cagaaggaaccgcagcucgcgaggc

SEQ ID NO: 32130 - RNA, 21 nt, Human
ucauccuauuuacugcagcaa

SEQ ID NO: 32131 - RNA, 18 nt, Human
gccaauaaaaaugucuca

SEQ ID NO: 32132 - RNA, 21 nt, Human
uccacagagagucccacugcc

SEQ ID NO: 32133 - RNA, 24 nt, Human
aacaacaaaggcuacccuuugacc

SEQ ID NO: 32134 - RNA, 23 nt, Human
ggaggugggggcuggggaaugag

SEQ ID NO: 32135 - RNA, 22 nt, Human
gcagugucuuucaaaaaaucaa

SEQ ID NO: 32136 - RNA, 21 nt, Human
auuacccuuuugcaggcacca

SEQ ID NO: 32137 - RNA, 21 nt, Human
ccucccuugguaaaggcacag

SEQ ID NO: 32138 - RNA, 18 nt, Human
cgcucagugccauagccu

SEQ ID NO: 32139 - RNA, 21 nt, Human
cuaccacuggacccuuccccu

SEQ ID NO: 32140 - RNA, 23 nt, Human
gaggcauguugaaugagccagga

SEQ ID NO: 32141 - RNA, 27 nt, Human
agcuuuucuugauaggccuaguacaau

SEQ ID NO: 32142 - RNA, 25 nt, Human
aggauccccgagagccacaccagcu

SEQ ID NO: 32143 - RNA, 21 nt, Human
cuuccuggcuguagcuuugua

SEQ ID NO: 32144 - RNA, 21 nt, Human
acuggaagacuuggagcuucu

SEQ ID NO: 32145 - RNA, 21 nt, Human
ggcaggauaauauagugcaaa

SEQ ID NO: 32146 - RNA, 21 nt, Human
uugcuaaugugccucuugguc

SEQ ID NO: 32147 - RNA, 23 nt, Human
cuucuccaagccucacugcgcca

SEQ ID NO: 32148 - RNA, 24 nt, Human
aacauguaacguacuacugccauc

SEQ ID NO: 32149 - RNA, 25 nt, Human
cagcaaaauuuauuuaaaacuguga

SEQ ID NO: 32150 - RNA, 22 nt, Human
auuuggcuggugccgaaguguu

SEQ ID NO: 32151 - RNA, 23 nt, Human
gucacuggaaacuuccucucucg

SEQ ID NO: 32152 - RNA, 27 nt, Human
cgcugggacacacacaggggccgggga

SEQ ID NO: 32153 - RNA, 21 nt, Human
acaucauccagcugagcggac

SEQ ID NO: 32154 - RNA, 19 nt, Human
ccugcagcagucccaugcc

SEQ ID NO: 32155 - RNA, 22 nt, Human
gagcucaggaguuugagaccag

SEQ ID NO: 32156 - RNA, 19 nt, Human
ccagaagugaaaaggcugc

SEQ ID NO: 32157 - RNA, 21 nt, Human
ggugagguccuggugccuauc

SEQ ID NO: 32158 - RNA, 20 nt, Human
acuuguggacacagcucuuc

SEQ ID NO: 32159 - RNA, 20 nt, Human
gugaggaagagaaaagcaga

SEQ ID NO: 32160 - RNA, 22 nt, Human
agcuuagccccuggaggcagca

SEQ ID NO: 32161 - RNA, 24 nt, Human
cccacugcacuggggccagcuggg

SEQ ID NO: 32162 - RNA, 21 nt, Human
ggucuaggugcuuuaaccuca

SEQ ID NO: 32163 - RNA, 23 nt, Human
caugccaggcugacggguccagu

SEQ ID NO: 32164 - RNA, 27 nt, Human
uugaguauuugaaaauuguuguagcua

SEQ ID NO: 32165 - RNA, 19 nt, Human
gucacugccacaacagcac

SEQ ID NO: 32166 - RNA, 27 nt, Human
agcagcaucugcuaauaaaacccaaca

SEQ ID NO: 32167 - RNA, 20 nt, Human
gacaguuuacagacgcugcu

SEQ ID NO: 32168 - RNA, 21 nt, Human
ugagucuuggcggcuguuaac

SEQ ID NO: 32169 - RNA, 26 nt, Human
cccuugcccaugugaaaagauccgcu

SEQ ID NO: 32170 - RNA, 23 nt, Human
ucucacugccaaacugccugucc

SEQ ID NO: 32171 - RNA, 28 nt, Human
ucucaaacuccugaccucaggugaucca

SEQ ID NO: 32172 - RNA, 25 nt, Human
acaaacuucagccugggaagugagg

SEQ ID NO: 32173 - RNA, 22 nt, Human
uucauaauauguucaccaggag

SEQ ID NO: 32174 - RNA, 22 nt, Human
uccagaagaggagacaaaagca

SEQ ID NO: 32175 - RNA, 22 nt, Human
aaacccagcuacugaggaggcu

SEQ ID NO: 32176 - RNA, 26 nt, Human
caaugccaucuaccggcguccugccg

SEQ ID NO: 32177 - RNA, 24 nt, Human
cuugaguucaggaguuggagacca

SEQ ID NO: 32178 - RNA, 21 nt, Human
guguuuauuuuucauauugug

SEQ ID NO: 32179 - RNA, 26 nt, Human
ggggcuccacaccugcaccuccuucu

SEQ ID NO: 32180 - RNA, 20 nt, Human
uuccaucccuagccauucug

SEQ ID NO: 32181 - RNA, 27 nt, Human
auagaguguaaauaaaauaguguugau

SEQ ID NO: 32182 - RNA, 27 nt, Human
guuugccagacugggugcagaauuuau

SEQ ID NO: 32183 - RNA, 15 nt, Human
uacugcacugggcag

SEQ ID NO: 32184 - RNA, 26 nt, Human
gcaggagcuguggaaauggugagcgc

SEQ ID NO: 32185 - RNA, 23 nt, Human
ccagauugcaugaucucccggga

SEQ ID NO: 32186 - RNA, 22 nt, Human
ugggagccggaggcgcggggac

SEQ ID NO: 32187 - RNA, 22 nt, Human
guuccggaaagccuuccucaag

SEQ ID NO: 32188 - RNA, 27 nt, Human
ucucuacccagcccaucuugccuccau

SEQ ID NO: 32189 - RNA, 26 nt, Human
ugcuccccaccuccaguucugccugc

SEQ ID NO: 32190 - RNA, 22 nt, Human
cugucucugcuguacagggccu

SEQ ID NO: 32191 - RNA, 22 nt, Human
accagccuggccaacacaguga

SEQ ID NO: 32192 - RNA, 22 nt, Human
cucuuucuuugcaacagcagug

SEQ ID NO: 32193 - RNA, 22 nt, Human
agcuuugacaaguccuugaccu

SEQ ID NO: 32194 - RNA, 21 nt, Human
aauggcaugcauuagcucacu

SEQ ID NO: 32195 - RNA, 24 nt, Human
gcaugguuuugugccaucuguagc

SEQ ID NO: 32196 - RNA, 22 nt, Human
guugguauuuuauaagcacaga

SEQ ID NO: 32197 - RNA, 27 nt, Human
ucuucugcucuuucuucuuccacacau

SEQ ID NO: 32198 - RNA, 22 nt, Human
ucccuauucccucucucuccca

SEQ ID NO: 32199 - RNA, 22 nt, Human
agcucagacaucuacuacagca

SEQ ID NO: 32200 - RNA, 22 nt, Human
aagcuguccccaucucaguguc

SEQ ID NO: 32201 - RNA, 22 nt, Human
gcucucugcaaccuccgccucc

SEQ ID NO: 32202 - RNA, 21 nt, Human
gucuccaaagcuggauugaug

SEQ ID NO: 32203 - RNA, 17 nt, Human
uuauuucucccugcccu

SEQ ID NO: 32204 - RNA, 23 nt, Human
ucguucaccuacauuugagaauu

SEQ ID NO: 32205 - RNA, 19 nt, Human
uagcaggguccugggggua

SEQ ID NO: 32206 - RNA, 22 nt, Human
ugugucuucaguagacaaguca

SEQ ID NO: 32207 - RNA, 20 nt, Human
guaaguuggucgcaugugaa

SEQ ID NO: 32208 - RNA, 20 nt, Human
aagcccagggugaagacagu

SEQ ID NO: 32209 - RNA, 19 nt, Human
ccaucuuuugcucuguaaa

SEQ ID NO: 32210 - RNA, 21 nt, Human
ugccuucagcacagaagaaga

SEQ ID NO: 32211 - RNA, 22 nt, Human
aggccgaggcaggcagaucaca

SEQ ID NO: 32212 - RNA, 20 nt, Human
cccugcaagcacaucaugac

SEQ ID NO: 32213 - RNA, 21 nt, Human
uguugcugggggaccuacaaa

SEQ ID NO: 32214 - RNA, 22 nt, Human
ccccacucugagugaauacuuu

SEQ ID NO: 32215 - RNA, 23 nt, Human
uagaagggcuagaaccuggaggg

SEQ ID NO: 32216 - RNA, 30 nt, Human
uacuugguaaagugcaguggggaagaggga

SEQ ID NO: 32217 - RNA, 23 nt, Human
acaacuugaagauuguagcaaua

SEQ ID NO: 32218 - RNA, 22 nt, Human
aucgcuugaacccaggagucag

SEQ ID NO: 32219 - RNA, 26 nt, Human
ggaaagggggcggaaaccucuccccu

SEQ ID NO: 32220 - RNA, 22 nt, Human
ugcccuucugcugacacuccug

SEQ ID NO: 32221 - RNA, 20 nt, Human
aauaucccccuuccucugca

SEQ ID NO: 32222 - RNA, 23 nt, Human
uuucaaaaacagcuacuuaaguu

SEQ ID NO: 32223 - RNA, 23 nt, Human
gcacugucaacacccacaggaga

SEQ ID NO: 32224 - RNA, 22 nt, Human
cgcagccgccgcuacaguccgg

SEQ ID NO: 32225 - RNA, 28 nt, Human
cgcgguucagcaugcaggaaaaagacgc

SEQ ID NO: 32226 - RNA, 23 nt, Human
gcacagccaagauucagagccag

SEQ ID NO: 32227 - RNA, 27 nt, Human
acuagcacauaccgcgugguguuugua

SEQ ID NO: 32228 - RNA, 20 nt, Human
gcuggcagcucuucccagug

SEQ ID NO: 32229 - RNA, 22 nt, Human
auucauauaaaugugcagaaag

SEQ ID NO: 32230 - RNA, 27 nt, Human
caggaagggggcggcgagucgugcgag

SEQ ID NO: 32231 - RNA, 26 nt, Human
cuguccaucugggccuuuguaugagc

SEQ ID NO: 32232 - RNA, 24 nt, Human
cuuucguacugcugaauguuuucc

SEQ ID NO: 32233 - RNA, 21 nt, Human
gcaaaauuucuguauauuccc

SEQ ID NO: 32234 - RNA, 24 nt, Human
augccucucuggcauuucagagcc

SEQ ID NO: 32235 - RNA, 20 nt, Human
uaccgcuccagcagccuggg

SEQ ID NO: 32236 - RNA, 22 nt, Human
ccugucaccaugacuuccucac

SEQ ID NO: 32237 - RNA, 24 nt, Human
ugaagcccgggauugguagagaag

SEQ ID NO: 32238 - RNA, 26 nt, Human
ggauacaauguauaagcuacucacuu

SEQ ID NO: 32239 - RNA, 18 nt, Human
ccacaccugacacuucca

SEQ ID NO: 32240 - RNA, 22 nt, Human
acugauggaugcccacuugccu

SEQ ID NO: 32241 - RNA, 22 nt, Human
cuccccucugccuuuuaaaccc

SEQ ID NO: 32242 - RNA, 21 nt, Human
ucucugccucucaccaggaca

SEQ ID NO: 32243 - RNA, 23 nt, Human
ggcaaaguuuucugggacuugau

SEQ ID NO: 32244 - RNA, 21 nt, Human
cccaacaccagccccugcccc

SEQ ID NO: 32245 - RNA, 26 nt, Human
gggaagggauacagagcuuggugggc

SEQ ID NO: 32246 - RNA, 20 nt, Human
aacuacuagaugugaacuug

SEQ ID NO: 32247 - RNA, 20 nt, Human
ggcccugagacccuagcucu

SEQ ID NO: 32248 - RNA, 22 nt, Human
uuuccuguacaggauguuugcc

SEQ ID NO: 32249 - RNA, 21 nt, Human
caguaacgcuacaaugaucau

SEQ ID NO: 32250 - RNA, 24 nt, Human
gaaguagcaaaaaguauugaaaug

SEQ ID NO: 32251 - RNA, 22 nt, Human
cuuucuuccuuuuggaauagua

SEQ ID NO: 32252 - RNA, 20 nt, Human
uuggggaggggagggggcgc

SEQ ID NO: 32253 - RNA, 25 nt, Human
aguguucuucuuucacacuucucaa

SEQ ID NO: 32254 - RNA, 22 nt, Human
gcauucuugcugacucugacag

SEQ ID NO: 32255 - RNA, 24 nt, Human
agucccuggccaggggugagaggc

SEQ ID NO: 32256 - RNA, 22 nt, Human
guccccaccucucucagcuucc

SEQ ID NO: 32257 - RNA, 21 nt, Human
ugucuccagcccugucuuucu

SEQ ID NO: 32258 - RNA, 27 nt, Human
cgggcuucauccacauccacaccucac

SEQ ID NO: 32259 - RNA, 21 nt, Human
uuucucuuggcuuuaaugaca

SEQ ID NO: 32260 - RNA, 22 nt, Human
uuugcugcugacacauggaacu

SEQ ID NO: 32261 - RNA, 27 nt, Human
uucauucucauuccaguuuauugaccu

SEQ ID NO: 32262 - RNA, 19 nt, Human
aguggugccaucucugucc

SEQ ID NO: 32263 - RNA, 27 nt, Human
aucucuagcuuauccucaguucuuagu

SEQ ID NO: 32264 - RNA, 15 nt, Human
cuucccuuaacucca

SEQ ID NO: 32265 - RNA, 25 nt, Human
cagcagccacaagugggcccagacu

SEQ ID NO: 32266 - RNA, 25 nt, Human
gccucuacauguauuucauuccccu

SEQ ID NO: 32267 - RNA, 22 nt, Human
uuccucuccuuccuugcugcaa

SEQ ID NO: 32268 - RNA, 21 nt, Human
ccuggcagaggcaaagaaagg

SEQ ID NO: 32269 - RNA, 19 nt, Human
uucaguuauaugugcugaa

SEQ ID NO: 32270 - RNA, 26 nt, Human
gcagccacagggaagcucacacaucc

SEQ ID NO: 32271 - RNA, 25 nt, Human
ggcuggggguuauuuugggagcagc

SEQ ID NO: 32272 - RNA, 20 nt, Human
gugacccacauuccccaaau

SEQ ID NO: 32273 - RNA, 22 nt, Human
gucccacuuccccuccuacccc

SEQ ID NO: 32274 - RNA, 22 nt, Human
ucccuuuaaacguuugccccug

SEQ ID NO: 32275 - RNA, 26 nt, Human
ggagaagggaagaguuauuccuccau

SEQ ID NO: 32276 - RNA, 20 nt, Human
uaggcuaugugugccuccaa

SEQ ID NO: 32277 - RNA, 27 nt, Human
gaccagccugggcaacauaguaagacc

SEQ ID NO: 32278 - RNA, 22 nt, Human
acugugaagaaugagaagggaa

SEQ ID NO: 32279 - RNA, 26 nt, Human
ucagcaucaugcuauuacaaucccaa

SEQ ID NO: 32280 - RNA, 21 nt, Human
cugugaucccagcuacucagg

SEQ ID NO: 32281 - RNA, 23 nt, Human
aaauguccacaauuuuaugaauu

SEQ ID NO: 32282 - RNA, 22 nt, Human
aucacuugaacccaggaggcgg

SEQ ID NO: 32283 - RNA, 22 nt, Human
ugugguucuuuguggcaagaua

SEQ ID NO: 32284 - RNA, 20 nt, Human
ccucccugucaccugccucc

SEQ ID NO: 32285 - RNA, 20 nt, Human
acucggccuccucuccuggg

SEQ ID NO: 32286 - RNA, 23 nt, Human
agugcccagagugacagcuguau

SEQ ID NO: 32287 - RNA, 28 nt, Human
gcacagagguccuggcuggaccgagcag

SEQ ID NO: 32288 - RNA, 27 nt, Human
ugcugugugaccuugggcaaguuccuu

SEQ ID NO: 32289 - RNA, 19 nt, Human
cugccucuggguuuuuguu

SEQ ID NO: 32290 - RNA, 22 nt, Human
ccuugcucuccgcucuuacgcu

SEQ ID NO: 32291 - RNA, 23 nt, Human
aucaccccacuuccaucauuucc

SEQ ID NO: 32292 - RNA, 22 nt, Human
acagagcagugcuagucgggcu

SEQ ID NO: 32293 - RNA, 20 nt, Human
caccccuuccucagccuggg

SEQ ID NO: 32294 - RNA, 24 nt, Human
cacacacaaucacugccacucuca

SEQ ID NO: 32295 - RNA, 22 nt, Human
cucaacuggacaucacagcaga

SEQ ID NO: 32296 - RNA, 20 nt, Human
cuuucagacagcauucuugc

SEQ ID NO: 32297 - RNA, 20 nt, Human
gccagccugccugcccagcg

SEQ ID NO: 32298 - RNA, 27 nt, Human
uucuggcccguggccuuuaauuuucuu

SEQ ID NO: 32299 - RNA, 22 nt, Human
cuuugacauccccuugugucuc

SEQ ID NO: 32300 - RNA, 23 nt, Human
uguuuuuucuuuagcaaaccagg

SEQ ID NO: 32301 - RNA, 25 nt, Human
gacuacaggugugcgcacaugccag

SEQ ID NO: 32302 - RNA, 22 nt, Human
aauuuaugguugugugcccagu

SEQ ID NO: 32303 - RNA, 21 nt, Human
caccacugcuuccuacccagg

SEQ ID NO: 32304 - RNA, 19 nt, Human
gugucuggugaggguccuc

SEQ ID NO: 32305 - RNA, 24 nt, Human
acagucagggaaggacucucacuu

SEQ ID NO: 32306 - RNA, 27 nt, Human
cugucacaaauagcagcaccacuuugg

SEQ ID NO: 32307 - RNA, 21 nt, Human
ccgggagcagagguucuauga

SEQ ID NO: 32308 - RNA, 22 nt, Human
gagcaaugcacuguaccugccu

SEQ ID NO: 32309 - RNA, 25 nt, Human
ggcuggcauauuaacaccugccuuc

SEQ ID NO: 32310 - RNA, 23 nt, Human
acacugucauaacacacauagau

SEQ ID NO: 32311 - RNA, 27 nt, Human
agcgggagcgggcgaggaugggcacag

SEQ ID NO: 32312 - RNA, 23 nt, Human
ccagcaagcugggacuggcagga

SEQ ID NO: 32313 - RNA, 20 nt, Human
uuccugggagagagcccccc

SEQ ID NO: 32314 - RNA, 23 nt, Human
ggaucuagccugggugaguaugg

SEQ ID NO: 32315 - RNA, 21 nt, Human
ggugagccaccgugcccaacc

SEQ ID NO: 32316 - RNA, 25 nt, Human
ggucggaagugagugaaggagccag

SEQ ID NO: 32317 - RNA, 24 nt, Human
caaacagaugguugcucagggaca

SEQ ID NO: 32318 - RNA, 22 nt, Human
gcuuuuuggagcuaagccuggg

SEQ ID NO: 32319 - RNA, 27 nt, Human
gaggaagacggaaaagacugccugccu

SEQ ID NO: 32320 - RNA, 20 nt, Human
ggcaguuucagggccccucc

SEQ ID NO: 32321 - RNA, 25 nt, Human
ugggguucaauacuggaagugccuu

SEQ ID NO: 32322 - RNA, 22 nt, Human
uugggaggcugaggcagcauug

SEQ ID NO: 32323 - RNA, 21 nt, Human
cauacuuguaacccagcacuu

SEQ ID NO: 32324 - RNA, 21 nt, Human
gacucacugcaagcuccgccu

SEQ ID NO: 32325 - RNA, 22 nt, Human
cgcccaggcugcagugcagugg

SEQ ID NO: 32326 - RNA, 21 nt, Human
ccccagaggcuggcagaggga

SEQ ID NO: 32327 - RNA, 25 nt, Human
ccacuucucugaaggagggcugggu

SEQ ID NO: 32328 - RNA, 28 nt, Human
gaggcagggagagaaugagccccgggac

SEQ ID NO: 32329 - RNA, 22 nt, Human
ucugagaguuauuacagccaga

SEQ ID NO: 32330 - RNA, 29 nt, Human
cuguucuggacugugccuguuaguugcuc

SEQ ID NO: 32331 - RNA, 26 nt, Human
cccuccaggccaagagucucagcugg

SEQ ID NO: 32332 - RNA, 21 nt, Human
gggagagagaagaagaguggg

SEQ ID NO: 32333 - RNA, 19 nt, Human
ggagacuucucucugugau

SEQ ID NO: 32334 - RNA, 23 nt, Human
cucagaaaaacacacaccaccuu

SEQ ID NO: 32335 - RNA, 26 nt, Human
aucaguauuaucaaccaauaguugau

SEQ ID NO: 32336 - RNA, 27 nt, Human
uuccauucaggaugccggcuuuauuaa

SEQ ID NO: 32337 - RNA, 29 nt, Human
gggaggcagcagacagggagccaccagca

SEQ ID NO: 32338 - RNA, 18 nt, Human
uuucuugccagcucagca

SEQ ID NO: 32339 - RNA, 26 nt, Human
gaggcugagguuaaggucuuagagcc

SEQ ID NO: 32340 - RNA, 21 nt, Human
uucccucugcuggucugugcu

SEQ ID NO: 32341 - RNA, 27 nt, Human
cugugugaccuucgcccuguguccuuc

SEQ ID NO: 32342 - RNA, 22 nt, Human
gacugcacuccagccuggguga

SEQ ID NO: 32343 - RNA, 21 nt, Human
cuuccaucgcccugccuacac

SEQ ID NO: 32344 - RNA, 22 nt, Human
ucuuuucucacuucaauccuua

SEQ ID NO: 32345 - RNA, 27 nt, Human
ucaucuugaagcccaguuaucugugau

SEQ ID NO: 32346 - RNA, 22 nt, Human
cacugcacuccagacuggguga

SEQ ID NO: 32347 - RNA, 24 nt, Human
gaauuauucaacaccuuuaacaau

SEQ ID NO: 32348 - RNA, 29 nt, Human
cucagccaccugaccuccauguaccugaa

SEQ ID NO: 32349 - RNA, 22 nt, Human
uggguguccuaggaaccuuuua

SEQ ID NO: 32350 - RNA, 24 nt, Human
ggcccucugucacauuuuucuuca

SEQ ID NO: 32351 - RNA, 25 nt, Human
guggggcugggaccuggugggugaa

SEQ ID NO: 32352 - RNA, 22 nt, Human
ggggagggcagguccagcucug

SEQ ID NO: 32353 - RNA, 21 nt, Human
ggcuuugaaacugaacaagau

SEQ ID NO: 32354 - RNA, 22 nt, Human
guaagcugacuggccccaggga

SEQ ID NO: 32355 - RNA, 26 nt, Human
caagcucaucccuggacuucugggag

SEQ ID NO: 32356 - RNA, 23 nt, Human
uggcgcuucauggagaacuucca

SEQ ID NO: 32357 - RNA, 22 nt, Human
ccccaaacccaggccccaugca

SEQ ID NO: 32358 - RNA, 23 nt, Human
gauuaaacagacuuuagcuuaca

SEQ ID NO: 32359 - RNA, 21 nt, Human
cagauuaucuuguacagccuu

SEQ ID NO: 32360 - RNA, 24 nt, Human
uccucauucccuucuguaugacag

SEQ ID NO: 32361 - RNA, 24 nt, Human
ccagagggcggguacaaggcuguc

SEQ ID NO: 32362 - RNA, 29 nt, Human
ucuccuccuccuucaugcagccaggauug

SEQ ID NO: 32363 - RNA, 32 nt, Human
caggauucuagguggagguugugcauguuguc

SEQ ID NO: 32364 - RNA, 22 nt, Human
gcgaucuuggcucacugcaacc

SEQ ID NO: 32365 - RNA, 27 nt, Human
uuccuuuguaacagaguuuuacgacuu

SEQ ID NO: 32366 - RNA, 27 nt, Human
ggguccccaugggaaagggacaugcaa

SEQ ID NO: 32367 - RNA, 20 nt, Human
uucauuucauaaggaaauga

SEQ ID NO: 32368 - RNA, 24 nt, Human
gcacagacacugacaagcacgcac

SEQ ID NO: 32369 - RNA, 26 nt, Human
ccagaagagagggucuggggccuggu

SEQ ID NO: 32370 - RNA, 27 nt, Human
gaaagcuuuauauuugugugaggacuu

SEQ ID NO: 32371 - RNA, 22 nt, Human
cuccacccugccucugcauccc

SEQ ID NO: 32372 - RNA, 19 nt, Human
aaaaccugacuucagugaa

SEQ ID NO: 32373 - RNA, 25 nt, Human
ucagccccgacuuccugacucucac

SEQ ID NO: 32374 - RNA, 20 nt, Human
agcaggacaccuggagggga

SEQ ID NO: 32375 - RNA, 27 nt, Human
acaaaacaaaacaguaagauugucugu

SEQ ID NO: 32376 - RNA, 22 nt, Human
ggguuccagggacuguaccugu

SEQ ID NO: 32377 - RNA, 20 nt, Human
acaguuacagagaucaguca

SEQ ID NO: 32378 - RNA, 21 nt, Human
gccugcaggggccacucucua

SEQ ID NO: 32379 - RNA, 26 nt, Human
acucacuggaccgcuccuagaaaggc

SEQ ID NO: 32380 - RNA, 27 nt, Human
ccagcuggccccuauguuguguucugg

SEQ ID NO: 32381 - RNA, 21 nt, Human
ucagggaagcugcccaggaag

SEQ ID NO: 32382 - RNA, 22 nt, Human
ugcuggaccccugaaaaccauu

SEQ ID NO: 32383 - RNA, 23 nt, Human
ccgggaggcagagguugcaguga

SEQ ID NO: 32384 - RNA, 23 nt, Human
ucguacuugcuguggcuacuucu

SEQ ID NO: 32385 - RNA, 23 nt, Human
ucucuccauagaacagcacuauc

SEQ ID NO: 32386 - RNA, 22 nt, Human
gcggugcccuggccggcgaugg

SEQ ID NO: 32387 - RNA, 20 nt, Human
auuggccaggcuggugucga

SEQ ID NO: 32388 - RNA, 25 nt, Human
cuuucacugauuucugaaucauguu

SEQ ID NO: 32389 - RNA, 20 nt, Human
gcaaaacugcaguguuugga

SEQ ID NO: 32390 - RNA, 22 nt, Human
cccacccccagcacccccaucu

SEQ ID NO: 32391 - RNA, 21 nt, Human
uugaugaaguccucccaggga

SEQ ID NO: 32392 - RNA, 21 nt, Human
gucauuguuauuuauacaaga

SEQ ID NO: 32393 - RNA, 27 nt, Human
uuacaugcucccaggucauugucaguu

SEQ ID NO: 32394 - RNA, 23 nt, Human
gcuguuaaagaugccacugauga

SEQ ID NO: 32395 - RNA, 22 nt, Human
ccgaaagugcugggauuacagg

SEQ ID NO: 32396 - RNA, 21 nt, Human
gcacaucucccugcugcaccc

SEQ ID NO: 32397 - RNA, 22 nt, Human
cccuccaggacaggagaucugg

SEQ ID NO: 32398 - RNA, 23 nt, Human
gcuucacucucucauucuuagcu

SEQ ID NO: 32399 - RNA, 21 nt, Human
cagaggagaaggcugagaccc

SEQ ID NO: 32400 - RNA, 22 nt, Human
cacuuuacauuuagauucuggu

SEQ ID NO: 32401 - RNA, 24 nt, Human
gauggcacuccggccaccuccucc

SEQ ID NO: 32402 - RNA, 20 nt, Human
aguacucaggcagugcagua

SEQ ID NO: 32403 - RNA, 23 nt, Human
gcagcagucuucauuguggugcu

SEQ ID NO: 32404 - RNA, 22 nt, Human
ggccuuugggguucaagaucac

SEQ ID NO: 32405 - RNA, 22 nt, Human
gccuggcccuggcaaggggcgg

SEQ ID NO: 32406 - RNA, 20 nt, Human
ugugugcugcgggaggcaga

SEQ ID NO: 32407 - RNA, 27 nt, Human
cagcccugccuggauuuguauccuugg

SEQ ID NO: 32408 - RNA, 22 nt, Human
guugccaggcuggagugcagug

SEQ ID NO: 32409 - RNA, 25 nt, Human
acaaugugaaaccaucacagcuggg

SEQ ID NO: 32410 - RNA, 25 nt, Human
cacauacagaagagcaacaacaaac

SEQ ID NO: 32411 - RNA, 26 nt, Human
ugugaugccuccaugccccgagggcc

SEQ ID NO: 32412 - RNA, 25 nt, Human
ggguaugaacuucugccuucacgcu

SEQ ID NO: 32413 - RNA, 24 nt, Human
gcaaguccacauggagauuuggag

SEQ ID NO: 32414 - RNA, 20 nt, Human
gucucuaggcugaggcggcg

SEQ ID NO: 32415 - RNA, 25 nt, Human
uccuaucauguuaaccucugcuuuu

SEQ ID NO: 32416 - RNA, 14 nt, Human
accauaaagccuuu

SEQ ID NO: 32417 - RNA, 27 nt, Human
ggccugacagacaagcagaugaccuca

SEQ ID NO: 32418 - RNA, 21 nt, Human
cagccaggcgccuccccaccg

SEQ ID NO: 32419 - RNA, 23 nt, Human
gaguaacaggcuuauuccacuuu

SEQ ID NO: 32420 - RNA, 23 nt, Human
uuuagcccuccuucccucuuucu

SEQ ID NO: 32421 - RNA, 19 nt, Human
gcccaggcuggagggcagu

SEQ ID NO: 32422 - RNA, 19 nt, Human
gcccaugcuggagugcagu

SEQ ID NO: 32423 - RNA, 20 nt, Human
cuccagguccuucagucucc

SEQ ID NO: 32424 - RNA, 27 nt, Human
ccccagccuggggugaggguaaggggu

SEQ ID NO: 32425 - RNA, 21 nt, Human
ggcucacuguaaccucugccu

SEQ ID NO: 32426 - RNA, 21 nt, Human
ggauucucuucauggccaggu

SEQ ID NO: 32427 - RNA, 21 nt, Human
ccagccuggaugacagagugg

SEQ ID NO: 32428 - RNA, 23 nt, Human
cgugacagccggcaggcccagcc

SEQ ID NO: 32429 - RNA, 21 nt, Human
cgacccacccauucucaccac

SEQ ID NO: 32430 - RNA, 28 nt, Human
agcuugcuggcauauggacugaaagaaa

SEQ ID NO: 32431 - RNA, 24 nt, Human
acccuaugccuuuuguagcuguca

SEQ ID NO: 32432 - RNA, 23 nt, Human
ucuaagaugaauuuaccagguga

SEQ ID NO: 32433 - RNA, 25 nt, Human
agcagcuuggggagagggauuuccc

SEQ ID NO: 32434 - RNA, 22 nt, Human
ccuaguugauagaaaugggggu

SEQ ID NO: 32435 - RNA, 28 nt, Human
gacccugucucugccaaaaaauuuuuua

SEQ ID NO: 32436 - RNA, 18 nt, Human
aaaugaacuuugcuuuuu

SEQ ID NO: 32437 - RNA, 24 nt, Human
accgacucagauucagacucugag

SEQ ID NO: 32438 - RNA, 26 nt, Human
gccuguguguuugugggcccugagag

SEQ ID NO: 32439 - RNA, 20 nt, Human
gcgggccaccaggcugcagu

SEQ ID NO: 32440 - RNA, 25 nt, Human
cggcguccugugccccucugcuccg

SEQ ID NO: 32441 - RNA, 21 nt, Human
ccugccugacccuagcugugc

SEQ ID NO: 32442 - RNA, 22 nt, Human
guggaggaacuucaucccacug

SEQ ID NO: 32443 - RNA, 23 nt, Human
ggugaucuuaauuacuuucagaa

SEQ ID NO: 32444 - RNA, 23 nt, Human
accacaccuggcuaauuuuuacu

SEQ ID NO: 32445 - RNA, 25 nt, Human
cgaauacuuugaauguuguguaaca

SEQ ID NO: 32446 - RNA, 19 nt, Human
accauaaagauauucuuua

SEQ ID NO: 32447 - RNA, 30 nt, Human
agcuggauuuaaucaucccugcccuacaua

SEQ ID NO: 32448 - RNA, 23 nt, Human
ggaagaagagaccugggcuugga

SEQ ID NO: 32449 - RNA, 27 nt, Human
agggggauggccauggaaggguugagg

SEQ ID NO: 32450 - RNA, 18 nt, Human
cgucaagccuuucaccuu

SEQ ID NO: 32451 - RNA, 27 nt, Human
ucugcagcuccagguacauaucacgcg

SEQ ID NO: 32452 - RNA, 25 nt, Human
ucuguggguuucugguccagugucc

SEQ ID NO: 32453 - RNA, 22 nt, Human
uccuggguaaaucugaaugaaa

SEQ ID NO: 32454 - RNA, 26 nt, Human
aauguucuauacaguggacagcccuc

SEQ ID NO: 32455 - RNA, 23 nt, Human
uguugcccaggcuggucuccaac

SEQ ID NO: 32456 - RNA, 20 nt, Human
aacagaagauccaaguuuaa

SEQ ID NO: 32457 - RNA, 22 nt, Human
gaaccagggagucagagguuuc

SEQ ID NO: 32458 - RNA, 23 nt, Human
aaccauggugauuaaaaugaguu

SEQ ID NO: 32459 - RNA, 22 nt, Human
agucucucaaagugcugggauu

SEQ ID NO: 32460 - RNA, 22 nt, Human
ucgucucaagggaccucccuca

SEQ ID NO: 32461 - RNA, 21 nt, Human
aagauuguugguuaggccaga

SEQ ID NO: 32462 - RNA, 24 nt, Human
aaugaaaauuccuuuccucuugga

SEQ ID NO: 32463 - RNA, 26 nt, Human
caucacagcccaggcucaccccaaga

SEQ ID NO: 32464 - RNA, 21 nt, Human
gcucccgucaccacugcaacc

SEQ ID NO: 32465 - RNA, 27 nt, Human
uugcccaggcuggucugaagcugcugg

SEQ ID NO: 32466 - RNA, 22 nt, Human
acccuguguaacaggaccccaa

SEQ ID NO: 32467 - RNA, 22 nt, Human
gagccuggcccugaagcguuuu

SEQ ID NO: 32468 - RNA, 21 nt, Human
gguugcuugggccacugcccu

SEQ ID NO: 32469 - RNA, 27 nt, Human
acaagggcugagauucuucguguauag

SEQ ID NO: 32470 - RNA, 25 nt, Human
uggggcugcugcuugagugcagagg

SEQ ID NO: 32471 - RNA, 22 nt, Human
ucuguauauuugugaugcaaug

SEQ ID NO: 32472 - RNA, 22 nt, Human
gggacuuccuucgucagcacug

SEQ ID NO: 32473 - RNA, 21 nt, Human
ccugugccccaaagaugaggg

SEQ ID NO: 32474 - RNA, 22 nt, Human
gagacagcccaccuugaagggg

SEQ ID NO: 32475 - RNA, 22 nt, Human
auacauacuuauucccauuuuu

SEQ ID NO: 32476 - RNA, 23 nt, Human
gcucccaagugcaaccucugucu

SEQ ID NO: 32477 - RNA, 21 nt, Human
ugcacauguuggaguguggug

SEQ ID NO: 32478 - RNA, 25 nt, Human
gccugagucucagcauggcggaugg

SEQ ID NO: 32479 - RNA, 19 nt, Human
gagcacccuuccuccuggg

SEQ ID NO: 32480 - RNA, 23 nt, Human
gacacuguuacagagauacuguu

SEQ ID NO: 32481 - RNA, 22 nt, Human
ucugcucccuacuggcugucuu

SEQ ID NO: 32482 - RNA, 21 nt, Human
ucugggagucaggcccggccu

SEQ ID NO: 32483 - RNA, 22 nt, Human
uuguacagugagugaaguauag

SEQ ID NO: 32484 - RNA, 26 nt, Human
gaccuacaguccauggucuacagaug

SEQ ID NO: 32485 - RNA, 27 nt, Human
uaauccuuucuccugccgcaguggaga

SEQ ID NO: 32486 - RNA, 20 nt, Human
ucagcagacugguuugcagu

SEQ ID NO: 32487 - RNA, 26 nt, Human
ccgagccuggcccgccgcgaugcugu

SEQ ID NO: 32488 - RNA, 21 nt, Human
accaagaauugcaggcauaug

SEQ ID NO: 32489 - RNA, 22 nt, Human
aggaauguuaaagucaguggga

SEQ ID NO: 32490 - RNA, 21 nt, Human
agaaucugagacaucuugccu

SEQ ID NO: 32491 - RNA, 22 nt, Human
gaaagacuuguuuguucugcuu

SEQ ID NO: 32492 - RNA, 23 nt, Human
ccagucauuaaaguccaguauua

SEQ ID NO: 32493 - RNA, 19 nt, Human
uugagccaucaccaaucag

SEQ ID NO: 32494 - RNA, 21 nt, Human
uuuuagaguggcuaguaguuu

SEQ ID NO: 32495 - RNA, 26 nt, Human
gaugagagccaggugcugcagccuga

SEQ ID NO: 32496 - RNA, 23 nt, Human
gguauuucuuugauacuuguaau

SEQ ID NO: 32497 - RNA, 22 nt, Human
gggagguggagauugcagugag

SEQ ID NO: 32498 - RNA, 22 nt, Human
ucauccaggcucccaaaagagg

SEQ ID NO: 32499 - RNA, 20 nt, Human
uuugagacuggccugggcag

SEQ ID NO: 32500 - RNA, 21 nt, Human
acacugugaacuucuaaagca

SEQ ID NO: 32501 - RNA, 19 nt, Human
aacacaugaaucuuuuuug

SEQ ID NO: 32502 - RNA, 21 nt, Human
gagcacaggcugggguggaug

SEQ ID NO: 32503 - RNA, 22 nt, Human
uugggggugguggaugaacaaa

SEQ ID NO: 32504 - RNA, 20 nt, Human
caaaacugauacccuuugaa

SEQ ID NO: 32505 - RNA, 24 nt, Human
cagaaggcuccugcccccauagug

SEQ ID NO: 32506 - RNA, 22 nt, Human
ggagguugaggugggaggauca

SEQ ID NO: 32507 - RNA, 20 nt, Human
gacaggcaugaaucacugug

SEQ ID NO: 32508 - RNA, 19 nt, Human
ugggggcugggugcagugg

SEQ ID NO: 32509 - RNA, 21 nt, Human
aauguguucuaaaacagcaga

SEQ ID NO: 32510 - RNA, 25 nt, Human
ucuuggugucugcuuucucagauuc

SEQ ID NO: 32511 - RNA, 27 nt, Human
cccugacccagaggaagccucuauuua

SEQ ID NO: 32512 - RNA, 23 nt, Human
ccaaaacagccugagcaaaaaga

SEQ ID NO: 32513 - RNA, 22 nt, Human
ugggacccccuguggcccucgc

SEQ ID NO: 32514 - RNA, 27 nt, Human
aagacaaggugaagaggauaaugagua

SEQ ID NO: 32515 - RNA, 25 nt, Human
gccagcugccccuccugggagggcc

SEQ ID NO: 32516 - RNA, 24 nt, Human
gccuuucuccagcccaugcuggcu

SEQ ID NO: 32517 - RNA, 21 nt, Human
aggcuggaauguaguggagag

SEQ ID NO: 32518 - RNA, 23 nt, Human
uucgccaaggcuggagugcagug

SEQ ID NO: 32519 - RNA, 19 nt, Human
uuaaaaaagaaaacaaaaa

SEQ ID NO: 32520 - RNA, 21 nt, Human
gcuguaaaccaaaagccacug

SEQ ID NO: 32521 - RNA, 25 nt, Human
ccuccugucugugucguucucugug

SEQ ID NO: 32522 - RNA, 23 nt, Human
caccuccacuccggcaucagcag

SEQ ID NO: 32523 - RNA, 19 nt, Human
gauugcuugagccuaggag

SEQ ID NO: 32524 - RNA, 27 nt, Human
ccaugaucuauaggaccuccuaaugag

SEQ ID NO: 32525 - RNA, 20 nt, Human
ugagccaaggaggcuuggga

SEQ ID NO: 32526 - RNA, 21 nt, Human
ccaaaacagcauuuucaguuc

SEQ ID NO: 32527 - RNA, 26 nt, Human
uaagaaaauauuucuuagcaacauuu

SEQ ID NO: 32528 - RNA, 21 nt, Human
gugggcaggaucucaagccag

SEQ ID NO: 32529 - RNA, 22 nt, Human
ggagaagaaagagaaaugugca

SEQ ID NO: 32530 - RNA, 29 nt, Human
acgcacaggccaccuuccuucuggcaggg

SEQ ID NO: 32531 - RNA, 19 nt, Human
uuaagguugggugcugcua

SEQ ID NO: 32532 - RNA, 23 nt, Human
auuguucaaagauccagugcagu

SEQ ID NO: 32533 - RNA, 22 nt, Human
aacuuguuacagccuucacauu

SEQ ID NO: 32534 - RNA, 21 nt, Human
acucuucuugagcagaccgug

SEQ ID NO: 32535 - RNA, 27 nt, Human
gcccacucucccuguuacacacugccc

SEQ ID NO: 32536 - RNA, 22 nt, Human
cucaacaacacaacuucaccca

SEQ ID NO: 32537 - RNA, 19 nt, Human
cuucccuuucuauaagcua

SEQ ID NO: 32538 - RNA, 22 nt, Human
ccgagaucgugccauugcauuc

SEQ ID NO: 32539 - RNA, 22 nt, Human
caucccucccugccggccucag

SEQ ID NO: 32540 - RNA, 27 nt, Human
ugggagguggggccuuagugccucacc

SEQ ID NO: 32541 - RNA, 21 nt, Human
cugucaggaaaccuaccugaa

SEQ ID NO: 32542 - RNA, 23 nt, Human
gcugguggcaauaaauauuagaa

SEQ ID NO: 32543 - RNA, 22 nt, Human
agggagaauuuauuuuuugaaa

SEQ ID NO: 32544 - RNA, 20 nt, Human
ccccacccccgcugggggug

SEQ ID NO: 32545 - RNA, 19 nt, Human
ggaaggggaucccacccca

SEQ ID NO: 32546 - RNA, 22 nt, Human
gccuaggaaagccaguuacaua

SEQ ID NO: 32547 - RNA, 24 nt, Human
ugggacaauggggggugggggugg

SEQ ID NO: 32548 - RNA, 21 nt, Human
aaaugauuguacauaguguua

SEQ ID NO: 32549 - RNA, 21 nt, Human
cccaauuaaguugaucuuuga

SEQ ID NO: 32550 - RNA, 27 nt, Human
gaccagccugggcaauauagcaagacc

SEQ ID NO: 32551 - RNA, 22 nt, Human
ugcggugagcccagaucgcgcc

SEQ ID NO: 32552 - RNA, 23 nt, Human
ucguagaacuagggcugcaggaa

SEQ ID NO: 32553 - RNA, 20 nt, Human
guaaggaaggugcucacaua

SEQ ID NO: 32554 - RNA, 25 nt, Human
gggaggcaagcacaaacuaggaaga

SEQ ID NO: 32555 - RNA, 26 nt, Human
uccccacucugcucugaugcaucaga

SEQ ID NO: 32556 - RNA, 20 nt, Human
ggggacgguggcaggagcgc

SEQ ID NO: 32557 - RNA, 21 nt, Human
gaguuugagaccagcuggggc

SEQ ID NO: 32558 - RNA, 21 nt, Human
ucagccugggggauacaguga

SEQ ID NO: 32559 - RNA, 22 nt, Human
gcugcccucucuggcucagggg

SEQ ID NO: 32560 - RNA, 25 nt, Human
cgagagggaggcagguggacgcugc

SEQ ID NO: 32561 - RNA, 20 nt, Human
ugcagccugcccccuaggca

SEQ ID NO: 32562 - RNA, 22 nt, Human
ccaugccuggcccugccugagc

SEQ ID NO: 32563 - RNA, 21 nt, Human
auuugguuaucuuacugggac

SEQ ID NO: 32564 - RNA, 27 nt, Human
ccaagccccucccccuaaggcagcugg

SEQ ID NO: 32565 - RNA, 20 nt, Human
ccuuugcaaaguuccagagg

SEQ ID NO: 32566 - RNA, 24 nt, Human
ugcuuaaguuuugaaccaaauccu

SEQ ID NO: 32567 - RNA, 25 nt, Human
uuuagcuaauucuaauuaaaaauua

SEQ ID NO: 32568 - RNA, 20 nt, Human
ucugccugugggucugagga

SEQ ID NO: 32569 - RNA, 21 nt, Human
ccuggguggcuuaugagagag

SEQ ID NO: 32570 - RNA, 20 nt, Human
aaaauugaaguuggguuggc

SEQ ID NO: 32571 - RNA, 22 nt, Human
ccgaguggagagagcgagcuga

SEQ ID NO: 32572 - RNA, 21 nt, Human
uucccaagcccuggcucauga

SEQ ID NO: 32573 - RNA, 21 nt, Human
ccacuucuagcagaucaugcc

SEQ ID NO: 32574 - RNA, 24 nt, Human
gacagugacaacccuuucucucca

SEQ ID NO: 32575 - RNA, 27 nt, Human
ccguuccccaguggcuguauccagccu

SEQ ID NO: 32576 - RNA, 26 nt, Human
gguucucccgggacaccagcagaucc

SEQ ID NO: 32577 - RNA, 21 nt, Human
agcagagugaggauguguuuu

SEQ ID NO: 32578 - RNA, 22 nt, Human
agaaaugugaacugugaugggg

SEQ ID NO: 32579 - RNA, 21 nt, Human
gggccauccuaucaucuggag

SEQ ID NO: 32580 - RNA, 21 nt, Human
ccuccugcagugucugaagcg

SEQ ID NO: 32581 - RNA, 26 nt, Human
acaaaugguuuuuauuucacaguuau

SEQ ID NO: 32582 - RNA, 24 nt, Human
cacaucacacaccauccccacugu

SEQ ID NO: 32583 - RNA, 26 nt, Human
ugcccaaccuggagugcaguggugcg

SEQ ID NO: 32584 - RNA, 24 nt, Human
acacccuacaaguugaucaugcag

SEQ ID NO: 32585 - RNA, 23 nt, Human
cacugcugcacuccagccugcgg

SEQ ID NO: 32586 - RNA, 24 nt, Human
cuuuaagucucagcagaagauacg

SEQ ID NO: 32587 - RNA, 26 nt, Human
guguggccccgcagugcccccaccca

SEQ ID NO: 32588 - RNA, 27 nt, Human
ccacugcacuccagccugggcuacaga

SEQ ID NO: 32589 - RNA, 20 nt, Human
uacgcuacaucuuguuuucu

SEQ ID NO: 32590 - RNA, 16 nt, Human
acugcuuucugggcaa

SEQ ID NO: 32591 - RNA, 22 nt, Human
ugggaagacaaaacaagaauga

SEQ ID NO: 32592 - RNA, 27 nt, Human
cuuuauuaucuugucagucacuaccuc

SEQ ID NO: 32593 - RNA, 21 nt, Human
ccgccuuguugccugcuuugu

SEQ ID NO: 32594 - RNA, 26 nt, Human
ccugcaggaagcgaauucggcagaag

SEQ ID NO: 32595 - RNA, 18 nt, Human
gcaacaugcauguuuaca

SEQ ID NO: 32596 - RNA, 23 nt, Human
acagaaguggccuguaagcuccu

SEQ ID NO: 32597 - RNA, 27 nt, Human
gacaucagauccugggcacauucuuuu

SEQ ID NO: 32598 - RNA, 22 nt, Human
ccacuacacuccagccugggug

SEQ ID NO: 32599 - RNA, 22 nt, Human
ccacugcacuccaaccugggug

SEQ ID NO: 32600 - RNA, 23 nt, Human
cagcucuuuccacacggggccgu

SEQ ID NO: 32601 - RNA, 19 nt, Human
gccuguuagcacagugccu

SEQ ID NO: 32602 - RNA, 22 nt, Human
gcagcaacccagcccauggaga

SEQ ID NO: 32603 - RNA, 21 nt, Human
gcucuccgagucugugucucc

SEQ ID NO: 32604 - RNA, 25 nt, Human
gcccucuccucccccuccuaggggg

SEQ ID NO: 32605 - RNA, 20 nt, Human
uaggcuaucucaacacugcu

SEQ ID NO: 32606 - RNA, 22 nt, Human
gcugccggaagucaucccagug

SEQ ID NO: 32607 - RNA, 22 nt, Human
uuauuuuucugucaucaaacaa

SEQ ID NO: 32608 - RNA, 23 nt, Human
aacuaucuccccuuccucugucc

SEQ ID NO: 32609 - RNA, 22 nt, Human
ccaggagguugagaaugcagug

SEQ ID NO: 32610 - RNA, 20 nt, Human
ccugcagcuccgcaccugcg

SEQ ID NO: 32611 - RNA, 25 nt, Human
cagcacauccucacacccaaagaag

SEQ ID NO: 32612 - RNA, 21 nt, Human
ugcuuucagauuaaaauuguu

SEQ ID NO: 32613 - RNA, 22 nt, Human
uuggaaaagagaagaugaaggg

SEQ ID NO: 32614 - RNA, 23 nt, Human
ccugguucugcuauccuuaguca

SEQ ID NO: 32615 - RNA, 27 nt, Human
gacagcagccacucaguucuuccucca

SEQ ID NO: 32616 - RNA, 29 nt, Human
gagccccgcggaagagcagaacguuuggg

SEQ ID NO: 32617 - RNA, 21 nt, Human
uggggcacuuacuauguacua

SEQ ID NO: 32618 - RNA, 26 nt, Human
gggcaguacacaggaagaggagccag

SEQ ID NO: 32619 - RNA, 24 nt, Human
agcccgugcccgggagcggcggcg

SEQ ID NO: 32620 - RNA, 21 nt, Human
ugaaguggggacggaauagac

SEQ ID NO: 32621 - RNA, 15 nt, Human
cuucccuuauggcau

SEQ ID NO: 32622 - RNA, 20 nt, Human
cccucuuuguuucugcuuca

SEQ ID NO: 32623 - RNA, 30 nt, Human
ggagcagccucuacccucagcauccuggcc

SEQ ID NO: 32624 - RNA, 29 nt, Human
cuccccucgccuaagcugcuggggggcgc

SEQ ID NO: 32625 - RNA, 25 nt, Human
cuuccaccaggagucuggagugcaa

SEQ ID NO: 32626 - RNA, 24 nt, Human
uuuaucucaguuucccaaaggaca

SEQ ID NO: 32627 - RNA, 22 nt, Human
gcccaggcuggagcauaguggc

SEQ ID NO: 32628 - RNA, 22 nt, Human
gcaagaaguccuuggggaagcu

SEQ ID NO: 32629 - RNA, 26 nt, Human
cccauguuggccucugcaaccacaca

SEQ ID NO: 32630 - RNA, 26 nt, Human
uggggcugcgaccuccagacucucca

SEQ ID NO: 32631 - RNA, 22 nt, Human
cauuguacuccagccuguguga

SEQ ID NO: 32632 - RNA, 27 nt, Human
gaaaugagacuguucgugagugauggc

SEQ ID NO: 32633 - RNA, 21 nt, Human
gccacuugggcaggaggcagg

SEQ ID NO: 32634 - RNA, 27 nt, Human
cauggugcuuuucugagcagaucaaua

SEQ ID NO: 32635 - RNA, 28 nt, Human
uggcuaacacgggugaaaccccgucucu

SEQ ID NO: 32636 - RNA, 22 nt, Human
uucauucugccaaaguaaaaca

SEQ ID NO: 32637 - RNA, 27 nt, Human
ugggaggcugaggcaagagaauugcuu

SEQ ID NO: 32638 - RNA, 24 nt, Human
cuggguccuugggccuggccaguc

SEQ ID NO: 32639 - RNA, 25 nt, Human
aacuaugauuccaauuacuacuuug

SEQ ID NO: 32640 - RNA, 22 nt, Human
aauacccuuuuucuuuuaguau

SEQ ID NO: 32641 - RNA, 23 nt, Human
ggagguaggguggggagcgggac

SEQ ID NO: 32642 - RNA, 23 nt, Human
cuuuuucuaggcucuaccaauaa

SEQ ID NO: 32643 - RNA, 24 nt, Human
acuuucuguugucuaccucaggcc

SEQ ID NO: 32644 - RNA, 22 nt, Human
gaguuugaugcagggaggagga

SEQ ID NO: 32645 - RNA, 27 nt, Human
ggugcagccugccacaggcuccucauc

SEQ ID NO: 32646 - RNA, 22 nt, Human
caugcaaauauuauucugggcu

SEQ ID NO: 32647 - RNA, 20 nt, Human
gugugcuggcccugcgcugc

SEQ ID NO: 32648 - RNA, 22 nt, Human
caggauuugaauuugucuuuua

SEQ ID NO: 32649 - RNA, 22 nt, Human
cugggacacacacaggggccgg

SEQ ID NO: 32650 - RNA, 23 nt, Human
acguuaaagggagagccagagaa

SEQ ID NO: 32651 - RNA, 24 nt, Human
gaaaaucauccagaagcacuguga

SEQ ID NO: 32652 - RNA, 23 nt, Human
ugucuuaaaaauacucagcuuuc

SEQ ID NO: 32653 - RNA, 22 nt, Human
uuccaggggucguuugcuuuuc

SEQ ID NO: 32654 - RNA, 22 nt, Human
ucugcugcuggccccgccccug

SEQ ID NO: 32655 - RNA, 21 nt, Human
uugcaacugcucacaugaguc

SEQ ID NO: 32656 - RNA, 21 nt, Human
ggaguuuaaggcugcagugag

SEQ ID NO: 32657 - RNA, 22 nt, Human
uccaccccaccuuuuuccuucu

SEQ ID NO: 32658 - RNA, 19 nt, Human
guugcccacauacugcagu

SEQ ID NO: 32659 - RNA, 23 nt, Human
agaaguugagacagggaggcagg

SEQ ID NO: 32660 - RNA, 25 nt, Human
ugguagcucaagccuauaaucccag

SEQ ID NO: 32661 - RNA, 26 nt, Human
gucccaagcccaccccuccucccacc

SEQ ID NO: 32662 - RNA, 25 nt, Human
agagccgccuuuccagcaugcaggg

SEQ ID NO: 32663 - RNA, 24 nt, Human
ugcagacaacaccuuccuccugca

SEQ ID NO: 32664 - RNA, 20 nt, Human
caccuagaguuuguacugga

SEQ ID NO: 32665 - RNA, 17 nt, Human
ugcccaaaaugcacuga

SEQ ID NO: 32666 - RNA, 25 nt, Human
ccauuauuccagagauucaguauua

SEQ ID NO: 32667 - RNA, 28 nt, Human
aagugauuaguugaacuggcauccugcu

SEQ ID NO: 32668 - RNA, 25 nt, Human
uuugggcaaaucuacaguucuguuu

SEQ ID NO: 32669 - RNA, 27 nt, Human
ccccacccccuaccugggggacagggc

SEQ ID NO: 32670 - RNA, 23 nt, Human
gccuuuccgguccuuccugggca

SEQ ID NO: 32671 - RNA, 23 nt, Human
ggaggucgggcggggcagagggg

SEQ ID NO: 32672 - RNA, 18 nt, Human
gaagccccagccaggagg

SEQ ID NO: 32673 - RNA, 26 nt, Human
ccugcacuccaccuggggacggcccc

SEQ ID NO: 32674 - RNA, 25 nt, Human
cauucccaccauuguuccuccaccg

SEQ ID NO: 32675 - RNA, 25 nt, Human
cuggggcagggacuuuugaguuuag

SEQ ID NO: 32676 - RNA, 19 nt, Human
aggcacccaccaucauguc

SEQ ID NO: 32677 - RNA, 22 nt, Human
ucgggaggcagagguugcagug

SEQ ID NO: 32678 - RNA, 22 nt, Human
acccucccaaaaugcugggauu

SEQ ID NO: 32679 - RNA, 19 nt, Human
gagauucugaauuccagaa

SEQ ID NO: 32680 - RNA, 22 nt, Human
acaaucaagacauaccuccagg

SEQ ID NO: 32681 - RNA, 25 nt, Human
gcaaugaccucauaaaauaccucuu

SEQ ID NO: 32682 - RNA, 22 nt, Human
caggagguaguggcagccaugg

SEQ ID NO: 32683 - RNA, 28 nt, Human
cugggagcccuuuuguuuuagaacacac

SEQ ID NO: 32684 - RNA, 30 nt, Human
gaguagcacuauuuauuuuuaaugcuucug

SEQ ID NO: 32685 - RNA, 23 nt, Human
ugcagcacaccccacagccaagu

SEQ ID NO: 32686 - RNA, 20 nt, Human
uucucccucguacagcacag

SEQ ID NO: 32687 - RNA, 27 nt, Human
cccaauguuugacaaaacacagccaag

SEQ ID NO: 32688 - RNA, 27 nt, Human
gcacagccucacacuugaaagacggug

SEQ ID NO: 32689 - RNA, 24 nt, Human
uauccuuccuuugacaauuagaca

SEQ ID NO: 32690 - RNA, 25 nt, Human
ugggaccccccgccccgccccccgc

SEQ ID NO: 32691 - RNA, 27 nt, Human
gaguagcugggacuacaggcacaaguc

SEQ ID NO: 32692 - RNA, 21 nt, Human
gcugucuuuagcaagcagguu

SEQ ID NO: 32693 - RNA, 26 nt, Human
ggagaggguccccggcagccccgcgc

SEQ ID NO: 32694 - RNA, 25 nt, Human
ugguggcauaggccuguaaucguag

SEQ ID NO: 32695 - RNA, 22 nt, Human
auuucccaacacaaagauucug

SEQ ID NO: 32696 - RNA, 24 nt, Human
ccuguacccaccugcugaccugcu

SEQ ID NO: 32697 - RNA, 22 nt, Human
agauagcugcauuacucacuug

SEQ ID NO: 32698 - RNA, 21 nt, Human
gggucuccuuggcagcuguau

SEQ ID NO: 32699 - RNA, 24 nt, Human
gagaggcugacuuucucucggugc

SEQ ID NO: 32700 - RNA, 24 nt, Human
aauggggacuuccaaaacccaagg

SEQ ID NO: 32701 - RNA, 25 nt, Human
ucccaggcuggagugcaauggugca

SEQ ID NO: 32702 - RNA, 17 nt, Human
cauccugacaggcacag

SEQ ID NO: 32703 - RNA, 25 nt, Human
agcugggcugucucucuccauguug

SEQ ID NO: 32704 - RNA, 20 nt, Human
uagcagccacagcaguaccu

SEQ ID NO: 32705 - RNA, 20 nt, Human
augaggauauggcagggaag

SEQ ID NO: 32706 - RNA, 26 nt, Human
ucauuuuucuaaaagaaagaaaaaag

SEQ ID NO: 32707 - RNA, 23 nt, Human
auugcaccacugcacuccaaccu

SEQ ID NO: 32708 - RNA, 24 nt, Human
ucuacaggacucccccaucuugcu

SEQ ID NO: 32709 - RNA, 28 nt, Human
uagggucauuugaaagcuucagucucgg

SEQ ID NO: 32710 - RNA, 23 nt, Human
cagauacaaaugucucuauccaa

SEQ ID NO: 32711 - RNA, 22 nt, Human
acccuuuacugcuguguauggg

SEQ ID NO: 32712 - RNA, 21 nt, Human
ccaaaacugauacccuuugaa

SEQ ID NO: 32713 - RNA, 27 nt, Human
gggagagaaggagggaggcgcuccugg

SEQ ID NO: 32714 - RNA, 24 nt, Human
ccgggagauagagggguuuuagau

SEQ ID NO: 32715 - RNA, 22 nt, Human
cuuagacgauccuccugccuca

SEQ ID NO: 32716 - RNA, 26 nt, Human
gccagccucgggccugggauuugagg

SEQ ID NO: 32717 - RNA, 23 nt, Human
gucaugagcaguugaaauucauc

SEQ ID NO: 32718 - RNA, 27 nt, Human
cugggagggggagccggggguuccgac

SEQ ID NO: 32719 - RNA, 27 nt, Human
cgggaagggaaagcagccagcagcccu

SEQ ID NO: 32720 - RNA, 22 nt, Human
agcaggugguagugggacagga

SEQ ID NO: 32721 - RNA, 21 nt, Human
gcuaccucugaucaaagcacc

SEQ ID NO: 32722 - RNA, 26 nt, Human
ccugcgagcuccguccugccugcagc

SEQ ID NO: 32723 - RNA, 21 nt, Human
ucugugcuugucuguuuaguu

SEQ ID NO: 32724 - RNA, 13 nt, Human
accauaaaucuua

SEQ ID NO: 32725 - RNA, 17 nt, Human
cauacagcuaaaaggga

SEQ ID NO: 32726 - RNA, 22 nt, Human
acuaucuccuuccuucccuacc

SEQ ID NO: 32727 - RNA, 20 nt, Human
acuucuggagauggauccuu

SEQ ID NO: 32728 - RNA, 21 nt, Human
cagaguuguacacuguguaca

SEQ ID NO: 32729 - RNA, 23 nt, Human
ugaagguaacugagagcagaugg

SEQ ID NO: 32730 - RNA, 27 nt, Human
ugggaaggcuagacuuccucagcccga

SEQ ID NO: 32731 - RNA, 21 nt, Human
guuccuuagagaacuguugaa

SEQ ID NO: 32732 - RNA, 24 nt, Human
agccauggucuaaggacauggauc

SEQ ID NO: 32733 - RNA, 22 nt, Human
gaccgaggauuugggguggaag

SEQ ID NO: 32734 - RNA, 27 nt, Human
ggagagggcuggguggggcagaggcca

SEQ ID NO: 32735 - RNA, 20 nt, Human
ccugagucauguggcucucu

SEQ ID NO: 32736 - RNA, 24 nt, Human
gcccaggcuggagugcaaugacac

SEQ ID NO: 32737 - RNA, 25 nt, Human
uuggucauuaggugaauauuacuca

SEQ ID NO: 32738 - RNA, 28 nt, Human
ucuguuagcugcucacuuaaacaauguc

SEQ ID NO: 32739 - RNA, 26 nt, Human
accaugucuguacagccucuaggccc

SEQ ID NO: 32740 - RNA, 22 nt, Human
ccugcccaucccagugccagcu

SEQ ID NO: 32741 - RNA, 22 nt, Human
cagacagcuacccccagaaggg

SEQ ID NO: 32742 - RNA, 19 nt, Human
auuuugauuauuguauuua

SEQ ID NO: 32743 - RNA, 18 nt, Human
aggucuggccacccugga

SEQ ID NO: 32744 - RNA, 22 nt, Human
ugggacacuacgcuaagggagg

SEQ ID NO: 32745 - RNA, 23 nt, Human
ccaggagauugaggcugcaguga

SEQ ID NO: 32746 - RNA, 22 nt, Human
uucaaugaucuauaacaacaga

SEQ ID NO: 32747 - RNA, 26 nt, Human
ugucuuuaaaaacuguuuuagaccua

SEQ ID NO: 32748 - RNA, 21 nt, Human
uaauuaucucaaaauauuuca

SEQ ID NO: 32749 - RNA, 21 nt, Human
ugcaaagccaggagucugacu

SEQ ID NO: 32750 - RNA, 24 nt, Human
cauggagaggucacagaugggccg

SEQ ID NO: 32751 - RNA, 18 nt, Human
uauauguacauguguaug

SEQ ID NO: 32752 - RNA, 20 nt, Human
uguaauaaauuggaauuuca

SEQ ID NO: 32753 - RNA, 22 nt, Human
gcaagggaaaaauaacaguuuc

SEQ ID NO: 32754 - RNA, 23 nt, Human
uauguaugcuaucuugauucaug

SEQ ID NO: 32755 - RNA, 24 nt, Human
guucuuccuuuaauuaucauucca

SEQ ID NO: 32756 - RNA, 22 nt, Human
cgccuguaauccuaacacuuug

SEQ ID NO: 32757 - RNA, 21 nt, Human
cguccggucucuggggccaag

SEQ ID NO: 32758 - RNA, 19 nt, Human
aacucacauucucuuccca

SEQ ID NO: 32759 - RNA, 22 nt, Human
guugagcaaguugcagugcaaa

SEQ ID NO: 32760 - RNA, 20 nt, Human
uguggaauugccgagaaauc

SEQ ID NO: 32761 - RNA, 22 nt, Human
caccccggcccggccuccaggc

SEQ ID NO: 32762 - RNA, 30 nt, Human
uuuagcgguuugcaaacaaaaugaugggaa

SEQ ID NO: 32763 - RNA, 20 nt, Human
uccagacccugccgcaugac

SEQ ID NO: 32764 - RNA, 21 nt, Human
uugagcuccuggaaauaguag

SEQ ID NO: 32765 - RNA, 24 nt, Human
acuuccuuucuuccuucauauuuu

SEQ ID NO: 32766 - RNA, 27 nt, Human
ccguucccgccgccguucucgcugacc

SEQ ID NO: 32767 - RNA, 21 nt, Human
guuccauccaccaccuugcca

SEQ ID NO: 32768 - RNA, 26 nt, Human
agacauuugauuucuuuaugaguucc

SEQ ID NO: 32769 - RNA, 25 nt, Human
agaacaacaagguacccagaauuuu

SEQ ID NO: 32770 - RNA, 23 nt, Human
ugucacccaggcugcagugcaau

SEQ ID NO: 32771 - RNA, 22 nt, Human
aggacagcagcuuccgcugucu

SEQ ID NO: 32772 - RNA, 23 nt, Human
gacugggugacagagugagacuc

SEQ ID NO: 32773 - RNA, 21 nt, Human
uccccuaucauaagagcuagg

SEQ ID NO: 32774 - RNA, 26 nt, Human
accauccuguauucuucaaccaguga

SEQ ID NO: 32775 - RNA, 23 nt, Human
uuuccugagcagugaugccaccu

SEQ ID NO: 32776 - RNA, 23 nt, Human
gugucccagggccugaggcagga

SEQ ID NO: 32777 - RNA, 24 nt, Human
cgggacggccgggcugggagcugg

SEQ ID NO: 32778 - RNA, 22 nt, Human
cuccaggcugacuuggggacag

SEQ ID NO: 32779 - RNA, 23 nt, Human
aggggcagccgcagggaggcagg

SEQ ID NO: 32780 - RNA, 26 nt, Human
cucugccucccggguucaagcaauuc

SEQ ID NO: 32781 - RNA, 22 nt, Human
agagacacggucccaccauguu

SEQ ID NO: 32782 - RNA, 24 nt, Human
uacacaucaaccuccauguccuua

SEQ ID NO: 32783 - RNA, 21 nt, Human
cucgugauccaccugccucgg

SEQ ID NO: 32784 - RNA, 25 nt, Human
gcaaaguuuuauauuugauauucuu

SEQ ID NO: 32785 - RNA, 23 nt, Human
ggaguccagagcaggagccaggc

SEQ ID NO: 32786 - RNA, 22 nt, Human
ucuccaucugucucugccuggc

SEQ ID NO: 32787 - RNA, 22 nt, Human
guccauauacuggaucaccuca

SEQ ID NO: 32788 - RNA, 21 nt, Human
guuucagggcacacaggacag

SEQ ID NO: 32789 - RNA, 22 nt, Human
gaccagccuggacaacauggug

SEQ ID NO: 32790 - RNA, 19 nt, Human
ugcugccucucuucugugu

SEQ ID NO: 32791 - RNA, 23 nt, Human
uuaugaaacuuaaccauacagaa

SEQ ID NO: 32792 - RNA, 23 nt, Human
cuguggcugcggagguugagggg

SEQ ID NO: 32793 - RNA, 23 nt, Human
aggcccaugggaggcuggaguug

SEQ ID NO: 32794 - RNA, 21 nt, Human
ccaaagugcugggauuacagg

SEQ ID NO: 32795 - RNA, 22 nt, Human
uuauguuuguaguuggaaagca

SEQ ID NO: 32796 - RNA, 21 nt, Human
uucuugugucuggagauucug

SEQ ID NO: 32797 - RNA, 20 nt, Human
ccauuucuuccucuggcuca

SEQ ID NO: 32798 - RNA, 22 nt, Human
gaucuuucaggacucuaccuca

SEQ ID NO: 32799 - RNA, 21 nt, Human
cuucacaacagauuauuaccu

SEQ ID NO: 32800 - RNA, 25 nt, Human
gucucccaggcugcuggagugcagu

SEQ ID NO: 32801 - RNA, 21 nt, Human
aggagguggaggcugcgguga

SEQ ID NO: 32802 - RNA, 22 nt, Human
ccaacagcccuaacauuugcca

SEQ ID NO: 32803 - RNA, 22 nt, Human
agaccagccuggccaauauggc

SEQ ID NO: 32804 - RNA, 23 nt, Human
aggcuggcgugcaguggugcgau

SEQ ID NO: 32805 - RNA, 24 nt, Human
gguuagacgccuuccaggucagga

SEQ ID NO: 32806 - RNA, 23 nt, Human
ugacauccuucaugacguuuucc

SEQ ID NO: 32807 - RNA, 23 nt, Human
ugucgcccaggcuggagcgcagu

SEQ ID NO: 32808 - RNA, 24 nt, Human
auucuauaaacugaauuauuuuaa

SEQ ID NO: 32809 - RNA, 27 nt, Human
gcucugucacccaggcuggagugccgu

SEQ ID NO: 32810 - RNA, 27 nt, Human
gcucugucccccaggcuggagugcagu

SEQ ID NO: 32811 - RNA, 27 nt, Human
ccaagcccugcugcuccaggacauaua

SEQ ID NO: 32812 - RNA, 23 nt, Human
gcuggguacuccagaggugccac

SEQ ID NO: 32813 - RNA, 22 nt, Human
agacucugggcucuuggcucag

SEQ ID NO: 32814 - RNA, 20 nt, Human
gucauucuuugcaguucuuc

SEQ ID NO: 32815 - RNA, 27 nt, Human
ccugcuguugccccuuagugaggaauc

SEQ ID NO: 32816 - RNA, 22 nt, Human
uuggguacuuucuaucucaucu

SEQ ID NO: 32817 - RNA, 26 nt, Human
uucacaugauucuccugccucagccu

SEQ ID NO: 32818 - RNA, 27 nt, Human
cuccuuguccagcacuuuucuagcucu

SEQ ID NO: 32819 - RNA, 18 nt, Human
ggaguuacagaagccauu

SEQ ID NO: 32820 - RNA, 19 nt, Human
aucauuagcccacauacca

SEQ ID NO: 32821 - RNA, 19 nt, Human
gcagggauccaggcucucu

SEQ ID NO: 32822 - RNA, 27 nt, Human
ucuuuagugaucaggaaccauaguuga

SEQ ID NO: 32823 - RNA, 21 nt, Human
aaacuaauucuuacagcuuuu

SEQ ID NO: 32824 - RNA, 22 nt, Human
guguaucaugguguucaaaaca

SEQ ID NO: 32825 - RNA, 22 nt, Human
cggacugucaguucucugggaa

SEQ ID NO: 32826 - RNA, 20 nt, Human
gcgcaguccccagucccgaa

SEQ ID NO: 32827 - RNA, 20 nt, Human
ucauucugucauugcugcua

SEQ ID NO: 32828 - RNA, 24 nt, Human
uccuaaguccucucagcagugggu

SEQ ID NO: 32829 - RNA, 22 nt, Human
cccuccuucuccccuccagacc

SEQ ID NO: 32830 - RNA, 21 nt, Human
gcagcucccagccucuuccca

SEQ ID NO: 32831 - RNA, 19 nt, Human
cauggcaguggaaggguuu

SEQ ID NO: 32832 - RNA, 21 nt, Human
gcugcuugcuaaagagccgag

SEQ ID NO: 32833 - RNA, 23 nt, Human
ugccucucggaggagccuguguc

SEQ ID NO: 32834 - RNA, 21 nt, Human
cacacaguuuacaaacccagu

SEQ ID NO: 32835 - RNA, 22 nt, Human
ccaaagauggcuucacugaaga

SEQ ID NO: 32836 - RNA, 23 nt, Human
gucauccagagcuggagugcagc

SEQ ID NO: 32837 - RNA, 27 nt, Human
ggaggcugagacaggagaaucgcuuga

SEQ ID NO: 32838 - RNA, 20 nt, Human
uccuccaggagcucugcuua

SEQ ID NO: 32839 - RNA, 27 nt, Human
ccacugcauccagccaauaggagccca

SEQ ID NO: 32840 - RNA, 21 nt, Human
auguaggagggaggugggugg

SEQ ID NO: 32841 - RNA, 22 nt, Human
gcaaguccugugggagauggca

SEQ ID NO: 32842 - RNA, 26 nt, Human
cccaacgcacaggaaaagguagcuua

SEQ ID NO: 32843 - RNA, 17 nt, Human
caggcagccugcagacc

SEQ ID NO: 32844 - RNA, 26 nt, Human
ggugacagcagauggagcuacuuggg

SEQ ID NO: 32845 - RNA, 30 nt, Human
ucaugguacuaccccagccugggguccauc

SEQ ID NO: 32846 - RNA, 20 nt, Human
ucaggcccaguuucucacuu

SEQ ID NO: 32847 - RNA, 28 nt, Human
uucuacucuucaugccucauccugcagc

SEQ ID NO: 32848 - RNA, 27 nt, Human
ccaugugugggcucagggacccccagg

SEQ ID NO: 32849 - RNA, 22 nt, Human
gccgucuccacucccuaggcaa

SEQ ID NO: 32850 - RNA, 22 nt, Human
gugugggaacugcuggggaucu

SEQ ID NO: 32851 - RNA, 22 nt, Human
ccaaggugcugggauugcagac

SEQ ID NO: 32852 - RNA, 24 nt, Human
cagaccccuuggcuuuugcuuggc

SEQ ID NO: 32853 - RNA, 23 nt, Human
cacucacugcagagcugcugccu

SEQ ID NO: 32854 - RNA, 25 nt, Human
cugcagcugcgccuccuugcaccug

SEQ ID NO: 32855 - RNA, 20 nt, Human
ucagcugcugccucugucuu

SEQ ID NO: 32856 - RNA, 26 nt, Human
gagcuuuaguuuaucucaguccugga

SEQ ID NO: 32857 - RNA, 27 nt, Human
cagggucccaggaagccggugccuggg

SEQ ID NO: 32858 - RNA, 18 nt, Human
ccagcuccaguugcucau

SEQ ID NO: 32859 - RNA, 27 nt, Human
ucccugcuccugugcuuuccucucuuc

SEQ ID NO: 32860 - RNA, 20 nt, Human
uguugcauaaccaccaccuu

SEQ ID NO: 32861 - RNA, 21 nt, Human
guguccccuccuuucuauuua

SEQ ID NO: 32862 - RNA, 23 nt, Human
gagguaaaauuucauuuuguuau

SEQ ID NO: 32863 - RNA, 28 nt, Human
agggucuuuguggacugaagguagacac

SEQ ID NO: 32864 - RNA, 26 nt, Human
ugcccaggugguggcugcaagguggc

SEQ ID NO: 32865 - RNA, 29 nt, Human
cuguucuucuguucugcagacacgccuuc

SEQ ID NO: 32866 - RNA, 22 nt, Human
ccgggagcggagguugcaguga

SEQ ID NO: 32867 - RNA, 19 nt, Human
ccugucccugucuuccucc

SEQ ID NO: 32868 - RNA, 21 nt, Human
uacuauucaagcuauaauuca

SEQ ID NO: 32869 - RNA, 19 nt, Human
agccucccucuccucuguc

SEQ ID NO: 32870 - RNA, 21 nt, Human
cgucugcugaacaaauccucu

SEQ ID NO: 32871 - RNA, 25 nt, Human
ugucagggugugagcacuccaaggc

SEQ ID NO: 32872 - RNA, 22 nt, Human
aaggcagaauaaaccggauccu

SEQ ID NO: 32873 - RNA, 23 nt, Human
aggacuugaacaaaaaugacaga

SEQ ID NO: 32874 - RNA, 21 nt, Human
gccuuucucuuccugcugacc

SEQ ID NO: 32875 - RNA, 24 nt, Human
ccuuugccaacuuucucugcaacu

SEQ ID NO: 32876 - RNA, 22 nt, Human
ggaacuugugccuggcuggcug

SEQ ID NO: 32877 - RNA, 24 nt, Human
aucgcucccacugcacuccagccu

SEQ ID NO: 32878 - RNA, 23 nt, Human
ucugaugcuuccugagggccaag

SEQ ID NO: 32879 - RNA, 18 nt, Human
cacuugaagaggaaguau

SEQ ID NO: 32880 - RNA, 24 nt, Human
uagcuuccguguuccuugccuugu

SEQ ID NO: 32881 - RNA, 26 nt, Human
ccugacuccucuccccucguuuuucc

SEQ ID NO: 32882 - RNA, 22 nt, Human
cuugcugcuguucacugaccuc

SEQ ID NO: 32883 - RNA, 24 nt, Human
uuucuucuacuagucugauguuuu

SEQ ID NO: 32884 - RNA, 22 nt, Human
gcucacaucuguaaucccagca

SEQ ID NO: 32885 - RNA, 19 nt, Human
auacuaucauacuacugaa

SEQ ID NO: 32886 - RNA, 22 nt, Human
uucccuggcaaacaaaggaaca

SEQ ID NO: 32887 - RNA, 25 nt, Human
uucccuuuaaugcuugcagaagcug

SEQ ID NO: 32888 - RNA, 26 nt, Human
uucccaagccgaccuucccuccgccu

SEQ ID NO: 32889 - RNA, 23 nt, Human
uuaggggaaaaaauucugcugca

SEQ ID NO: 32890 - RNA, 18 nt, Human
ccgcagucuucgccacca

SEQ ID NO: 32891 - RNA, 18 nt, Human
cugugaaaaagcauuuua

SEQ ID NO: 32892 - RNA, 22 nt, Human
agagagggacagaaggggcggu

SEQ ID NO: 32893 - RNA, 22 nt, Human
cuccacccaccugccccauguc

SEQ ID NO: 32894 - RNA, 22 nt, Human
agagguccaaggcugcagugag

SEQ ID NO: 32895 - RNA, 25 nt, Human
accccucucugcacgccagcccgcc

SEQ ID NO: 32896 - RNA, 24 nt, Human
ugaacuguaguacauggacaauaa

SEQ ID NO: 32897 - RNA, 25 nt, Human
gccucaccccugaauagcuccuucg

SEQ ID NO: 32898 - RNA, 19 nt, Human
cuccauaaauuacuuaguc

SEQ ID NO: 32899 - RNA, 22 nt, Human
uuuucuuagcucccuggacccg

SEQ ID NO: 32900 - RNA, 14 nt, Human
cuucccuuuggucu

SEQ ID NO: 32901 - RNA, 27 nt, Human
ggagagcucugcagggagccgaggccc

SEQ ID NO: 32902 - RNA, 31 nt, Human
ccuggcguccugguccaggggagcccugggc

SEQ ID NO: 32903 - RNA, 18 nt, Human
ucgccucccuccugcugc

SEQ ID NO: 32904 - RNA, 19 nt, Human
cuagcaaaacuccaucuca

SEQ ID NO: 32905 - RNA, 22 nt, Human
cucaaugcucauaacggaucag

SEQ ID NO: 32906 - RNA, 23 nt, Human
ugccucagcuuuuuuccuugcag

SEQ ID NO: 32907 - RNA, 21 nt, Human
gaucgacuccuccuucauuga

SEQ ID NO: 32908 - RNA, 23 nt, Human
acgaucuuggcucacugcaagcu

SEQ ID NO: 32909 - RNA, 24 nt, Human
caccuggguuuggcaucagcacag

SEQ ID NO: 32910 - RNA, 22 nt, Human
aauaagaaaguauacuuaugga

SEQ ID NO: 32911 - RNA, 22 nt, Human
aacagguuugaucuguggauga

SEQ ID NO: 32912 - RNA, 24 nt, Human
aauucauacaaaguauuguccuca

SEQ ID NO: 32913 - RNA, 21 nt, Human
agcuacccaacaguccaggac

SEQ ID NO: 32914 - RNA, 21 nt, Human
gguggaaggcagacagcaggc

SEQ ID NO: 32915 - RNA, 22 nt, Human
gggauuacaggugugcaccacc

SEQ ID NO: 32916 - RNA, 24 nt, Human
agcugccuccugauccuggccagc

SEQ ID NO: 32917 - RNA, 23 nt, Human
cuacacagaaauagagaugcuau

SEQ ID NO: 32918 - RNA, 24 nt, Human
ucuuccauggucaucagugaccuc

SEQ ID NO: 32919 - RNA, 20 nt, Human
aggcuuaggccucucugccu

SEQ ID NO: 32920 - RNA, 22 nt, Human
aguaaauggaaucaguccuggg

SEQ ID NO: 32921 - RNA, 25 nt, Human
acccaggcuggagugcaguguugca

SEQ ID NO: 32922 - RNA, 21 nt, Human
uuuggguugauaccaagugca

SEQ ID NO: 32923 - RNA, 23 nt, Human
cgugcaugcuguagcugcagccu

SEQ ID NO: 32924 - RNA, 27 nt, Human
acagagaaaucacagacuuuugcuaca

SEQ ID NO: 32925 - RNA, 22 nt, Human
aacuugauaaugguguaauacu

SEQ ID NO: 32926 - RNA, 19 nt, Human
aggcugggacagaggcaga

SEQ ID NO: 32927 - RNA, 21 nt, Human
accacacgugucuccuccucc

SEQ ID NO: 32928 - RNA, 23 nt, Human
auugcaccacugcacuccaggcu

SEQ ID NO: 32929 - RNA, 22 nt, Human
uaacaucccuuccuuaaaugcc

SEQ ID NO: 32930 - RNA, 20 nt, Human
cuuucuggcuauuuuuuguu

SEQ ID NO: 32931 - RNA, 22 nt, Human
ggacauucuaccauuucugcca

SEQ ID NO: 32932 - RNA, 20 nt, Human
cccucgggcucgaucgcccg

SEQ ID NO: 32933 - RNA, 22 nt, Human
gaugggacuggaguugagggaa

SEQ ID NO: 32934 - RNA, 27 nt, Human
uugaccagaaaauaugauauauaugua

SEQ ID NO: 32935 - RNA, 22 nt, Human
ggggcgcuuaggcgcugccuuu

SEQ ID NO: 32936 - RNA, 22 nt, Human
ugaacaaaugacaucaaacuug

SEQ ID NO: 32937 - RNA, 28 nt, Human
gacagcagccucccugucacucagcuga

SEQ ID NO: 32938 - RNA, 22 nt, Human
gcuuaccucucagccuuagcuc

SEQ ID NO: 32939 - RNA, 25 nt, Human
gaaagagacaauguaauacuguugg

SEQ ID NO: 32940 - RNA, 21 nt, Human
uaaccuguuacacugggcugg

SEQ ID NO: 32941 - RNA, 22 nt, Human
aaaaccaaacucuuauucucag

SEQ ID NO: 32942 - RNA, 21 nt, Human
cuaauguaauaauagaaaaau

SEQ ID NO: 32943 - RNA, 17 nt, Human
ugcuccugccugcuucg

SEQ ID NO: 32944 - RNA, 20 nt, Human
uuuaaaauauuuugcugcua

SEQ ID NO: 32945 - RNA, 21 nt, Human
uuccuuuaaagagaggcuguc

SEQ ID NO: 32946 - RNA, 27 nt, Human
cugagauauuuauuguuuauuuaucag

SEQ ID NO: 32947 - RNA, 21 nt, Human
uugucugacacaugcucucaa

SEQ ID NO: 32948 - RNA, 26 nt, Human
uguggucugcuuguccuucagcccau

SEQ ID NO: 32949 - RNA, 22 nt, Human
gugaugaagacagaaggcuccg

SEQ ID NO: 32950 - RNA, 27 nt, Human
uccucaccaacauccaggauugugucu

SEQ ID NO: 32951 - RNA, 18 nt, Human
uuccuguauucuacagca

SEQ ID NO: 32952 - RNA, 27 nt, Human
guccucucccccaacccccugcaagaa

SEQ ID NO: 32953 - RNA, 21 nt, Human
guuacagcuggagguguguau

SEQ ID NO: 32954 - RNA, 24 nt, Human
guccucuggguaggaaucagcaag

SEQ ID NO: 32955 - RNA, 27 nt, Human
uggcuguaaugagaacuucaaucacug

SEQ ID NO: 32956 - RNA, 21 nt, Human
uugcccaggcuugagugcaau

SEQ ID NO: 32957 - RNA, 22 nt, Human
uagcauagagcugucugccaca

SEQ ID NO: 32958 - RNA, 28 nt, Human
cagcccuccugucccuuccccccaguca

SEQ ID NO: 32959 - RNA, 24 nt, Human
agagugagcaggacacagagggga

SEQ ID NO: 32960 - RNA, 22 nt, Human
ggccuccccugccuuuucuccg

SEQ ID NO: 32961 - RNA, 22 nt, Human
acccggcuuucgcauuugggac

SEQ ID NO: 32962 - RNA, 23 nt, Human
aguuauuggagugaugacaggaa

SEQ ID NO: 32963 - RNA, 28 nt, Human
cucucagccugggagacuccugccaagc

SEQ ID NO: 32964 - RNA, 19 nt, Human
ugcccuuuaacugcaccug

SEQ ID NO: 32965 - RNA, 20 nt, Human
uagcuuccaccugcaccuuc

SEQ ID NO: 32966 - RNA, 22 nt, Human
aggacagcuguagucuguugug

SEQ ID NO: 32967 - RNA, 23 nt, Human
aucacaucacugcacuccagccu

SEQ ID NO: 32968 - RNA, 22 nt, Human
aacugauauugcauacuacaca

SEQ ID NO: 32969 - RNA, 21 nt, Human
ugcucacaguuuguucuggag

SEQ ID NO: 32970 - RNA, 25 nt, Human
gcaucauuuacaagacaacauugua

SEQ ID NO: 32971 - RNA, 23 nt, Human
aacugaugaguaaacugaggccc

SEQ ID NO: 32972 - RNA, 21 nt, Human
ccugcccugcugccgccuccc

SEQ ID NO: 32973 - RNA, 25 nt, Human
aucacccuacauuccagcaucuuac

SEQ ID NO: 32974 - RNA, 23 nt, Human
cgcccccaggugggguacuggca

SEQ ID NO: 32975 - RNA, 24 nt, Human
uuugcaaugcccuaauuagggcau

SEQ ID NO: 32976 - RNA, 23 nt, Human
ucauccagccauaugccugugga

SEQ ID NO: 32977 - RNA, 22 nt, Human
auguuucagaagcauucaggca

SEQ ID NO: 32978 - RNA, 26 nt, Human
gcggaagggacucugggcugugccug

SEQ ID NO: 32979 - RNA, 21 nt, Human
gacuucacugcacguuuucuc

SEQ ID NO: 32980 - RNA, 27 nt, Human
uuccugccucugcuccgacacccggca

SEQ ID NO: 32981 - RNA, 32 nt, Human
ggagcccagguagggggcagagcuguccucag

SEQ ID NO: 32982 - RNA, 21 nt, Human
accuguaaucccaacauuuug

SEQ ID NO: 32983 - RNA, 22 nt, Human
ucauaacaaaagcuacagcucc

SEQ ID NO: 32984 - RNA, 19 nt, Human
aacagcccugcacgcccag

SEQ ID NO: 32985 - RNA, 26 nt, Human
ugguacaaugaucaaaaucauguuuu

SEQ ID NO: 32986 - RNA, 20 nt, Human
aguuaguuugaaagcauuuu

SEQ ID NO: 32987 - RNA, 24 nt, Human
ggaggacauugcccugcccugcgc

SEQ ID NO: 32988 - RNA, 19 nt, Human
acgaggagccagcaguuga

SEQ ID NO: 32989 - RNA, 27 nt, Human
agccauggagagcuggggaaaccacau

SEQ ID NO: 32990 - RNA, 25 nt, Human
gcucagcccuagcccucagcccacc

SEQ ID NO: 32991 - RNA, 23 nt, Human
aagcucaggguuacacaguucca

SEQ ID NO: 32992 - RNA, 20 nt, Human
ggcccucgggacuguccucg

SEQ ID NO: 32993 - RNA, 25 nt, Human
agaggaaacgaggugagcagaggac

SEQ ID NO: 32994 - RNA, 22 nt, Human
aggcugagacaggagaaucgcu

SEQ ID NO: 32995 - RNA, 24 nt, Human
gagucugaggcuuccauccgggga

SEQ ID NO: 32996 - RNA, 19 nt, Human
agggaaaucacuuccuuua

SEQ ID NO: 32997 - RNA, 24 nt, Human
ggcaccaaugccuucuuagugugg

SEQ ID NO: 32998 - RNA, 22 nt, Human
aguggcagcuccuguuacuccc

SEQ ID NO: 32999 - RNA, 27 nt, Human
ucuccaccccuucagcguggacuuccu

SEQ ID NO: 33000 - RNA, 26 nt, Human
gggagcugggccaggagagggacuga

SEQ ID NO: 33001 - RNA, 21 nt, Human
uaggaaacaaaugccuuacag

SEQ ID NO: 33002 - RNA, 26 nt, Human
gggacccccacaucaccaccuuggau

SEQ ID NO: 33003 - RNA, 23 nt, Human
gccuuccacugaauacacgauug

SEQ ID NO: 33004 - RNA, 21 nt, Human
gcucagaauuuggagggaggg

SEQ ID NO: 33005 - RNA, 26 nt, Human
cagugggaggccaguggugcuggcca

SEQ ID NO: 33006 - RNA, 20 nt, Human
cuuugcagagucaagcucca

SEQ ID NO: 33007 - RNA, 27 nt, Human
guggcugcaguaagccaagaucacacc

SEQ ID NO: 33008 - RNA, 20 nt, Human
ccaagaaugaaggcagagcg

SEQ ID NO: 33009 - RNA, 26 nt, Human
uggggcgcagaagagaggggagcccu

SEQ ID NO: 33010 - RNA, 22 nt, Human
cugaacuugugguucauucuca

SEQ ID NO: 33011 - RNA, 19 nt, Human
ugugccccuccuuccuaac

SEQ ID NO: 33012 - RNA, 19 nt, Human
aacaaccaagugccgugga

SEQ ID NO: 33013 - RNA, 21 nt, Human
gguucacugcaaccuccgcau

SEQ ID NO: 33014 - RNA, 23 nt, Human
caauuggagaaaucauaugaaaa

SEQ ID NO: 33015 - RNA, 26 nt, Human
aggagguggagguugcauucaacuga

SEQ ID NO: 33016 - RNA, 22 nt, Human
cccaugaccucccucugcuugu

SEQ ID NO: 33017 - RNA, 25 nt, Human
uucuguguguucucagauuauauau

SEQ ID NO: 33018 - RNA, 28 nt, Human
cgcaggacgccgccucacgcaagccggg

SEQ ID NO: 33019 - RNA, 19 nt, Human
ucaacaauccaaaucuaca

SEQ ID NO: 33020 - RNA, 25 nt, Human
ucuuuaccccucacaauccuugcca

SEQ ID NO: 33021 - RNA, 19 nt, Human
gcugcccacuccuccuggg

SEQ ID NO: 33022 - RNA, 18 nt, Human
agggagagcugugguacu

SEQ ID NO: 33023 - RNA, 24 nt, Human
cuguugcccaggcuggagugcaau

SEQ ID NO: 33024 - RNA, 26 nt, Human
ccugaccauggucccugccuggcugu

SEQ ID NO: 33025 - RNA, 22 nt, Human
uagauugaguuauuaacuguau

SEQ ID NO: 33026 - RNA, 22 nt, Human
ccacaaaacagccagucagguu

SEQ ID NO: 33027 - RNA, 23 nt, Human
agcuccaggaagcaggcaggccu

SEQ ID NO: 33028 - RNA, 26 nt, Human
auuauuucuucucuuauccucucucu

SEQ ID NO: 33029 - RNA, 25 nt, Human
ccugccugccuuuuggcuuuguuuc

SEQ ID NO: 33030 - RNA, 23 nt, Human
guuccugccccuuccuccucgua

SEQ ID NO: 33031 - RNA, 21 nt, Human
guguuggauuuagaagugaau

SEQ ID NO: 33032 - RNA, 19 nt, Human
caacaaaacucagcgcagc

SEQ ID NO: 33033 - RNA, 22 nt, Human
cauugugauauauucuguacuu

SEQ ID NO: 33034 - RNA, 21 nt, Human
uagcaagaggucacagaugcu

SEQ ID NO: 33035 - RNA, 24 nt, Human
cucccuugauggucugggagccug

SEQ ID NO: 33036 - RNA, 21 nt, Human
cuggggcaacugagagcugag

SEQ ID NO: 33037 - RNA, 27 nt, Human
cacaggcagagugccuuggcagguuug

SEQ ID NO: 33038 - RNA, 27 nt, Human
gccgccuccccucuccugggagcauuc

SEQ ID NO: 33039 - RNA, 21 nt, Human
gaaugucuuuccuuuacaccu

SEQ ID NO: 33040 - RNA, 23 nt, Human
cucacccucuuguuacagcagau

SEQ ID NO: 33041 - RNA, 21 nt, Human
gucuuaaaaugcuuuaguuuc

SEQ ID NO: 33042 - RNA, 24 nt, Human
gggguuagagagaaggcagguuga

SEQ ID NO: 33043 - RNA, 18 nt, Human
guguugccuaggcugguc

SEQ ID NO: 33044 - RNA, 16 nt, Human
agggaaagaggaggaa

SEQ ID NO: 33045 - RNA, 27 nt, Human
guugcccaggcuggucgugaacuccug

SEQ ID NO: 33046 - RNA, 21 nt, Human
uccagaagaaguguugaagua

SEQ ID NO: 33047 - RNA, 27 nt, Human
ugucaauguccaaacaaaguccaaugc

SEQ ID NO: 33048 - RNA, 25 nt, Human
uccaacaacuccaggaaaacuguuu

SEQ ID NO: 33049 - RNA, 24 nt, Human
ccuucucuuucuucguucccugcc

SEQ ID NO: 33050 - RNA, 22 nt, Human
accagccugggcaacaaaguga

SEQ ID NO: 33051 - RNA, 22 nt, Human
uguucucacacugguggaggag

SEQ ID NO: 33052 - RNA, 22 nt, Human
ggggaauacuuuuacuacucag

SEQ ID NO: 33053 - RNA, 18 nt, Human
aacucuguaucuaguugu

SEQ ID NO: 33054 - RNA, 27 nt, Human
uaccucuucaguguuuuccuccagucc

SEQ ID NO: 33055 - RNA, 22 nt, Human
uccuccucuuccucuggcauca

SEQ ID NO: 33056 - RNA, 24 nt, Human
ugagcugacaguaaagcugcagug

SEQ ID NO: 33057 - RNA, 22 nt, Human
uucuuauuuguaaaaugcagag

SEQ ID NO: 33058 - RNA, 26 nt, Human
ucugcucccaauucaccucguuacuc

SEQ ID NO: 33059 - RNA, 21 nt, Human
cugaggugcauuuucucauca

SEQ ID NO: 33060 - RNA, 26 nt, Human
cuccggacaucgggggccagggcaca

SEQ ID NO: 33061 - RNA, 21 nt, Human
ggcgggcggagguuccaggag

SEQ ID NO: 33062 - RNA, 18 nt, Human
guucugcucucugcagca

SEQ ID NO: 33063 - RNA, 21 nt, Human
auuuucaugacuacuaacuca

SEQ ID NO: 33064 - RNA, 25 nt, Human
ucugcccuuaggaguccaggcugca

SEQ ID NO: 33065 - RNA, 20 nt, Human
uucauuucacagucuucuau

SEQ ID NO: 33066 - RNA, 27 nt, Human
aaaggccugaagagugagcucuggggg

SEQ ID NO: 33067 - RNA, 23 nt, Human
uuccuuugagaauugugcgacuu

SEQ ID NO: 33068 - RNA, 25 nt, Human
guuuagauuauaaaaugaaaaagaa

SEQ ID NO: 33069 - RNA, 26 nt, Human
guucauguuuggugcauagaacuggg

SEQ ID NO: 33070 - RNA, 23 nt, Human
gccaaauuggaguccauucuucu

SEQ ID NO: 33071 - RNA, 23 nt, Human
ugucaccuaggcuggagugcagu

SEQ ID NO: 33072 - RNA, 22 nt, Human
aaaauauaaaaauuaggccagg

SEQ ID NO: 33073 - RNA, 20 nt, Human
uauugagagaaacaccaaga

SEQ ID NO: 33074 - RNA, 21 nt, Human
ggggugagggcuggugguugg

SEQ ID NO: 33075 - RNA, 24 nt, Human
cucccccacuggagugauuucagu

SEQ ID NO: 33076 - RNA, 26 nt, Human
uagcccaggcuggagugcaauggcag

SEQ ID NO: 33077 - RNA, 21 nt, Human
agguuguaucaauagcaguga

SEQ ID NO: 33078 - RNA, 23 nt, Human
cggagccagugugccauucucug

SEQ ID NO: 33079 - RNA, 22 nt, Human
uggcacacaccuguagucccag

SEQ ID NO: 33080 - RNA, 26 nt, Human
ugggcuuagcgugagcaggcacuucc

SEQ ID NO: 33081 - RNA, 27 nt, Human
gggagagaacaaaagcuauaccaaaag

SEQ ID NO: 33082 - RNA, 25 nt, Human
aggacuuuuaaguauucuucagugc

SEQ ID NO: 33083 - RNA, 23 nt, Human
uacaugguuugaaaugugcauag

SEQ ID NO: 33084 - RNA, 18 nt, Human
cccacauaccuccauucc

SEQ ID NO: 33085 - RNA, 22 nt, Human
gaccagacucgccaacauggug

SEQ ID NO: 33086 - RNA, 27 nt, Human
ccauugcacuccagccuugggcgacaa

SEQ ID NO: 33087 - RNA, 23 nt, Human
uucagcaccaaguuauucccccc

SEQ ID NO: 33088 - RNA, 24 nt, Human
gcagccugcugccuccccuccauc

SEQ ID NO: 33089 - RNA, 21 nt, Human
aacucccaggcucaagggauc

SEQ ID NO: 33090 - RNA, 24 nt, Human
ggaccuuaggccuuccucucucca

SEQ ID NO: 33091 - RNA, 27 nt, Human
gacuccaugugugcuguccucugaagg

SEQ ID NO: 33092 - RNA, 21 nt, Human
aauuaccauugcuuccuccag

SEQ ID NO: 33093 - RNA, 18 nt, Human
acauucuucucuuuucua

SEQ ID NO: 33094 - RNA, 27 nt, Human
acaaucagcuaauuuauguauagauuu

SEQ ID NO: 33095 - RNA, 21 nt, Human
uuccuacccacaccucugcca

SEQ ID NO: 33096 - RNA, 19 nt, Human
cugucccagagccuguguc

SEQ ID NO: 33097 - RNA, 21 nt, Human
ugucuucugugaagacaggac

SEQ ID NO: 33098 - RNA, 27 nt, Human
uuugaaaaguguuauuucucuugucca

SEQ ID NO: 33099 - RNA, 27 nt, Human
cucaaagcaucuuguaaccuagggcuu

SEQ ID NO: 33100 - RNA, 21 nt, Human
augucgggagcauccugcugc

SEQ ID NO: 33101 - RNA, 26 nt, Human
gacaguuuuuguagcuuucuauugag

SEQ ID NO: 33102 - RNA, 21 nt, Human
cucccagaugccuucuagauu

SEQ ID NO: 33103 - RNA, 21 nt, Human
cugccuuuuaaaaaacccaca

SEQ ID NO: 33104 - RNA, 21 nt, Human
uccuguggcacccaucaccau

SEQ ID NO: 33105 - RNA, 24 nt, Human
acaggaauggggaaaaagagggau

SEQ ID NO: 33106 - RNA, 20 nt, Human
cucugcccucugugaccuug

SEQ ID NO: 33107 - RNA, 20 nt, Human
acccucacagcuggccugcc

SEQ ID NO: 33108 - RNA, 23 nt, Human
acuguaucuguaagggcuuuuca

SEQ ID NO: 33109 - RNA, 23 nt, Human
gcuggucagugggacauuuuguc

SEQ ID NO: 33110 - RNA, 23 nt, Human
aaccuguacaaaauagcugacag

SEQ ID NO: 33111 - RNA, 23 nt, Human
uaucaacuauucuaaauacaggu

SEQ ID NO: 33112 - RNA, 22 nt, Human
aaaccaauuugggcucagaggg

SEQ ID NO: 33113 - RNA, 23 nt, Human
ggugcuuguaaucccagcuacuu

SEQ ID NO: 33114 - RNA, 21 nt, Human
cuguaaucuuaacacuguggg

SEQ ID NO: 33115 - RNA, 24 nt, Human
acaaugccaucacaguacacauga

SEQ ID NO: 33116 - RNA, 23 nt, Human
ugggggcgcgcugccuucugccu

SEQ ID NO: 33117 - RNA, 23 nt, Human
agaguuucugccuccacaguuaa

SEQ ID NO: 33118 - RNA, 24 nt, Human
agcacagauugugcuaaucucucu

SEQ ID NO: 33119 - RNA, 22 nt, Human
gcaaucccaggcuggggucagc

SEQ ID NO: 33120 - RNA, 27 nt, Human
cccaaguagcuaagaccacaggcacau

SEQ ID NO: 33121 - RNA, 22 nt, Human
auaguuacauuuaugugcuguu

SEQ ID NO: 33122 - RNA, 21 nt, Human
ucacacacaccggcacuuuca

SEQ ID NO: 33123 - RNA, 20 nt, Human
gagauggggugaagggacac

SEQ ID NO: 33124 - RNA, 18 nt, Human
cuguuucucuuuucucuu

SEQ ID NO: 33125 - RNA, 19 nt, Human
ugccuccucuccccugcua

SEQ ID NO: 33126 - RNA, 22 nt, Human
gccaagcugcuuguccugggcc

SEQ ID NO: 33127 - RNA, 24 nt, Human
ucucccacccucgcucgcguagcc

SEQ ID NO: 33128 - RNA, 20 nt, Human
ccugguggagagagcuggaa

SEQ ID NO: 33129 - RNA, 22 nt, Human
augaaugacagugcccagagug

SEQ ID NO: 33130 - RNA, 26 nt, Human
agcagcagcucgccuaccucugagcc

SEQ ID NO: 33131 - RNA, 15 nt, Human
ucaagaaugauggca

SEQ ID NO: 33132 - RNA, 27 nt, Human
gcuguuggggguuucccuguguggacc

SEQ ID NO: 33133 - RNA, 26 nt, Human
uauucuuuauuccuggacagcucggu

SEQ ID NO: 33134 - RNA, 25 nt, Human
ucccgagguauggcagaggugcaag

SEQ ID NO: 33135 - RNA, 27 nt, Human
gagcaaauauuaaaauuguuaauaugc

SEQ ID NO: 33136 - RNA, 27 nt, Human
ucugcucccagccccuaccuugagacc

SEQ ID NO: 33137 - RNA, 23 nt, Human
guagauucuugagaagcauuuca

SEQ ID NO: 33138 - RNA, 24 nt, Human
ggagauagagcaagacuccaucuc

SEQ ID NO: 33139 - RNA, 20 nt, Human
uggccuuauggauuuggacu

SEQ ID NO: 33140 - RNA, 22 nt, Human
uacucugcaaguugaccuggcc

SEQ ID NO: 33141 - RNA, 21 nt, Human
ugaaucugcuugccuuuccug

SEQ ID NO: 33142 - RNA, 19 nt, Human
gguccuuccuagcaaggca

SEQ ID NO: 33143 - RNA, 27 nt, Human
ccgguucugcugacugaauuggaugca

SEQ ID NO: 33144 - RNA, 25 nt, Human
uaggaacucccucagaucccaguuc

SEQ ID NO: 33145 - RNA, 22 nt, Human
agggcaaaggacccauucucag

SEQ ID NO: 33146 - RNA, 28 nt, Human
acaagcuuuuguucucucaguacuuguu

SEQ ID NO: 33147 - RNA, 19 nt, Human
gauuacaggcguuagccac

SEQ ID NO: 33148 - RNA, 22 nt, Human
gggaguaauggcgggcacuuuc

SEQ ID NO: 33149 - RNA, 23 nt, Human
cagcccgccuggcuuucucucuu

SEQ ID NO: 33150 - RNA, 22 nt, Human
aacugauuucuagaaaaagcug

SEQ ID NO: 33151 - RNA, 27 nt, Human
ggggccgguaacgagagcagucgcggc

SEQ ID NO: 33152 - RNA, 26 nt, Human
gaggaagggcagacuggugaaaucgc

SEQ ID NO: 33153 - RNA, 29 nt, Human
aaagauugguccuuggugaaauaaacuuu

SEQ ID NO: 33154 - RNA, 22 nt, Human
cucuggagaaaagagagaaagg

SEQ ID NO: 33155 - RNA, 24 nt, Human
agcacgugauucuuaacaucauuu

SEQ ID NO: 33156 - RNA, 20 nt, Human
gcacagggcaaggagccaag

SEQ ID NO: 33157 - RNA, 27 nt, Human
auuccuuugcccggcaucaaggcacag

SEQ ID NO: 33158 - RNA, 20 nt, Human
cagauuuugauacacuguau

SEQ ID NO: 33159 - RNA, 21 nt, Human
uuccugcuuaaugguaacuga

SEQ ID NO: 33160 - RNA, 21 nt, Human
ucucuucuggcccuccaugga

SEQ ID NO: 33161 - RNA, 22 nt, Human
gugcuaggccccuguguaguag

SEQ ID NO: 33162 - RNA, 24 nt, Human
ugcacucagggucagcaguggagu

SEQ ID NO: 33163 - RNA, 19 nt, Human
aaaguauuuuguguucaaa

SEQ ID NO: 33164 - RNA, 23 nt, Human
auuuccucuccaucugcuggcac

SEQ ID NO: 33165 - RNA, 26 nt, Human
agcaccacuggacuacacauucuucu

SEQ ID NO: 33166 - RNA, 21 nt, Human
uugcuuguacuagauuucuua

SEQ ID NO: 33167 - RNA, 22 nt, Human
gacuacagguacgugcggcuau

SEQ ID NO: 33168 - RNA, 27 nt, Human
aaacaggccuugugcucaaccacugga

SEQ ID NO: 33169 - RNA, 21 nt, Human
acccagccaacagcaugaacu

SEQ ID NO: 33170 - RNA, 26 nt, Human
guuacugcuacuacacuuugcuccuc

SEQ ID NO: 33171 - RNA, 23 nt, Human
gccagggcaaaggaccuggcgug

SEQ ID NO: 33172 - RNA, 27 nt, Human
guugaccaggcuggagugaaguggugu

SEQ ID NO: 33173 - RNA, 25 nt, Human
cuucuuagugugacaccaaaaccuu

SEQ ID NO: 33174 - RNA, 20 nt, Human
agaaaagauuuuucacugga

SEQ ID NO: 33175 - RNA, 21 nt, Human
aagcagugucuguguuuugaa

SEQ ID NO: 33176 - RNA, 22 nt, Human
gucucagcuugagaccauuuca

SEQ ID NO: 33177 - RNA, 26 nt, Human
caguauauuuuuacuucuucauucug

SEQ ID NO: 33178 - RNA, 20 nt, Human
aggugcguguucagcagaac

SEQ ID NO: 33179 - RNA, 25 nt, Human
guccgcguucuccccaccccgacgg

SEQ ID NO: 33180 - RNA, 22 nt, Human
cugggaggcagagcuugcagug

SEQ ID NO: 33181 - RNA, 27 nt, Human
aacaacaaaauggggacuucuuugggc

SEQ ID NO: 33182 - RNA, 24 nt, Human
ggguuuuaauaaacagacccuggc

SEQ ID NO: 33183 - RNA, 21 nt, Human
cauugucauuguuauugugac

SEQ ID NO: 33184 - RNA, 20 nt, Human
gcagaauucaacaagcacaa

SEQ ID NO: 33185 - RNA, 27 nt, Human
gggcaaugcugugagagccauuggaag

SEQ ID NO: 33186 - RNA, 21 nt, Human
uuuguguuuagaaaugaguua

SEQ ID NO: 33187 - RNA, 27 nt, Human
cuugacagagccugaguuugccucuua

SEQ ID NO: 33188 - RNA, 22 nt, Human
uuucauuuuacaauguauuauc

SEQ ID NO: 33189 - RNA, 19 nt, Human
uuuagugugugugcuuaca

SEQ ID NO: 33190 - RNA, 23 nt, Human
cgcagacgcacacuucccccuuc

SEQ ID NO: 33191 - RNA, 27 nt, Human
uugcacugugccuuucaacuccagaaa

SEQ ID NO: 33192 - RNA, 21 nt, Human
cccagcccagccaggucuccu

SEQ ID NO: 33193 - RNA, 23 nt, Human
gaacgccacaccucaggauuccu

SEQ ID NO: 33194 - RNA, 24 nt, Human
agggcuucucguucaugcacccuu

SEQ ID NO: 33195 - RNA, 25 nt, Human
uccagugguaagcacauuccucagc

SEQ ID NO: 33196 - RNA, 21 nt, Human
uaauaaaacaugcaucauuuu

SEQ ID NO: 33197 - RNA, 22 nt, Human
uggcucaugccuguaauccgag

SEQ ID NO: 33198 - RNA, 24 nt, Human
aacuuaguucuugaugaucccacu

SEQ ID NO: 33199 - RNA, 23 nt, Human
gugcaguguuuuuaaaagccaau

SEQ ID NO: 33200 - RNA, 26 nt, Human
cacucuauccuggauagguauuuaga

SEQ ID NO: 33201 - RNA, 20 nt, Human
ggaacggaggcuucagaagc

SEQ ID NO: 33202 - RNA, 25 nt, Human
gugcugucugcuggagccucuaguc

SEQ ID NO: 33203 - RNA, 22 nt, Human
gggaccccuccccagagccggc

SEQ ID NO: 33204 - RNA, 20 nt, Human
ggaguuucuuuuccuccggc

SEQ ID NO: 33205 - RNA, 20 nt, Human
cagaaccaguccugcccugu

SEQ ID NO: 33206 - RNA, 27 nt, Human
ccugagcggugggagggcucugcgggg

SEQ ID NO: 33207 - RNA, 23 nt, Human
cacaguccagacccaagucaaag

SEQ ID NO: 33208 - RNA, 26 nt, Human
ccugugguugccugcccuccugagcc

SEQ ID NO: 33209 - RNA, 21 nt, Human
ggugagccaccaugcccggcc

SEQ ID NO: 33210 - RNA, 22 nt, Human
ucguaacuccaguaaaaguuac

SEQ ID NO: 33211 - RNA, 28 nt, Human
aacagggcugccuucuggccuuguaaga

SEQ ID NO: 33212 - RNA, 22 nt, Human
ugacagagcgagacuccaucuc

SEQ ID NO: 33213 - RNA, 22 nt, Human
cgacagagugagacuccaucuc

SEQ ID NO: 33214 - RNA, 22 nt, Human
uaacagagcaagacuccaucuc

SEQ ID NO: 33215 - RNA, 19 nt, Human
ggacaauuguaacugugaa

SEQ ID NO: 33216 - RNA, 27 nt, Human
ggaaguuaagggagagucaaugggcag

SEQ ID NO: 33217 - RNA, 22 nt, Human
cugugcugugcucaagcgggca

SEQ ID NO: 33218 - RNA, 22 nt, Human
gcugggaguggagaggcacugu

SEQ ID NO: 33219 - RNA, 22 nt, Human
acacaggaaguucuccaagguc

SEQ ID NO: 33220 - RNA, 21 nt, Human
ucaugagugaggucaccaaga

SEQ ID NO: 33221 - RNA, 27 nt, Human
gaaacacagauauuuguuuuacaaaaa

SEQ ID NO: 33222 - RNA, 27 nt, Human
guugcccaggcuggucuugaacuccua

SEQ ID NO: 33223 - RNA, 19 nt, Human
gcaaguccccagacuuuug

SEQ ID NO: 33224 - RNA, 22 nt, Human
cuccacccacaccuccaugacc

SEQ ID NO: 33225 - RNA, 22 nt, Human
uucauucugucuuucugguucc

SEQ ID NO: 33226 - RNA, 22 nt, Human
uggcucacaccuauaaccccag

SEQ ID NO: 33227 - RNA, 21 nt, Human
agggcagggcccacccugcgg

SEQ ID NO: 33228 - RNA, 20 nt, Human
cacuccucugcugaccugcu

SEQ ID NO: 33229 - RNA, 22 nt, Human
ucucaauaaagaacacagugca

SEQ ID NO: 33230 - RNA, 26 nt, Human
uuucauuuucacuuccagucuaagcc

SEQ ID NO: 33231 - RNA, 23 nt, Human
ccugucacugucuuugugucucu

SEQ ID NO: 33232 - RNA, 17 nt, Human
uccauaaaaugaccuuu

SEQ ID NO: 33233 - RNA, 23 nt, Human
ugucaucaaaaucugcacaguca

SEQ ID NO: 33234 - RNA, 21 nt, Human
gucagcucauuuccauuccac

SEQ ID NO: 33235 - RNA, 19 nt, Human
gggguggaagcuuggggaa

SEQ ID NO: 33236 - RNA, 24 nt, Human
gcuuaucucccugcuucauaucuc

SEQ ID NO: 33237 - RNA, 21 nt, Human
aucucuagucccaauuacuca

SEQ ID NO: 33238 - RNA, 18 nt, Human
gucaaugauacagucccu

SEQ ID NO: 33239 - RNA, 20 nt, Human
ggcauccuugaucucaggga

SEQ ID NO: 33240 - RNA, 26 nt, Human
uaaaccaaguugagugaauugguagu

SEQ ID NO: 33241 - RNA, 25 nt, Human
uccucaagcccagccuucuacagag

SEQ ID NO: 33242 - RNA, 26 nt, Human
gcugagugugguggcucacgccuaua

SEQ ID NO: 33243 - RNA, 25 nt, Human
uucaggguucauuuucauccauucu

SEQ ID NO: 33244 - RNA, 24 nt, Human
gggaaagaaaguugcacggcugcu

SEQ ID NO: 33245 - RNA, 25 nt, Human
uuugcuuccugauuagauccaguca

SEQ ID NO: 33246 - RNA, 25 nt, Human
guguccguauauuucuguaccugca

SEQ ID NO: 33247 - RNA, 23 nt, Human
agugaggacagcaggcagggacu

SEQ ID NO: 33248 - RNA, 27 nt, Human
gugcaaaugauaucaccuaugcagccu

SEQ ID NO: 33249 - RNA, 26 nt, Human
gcaggucuggauggaaaguggacagg

SEQ ID NO: 33250 - RNA, 27 nt, Human
ucccugguuccucccugccccuugcca

SEQ ID NO: 33251 - RNA, 27 nt, Human
aaagugcugggauuacagguacaauga

SEQ ID NO: 33252 - RNA, 28 nt, Human
ccugucccacagcccugccuggauuugu

SEQ ID NO: 33253 - RNA, 25 nt, Human
gcugcaccagagcaaccucucacuc

SEQ ID NO: 33254 - RNA, 22 nt, Human
ccacaguguauaugcaauucua

SEQ ID NO: 33255 - RNA, 22 nt, Human
cccuugagagaagaggcagcag

SEQ ID NO: 33256 - RNA, 28 nt, Human
gcugcugacccagcuguggacugugccg

SEQ ID NO: 33257 - RNA, 27 nt, Human
cacugccugcagaggucugugcugagg

SEQ ID NO: 33258 - RNA, 19 nt, Human
aauguaacuuccucuuagg

SEQ ID NO: 33259 - RNA, 29 nt, Human
cucuugcaaaaccaaaccacaagacagac

SEQ ID NO: 33260 - RNA, 26 nt, Human
auagcccagaucccaagagauuaugu

SEQ ID NO: 33261 - RNA, 24 nt, Human
cuaccugcuggacagccuccgcca

SEQ ID NO: 33262 - RNA, 22 nt, Human
uugccuaggcuggaggacagug

SEQ ID NO: 33263 - RNA, 22 nt, Human
aguguugccagaucuucugauu

SEQ ID NO: 33264 - RNA, 22 nt, Human
acucugggcgucucugaagaug

SEQ ID NO: 33265 - RNA, 21 nt, Human
uuuuaaaugcuuuuuucucua

SEQ ID NO: 33266 - RNA, 23 nt, Human
ggggugaggcagggucaagugcu

SEQ ID NO: 33267 - RNA, 23 nt, Human
accccuucuagaaccugcauucc

SEQ ID NO: 33268 - RNA, 20 nt, Human
ucuccucugaccugccugua

SEQ ID NO: 33269 - RNA, 27 nt, Human
ugccuguaguccaagcuacuugaaggc

SEQ ID NO: 33270 - RNA, 27 nt, Human
gacccacaacccacaaccuuccagcuc

SEQ ID NO: 33271 - RNA, 27 nt, Human
ccccacucugagugaauacuuugauga

SEQ ID NO: 33272 - RNA, 26 nt, Human
guuuaaugcagugaucuuuguuuuug

SEQ ID NO: 33273 - RNA, 21 nt, Human
gcagguuccuucuagcuggag

SEQ ID NO: 33274 - RNA, 22 nt, Human
ccuugcgcaccugcucucuuac

SEQ ID NO: 33275 - RNA, 26 nt, Human
cccacugcacuccagccuggcaauag

SEQ ID NO: 33276 - RNA, 19 nt, Human
cucaucaggaaaugccuuc

SEQ ID NO: 33277 - RNA, 23 nt, Human
uuguguaccucauugcuuuagcu

SEQ ID NO: 33278 - RNA, 28 nt, Human
uucucgcuuccuccuuugggcaucucuu

SEQ ID NO: 33279 - RNA, 21 nt, Human
agccacaaaaagaccuaccuu

SEQ ID NO: 33280 - RNA, 22 nt, Human
accagccuggccaguaugguga

SEQ ID NO: 33281 - RNA, 22 nt, Human
ggcgugaacccgggaggcggag

SEQ ID NO: 33282 - RNA, 27 nt, Human
gcccaggagccuugcaggcuggagggc

SEQ ID NO: 33283 - RNA, 24 nt, Human
cuggcagcugcuccaggggcugcc

SEQ ID NO: 33284 - RNA, 25 nt, Human
guggccuccacugggcacuugccga

SEQ ID NO: 33285 - RNA, 22 nt, Human
gauuagguagacuuugcuuagu

SEQ ID NO: 33286 - RNA, 24 nt, Human
aaguggguguucugcacaccaggc

SEQ ID NO: 33287 - RNA, 15 nt, Human
cuugauugugccagu

SEQ ID NO: 33288 - RNA, 18 nt, Human
gcagucaggucacugccu

SEQ ID NO: 33289 - RNA, 23 nt, Human
cgaaauagaauaugacaugugag

SEQ ID NO: 33290 - RNA, 20 nt, Human
agggcacaaagaugggugaa

SEQ ID NO: 33291 - RNA, 20 nt, Human
ggagggugguccccaccagc

SEQ ID NO: 33292 - RNA, 23 nt, Human
aucgcaccacugcacucuagccu

SEQ ID NO: 33293 - RNA, 27 nt, Human
uguagcucuggaccugucucuaccuaa

SEQ ID NO: 33294 - RNA, 21 nt, Human
accaugucggagaaaagcgug

SEQ ID NO: 33295 - RNA, 24 nt, Human
cacaucccaauucugacaagaccu

SEQ ID NO: 33296 - RNA, 20 nt, Human
aggccucugacauuuaucca

SEQ ID NO: 33297 - RNA, 20 nt, Human
auugcugcuacucuaacacu

SEQ ID NO: 33298 - RNA, 29 nt, Human
cugguggaugccugguucguuccgcagca

SEQ ID NO: 33299 - RNA, 26 nt, Human
ggcccaggcugcccgcgggugcaccc

SEQ ID NO: 33300 - RNA, 25 nt, Human
uacuaaugcugcccucacugccucu

SEQ ID NO: 33301 - RNA, 23 nt, Human
agagugcugccaagcacagccuu

SEQ ID NO: 33302 - RNA, 18 nt, Human
uugggguguuuuguccag

SEQ ID NO: 33303 - RNA, 26 nt, Human
ugagccagcauuccagcuguuucacc

SEQ ID NO: 33304 - RNA, 22 nt, Human
ccggcaucuccccuagcucacc

SEQ ID NO: 33305 - RNA, 22 nt, Human
cccgcucaggcuggaggccagc

SEQ ID NO: 33306 - RNA, 28 nt, Human
cccuggcucuccccgcagcggggaaacu

SEQ ID NO: 33307 - RNA, 23 nt, Human
acuuccucucugcaccuccuggc

SEQ ID NO: 33308 - RNA, 26 nt, Human
agaaggcuggugauggaucugcugcu

SEQ ID NO: 33309 - RNA, 22 nt, Human
uccagccugggcaacaagagug

SEQ ID NO: 33310 - RNA, 21 nt, Human
cuucugcugagaggacacacg

SEQ ID NO: 33311 - RNA, 22 nt, Human
ccuuugcuggucccacuucaga

SEQ ID NO: 33312 - RNA, 25 nt, Human
acccaggcuggagugcaaugaugcg

SEQ ID NO: 33313 - RNA, 27 nt, Human
ggaggcugagagaggagauuugcuuga

SEQ ID NO: 33314 - RNA, 23 nt, Human
gagagaagaggaaugcugcauga

SEQ ID NO: 33315 - RNA, 28 nt, Human
ugggccaagcagggguugcagggcagua

SEQ ID NO: 33316 - RNA, 21 nt, Human
guagcuuggaaaaggaguagg

SEQ ID NO: 33317 - RNA, 20 nt, Human
gaauguccuucuuuaaaccu

SEQ ID NO: 33318 - RNA, 19 nt, Human
gggagguguagaaagaggu

SEQ ID NO: 33319 - RNA, 21 nt, Human
ugcuucagaaauccuuuagca

SEQ ID NO: 33320 - RNA, 23 nt, Human
aucacaccacugcacuccagccu

SEQ ID NO: 33321 - RNA, 22 nt, Human
uuacccuguccuccaccugccu

SEQ ID NO: 33322 - RNA, 23 nt, Human
ccaggaucuuaagggacuuugaa

SEQ ID NO: 33323 - RNA, 24 nt, Human
auccaucuugcagagaaguuuaca

SEQ ID NO: 33324 - RNA, 19 nt, Human
agccccccacucagcucuu

SEQ ID NO: 33325 - RNA, 27 nt, Human
caagggccuaagagaaaagccagccaa

SEQ ID NO: 33326 - RNA, 25 nt, Human
gcuccaggaagcaggcaggccuugg

SEQ ID NO: 33327 - RNA, 24 nt, Human
gucuuucucccgacccgcuccgcc

SEQ ID NO: 33328 - RNA, 26 nt, Human
cauuauccaaaaacaauaccaaaaag

SEQ ID NO: 33329 - RNA, 22 nt, Human
cggggacccacucugcccagcc

SEQ ID NO: 33330 - RNA, 23 nt, Human
gcucauucauauuccugccuuuc

SEQ ID NO: 33331 - RNA, 22 nt, Human
caaugauuuauuaaauauguuu

SEQ ID NO: 33332 - RNA, 23 nt, Human
acccaggcuguggugcaguaagc

SEQ ID NO: 33333 - RNA, 24 nt, Human
uccaccaggagucuggagugcaau

SEQ ID NO: 33334 - RNA, 22 nt, Human
gaguccuggagcuggcucuaua

SEQ ID NO: 33335 - RNA, 21 nt, Human
ccuaaccugggaccugugguc

SEQ ID NO: 33336 - RNA, 22 nt, Human
cgaggccagaguugcagggacu

SEQ ID NO: 33337 - RNA, 22 nt, Human
uggcucacaccuguaaucccag

SEQ ID NO: 33338 - RNA, 20 nt, Human
cagauaccagcuugccuuga

SEQ ID NO: 33339 - RNA, 23 nt, Human
uuggcuauuuaaagacaaagaca

SEQ ID NO: 33340 - RNA, 21 nt, Human
cagccuguucacacugcaccu

SEQ ID NO: 33341 - RNA, 22 nt, Human
agagcacauucuccucagugag

SEQ ID NO: 33342 - RNA, 26 nt, Human
ugagaagcuggaaauauuucuuucaa

SEQ ID NO: 33343 - RNA, 23 nt, Human
ccacaacauccgccuccuggguu

SEQ ID NO: 33344 - RNA, 20 nt, Human
ggaaagggguggacuccuau

SEQ ID NO: 33345 - RNA, 20 nt, Human
gaggaagagagaguuuacca

SEQ ID NO: 33346 - RNA, 27 nt, Human
cagaaagccuauuccaucaacugugaa

SEQ ID NO: 33347 - RNA, 18 nt, Human
ccaacuuggccucccaca

SEQ ID NO: 33348 - RNA, 22 nt, Human
agcucacugcggccucuaagaa

SEQ ID NO: 33349 - RNA, 21 nt, Human
ugagaagaucggaacagcucc

SEQ ID NO: 33350 - RNA, 27 nt, Human
ggaauuuggcauucagcaauguggaaa

SEQ ID NO: 33351 - RNA, 24 nt, Human
gggcccaggcggggaaguggggug

SEQ ID NO: 33352 - RNA, 27 nt, Human
uuugccuccagaaccuucccgucugau

SEQ ID NO: 33353 - RNA, 21 nt, Human
aggaacuuuuaauuugcaggg

SEQ ID NO: 33354 - RNA, 26 nt, Human
gcuccucugccuccccauggauaugc

SEQ ID NO: 33355 - RNA, 21 nt, Human
cuucucccucuccuucacacu

SEQ ID NO: 33356 - RNA, 19 nt, Human
uguguaguggacacuugua

SEQ ID NO: 33357 - RNA, 20 nt, Human
acauggacuacacacaauac

SEQ ID NO: 33358 - RNA, 20 nt, Human
aguaauaaacuaggacacua

SEQ ID NO: 33359 - RNA, 22 nt, Human
gcucacugcagccuccuucucc

SEQ ID NO: 33360 - RNA, 21 nt, Human
gauuuugcaguaggcuugggg

SEQ ID NO: 33361 - RNA, 24 nt, Human
ccaaaacucuuccuuuuggaacca

SEQ ID NO: 33362 - RNA, 20 nt, Human
ccuucugguuucuuccagcc

SEQ ID NO: 33363 - RNA, 21 nt, Human
cagguagauuucucagccagc

SEQ ID NO: 33364 - RNA, 22 nt, Human
gccguacaccuucugcaucuca

SEQ ID NO: 33365 - RNA, 27 nt, Human
gcucucccuuggaaccugcacagcucu

SEQ ID NO: 33366 - RNA, 21 nt, Human
ucaagaccaucacagaccagg

SEQ ID NO: 33367 - RNA, 23 nt, Human
ccugcagugccaaagccccaccu

SEQ ID NO: 33368 - RNA, 26 nt, Human
gauuaucuuuauaucacugucuuucu

SEQ ID NO: 33369 - RNA, 20 nt, Human
acauguuuucucuggaguau

SEQ ID NO: 33370 - RNA, 21 nt, Human
acacaugcugccuucuugggg

SEQ ID NO: 33371 - RNA, 20 nt, Human
gcccuggaugaaguggagaa

SEQ ID NO: 33372 - RNA, 23 nt, Human
cacucuggggugggagggucugc

SEQ ID NO: 33373 - RNA, 21 nt, Human
cacccaggcuggggcgcaaug

SEQ ID NO: 33374 - RNA, 25 nt, Human
cuugccucucccuauggccugcugg

SEQ ID NO: 33375 - RNA, 23 nt, Human
uuccugggaaucaggagccugga

SEQ ID NO: 33376 - RNA, 25 nt, Human
accuccauuuugaucaucaggauuu

SEQ ID NO: 33377 - RNA, 25 nt, Human
aagguggggggauuacccgagguca

SEQ ID NO: 33378 - RNA, 21 nt, Human
gaaaccccauuuuucccaggg

SEQ ID NO: 33379 - RNA, 23 nt, Human
gcgccugccuccucccuccuggg

SEQ ID NO: 33380 - RNA, 22 nt, Human
uucauaaggccaguaugauuua

SEQ ID NO: 33381 - RNA, 20 nt, Human
cuccaccaacucuguccucg

SEQ ID NO: 33382 - RNA, 27 nt, Human
ccugccuggcugcccuuuccccccugc

SEQ ID NO: 33383 - RNA, 23 nt, Human
uucuguuggggagauucccuagg

SEQ ID NO: 33384 - RNA, 23 nt, Human
aagaucuacccuuauggccaggu

SEQ ID NO: 33385 - RNA, 27 nt, Human
ucccacccucaaggugcggggagaaga

SEQ ID NO: 33386 - RNA, 22 nt, Human
uacaagugggccgugcagcugg

SEQ ID NO: 33387 - RNA, 21 nt, Human
uagucauuccauaagagucuu

SEQ ID NO: 33388 - RNA, 23 nt, Human
uccuccauuaugucuucgucucu

SEQ ID NO: 33389 - RNA, 26 nt, Human
ucuuggauugucugaccucaguagcu

SEQ ID NO: 33390 - RNA, 21 nt, Human
aagugaccuuagugaugcaga

SEQ ID NO: 33391 - RNA, 24 nt, Human
ucauaacguaaugauuauaugaca

SEQ ID NO: 33392 - RNA, 26 nt, Human
cugccaccucccaccucucugagggc

SEQ ID NO: 33393 - RNA, 24 nt, Human
cgcaagaagcgcuacaccguggug

SEQ ID NO: 33394 - RNA, 26 nt, Human
cuacaguggacuuucucucuggaaug

SEQ ID NO: 33395 - RNA, 23 nt, Human
ugcccuugaggugaccucuggca

SEQ ID NO: 33396 - RNA, 26 nt, Human
ugcaggaguggguggggaaaggaagu

SEQ ID NO: 33397 - RNA, 29 nt, Human
gcgauugaauucuaaccucuuugacuccu

SEQ ID NO: 33398 - RNA, 21 nt, Human
gguggcaggggggcugugggg

SEQ ID NO: 33399 - RNA, 22 nt, Human
ccugccguagagaaugauagag

SEQ ID NO: 33400 - RNA, 22 nt, Human
aguauagaaaugauguuuccua

SEQ ID NO: 33401 - RNA, 26 nt, Human
aucaauaauccuucgaucuugucucc

SEQ ID NO: 33402 - RNA, 21 nt, Human
ucugggaaaugccagugcaaa

SEQ ID NO: 33403 - RNA, 26 nt, Human
ccgcucugcaugcccugucugugcca

SEQ ID NO: 33404 - RNA, 27 nt, Human
ugucaacaguaauggauuggaguguug

SEQ ID NO: 33405 - RNA, 22 nt, Human
ccccugcagcuccagccccggg

SEQ ID NO: 33406 - RNA, 30 nt, Human
gguuauuuuuccagauuggagaguugaaag

SEQ ID NO: 33407 - RNA, 25 nt, Human
cagacuggcaacaagaagaugguac

SEQ ID NO: 33408 - RNA, 22 nt, Human
gggauccagaaacccaugauac

SEQ ID NO: 33409 - RNA, 27 nt, Human
gcuuggguccaguggaggaagaaggaa

SEQ ID NO: 33410 - RNA, 28 nt, Human
agaggaaggccuccugagggaggggcag

SEQ ID NO: 33411 - RNA, 20 nt, Human
ccucacugcucucucagucu

SEQ ID NO: 33412 - RNA, 16 nt, Human
agccucucccaccuaa

SEQ ID NO: 33413 - RNA, 23 nt, Human
caggugcaaaaagauuguguguu

SEQ ID NO: 33414 - RNA, 30 nt, Human
cccgcauucagauuucauuugcuguugcuu

SEQ ID NO: 33415 - RNA, 22 nt, Human
caggaguuugaggcugcagcga

SEQ ID NO: 33416 - RNA, 26 nt, Human
ugcauuuucacccauucugugguuca

SEQ ID NO: 33417 - RNA, 21 nt, Human
ccuccacuaugcucucccucc

SEQ ID NO: 33418 - RNA, 21 nt, Human
ccacaaucgcugccuccuggg

SEQ ID NO: 33419 - RNA, 21 nt, Human
cucaccguacauacuccaguc

SEQ ID NO: 33420 - RNA, 22 nt, Human
cuuggccucccaaaguguuggg

SEQ ID NO: 33421 - RNA, 23 nt, Human
uuguuggggcagagccaguggag

SEQ ID NO: 33422 - RNA, 22 nt, Human
uuccaaaugaaucaguauuuua

SEQ ID NO: 33423 - RNA, 27 nt, Human
ugcuacaguuuaucuagguugcagugg

SEQ ID NO: 33424 - RNA, 27 nt, Human
cccuccaggaaggguccuucacggccu

SEQ ID NO: 33425 - RNA, 22 nt, Human
guuuuccuuugagucuucugga

SEQ ID NO: 33426 - RNA, 24 nt, Human
gucacccaggcuggagugcagugu

SEQ ID NO: 33427 - RNA, 24 nt, Human
cucuaacacuucccuccccugucc

SEQ ID NO: 33428 - RNA, 21 nt, Human
ggcacgcccuaguuaagcagc

SEQ ID NO: 33429 - RNA, 27 nt, Human
cuccaucucuuuaaaaacaaacaaaaa

SEQ ID NO: 33430 - RNA, 22 nt, Human
ggugcucaggcugggaggguag

SEQ ID NO: 33431 - RNA, 26 nt, Human
agggaggcagaagucugcaguugaag

SEQ ID NO: 33432 - RNA, 25 nt, Human
auauucccaugguagacugugacac

SEQ ID NO: 33433 - RNA, 29 nt, Human
gggcucaauuuccugauuguaguagaggu

SEQ ID NO: 33434 - RNA, 21 nt, Human
aaccucaaaaugucuaagaua

SEQ ID NO: 33435 - RNA, 21 nt, Human
ugcaaacacccaagcccucuc

SEQ ID NO: 33436 - RNA, 27 nt, Human
ucaaagccugaccuuucaaauccauga

SEQ ID NO: 33437 - RNA, 20 nt, Human
ccuuggaggggucacaugag

SEQ ID NO: 33438 - RNA, 21 nt, Human
accugcguuccggacacugag

SEQ ID NO: 33439 - RNA, 24 nt, Human
gcacagccacagccuccucgccuc

SEQ ID NO: 33440 - RNA, 31 nt, Human
ccagugcccagccccaccaaugggccuccag

SEQ ID NO: 33441 - RNA, 20 nt, Human
guucucucucauuuggacuu

SEQ ID NO: 33442 - RNA, 22 nt, Human
ggccugccggguagcugggacu

SEQ ID NO: 33443 - RNA, 22 nt, Human
gugugagccacuaugccuggcc

SEQ ID NO: 33444 - RNA, 27 nt, Human
ccucacacugcuaugauugccaacucc

SEQ ID NO: 33445 - RNA, 20 nt, Human
agaccugagcuuuccgcguc

SEQ ID NO: 33446 - RNA, 22 nt, Human
cccgccgcgcaacuaccuccuc

SEQ ID NO: 33447 - RNA, 21 nt, Human
gaggcacaggcgggaggauca

SEQ ID NO: 33448 - RNA, 23 nt, Human
caccagugcccaagucucuaugg

SEQ ID NO: 33449 - RNA, 22 nt, Human
gguccccccacagcuccaggac

SEQ ID NO: 33450 - RNA, 23 nt, Human
ucagcccagagccagagggcugg

SEQ ID NO: 33451 - RNA, 26 nt, Human
uucauuggcugacacaccuccugucc

SEQ ID NO: 33452 - RNA, 26 nt, Human
aggguguaauuggguugauggguggg

SEQ ID NO: 33453 - RNA, 22 nt, Human
ugugaaucuuauuuggaaauua

SEQ ID NO: 33454 - RNA, 21 nt, Human
cuguauuucacucuuucuccc

SEQ ID NO: 33455 - RNA, 23 nt, Human
ugccuguagugccagcuacucag

SEQ ID NO: 33456 - RNA, 21 nt, Human
gcucacuuguuaguauuucug

SEQ ID NO: 33457 - RNA, 19 nt, Human
ggcugcugcuuucugccca

SEQ ID NO: 33458 - RNA, 22 nt, Human
ugggcaacauggcaaagcccca

SEQ ID NO: 33459 - RNA, 24 nt, Human
ccggacacaugggccagcugccug

SEQ ID NO: 33460 - RNA, 25 nt, Human
ugccuugguguuccaauaagugaau

SEQ ID NO: 33461 - RNA, 21 nt, Human
uauaaucccagcacuuuugga

SEQ ID NO: 33462 - RNA, 27 nt, Human
ucucuguucuguucccuccaucuaugc

SEQ ID NO: 33463 - RNA, 21 nt, Human
aggugcuggacaaaaacaugg

SEQ ID NO: 33464 - RNA, 21 nt, Human
uaaccaggagggggauggaga

SEQ ID NO: 33465 - RNA, 21 nt, Human
guauguaaucccagcacuuug

SEQ ID NO: 33466 - RNA, 21 nt, Human
augggaaagccaccucucccu

SEQ ID NO: 33467 - RNA, 19 nt, Human
cguucaucugaggagucca

SEQ ID NO: 33468 - RNA, 21 nt, Human
ggcugcucugagaaguacaca

SEQ ID NO: 33469 - RNA, 22 nt, Human
cugaggcagggggaucgcuuga

SEQ ID NO: 33470 - RNA, 27 nt, Human
gaggaagaggccucgcgcagaggaggg

SEQ ID NO: 33471 - RNA, 23 nt, Human
cccucggucccauguccaugggg

SEQ ID NO: 33472 - RNA, 23 nt, Human
agaguccugagucccucagugga

SEQ ID NO: 33473 - RNA, 27 nt, Human
cucuggguugucauucacuuugagagc

SEQ ID NO: 33474 - RNA, 21 nt, Human
uuccucugggcaggggacaga

SEQ ID NO: 33475 - RNA, 22 nt, Human
cacccaggcaugaagcacguug

SEQ ID NO: 33476 - RNA, 18 nt, Human
ucacaugcacauguugca

SEQ ID NO: 33477 - RNA, 24 nt, Human
auugagugcuccugugugcuggcc

SEQ ID NO: 33478 - RNA, 21 nt, Human
uccucaccaugucuucgacuc

SEQ ID NO: 33479 - RNA, 22 nt, Human
gcuucccgaguaacugagauua

SEQ ID NO: 33480 - RNA, 23 nt, Human
ggacgccaugggcacugcaggga

SEQ ID NO: 33481 - RNA, 23 nt, Human
gggcgcugcauugggcagaggaa

SEQ ID NO: 33482 - RNA, 24 nt, Human
ugcauaguuuggcagaaaaaucag

SEQ ID NO: 33483 - RNA, 23 nt, Human
ugaagugccuacuggggggcuuu

SEQ ID NO: 33484 - RNA, 20 nt, Human
auccuguucugacagcuuga

SEQ ID NO: 33485 - RNA, 26 nt, Human
acugcagugagaaugagggccaagaa

SEQ ID NO: 33486 - RNA, 21 nt, Human
ggcucacugcauccuccgccu

SEQ ID NO: 33487 - RNA, 24 nt, Human
ucuguauuuacacuccuucaccua

SEQ ID NO: 33488 - RNA, 19 nt, Human
cguggggcccaugggugag

SEQ ID NO: 33489 - RNA, 20 nt, Human
aggcugaggaggaagucuuc

SEQ ID NO: 33490 - RNA, 24 nt, Human
cccaacaagaagguuucuguccua

SEQ ID NO: 33491 - RNA, 24 nt, Human
gcccccagcaguacaguccuuccu

SEQ ID NO: 33492 - RNA, 22 nt, Human
uuguuuuacuucagaaguauug

SEQ ID NO: 33493 - RNA, 21 nt, Human
uguacugccuggaugagcaca

SEQ ID NO: 33494 - RNA, 20 nt, Human
ucuaauaagcugagauuccc

SEQ ID NO: 33495 - RNA, 25 nt, Human
aaauaacugacauuauauauaacca

SEQ ID NO: 33496 - RNA, 22 nt, Human
uucaggcgauucuccugccuca

SEQ ID NO: 33497 - RNA, 26 nt, Human
aagcaauggccccauccucaaagaag

SEQ ID NO: 33498 - RNA, 22 nt, Human
cacagcuguggccauauguuug

SEQ ID NO: 33499 - RNA, 23 nt, Human
uuguacuugcuccuuuugcucuu

SEQ ID NO: 33500 - RNA, 19 nt, Human
cucaguggccaucaugucu

SEQ ID NO: 33501 - RNA, 27 nt, Human
gcagcccauggcaacucaaagugccuu

SEQ ID NO: 33502 - RNA, 22 nt, Human
gcacacugcaagcugggguggc

SEQ ID NO: 33503 - RNA, 22 nt, Human
uauaaggacacugaagcuuaga

SEQ ID NO: 33504 - RNA, 18 nt, Human
uugcccaguacaguaguu

SEQ ID NO: 33505 - RNA, 28 nt, Human
ggcuuaccauucccuagcacacuggccu

SEQ ID NO: 33506 - RNA, 21 nt, Human
uuccucugggaaaggagcagg

SEQ ID NO: 33507 - RNA, 19 nt, Human
cugguucccaccucagccu

SEQ ID NO: 33508 - RNA, 21 nt, Human
uaauccagggcgucagucaaa

SEQ ID NO: 33509 - RNA, 27 nt, Human
cuccaucucacuaaggguuaaaggcgu

SEQ ID NO: 33510 - RNA, 20 nt, Human
uuugauucugguucaucucg

SEQ ID NO: 33511 - RNA, 24 nt, Human
ggcucacagugcaaccucugcuuc

SEQ ID NO: 33512 - RNA, 22 nt, Human
cacugcucuccagccugggagg

SEQ ID NO: 33513 - RNA, 22 nt, Human
uuugaaacaacuuucucuugua

SEQ ID NO: 33514 - RNA, 25 nt, Human
caacaucaagacucucugucguugg

SEQ ID NO: 33515 - RNA, 19 nt, Human
uuugcccugccugcagccu

SEQ ID NO: 33516 - RNA, 21 nt, Human
uuguguggaagaggaggaauc

SEQ ID NO: 33517 - RNA, 20 nt, Human
cuuggucuugcagugaggaa

SEQ ID NO: 33518 - RNA, 26 nt, Human
aggaagaggguauggucugagaugug

SEQ ID NO: 33519 - RNA, 27 nt, Human
gaagcaguuccagggagagucagguuc

SEQ ID NO: 33520 - RNA, 22 nt, Human
ccaaaguguugggauuauaggc

SEQ ID NO: 33521 - RNA, 26 nt, Human
ggccgaggcaggggcugggcagaggg

SEQ ID NO: 33522 - RNA, 22 nt, Human
gcucacugcagccuugacuucu

SEQ ID NO: 33523 - RNA, 20 nt, Human
aguacugucaggaugggguc

SEQ ID NO: 33524 - RNA, 24 nt, Human
ugggcagccuuuuccauggccugg

SEQ ID NO: 33525 - RNA, 22 nt, Human
cccugucucuuccugccugugu

SEQ ID NO: 33526 - RNA, 18 nt, Human
acaaucccccacgcccag

SEQ ID NO: 33527 - RNA, 25 nt, Human
ggggugagccgcugugccuggcugg

SEQ ID NO: 33528 - RNA, 27 nt, Human
gccaguuacccacccacaggucccccu

SEQ ID NO: 33529 - RNA, 22 nt, Human
accacacauggcuaauuuuugu

SEQ ID NO: 33530 - RNA, 22 nt, Human
ccuccuccuccucaccaagggc

SEQ ID NO: 33531 - RNA, 22 nt, Human
ccugcucuuuggccugaugacc

SEQ ID NO: 33532 - RNA, 26 nt, Human
cucugcuuucaaaacaaaaagagauu

SEQ ID NO: 33533 - RNA, 22 nt, Human
ucugucauguguccuugucccu

SEQ ID NO: 33534 - RNA, 19 nt, Human
gcuuuuccccucugugacu

SEQ ID NO: 33535 - RNA, 19 nt, Human
cugcgcuugaggccugucu

SEQ ID NO: 33536 - RNA, 27 nt, Human
gcugccucugggccaugccaggccaga

SEQ ID NO: 33537 - RNA, 22 nt, Human
agccguaagugcuucuuuguca

SEQ ID NO: 33538 - RNA, 26 nt, Human
gugcccaggaggcaggcagugcgggg

SEQ ID NO: 33539 - RNA, 27 nt, Human
auaaaguguaacaaggaacacuaaaac

SEQ ID NO: 33540 - RNA, 27 nt, Human
uuccuuuggcccggagauggcugcuag

SEQ ID NO: 33541 - RNA, 22 nt, Human
gcacaggaagugggcggugggg

SEQ ID NO: 33542 - RNA, 20 nt, Human
ggggaaagcuuuuucugaag

SEQ ID NO: 33543 - RNA, 22 nt, Human
cuuuuugcuuucuuuuacgacc

SEQ ID NO: 33544 - RNA, 21 nt, Human
ugccucuccccucugccaucc

SEQ ID NO: 33545 - RNA, 22 nt, Human
guuggcuguuaacacugccuuu

SEQ ID NO: 33546 - RNA, 20 nt, Human
ggccggaguccaguggugca

SEQ ID NO: 33547 - RNA, 26 nt, Human
ggagaggacagagcaggggcuccagc

SEQ ID NO: 33548 - RNA, 22 nt, Human
ucugcgguucucgccugggcag

SEQ ID NO: 33549 - RNA, 23 nt, Human
uuguucaaagauccagugcaguu

SEQ ID NO: 33550 - RNA, 24 nt, Human
aucuuagugccugagaguauuuag

SEQ ID NO: 33551 - RNA, 21 nt, Human
cgaucugggcugccuccagcc

SEQ ID NO: 33552 - RNA, 21 nt, Human
auccgaacuccuggauuucag

SEQ ID NO: 33553 - RNA, 24 nt, Human
agccuucagucccgcccacgugcu

SEQ ID NO: 33554 - RNA, 17 nt, Human
gcagggaacagcuuugg

SEQ ID NO: 33555 - RNA, 24 nt, Human
ugcuccugcugcacagcugccagg

SEQ ID NO: 33556 - RNA, 22 nt, Human
ggcacagauuuaucaagcuccu

SEQ ID NO: 33557 - RNA, 22 nt, Human
ugcauacauucaaagcacuguu

SEQ ID NO: 33558 - RNA, 22 nt, Human
ggcucucaggaccugcgcugcc

SEQ ID NO: 33559 - RNA, 25 nt, Human
ccuuuagaucuugauuucuugguca

SEQ ID NO: 33560 - RNA, 25 nt, Human
augcgggagcagcagaaggagcagc

SEQ ID NO: 33561 - RNA, 17 nt, Human
uguacacacaaucucug

SEQ ID NO: 33562 - RNA, 23 nt, Human
cuaucuuguuccaaggccaggga

SEQ ID NO: 33563 - RNA, 26 nt, Human
gaaaguugguuuuauuagguguuccc

SEQ ID NO: 33564 - RNA, 17 nt, Human
accacuugacaccagaa

SEQ ID NO: 33565 - RNA, 22 nt, Human
aaagaacagaaggacugaagac

SEQ ID NO: 33566 - RNA, 18 nt, Human
agagaauugcuguggaga

SEQ ID NO: 33567 - RNA, 26 nt, Human
guagucucaccuacuccggaggcuga

SEQ ID NO: 33568 - RNA, 23 nt, Human
caaacagaguauguccgauggua

SEQ ID NO: 33569 - RNA, 21 nt, Human
gcaauuucucccuucugaguu

SEQ ID NO: 33570 - RNA, 27 nt, Human
cgcagccgccugugcugguacgacuau

SEQ ID NO: 33571 - RNA, 24 nt, Human
ucuccaccucccccaaacccugcu

SEQ ID NO: 33572 - RNA, 27 nt, Human
uucuuguuucuaugauaaaagcacuuu

SEQ ID NO: 33573 - RNA, 22 nt, Human
uggcucacaccugcaaucccag

SEQ ID NO: 33574 - RNA, 21 nt, Human
uucucuugcuucagccuccca

SEQ ID NO: 33575 - RNA, 24 nt, Human
ccugcccuugcuccagccugacaa

SEQ ID NO: 33576 - RNA, 22 nt, Human
uuggggcacagaagcuguggga

SEQ ID NO: 33577 - RNA, 27 nt, Human
ggccagccuggcccugcaggucuccca

SEQ ID NO: 33578 - RNA, 21 nt, Human
cgugcuguuugcugugcgugg

SEQ ID NO: 33579 - RNA, 22 nt, Human
uuccauccugaauuuaucaagu

SEQ ID NO: 33580 - RNA, 27 nt, Human
acgcuugggcucggcaggagcugccgu

SEQ ID NO: 33581 - RNA, 21 nt, Human
acagggucucaugccauuccg

SEQ ID NO: 33582 - RNA, 24 nt, Human
gacuuccugacaccacagucaauu

SEQ ID NO: 33583 - RNA, 27 nt, Human
gugugagccaccacgcccgguacauau

SEQ ID NO: 33584 - RNA, 22 nt, Human
accgcccaccagggcucagggu

SEQ ID NO: 33585 - RNA, 23 nt, Human
cugggcuugggcaccagcucaug

SEQ ID NO: 33586 - RNA, 23 nt, Human
gccacucugucccuuccugggca

SEQ ID NO: 33587 - RNA, 22 nt, Human
cuuauuucucauugccucuucu

SEQ ID NO: 33588 - RNA, 23 nt, Human
ccguccucuacagccuccuggcc

SEQ ID NO: 33589 - RNA, 25 nt, Human
ccccaggcucaugugccaccaccuu

SEQ ID NO: 33590 - RNA, 21 nt, Human
gcauuuuucugucagaaucac

SEQ ID NO: 33591 - RNA, 23 nt, Human
ucucaccucugugccucugucuc

SEQ ID NO: 33592 - RNA, 27 nt, Human
ugccugacuaaaauguuucauuuaccu

SEQ ID NO: 33593 - RNA, 23 nt, Human
ucuguucuuuaguuuauucuuac

SEQ ID NO: 33594 - RNA, 22 nt, Human
acccacguuccagccucuaggu

SEQ ID NO: 33595 - RNA, 23 nt, Human
ucuccucuuuuaucuuggacuga

SEQ ID NO: 33596 - RNA, 23 nt, Human
aggaguccaggcugcacccugga

SEQ ID NO: 33597 - RNA, 19 nt, Human
cccggcgccccaccucugg

SEQ ID NO: 33598 - RNA, 26 nt, Human
agcugaaucacuagcucagauuuuuc

SEQ ID NO: 33599 - RNA, 22 nt, Human
ugggacugaaguaaacauauca

SEQ ID NO: 33600 - RNA, 26 nt, Human
ccaacauggugccaaagcuuccagaa

SEQ ID NO: 33601 - RNA, 21 nt, Human
agccaccuugcaaccuugacu

SEQ ID NO: 33602 - RNA, 25 nt, Human
cagcacuuugagaggcugagguggu

SEQ ID NO: 33603 - RNA, 23 nt, Human
gucucuugguccacaccucgcuc

SEQ ID NO: 33604 - RNA, 21 nt, Human
gaacauguaacuucucucaca

SEQ ID NO: 33605 - RNA, 26 nt, Human
caguucugcggaugcuucuuacaacc

SEQ ID NO: 33606 - RNA, 24 nt, Human
cugggguggacucagauggguggg

SEQ ID NO: 33607 - RNA, 19 nt, Human
auuaucuaaagcauguuag

SEQ ID NO: 33608 - RNA, 22 nt, Human
acccagccucagcaucacagcc

SEQ ID NO: 33609 - RNA, 25 nt, Human
gcaugcccagcuccucccuggguga

SEQ ID NO: 33610 - RNA, 20 nt, Human
uuuacuuccuucucugaaau

SEQ ID NO: 33611 - RNA, 18 nt, Human
aggcgggccucacagguc

SEQ ID NO: 33612 - RNA, 24 nt, Human
uaauuuucuuuuccuuuuaaagac

SEQ ID NO: 33613 - RNA, 22 nt, Human
acuuaccauacugggagguaga

SEQ ID NO: 33614 - RNA, 23 nt, Human
uuuaaaacugcaguuuucagacg

SEQ ID NO: 33615 - RNA, 26 nt, Human
cccaagaauguaaauaauauucauaa

SEQ ID NO: 33616 - RNA, 20 nt, Human
gguaacaaggaacucacuug

SEQ ID NO: 33617 - RNA, 20 nt, Human
agcaaggauaugaugagauu

SEQ ID NO: 33618 - RNA, 27 nt, Human
ggagagggaggagugagcucccugggu

SEQ ID NO: 33619 - RNA, 27 nt, Human
ugcagcuccacguggaauccaggugcc

SEQ ID NO: 33620 - RNA, 27 nt, Human
cuuguguguguuuuucuaaguagauuc

SEQ ID NO: 33621 - RNA, 22 nt, Human
gagacccaggccuggagaguag

SEQ ID NO: 33622 - RNA, 25 nt, Human
ggcucagaauaucuggauuggagag

SEQ ID NO: 33623 - RNA, 23 nt, Human
ugcaccaaaagaaugagugccuu

SEQ ID NO: 33624 - RNA, 22 nt, Human
agcuuuagaaagaaacuggaau

SEQ ID NO: 33625 - RNA, 22 nt, Human
ggcauuuuacugauagcuguuc

SEQ ID NO: 33626 - RNA, 27 nt, Human
uucuaggguuuguacucaggagucuga

SEQ ID NO: 33627 - RNA, 26 nt, Human
cugcccaggagguggcguccagcagu

SEQ ID NO: 33628 - RNA, 27 nt, Human
aaggcauuuauugcugaguuauauguu

SEQ ID NO: 33629 - RNA, 22 nt, Human
cuccucaaaagggaacugagag

SEQ ID NO: 33630 - RNA, 21 nt, Human
ucucuccccugcuccagcgca

SEQ ID NO: 33631 - RNA, 19 nt, Human
guuuuccaagcugggcaag

SEQ ID NO: 33632 - RNA, 27 nt, Human
cccuucucuuuuaauggagacaggguc

SEQ ID NO: 33633 - RNA, 21 nt, Human
gccacccugcaacccacccuc

SEQ ID NO: 33634 - RNA, 22 nt, Human
gugucccaggcuggagugcagu

SEQ ID NO: 33635 - RNA, 23 nt, Human
caggugcaaacaucucaagccag

SEQ ID NO: 33636 - RNA, 21 nt, Human
gagccaccugcccagccaugu

SEQ ID NO: 33637 - RNA, 23 nt, Human
cuuggggaaaauggccauacagg

SEQ ID NO: 33638 - RNA, 23 nt, Human
cuguggcugggacagccaggggg

SEQ ID NO: 33639 - RNA, 22 nt, Human
ggaaguuuugaguuucucucca

SEQ ID NO: 33640 - RNA, 17 nt, Human
uucagcucuggcgccuu

SEQ ID NO: 33641 - RNA, 24 nt, Human
gcaugggacuggccugccuccucc

SEQ ID NO: 33642 - RNA, 18 nt, Human
aaccuguuucgcaguuuc

SEQ ID NO: 33643 - RNA, 19 nt, Human
acuccugaagauccaucuc

SEQ ID NO: 33644 - RNA, 23 nt, Human
cccacagagacacuuuaccagga

SEQ ID NO: 33645 - RNA, 20 nt, Human
ucuagauguuuauucuucua

SEQ ID NO: 33646 - RNA, 23 nt, Human
gucugggcgagcggggcggcucg

SEQ ID NO: 33647 - RNA, 21 nt, Human
acaaguguauaucagaaaagg

SEQ ID NO: 33648 - RNA, 22 nt, Human
ugauagugaugcauguugaugu

SEQ ID NO: 33649 - RNA, 20 nt, Human
gccucucccugccaaagccc

SEQ ID NO: 33650 - RNA, 22 nt, Human
aggaauugcgggaggaaaaugg

SEQ ID NO: 33651 - RNA, 26 nt, Human
cacccaggcuccauggggaagugcuc

SEQ ID NO: 33652 - RNA, 23 nt, Human
uuugggaaaaaguagcccauggg

SEQ ID NO: 33653 - RNA, 23 nt, Human
gcuuuuuucaguugucugucuuu

SEQ ID NO: 33654 - RNA, 21 nt, Human
auuggcuggaguugagacugu

SEQ ID NO: 33655 - RNA, 19 nt, Human
ggcaaauuucuguucuauu

SEQ ID NO: 33656 - RNA, 20 nt, Human
gugggaagaaaaauagcuga

SEQ ID NO: 33657 - RNA, 20 nt, Human
ccagccuggccuguggcugc

SEQ ID NO: 33658 - RNA, 21 nt, Human
ugacaucgagggauggcauua

SEQ ID NO: 33659 - RNA, 21 nt, Human
guuaggauggcuggagaguag

SEQ ID NO: 33660 - RNA, 22 nt, Human
ccggguggcugggauugcaggc

SEQ ID NO: 33661 - RNA, 26 nt, Human
gcggcagcuccagcccggcccggcag

SEQ ID NO: 33662 - RNA, 22 nt, Human
aauauauauacauacauacaca

SEQ ID NO: 33663 - RNA, 21 nt, Human
cuucuggguuuucuuuuugac

SEQ ID NO: 33664 - RNA, 23 nt, Human
gcguuagggccgccgcugccucc

SEQ ID NO: 33665 - RNA, 21 nt, Human
gguucuuguuagugcacagca

SEQ ID NO: 33666 - RNA, 20 nt, Human
acauuuucucccuuaggaau

SEQ ID NO: 33667 - RNA, 19 nt, Human
gugacuguuguagcauuuu

SEQ ID NO: 33668 - RNA, 18 nt, Human
aggagugccuggccaggu

SEQ ID NO: 33669 - RNA, 19 nt, Human
ugugguggucaucuccggc

SEQ ID NO: 33670 - RNA, 23 nt, Human
gucaucuguguguuuuuaaggcc

SEQ ID NO: 33671 - RNA, 19 nt, Human
gaugggccuggcugcacag

SEQ ID NO: 33672 - RNA, 20 nt, Human
ggucuugacaccagcuguuc

SEQ ID NO: 33673 - RNA, 25 nt, Human
acucggcaucucugugaaagcaaca

SEQ ID NO: 33674 - RNA, 23 nt, Human
aggaggagagggaggcugcagac

SEQ ID NO: 33675 - RNA, 22 nt, Human
aagauguuucuccuaucuccuu

SEQ ID NO: 33676 - RNA, 20 nt, Human
gaaccuauagcaucuucuca

SEQ ID NO: 33677 - RNA, 24 nt, Human
cuggagugcaguggcaucaucuca

SEQ ID NO: 33678 - RNA, 18 nt, Human
ccgaccaccuccuccucu

SEQ ID NO: 33679 - RNA, 17 nt, Human
gcaccucccugcaguca

SEQ ID NO: 33680 - RNA, 22 nt, Human
cacugcacuccggccugggcga

SEQ ID NO: 33681 - RNA, 22 nt, Human
gccuccugcagccaucaugucc

SEQ ID NO: 33682 - RNA, 23 nt, Human
gaagucagggaagaucggaauuc

SEQ ID NO: 33683 - RNA, 27 nt, Human
gccuuucugacauuuccuugggaaucu

SEQ ID NO: 33684 - RNA, 24 nt, Human
guaauuaaccuuucuuuacauuuc

SEQ ID NO: 33685 - RNA, 25 nt, Human
cugucccccaggcuggagugcagug

SEQ ID NO: 33686 - RNA, 20 nt, Human
ccuuuugguaaccguauuga

SEQ ID NO: 33687 - RNA, 19 nt, Human
gaagcacaagucucagggg

SEQ ID NO: 33688 - RNA, 24 nt, Human
aucaaauuuuuaaagcaacuuggg

SEQ ID NO: 33689 - RNA, 23 nt, Human
cccaugccuccugcacacagccg

SEQ ID NO: 33690 - RNA, 22 nt, Human
cuucugcuuuucugcccuggcu

SEQ ID NO: 33691 - RNA, 22 nt, Human
cugcacccugccccauccugcc

SEQ ID NO: 33692 - RNA, 24 nt, Human
ugcggcuccaggugggcucacgcg

SEQ ID NO: 33693 - RNA, 25 nt, Human
uaggaauaguauaaaaaaucccugu

SEQ ID NO: 33694 - RNA, 27 nt, Human
gaccagccugggcaacauaccaagacc

SEQ ID NO: 33695 - RNA, 17 nt, Human
cuuacccuaccucugcc

SEQ ID NO: 33696 - RNA, 20 nt, Human
aaauccacagaccaaccugg

SEQ ID NO: 33697 - RNA, 20 nt, Human
ucccagacugugacucugau

SEQ ID NO: 33698 - RNA, 20 nt, Human
cucugucucaguuuucacug

SEQ ID NO: 33699 - RNA, 25 nt, Human
guccuaggaagacuuuucuuuuccu

SEQ ID NO: 33700 - RNA, 22 nt, Human
ugcugcaauauuucaguguugu

SEQ ID NO: 33701 - RNA, 21 nt, Human
ucagcccacagagcuaauaau

SEQ ID NO: 33702 - RNA, 25 nt, Human
ccuaauauuuaaaauuuacacuucu

SEQ ID NO: 33703 - RNA, 22 nt, Human
ucuccaauccacacauauuguu

SEQ ID NO: 33704 - RNA, 20 nt, Human
gcagucccuccaucugguau

SEQ ID NO: 33705 - RNA, 22 nt, Human
gugaucugcuggcccucaggcu

SEQ ID NO: 33706 - RNA, 21 nt, Human
ugacuuaauuguuaaacccca

SEQ ID NO: 33707 - RNA, 18 nt, Human
gggaugagguugcuguga

SEQ ID NO: 33708 - RNA, 23 nt, Human
gccuguaaucccagcuacaccug

SEQ ID NO: 33709 - RNA, 27 nt, Human
accagccuggccaagagaccagccugg

SEQ ID NO: 33710 - RNA, 24 nt, Human
ugcauccauuuacugacacuuccu

SEQ ID NO: 33711 - RNA, 25 nt, Human
agagacacauacagagugggccccg

SEQ ID NO: 33712 - RNA, 19 nt, Human
ugggacuccagucgggaua

SEQ ID NO: 33713 - RNA, 22 nt, Human
ggucccggguuagccuggugac

SEQ ID NO: 33714 - RNA, 28 nt, Human
agcagaguuuggcaggcaggugccagga

SEQ ID NO: 33715 - RNA, 18 nt, Human
ucuuuuucuuuaccucca

SEQ ID NO: 33716 - RNA, 27 nt, Human
ucgacagcuguggcuuccuuguuuuug

SEQ ID NO: 33717 - RNA, 27 nt, Human
ccaugaucccuaagaagacagcuugaa

SEQ ID NO: 33718 - RNA, 21 nt, Human
uauaaugacacaaagcauugg

SEQ ID NO: 33719 - RNA, 17 nt, Human
ccugaggaggcggcggc

SEQ ID NO: 33720 - RNA, 21 nt, Human
augccuggcuuggugucuggc

SEQ ID NO: 33721 - RNA, 26 nt, Human
uuccugggcacaggcucuugggugca

SEQ ID NO: 33722 - RNA, 22 nt, Human
uccaugaaaauauuuuaugaua

SEQ ID NO: 33723 - RNA, 21 nt, Human
uaguuucuucaaaacccuauc

SEQ ID NO: 33724 - RNA, 24 nt, Human
ccaucucauucaucaugugacugu

SEQ ID NO: 33725 - RNA, 22 nt, Human
ccgggagguacagcuggcagag

SEQ ID NO: 33726 - RNA, 21 nt, Human
cugcccaggcuggagcauagu

SEQ ID NO: 33727 - RNA, 21 nt, Human
uuuguucuuauucuuuuucuc

SEQ ID NO: 33728 - RNA, 27 nt, Human
aaaaggagaagaggaacauccguugaa

SEQ ID NO: 33729 - RNA, 22 nt, Human
guagcacauuaaagugauuuua

SEQ ID NO: 33730 - RNA, 24 nt, Human
aagucuuuacuggcuuucauagcu

SEQ ID NO: 33731 - RNA, 27 nt, Human
cucagcaggacaggccccgggcacugc

SEQ ID NO: 33732 - RNA, 27 nt, Human
gggcugacagagcaagacacugucuca

SEQ ID NO: 33733 - RNA, 27 nt, Human
cacugcaccuaguaggcacucaaauau

SEQ ID NO: 33734 - RNA, 24 nt, Human
auacugaagaacuagagugucacu

SEQ ID NO: 33735 - RNA, 26 nt, Human
ggucucaaagauaacugcauccuuca

SEQ ID NO: 33736 - RNA, 20 nt, Human
cccaucaaaucacagugccc

SEQ ID NO: 33737 - RNA, 19 nt, Human
agugcucccuuccuccuca

SEQ ID NO: 33738 - RNA, 23 nt, Human
cugggagccggaggcugcaguga

SEQ ID NO: 33739 - RNA, 22 nt, Human
uagucucaaacugucccccuua

SEQ ID NO: 33740 - RNA, 23 nt, Human
uggggacugccaagccacccuaa

SEQ ID NO: 33741 - RNA, 25 nt, Human
cacugcacuuuggaccccuggggcc

SEQ ID NO: 33742 - RNA, 21 nt, Human
caggcagcccgggcacaguga

SEQ ID NO: 33743 - RNA, 26 nt, Human
caguguccuaggaccuuuucccaaua

SEQ ID NO: 33744 - RNA, 26 nt, Human
uuccucccgaccccaggaccaggcua

SEQ ID NO: 33745 - RNA, 21 nt, Human
ugccgccgccaccacagccac

SEQ ID NO: 33746 - RNA, 20 nt, Human
ucccugucauuguucugccu

SEQ ID NO: 33747 - RNA, 27 nt, Human
cuucccaacaugccuccugcccugcua

SEQ ID NO: 33748 - RNA, 24 nt, Human
ccugccuggcacaugccugccagc

SEQ ID NO: 33749 - RNA, 26 nt, Human
ccuccccauuuggcccugggcucagg

SEQ ID NO: 33750 - RNA, 24 nt, Human
cagguguauaaauguacauuucca

SEQ ID NO: 33751 - RNA, 27 nt, Human
ggagaauugguugaguagccaaggaag

SEQ ID NO: 33752 - RNA, 21 nt, Human
gcauuuuuuagaagcauuuua

SEQ ID NO: 33753 - RNA, 27 nt, Human
auacagaguacguuaaaagcaaaaaga

SEQ ID NO: 33754 - RNA, 21 nt, Human
uugcccaggcuggagugcaac

SEQ ID NO: 33755 - RNA, 18 nt, Human
accagucuucuguuuugu

SEQ ID NO: 33756 - RNA, 26 nt, Human
cagcuucuuaguucaaaaagaauucu

SEQ ID NO: 33757 - RNA, 24 nt, Human
ucuucccagagggccggcuggaac

SEQ ID NO: 33758 - RNA, 26 nt, Human
cacacccugcucugggcacugggaau

SEQ ID NO: 33759 - RNA, 27 nt, Human
gggagagaggaacaaaggaccgugaaa

SEQ ID NO: 33760 - RNA, 23 nt, Human
acuacauuuuguccccuccuggg

SEQ ID NO: 33761 - RNA, 23 nt, Human
gccaguccaggcugccguggggc

SEQ ID NO: 33762 - RNA, 23 nt, Human
caaaaguaauuggcagugauugg

SEQ ID NO: 33763 - RNA, 27 nt, Human
ccuaugucucuguccccaaaauagcug

SEQ ID NO: 33764 - RNA, 26 nt, Human
uugcccagaguugggggcuaggggag

SEQ ID NO: 33765 - RNA, 26 nt, Human
ucuggcaacagagcaagacuccaucu

SEQ ID NO: 33766 - RNA, 22 nt, Human
ggagucugaggaccuuuauggg

SEQ ID NO: 33767 - RNA, 19 nt, Human
ggagcccugcugcccacau

SEQ ID NO: 33768 - RNA, 23 nt, Human
gcuucauguggcauucucucugc

SEQ ID NO: 33769 - RNA, 22 nt, Human
uucucucgaacaaaacagcaaa

SEQ ID NO: 33770 - RNA, 19 nt, Human
ccuuccuccucaacuccca

SEQ ID NO: 33771 - RNA, 27 nt, Human
cuaccugcauuaucucauucuggcuuc

SEQ ID NO: 33772 - RNA, 22 nt, Human
cccugcuccaggcucuaggacu

SEQ ID NO: 33773 - RNA, 23 nt, Human
cuuacacucuuuaagccauucca

SEQ ID NO: 33774 - RNA, 22 nt, Human
auaacuugccauuucuuuauau

SEQ ID NO: 33775 - RNA, 23 nt, Human
uggagccaauccacuccuuccuu

SEQ ID NO: 33776 - RNA, 26 nt, Human
uuccagaugguuccuacuuaaaugau

SEQ ID NO: 33777 - RNA, 25 nt, Human
ggaaaggggagaggguuuuucucac

SEQ ID NO: 33778 - RNA, 23 nt, Human
cacaccacuccagaaccugacaa

SEQ ID NO: 33779 - RNA, 23 nt, Human
ggggccaccugccacugccagcu

SEQ ID NO: 33780 - RNA, 20 nt, Human
cagcguucauguucugugau

SEQ ID NO: 33781 - RNA, 23 nt, Human
ccacuucuccaguauagucaguu

SEQ ID NO: 33782 - RNA, 23 nt, Human
acccacagcccuccccagcugcc

SEQ ID NO: 33783 - RNA, 20 nt, Human
caucugucuauauuuuauuu

SEQ ID NO: 33784 - RNA, 18 nt, Human
acagggcugcaacaccac

SEQ ID NO: 33785 - RNA, 18 nt, Human
ucaagauuccacucugug

SEQ ID NO: 33786 - RNA, 22 nt, Human
ucgacgucucucucaccaggau

SEQ ID NO: 33787 - RNA, 19 nt, Human
cuucugcucucauccugca

SEQ ID NO: 33788 - RNA, 20 nt, Human
ugagccacagcagcauuuuu

SEQ ID NO: 33789 - RNA, 25 nt, Human
cauggugaccacagccagcuggaac

SEQ ID NO: 33790 - RNA, 23 nt, Human
aacuugugcccucccuguccuua

SEQ ID NO: 33791 - RNA, 29 nt, Human
cagucccuauccuagagggguugagcuuu

SEQ ID NO: 33792 - RNA, 21 nt, Human
gaccacccaggcuugaggcag

SEQ ID NO: 33793 - RNA, 21 nt, Human
uaucacuuuuccuccaggguu

SEQ ID NO: 33794 - RNA, 18 nt, Human
cuccagcaugcacaugcc

SEQ ID NO: 33795 - RNA, 20 nt, Human
uucaguugaccuaauucauu

SEQ ID NO: 33796 - RNA, 27 nt, Human
gcuuucaucuucuguugcucucugugu

SEQ ID NO: 33797 - RNA, 23 nt, Human
cccugcucugcuggagaggaacc

SEQ ID NO: 33798 - RNA, 23 nt, Human
cugaaaacuuuaccaucuagagu

SEQ ID NO: 33799 - RNA, 21 nt, Human
ggggagggggacuuguuuuuc

SEQ ID NO: 33800 - RNA, 26 nt, Human
ucauucuucuccgguagccucuccca

SEQ ID NO: 33801 - RNA, 29 nt, Human
acucuucugugaagaaaucauacacuugg

SEQ ID NO: 33802 - RNA, 20 nt, Human
gggaagagauucagccagca

SEQ ID NO: 33803 - RNA, 24 nt, Human
gucugggaaaaagugcacgugaag

SEQ ID NO: 33804 - RNA, 23 nt, Human
aucacaccacuguacuccagccu

SEQ ID NO: 33805 - RNA, 27 nt, Human
cuuucucagccucucucgugcuuuucu

SEQ ID NO: 33806 - RNA, 25 nt, Human
cuccagucuccuuuccuaggcuuuu

SEQ ID NO: 33807 - RNA, 19 nt, Human
ugccaggaaaauacaccaa

SEQ ID NO: 33808 - RNA, 20 nt, Human
cuauuugaaagucucagggg

SEQ ID NO: 33809 - RNA, 26 nt, Human
acuucuggccaggucucugccauggu

SEQ ID NO: 33810 - RNA, 22 nt, Human
gcuuaugccuguaaucccagca

SEQ ID NO: 33811 - RNA, 23 nt, Human
caggccuccucaaccuucaccuc

SEQ ID NO: 33812 - RNA, 20 nt, Human
cugaccuuuuaaaggccacu

SEQ ID NO: 33813 - RNA, 23 nt, Human
guacuggccuucucuaucuaaga

SEQ ID NO: 33814 - RNA, 21 nt, Human
aucuguaaccccagcacuuug

SEQ ID NO: 33815 - RNA, 26 nt, Human
cuagagguggaggaggcaguccuggg

SEQ ID NO: 33816 - RNA, 22 nt, Human
gccugcuuacacccugcccuca

SEQ ID NO: 33817 - RNA, 21 nt, Human
auugucuaaauccauucucaa

SEQ ID NO: 33818 - RNA, 27 nt, Human
ucuucauccacuuggagugcugcgggg

SEQ ID NO: 33819 - RNA, 25 nt, Human
uucaguuauagagguaaaauuugca

SEQ ID NO: 33820 - RNA, 25 nt, Human
ccaggaggcccucgagguugcucug

SEQ ID NO: 33821 - RNA, 25 nt, Human
cucacccuagcagcccugcccagac

SEQ ID NO: 33822 - RNA, 26 nt, Human
acucccuccagccucagcuggcugaa

SEQ ID NO: 33823 - RNA, 18 nt, Human
ccuucccucucaccaucc

SEQ ID NO: 33824 - RNA, 26 nt, Human
guaggcacagggcucccaggccaggc

SEQ ID NO: 33825 - RNA, 22 nt, Human
caggacucuggcuucucuccuc

SEQ ID NO: 33826 - RNA, 29 nt, Human
ggucaauacugccuuaaugagaacauuua

SEQ ID NO: 33827 - RNA, 27 nt, Human
ugccccugugugguuggucaaggaggg

SEQ ID NO: 33828 - RNA, 27 nt, Human
gcuccugccgccccucuugccccucag

SEQ ID NO: 33829 - RNA, 21 nt, Human
accagauaaauagaacuaucu

SEQ ID NO: 33830 - RNA, 21 nt, Human
uggaaaggauagccauuagca

SEQ ID NO: 33831 - RNA, 24 nt, Human
agagugagacccugucucaaaagc

SEQ ID NO: 33832 - RNA, 22 nt, Human
cuguccugcacaaccucccuca

SEQ ID NO: 33833 - RNA, 21 nt, Human
gguucacugcaaccucugccu

SEQ ID NO: 33834 - RNA, 22 nt, Human
ccuggcagcgcugcacuugcca

SEQ ID NO: 33835 - RNA, 22 nt, Human
gcucacugcauccucugccucc

SEQ ID NO: 33836 - RNA, 16 nt, Human
aguuccuuaccugccc

SEQ ID NO: 33837 - RNA, 22 nt, Human
cagaauuacugagauuucucag

SEQ ID NO: 33838 - RNA, 27 nt, Human
gccaggcgcugauguaagcacuuuagg

SEQ ID NO: 33839 - RNA, 20 nt, Human
caguauucucugcuacuucu

SEQ ID NO: 33840 - RNA, 32 nt, Human
ccaggucucaucuuccaccccaaaaaugucug

SEQ ID NO: 33841 - RNA, 19 nt, Human
gaagcucucacacgcacag

SEQ ID NO: 33842 - RNA, 23 nt, Human
cccaggaggucgaggcugcagug

SEQ ID NO: 33843 - RNA, 21 nt, Human
cgcacccagcccagagaagag

SEQ ID NO: 33844 - RNA, 22 nt, Human
gcccagugcugcuguaaauaca

SEQ ID NO: 33845 - RNA, 18 nt, Human
gcuacuugaauagcaaua

SEQ ID NO: 33846 - RNA, 23 nt, Human
cauuccugccugguccagugggg

SEQ ID NO: 33847 - RNA, 21 nt, Human
cccuguccugccucagugccu

SEQ ID NO: 33848 - RNA, 20 nt, Human
uccaucuccagggucucauu

SEQ ID NO: 33849 - RNA, 22 nt, Human
auugcuugaacccaugaggugg

SEQ ID NO: 33850 - RNA, 22 nt, Human
auugcuggaacccaggaggugg

SEQ ID NO: 33851 - RNA, 21 nt, Human
uucucucucauuauucccucg

SEQ ID NO: 33852 - RNA, 21 nt, Human
gaacccagggguggggggugg

SEQ ID NO: 33853 - RNA, 14 nt, Human
agaacucaaacuuc

SEQ ID NO: 33854 - RNA, 28 nt, Human
uccauauucaagaccuuuuuauuuguuu

SEQ ID NO: 33855 - RNA, 26 nt, Human
uuuggcuucuguuugcuucaaaauau

SEQ ID NO: 33856 - RNA, 22 nt, Human
ugcuggcaggugggcuugcccu

SEQ ID NO: 33857 - RNA, 24 nt, Human
cguccugggugucugggcugcuaa

SEQ ID NO: 33858 - RNA, 22 nt, Human
gucuugcucauucuucaugaca

SEQ ID NO: 33859 - RNA, 18 nt, Human
uaaaaucaguaaugugau

SEQ ID NO: 33860 - RNA, 23 nt, Human
uaccucuaccagcgcacugaugg

SEQ ID NO: 33861 - RNA, 22 nt, Human
aaauucuucuuuuguaugucca

SEQ ID NO: 33862 - RNA, 27 nt, Human
guggguggaucaccugagguccggagu

SEQ ID NO: 33863 - RNA, 24 nt, Human
caacucaaugccuuuucagcugca

SEQ ID NO: 33864 - RNA, 21 nt, Human
gcuuuaaucccagcacuuugg

SEQ ID NO: 33865 - RNA, 21 nt, Human
cacaccccacagcugccaccg

SEQ ID NO: 33866 - RNA, 29 nt, Human
ccugccugccugccugagguccccgcugc

SEQ ID NO: 33867 - RNA, 21 nt, Human
ugaaaccaagcuuugauuuag

SEQ ID NO: 33868 - RNA, 26 nt, Human
uucuguugagaacauccauucauucu

SEQ ID NO: 33869 - RNA, 22 nt, Human
caggcuggagugcaguggugag

SEQ ID NO: 33870 - RNA, 19 nt, Human
ucugggugggaguggggag

SEQ ID NO: 33871 - RNA, 23 nt, Human
auuccaucaccuuccuccucugc

SEQ ID NO: 33872 - RNA, 21 nt, Human
uccucauauccaaggcuacuu

SEQ ID NO: 33873 - RNA, 22 nt, Human
ccuccauguguuucucaguuuc

SEQ ID NO: 33874 - RNA, 21 nt, Human
ccuccacuggggaagugcucc

SEQ ID NO: 33875 - RNA, 19 nt, Human
ggaacuggaguugugcaca

SEQ ID NO: 33876 - RNA, 26 nt, Human
guuacugccuguguauaguauaaaua

SEQ ID NO: 33877 - RNA, 24 nt, Human
gcggaggcgggugccuggcagacc

SEQ ID NO: 33878 - RNA, 22 nt, Human
cacggccuccgaagcugcgugu

SEQ ID NO: 33879 - RNA, 22 nt, Human
gccucucuugccccuuguccug

SEQ ID NO: 33880 - RNA, 22 nt, Human
cagcguucggggcagggccacu

SEQ ID NO: 33881 - RNA, 23 nt, Human
cagggaggagggaauuauuagca

SEQ ID NO: 33882 - RNA, 25 nt, Human
uccaggaaagagcagucagagucca

SEQ ID NO: 33883 - RNA, 19 nt, Human
gcuggcugccccuggugca

SEQ ID NO: 33884 - RNA, 22 nt, Human
cucugguggccacuucauucca

SEQ ID NO: 33885 - RNA, 24 nt, Human
uggugugagagggacggcucacag

SEQ ID NO: 33886 - RNA, 22 nt, Human
ccagccggccacugugugucau

SEQ ID NO: 33887 - RNA, 27 nt, Human
ccaggugcagagguacccugggugucc

SEQ ID NO: 33888 - RNA, 24 nt, Human
aguuuucucacgugguuucuagcu

SEQ ID NO: 33889 - RNA, 27 nt, Human
gcuauguuagaaguccaggcagagaca

SEQ ID NO: 33890 - RNA, 23 nt, Human
caggaacacuagagaccaaaaag

SEQ ID NO: 33891 - RNA, 23 nt, Human
ccacgucaaacuucucucccuca

SEQ ID NO: 33892 - RNA, 20 nt, Human
aacacaaaacaaaacuugca

SEQ ID NO: 33893 - RNA, 27 nt, Human
caggcagcaaggucauggucugagugg

SEQ ID NO: 33894 - RNA, 23 nt, Human
acagagagugaauacacuggaau

SEQ ID NO: 33895 - RNA, 19 nt, Human
aggcagcagaauugcuuga

SEQ ID NO: 33896 - RNA, 25 nt, Human
agaggagacugggaggcagcaagag

SEQ ID NO: 33897 - RNA, 26 nt, Human
guggguggccugugggugugccgggg

SEQ ID NO: 33898 - RNA, 19 nt, Human
ugccuucaguggagcuaga

SEQ ID NO: 33899 - RNA, 21 nt, Human
guugucuaggagacagagcca

SEQ ID NO: 33900 - RNA, 23 nt, Human
aucacaccacuguacuccagccc

SEQ ID NO: 33901 - RNA, 27 nt, Human
ccacugcacaccagccugggcaacaca

SEQ ID NO: 33902 - RNA, 23 nt, Human
gucaaccaggcuagaaugcagcg

SEQ ID NO: 33903 - RNA, 19 nt, Human
uagccuaucuauugcucuu

SEQ ID NO: 33904 - RNA, 22 nt, Human
ucgcucaggcuggagugcagug

SEQ ID NO: 33905 - RNA, 23 nt, Human
aauaagaaugguugccuuaaaga

SEQ ID NO: 33906 - RNA, 25 nt, Human
acaauuugcuccaaauauuuuguuu

SEQ ID NO: 33907 - RNA, 25 nt, Human
uguuuucaaaauacuucuuuuucau

SEQ ID NO: 33908 - RNA, 25 nt, Human
ugcuggcauccugaguccuggcccu

SEQ ID NO: 33909 - RNA, 27 nt, Human
gccuuucuccucuucucuucuugggac

SEQ ID NO: 33910 - RNA, 24 nt, Human
gcagguuuugagcugcagagaccc

SEQ ID NO: 33911 - RNA, 22 nt, Human
caggacaggccaucugcaguga

SEQ ID NO: 33912 - RNA, 22 nt, Human
ggccuaggaggguccucugaga

SEQ ID NO: 33913 - RNA, 27 nt, Human
ggccuccuaugggugucuuacgucugu

SEQ ID NO: 33914 - RNA, 26 nt, Human
cugccucuuuguugccaugagagcug

SEQ ID NO: 33915 - RNA, 29 nt, Human
cccaucggcauggcucaagaguuugugaa

SEQ ID NO: 33916 - RNA, 24 nt, Human
ggagagguagguggauccagggaa

SEQ ID NO: 33917 - RNA, 26 nt, Human
ucaguauuucuacaauugcagcuaag

SEQ ID NO: 33918 - RNA, 22 nt, Human
caugccuguaaucccaucaucu

SEQ ID NO: 33919 - RNA, 21 nt, Human
ucgaggcagcuucccuuugcc

SEQ ID NO: 33920 - RNA, 26 nt, Human
ugcuuucuuuugucuuuaaaaccuga

SEQ ID NO: 33921 - RNA, 22 nt, Human
augucuggggccacaguugcug

SEQ ID NO: 33922 - RNA, 19 nt, Human
gguuuggggagaaauaaau

SEQ ID NO: 33923 - RNA, 20 nt, Human
aacuuuucaaaaaugaaugu

SEQ ID NO: 33924 - RNA, 26 nt, Human
gugggugggacaggaguguguucaag

SEQ ID NO: 33925 - RNA, 27 nt, Human
uuagaaaacauguuccccaucuggugc

SEQ ID NO: 33926 - RNA, 21 nt, Human
ggguccucugacuuccucaug

SEQ ID NO: 33927 - RNA, 17 nt, Human
acuuucucauaagcacc

SEQ ID NO: 33928 - RNA, 27 nt, Human
uugagguggugcaugcaaguaacuagg

SEQ ID NO: 33929 - RNA, 22 nt, Human
gucuuaauucaacacaggaucg

SEQ ID NO: 33930 - RNA, 23 nt, Human
aaucagcucaacucaagauuuca

SEQ ID NO: 33931 - RNA, 23 nt, Human
cugucaugacaagccucugugau

SEQ ID NO: 33932 - RNA, 26 nt, Human
ugcugagcucuggcugucaguguguu

SEQ ID NO: 33933 - RNA, 20 nt, Human
gcuccuccuccuuucccagc

SEQ ID NO: 33934 - RNA, 21 nt, Human
cacuccuaauucucaaguacu

SEQ ID NO: 33935 - RNA, 22 nt, Human
cagacggccuagugugccaaga

SEQ ID NO: 33936 - RNA, 20 nt, Human
cccucccacuggagugcggg

SEQ ID NO: 33937 - RNA, 21 nt, Human
uggaauagauucucagaguga

SEQ ID NO: 33938 - RNA, 24 nt, Human
ccaacucgccgucagaccccaccu

SEQ ID NO: 33939 - RNA, 22 nt, Human
gaggcucuuccuccuccucccg

SEQ ID NO: 33940 - RNA, 22 nt, Human
gaacccaggaggcggagguuac

SEQ ID NO: 33941 - RNA, 21 nt, Human
ccuguacuccagccuggguga

SEQ ID NO: 33942 - RNA, 22 nt, Human
cccccuccccugccugcucugc

SEQ ID NO: 33943 - RNA, 22 nt, Human
ucagucuccuagcaucuuguga

SEQ ID NO: 33944 - RNA, 28 nt, Human
ucuagaucuugacucccugccguaacua

SEQ ID NO: 33945 - RNA, 21 nt, Human
cacacauauauauaacaaaua

SEQ ID NO: 33946 - RNA, 27 nt, Human
uggaaacaucuguggacucuguuagau

SEQ ID NO: 33947 - RNA, 27 nt, Human
gagguuaguacauuauuauugagcucu

SEQ ID NO: 33948 - RNA, 20 nt, Human
cagacaccucccccuaccca

SEQ ID NO: 33949 - RNA, 21 nt, Human
caggccaggugcaguggcuca

SEQ ID NO: 33950 - RNA, 22 nt, Human
cauugcauuccagccugggcaa

SEQ ID NO: 33951 - RNA, 17 nt, Human
ucuccucuggaaaugcc

SEQ ID NO: 33952 - RNA, 29 nt, Human
cugccugagcucugggccuuagcuccucc

SEQ ID NO: 33953 - RNA, 22 nt, Human
ggguggccagaagucccugcgg

SEQ ID NO: 33954 - RNA, 26 nt, Human
agcuuuguucucuugcucuacacaau

SEQ ID NO: 33955 - RNA, 22 nt, Human
cccuugccccuaccaaugcccc

SEQ ID NO: 33956 - RNA, 27 nt, Human
cuucccaaauuuuccccccucgcuaga

SEQ ID NO: 33957 - RNA, 29 nt, Human
gagaauuuagacucugucuucagccaggc

SEQ ID NO: 33958 - RNA, 21 nt, Human
ugcugaugaucccaaagauug

SEQ ID NO: 33959 - RNA, 18 nt, Human
gcagccgccgccgccggg

SEQ ID NO: 33960 - RNA, 22 nt, Human
cugaggcaggaggaucacuuua

SEQ ID NO: 33961 - RNA, 20 nt, Human
cccccuucccgccgcgcucu

SEQ ID NO: 33962 - RNA, 22 nt, Human
agccugagaaauaauuaaauau

SEQ ID NO: 33963 - RNA, 28 nt, Human
gaaugcuggcaaaggcuggcuguguaua

SEQ ID NO: 33964 - RNA, 22 nt, Human
acgccaacaugcagcgaaguau

SEQ ID NO: 33965 - RNA, 21 nt, Human
ucccccagccccacugagcuc

SEQ ID NO: 33966 - RNA, 23 nt, Human
aaaugcacaaguuauaaauacag

SEQ ID NO: 33967 - RNA, 27 nt, Human
gaggaagaguacaaauagaccuaaauu

SEQ ID NO: 33968 - RNA, 25 nt, Human
cuccaaagaaauagggcauggcuug

SEQ ID NO: 33969 - RNA, 19 nt, Human
cucuuagaauucccauuua

SEQ ID NO: 33970 - RNA, 22 nt, Human
uggcuucaggagggagcauaga

SEQ ID NO: 33971 - RNA, 21 nt, Human
cugccuuuuaaacccaucccc

SEQ ID NO: 33972 - RNA, 22 nt, Human
accauccuggccaacauuguaa

SEQ ID NO: 33973 - RNA, 22 nt, Human
cccaucauucuccacccagcug

SEQ ID NO: 33974 - RNA, 26 nt, Human
gcagggacucuuuccuuacugggccc

SEQ ID NO: 33975 - RNA, 21 nt, Human
ugagagccaggaauccugcgg

SEQ ID NO: 33976 - RNA, 19 nt, Human
cucuguucugccucuuauc

SEQ ID NO: 33977 - RNA, 32 nt, Human
gggcagcccugugaagccagaggagauggacu

SEQ ID NO: 33978 - RNA, 27 nt, Human
uguguucaugcaacagccauagagaug

SEQ ID NO: 33979 - RNA, 22 nt, Human
acgcuaagcuccagucggcgcc

SEQ ID NO: 33980 - RNA, 26 nt, Human
aaagaauugcugcuacuuugugcaag

SEQ ID NO: 33981 - RNA, 27 nt, Human
cagccuauuguaggagggggauguggc

SEQ ID NO: 33982 - RNA, 22 nt, Human
gcagugcugggcaggugacuuc

SEQ ID NO: 33983 - RNA, 22 nt, Human
uuuaaggccacaccuuuuugaa

SEQ ID NO: 33984 - RNA, 24 nt, Human
gcagccgccgccaccgcugcccag

SEQ ID NO: 33985 - RNA, 22 nt, Human
gaguuucuuguugcuuuacaau

SEQ ID NO: 33986 - RNA, 20 nt, Human
cacuugaggcuggaggcaug

SEQ ID NO: 33987 - RNA, 23 nt, Human
gaggaaacuaaacucuguggaag

SEQ ID NO: 33988 - RNA, 21 nt, Human
acuccuauugagacagcugca

SEQ ID NO: 33989 - RNA, 23 nt, Human
ugggacccaccucaggucccagc

SEQ ID NO: 33990 - RNA, 21 nt, Human
gugugccccuuugcguccugu

SEQ ID NO: 33991 - RNA, 23 nt, Human
auacauacuugguaaacauuuau

SEQ ID NO: 33992 - RNA, 21 nt, Human
aggacaccuucaaccgggcca

SEQ ID NO: 33993 - RNA, 24 nt, Human
augaaaguuauccaggcgcagagu

SEQ ID NO: 33994 - RNA, 23 nt, Human
agugcaaugauacaacaaaaaga

SEQ ID NO: 33995 - RNA, 32 nt, Human
agccaguugggugugcgcagagcugucauagg

SEQ ID NO: 33996 - RNA, 22 nt, Human
ggagcagcugcuccauugugcc

SEQ ID NO: 33997 - RNA, 26 nt, Human
ucacccagacuuuaccgcggaggcgg

SEQ ID NO: 33998 - RNA, 21 nt, Human
cuaacauccugcuuugauucc

SEQ ID NO: 33999 - RNA, 24 nt, Human
ggacaaagcuacugaaacuccucc

SEQ ID NO: 34000 - RNA, 23 nt, Human
ccuuucucagccucucucgugcu

SEQ ID NO: 34001 - RNA, 29 nt, Human
gcaagccugggaacucaggaaaauucaca

SEQ ID NO: 34002 - RNA, 27 nt, Human
gcacagccaccugccagacccguggcu

SEQ ID NO: 34003 - RNA, 28 nt, Human
ucuucaugggcauguuccugcuggggcg

SEQ ID NO: 34004 - RNA, 27 nt, Human
ccagcuccuuucuccugugaauggagg

SEQ ID NO: 34005 - RNA, 27 nt, Human
cccuucacuucugccugcacagcuuac

SEQ ID NO: 34006 - RNA, 22 nt, Human
gcucacgccugcaaucccagca

SEQ ID NO: 34007 - RNA, 29 nt, Human
gggaaguguuuacacauggagagaugccc

SEQ ID NO: 34008 - RNA, 27 nt, Human
uuuaccucccgccucccuugcuggucc

SEQ ID NO: 34009 - RNA, 25 nt, Human
aauccaaggaaacaugcagcucuuc

SEQ ID NO: 34010 - RNA, 22 nt, Human
ucacauguguggguccaacacu

SEQ ID NO: 34011 - RNA, 20 nt, Human
ugauuccuuuuucuaaucca

SEQ ID NO: 34012 - RNA, 22 nt, Human
cggggagggggcgccgagcggc

SEQ ID NO: 34013 - RNA, 21 nt, Human
ugaaggaggaagacaccuuga

SEQ ID NO: 34014 - RNA, 20 nt, Human
ggggugagcaggcaggcucc

SEQ ID NO: 34015 - RNA, 21 nt, Human
aggccucacuacaggccuggu

SEQ ID NO: 34016 - RNA, 24 nt, Human
gagggggagagcaggcagcgggcg

SEQ ID NO: 34017 - RNA, 22 nt, Human
agcagcugugagugaggggaca

SEQ ID NO: 34018 - RNA, 28 nt, Human
gaucauuugggcaaauuuuacguaaaga

SEQ ID NO: 34019 - RNA, 23 nt, Human
acaccccagcccuuucucccuca

SEQ ID NO: 34020 - RNA, 26 nt, Human
ggagagaagaaugagccuacgcugaa

SEQ ID NO: 34021 - RNA, 22 nt, Human
uuccccagccagucuuguucuc

SEQ ID NO: 34022 - RNA, 22 nt, Human
guccaggcagagacaauaaaac

SEQ ID NO: 34023 - RNA, 24 nt, Human
ggauacuugaaguuuaaugcucag

SEQ ID NO: 34024 - RNA, 23 nt, Human
gcugagucuggaggagacggagg

SEQ ID NO: 34025 - RNA, 27 nt, Human
ccagcuguuggcuacaugaguauuuag

SEQ ID NO: 34026 - RNA, 22 nt, Human
agcagcccucugccuccucccc

SEQ ID NO: 34027 - RNA, 19 nt, Human
gggggugggaauggggugg

SEQ ID NO: 34028 - RNA, 24 nt, Human
ucagcaauagagugagacugucuc

SEQ ID NO: 34029 - RNA, 22 nt, Human
uucuuagcuuuuuaauuguugu

SEQ ID NO: 34030 - RNA, 20 nt, Human
uuccauuguauuuucuugaa

SEQ ID NO: 34031 - RNA, 22 nt, Human
aucggugacugguuaucacacc

SEQ ID NO: 34032 - RNA, 26 nt, Human
agaacuuagggucagggucucaggga

SEQ ID NO: 34033 - RNA, 24 nt, Human
uccauguagauaagagcaagugua

SEQ ID NO: 34034 - RNA, 24 nt, Human
cauaugguguggugaaaacucacu

SEQ ID NO: 34035 - RNA, 22 nt, Human
uucagaggcucaucuaacucug

SEQ ID NO: 34036 - RNA, 19 nt, Human
ccugcagcagucccgugcc

SEQ ID NO: 34037 - RNA, 25 nt, Human
cgcgucaggcccagcgcacagccug

SEQ ID NO: 34038 - RNA, 22 nt, Human
ucucccuggcagcagaugaggu

SEQ ID NO: 34039 - RNA, 26 nt, Human
ggacacaggggcaaagaacugcccca

SEQ ID NO: 34040 - RNA, 27 nt, Human
gccggccuggcuucacuggcgcccuuu

SEQ ID NO: 34041 - RNA, 23 nt, Human
uggccccucuggccagggccccu

SEQ ID NO: 34042 - RNA, 24 nt, Human
cauuccugcacugcuuucucugcu

SEQ ID NO: 34043 - RNA, 22 nt, Human
guaaucgugcagaacagcaugu

SEQ ID NO: 34044 - RNA, 22 nt, Human
cgcaucaccaccccuuccucca

SEQ ID NO: 34045 - RNA, 28 nt, Human
aggaguuuggaaugcauuaagagcagac

SEQ ID NO: 34046 - RNA, 21 nt, Human
cacucugucccauugucuacu

SEQ ID NO: 34047 - RNA, 23 nt, Human
uguggcuugacuguuuucuuuau

SEQ ID NO: 34048 - RNA, 21 nt, Human
ucagugaugggaguaagagca

SEQ ID NO: 34049 - RNA, 24 nt, Human
ugccuccccucuccuuccugugug

SEQ ID NO: 34050 - RNA, 22 nt, Human
ucaauauuuuccuucucucuca

SEQ ID NO: 34051 - RNA, 23 nt, Human
ugcacaguugcucugggagucuu

SEQ ID NO: 34052 - RNA, 22 nt, Human
gggcugaggugggaggaucgcc

SEQ ID NO: 34053 - RNA, 24 nt, Human
uggggaagcucccagaacuucgua

SEQ ID NO: 34054 - RNA, 23 nt, Human
uuacauacaugcuuugaaguuuc

SEQ ID NO: 34055 - RNA, 21 nt, Human
agggaucuuuuuugcauuuug

SEQ ID NO: 34056 - RNA, 22 nt, Human
aguggcaggaucucagcucacu

SEQ ID NO: 34057 - RNA, 22 nt, Human
aguggcgggaucucggcucacu

SEQ ID NO: 34058 - RNA, 24 nt, Human
agcuuagugcuacugaauacccug

SEQ ID NO: 34059 - RNA, 25 nt, Human
aucacccaggcuggcagaucauggu

SEQ ID NO: 34060 - RNA, 21 nt, Human
gcacagaagcucaucucaguc

SEQ ID NO: 34061 - RNA, 22 nt, Human
cucacccucccaaguagcuggg

SEQ ID NO: 34062 - RNA, 22 nt, Human
ucuucaccuaagucucugugaa

SEQ ID NO: 34063 - RNA, 15 nt, Human
ucuaucucccagccc

SEQ ID NO: 34064 - RNA, 24 nt, Human
uucuuuaauuuuguuaucagugcc

SEQ ID NO: 34065 - RNA, 27 nt, Human
cugggaggcgcggcggugugcgcggga

SEQ ID NO: 34066 - RNA, 22 nt, Human
cccaaguagcugggacuacagg

SEQ ID NO: 34067 - RNA, 27 nt, Human
cccuccugccccaggcuuccaggcccc

SEQ ID NO: 34068 - RNA, 21 nt, Human
agucuguuccaaggcaucacc

SEQ ID NO: 34069 - RNA, 22 nt, Human
uuuaaauuggaacauaucuugc

SEQ ID NO: 34070 - RNA, 19 nt, Human
aauugcuaacauucauauu

SEQ ID NO: 34071 - RNA, 20 nt, Human
cccugcggaagccuggccug

SEQ ID NO: 34072 - RNA, 24 nt, Human
uuucaacaaagauggccacauuga

SEQ ID NO: 34073 - RNA, 25 nt, Human
ucuggaccugggcccugcucaaugc

SEQ ID NO: 34074 - RNA, 25 nt, Human
cuuccaccugcaccuucuagccacc

SEQ ID NO: 34075 - RNA, 22 nt, Human
cugaggcagaaagaucccuuga

SEQ ID NO: 34076 - RNA, 23 nt, Human
cuuacuuccucggggccugccuc

SEQ ID NO: 34077 - RNA, 27 nt, Human
acugaacacacuguguuggaucggagg

SEQ ID NO: 34078 - RNA, 22 nt, Human
agggaucuguuuccuugcccug

SEQ ID NO: 34079 - RNA, 26 nt, Human
uuacauguguuuuucucucccuccuu

SEQ ID NO: 34080 - RNA, 22 nt, Human
ccuuguacccacccaugagaag

SEQ ID NO: 34081 - RNA, 20 nt, Human
gaaggggaguacagcucucu

SEQ ID NO: 34082 - RNA, 21 nt, Human
gguuagauuugacugguuuug

SEQ ID NO: 34083 - RNA, 22 nt, Human
agccuuuacacugaauguaaug

SEQ ID NO: 34084 - RNA, 22 nt, Human
cugacuggaguucaguggugca

SEQ ID NO: 34085 - RNA, 20 nt, Human
uuugccucacguauuccugc

SEQ ID NO: 34086 - RNA, 22 nt, Human
cccugucagcugccuccagaag

SEQ ID NO: 34087 - RNA, 23 nt, Human
acacauuuaaauacagacagcuu

SEQ ID NO: 34088 - RNA, 28 nt, Human
ccagcuccucagucacuuuccucagcca

SEQ ID NO: 34089 - RNA, 29 nt, Human
cauggccugccugcccugccuccguccca

SEQ ID NO: 34090 - RNA, 20 nt, Human
gcacucugaugucagaguag

SEQ ID NO: 34091 - RNA, 24 nt, Human
gggacucuaguagaucuucuuguc

SEQ ID NO: 34092 - RNA, 23 nt, Human
agagcuacuucuaacacagccuu

SEQ ID NO: 34093 - RNA, 20 nt, Human
gcuguagcccacaucucccg

SEQ ID NO: 34094 - RNA, 23 nt, Human
uucacuuucaucuugucugcuau

SEQ ID NO: 34095 - RNA, 27 nt, Human
gcuccucccucugccucauccuccucc

SEQ ID NO: 34096 - RNA, 22 nt, Human
agcggcagccagagaacuguuu

SEQ ID NO: 34097 - RNA, 20 nt, Human
gucucauccugcccuugcca

SEQ ID NO: 34098 - RNA, 22 nt, Human
aagccauuuacagaaacccacu

SEQ ID NO: 34099 - RNA, 22 nt, Human
guugcccaggcuggaguucagc

SEQ ID NO: 34100 - RNA, 25 nt, Human
ggacucugccuuuuuucacagcccg

SEQ ID NO: 34101 - RNA, 22 nt, Human
ggagccccgcccucccaaaaag

SEQ ID NO: 34102 - RNA, 22 nt, Human
cccacuccccuccucucagccu

SEQ ID NO: 34103 - RNA, 22 nt, Human
cugugcacuuacaacaagcuga

SEQ ID NO: 34104 - RNA, 21 nt, Human
uucagcaccuggaaguaaucc

SEQ ID NO: 34105 - RNA, 22 nt, Human
caggaggcggaggaggcuagug

SEQ ID NO: 34106 - RNA, 26 nt, Human
gggugaggauggugagggagggcugg

SEQ ID NO: 34107 - RNA, 23 nt, Human
ccuaccccacaccaggccguccu

SEQ ID NO: 34108 - RNA, 29 nt, Human
uggugugugcuggggaugggcagcugcgc

SEQ ID NO: 34109 - RNA, 22 nt, Human
guguacgccuguaaucccagug

SEQ ID NO: 34110 - RNA, 21 nt, Human
ccucaggaacccugaagcugg

SEQ ID NO: 34111 - RNA, 23 nt, Human
gggagcggaagagagggcuucaa

SEQ ID NO: 34112 - RNA, 23 nt, Human
gccaucccagccaucacucuucc

SEQ ID NO: 34113 - RNA, 28 nt, Human
ccccaugccucugaccuccaccgaccuc

SEQ ID NO: 34114 - RNA, 22 nt, Human
ggcgagcgcagccaacaugucg

SEQ ID NO: 34115 - RNA, 27 nt, Human
gcucuucucggccaccugccauggccc

SEQ ID NO: 34116 - RNA, 22 nt, Human
gcaggcaugagccaggugcugg

SEQ ID NO: 34117 - RNA, 21 nt, Human
ccaaaugcugggauuacagac

SEQ ID NO: 34118 - RNA, 23 nt, Human
augcugagcuagaguugaaggaa

SEQ ID NO: 34119 - RNA, 21 nt, Human
ccccagucuuuggguggugcu

SEQ ID NO: 34120 - RNA, 27 nt, Human
cgcaccaaacuccuagcucuacaagua

SEQ ID NO: 34121 - RNA, 22 nt, Human
aggaacaggagauauuucucaa

SEQ ID NO: 34122 - RNA, 23 nt, Human
ucugccccugcccugccugggac

SEQ ID NO: 34123 - RNA, 26 nt, Human
agcuaaauguaguuauuuuauccugu

SEQ ID NO: 34124 - RNA, 21 nt, Human
cugcaaccuccacccccgggg

SEQ ID NO: 34125 - RNA, 28 nt, Human
ccuggcucccuucugccccagcuccguc

SEQ ID NO: 34126 - RNA, 26 nt, Human
ugagagauggagggcgagauuuggau

SEQ ID NO: 34127 - RNA, 22 nt, Human
uacagaagcucuucguuucagu

SEQ ID NO: 34128 - RNA, 23 nt, Human
ugugagccuagcagggcagaucu

SEQ ID NO: 34129 - RNA, 19 nt, Human
ggaagacaggcuucccuuc

SEQ ID NO: 34130 - RNA, 22 nt, Human
gcucaugucuauaaucccagca

SEQ ID NO: 34131 - RNA, 23 nt, Human
ggaggcacgcccagugugggaga

SEQ ID NO: 34132 - RNA, 20 nt, Human
cagacaccagcuguuugcaa

SEQ ID NO: 34133 - RNA, 20 nt, Human
cagccucuguccuggcugug

SEQ ID NO: 34134 - RNA, 25 nt, Human
gcccugcugaguuccugcuuucuga

SEQ ID NO: 34135 - RNA, 24 nt, Human
ccuccucuguggauggucacugcc

SEQ ID NO: 34136 - RNA, 26 nt, Human
ucucuccccucuuuccucucacauac

SEQ ID NO: 34137 - RNA, 22 nt, Human
cuuauuaucuuuauuuguacuu

SEQ ID NO: 34138 - RNA, 22 nt, Human
cgggaggcagagguuguaguga

SEQ ID NO: 34139 - RNA, 19 nt, Human
ucagagaauaaccagagaa

SEQ ID NO: 34140 - RNA, 22 nt, Human
ugggaggcagagguugcaguga

SEQ ID NO: 34141 - RNA, 22 nt, Human
uggaaggcagaaguugcaguga

SEQ ID NO: 34142 - RNA, 20 nt, Human
ucugccuggagccugggcag

SEQ ID NO: 34143 - RNA, 22 nt, Human
ccgggagguggagguugcagug

SEQ ID NO: 34144 - RNA, 22 nt, Human
accagcugauucacaaagugcu

SEQ ID NO: 34145 - RNA, 22 nt, Human
gggaagguagcacagggcagag

SEQ ID NO: 34146 - RNA, 23 nt, Human
ucuaaagacaaguuguacccaga

SEQ ID NO: 34147 - RNA, 23 nt, Human
cucuucauagacggcaggugccc

SEQ ID NO: 34148 - RNA, 26 nt, Human
gcucugaagagcaaaacugcugucgc

SEQ ID NO: 34149 - RNA, 19 nt, Human
uacuguagaacuaaaugca

SEQ ID NO: 34150 - RNA, 22 nt, Human
ucaagccagcauauuccuagua

SEQ ID NO: 34151 - RNA, 23 nt, Human
ugcauaggcaaaauacuuuucag

SEQ ID NO: 34152 - RNA, 21 nt, Human
cacuccaguccagcuugggcc

SEQ ID NO: 34153 - RNA, 20 nt, Human
aauuaaacuguuaacuuauu

SEQ ID NO: 34154 - RNA, 23 nt, Human
uuacagucaauuuggaaaaacau

SEQ ID NO: 34155 - RNA, 27 nt, Human
ggaugccuuugaauguggcccaacaca

SEQ ID NO: 34156 - RNA, 19 nt, Human
ucggccaccucugcagccu

SEQ ID NO: 34157 - RNA, 22 nt, Human
uccaccccacugggcccaacca

SEQ ID NO: 34158 - RNA, 26 nt, Human
acacuguuacuuucccccuccccuag

SEQ ID NO: 34159 - RNA, 21 nt, Human
ggccagccucaccucauucca

SEQ ID NO: 34160 - RNA, 27 nt, Human
auagcaauucacgcauucuucaagcag

SEQ ID NO: 34161 - RNA, 19 nt, Human
guccccagccagucugcuc

SEQ ID NO: 34162 - RNA, 28 nt, Human
ccugcuuccucccucccugcccugcuga

SEQ ID NO: 34163 - RNA, 27 nt, Human
gccaacaacucugauuaacuauuccua

SEQ ID NO: 34164 - RNA, 31 nt, Human
agcuucagucucggaacaugaccuuuagucu

SEQ ID NO: 34165 - RNA, 27 nt, Human
gcuuggacuugcccaucuagcacuuug

SEQ ID NO: 34166 - RNA, 27 nt, Human
ucuagaucaguuagcacaugcuuucua

SEQ ID NO: 34167 - RNA, 23 nt, Human
auuuuccuauuuuaauugcuuua

SEQ ID NO: 34168 - RNA, 27 nt, Human
cccuccaggagagagccaggaugccca

SEQ ID NO: 34169 - RNA, 23 nt, Human
gaagaagaaguuaguggugcugg

SEQ ID NO: 34170 - RNA, 21 nt, Human
ucucuggguugacugcauuuc

SEQ ID NO: 34171 - RNA, 22 nt, Human
agcucacugcaaccucugccuc

SEQ ID NO: 34172 - RNA, 22 nt, Human
ggcucacuacaaccucugccuc

SEQ ID NO: 34173 - RNA, 23 nt, Human
ccuaaacugaagagccucacccg

SEQ ID NO: 34174 - RNA, 18 nt, Human
uccauccuggggccagga

SEQ ID NO: 34175 - RNA, 20 nt, Human
gcaaacugccuucuugucag

SEQ ID NO: 34176 - RNA, 22 nt, Human
auugcaacugcucacaugaguc

SEQ ID NO: 34177 - RNA, 22 nt, Human
ccacccuccggcagcucaggga

SEQ ID NO: 34178 - RNA, 21 nt, Human
cuaaaaauguugggcuaaagc

SEQ ID NO: 34179 - RNA, 16 nt, Human
uuagcagccucugggu

SEQ ID NO: 34180 - RNA, 20 nt, Human
cugcuggugaacuccaucuc

SEQ ID NO: 34181 - RNA, 21 nt, Human
uucacagaauaaugugccagu

SEQ ID NO: 34182 - RNA, 21 nt, Human
caggccugcagacccagacuc

SEQ ID NO: 34183 - RNA, 26 nt, Human
uuugcacuauccuuccucucugugau

SEQ ID NO: 34184 - RNA, 27 nt, Human
ucaagcuuaauaugugcugaacauugu

SEQ ID NO: 34185 - RNA, 26 nt, Human
guggauaccuguaaucccagcuacgu

SEQ ID NO: 34186 - RNA, 19 nt, Human
ggcaggaccucccaccuuc

SEQ ID NO: 34187 - RNA, 19 nt, Human
gaguugguauuugcacagc

SEQ ID NO: 34188 - RNA, 22 nt, Human
cgagaggccgcccgcgaggcgc

SEQ ID NO: 34189 - RNA, 30 nt, Human
cccaaguuccgcuuccccagggugucccua

SEQ ID NO: 34190 - RNA, 22 nt, Human
cuccccuccucugaagacugcc

SEQ ID NO: 34191 - RNA, 21 nt, Human
ugaaccauguauuucagugaa

SEQ ID NO: 34192 - RNA, 21 nt, Human
ggguaagggggguugggggug

SEQ ID NO: 34193 - RNA, 27 nt, Human
gacagcccaguguagagauuggcacuu

SEQ ID NO: 34194 - RNA, 21 nt, Human
cgccuccagguucaagugauu

SEQ ID NO: 34195 - RNA, 23 nt, Human
caccaggugcuagggugccaggg

SEQ ID NO: 34196 - RNA, 21 nt, Human
uuuaaggccuuaacaggugaa

SEQ ID NO: 34197 - RNA, 27 nt, Human
auugggguugcaacaauaauucaucaa

SEQ ID NO: 34198 - RNA, 21 nt, Human
uggcaaagcuuugugcggagg

SEQ ID NO: 34199 - RNA, 20 nt, Human
cacuccgauccgccugggcu

SEQ ID NO: 34200 - RNA, 22 nt, Human
uauugacuuuuugcgucacuua

SEQ ID NO: 34201 - RNA, 22 nt, Human
gugaccaaacuuuccaggcaua

SEQ ID NO: 34202 - RNA, 21 nt, Human
agugagcuuggcagggccagg

SEQ ID NO: 34203 - RNA, 20 nt, Human
auucauauuuaccgucaaag

SEQ ID NO: 34204 - RNA, 23 nt, Human
uuucuauuucuagaaauaauauu

SEQ ID NO: 34205 - RNA, 20 nt, Human
cgaguuccugugauuuuugu

SEQ ID NO: 34206 - RNA, 27 nt, Human
cugacuccaagguauuguucagaccuc

SEQ ID NO: 34207 - RNA, 21 nt, Human
ugucuucuugaaauuugugau

SEQ ID NO: 34208 - RNA, 21 nt, Human
ccuuuucugcuaucaccuucc

SEQ ID NO: 34209 - RNA, 19 nt, Human
agaaaacaauacagagcuu

SEQ ID NO: 34210 - RNA, 21 nt, Human
cccagacucggccuccucucc

SEQ ID NO: 34211 - RNA, 23 nt, Human
gcuaguagaauggcagcacgcug

SEQ ID NO: 34212 - RNA, 21 nt, Human
ugcccuccaagaucuucccuu

SEQ ID NO: 34213 - RNA, 23 nt, Human
ugcaauuuuuugguauuuuuugu

SEQ ID NO: 34214 - RNA, 22 nt, Human
uaggauaauacauaaaugauaa

SEQ ID NO: 34215 - RNA, 21 nt, Human
agcccaggaagcagagauucc

SEQ ID NO: 34216 - RNA, 23 nt, Human
ggcuucugcuucauccugcucca

SEQ ID NO: 34217 - RNA, 20 nt, Human
ccugcgcuugaggccugucu

SEQ ID NO: 34218 - RNA, 18 nt, Human
uccaauaaaaauaucuua

SEQ ID NO: 34219 - RNA, 26 nt, Human
gaccacacugggucggcggacacaaa

SEQ ID NO: 34220 - RNA, 21 nt, Human
gccacugcaguccagccuagg

SEQ ID NO: 34221 - RNA, 22 nt, Human
uuuaauacuuuggauucuuccc

SEQ ID NO: 34222 - RNA, 25 nt, Human
gcugccuggccacugcucccuaagc

SEQ ID NO: 34223 - RNA, 27 nt, Human
gaagagaaguucaggggucccagaaag

SEQ ID NO: 34224 - RNA, 23 nt, Human
ucucccauuucugaguugucucu

SEQ ID NO: 34225 - RNA, 19 nt, Human
cuucugcugaaguuuuaag

SEQ ID NO: 34226 - RNA, 23 nt, Human
gccgauaucaacacuuguaucug

SEQ ID NO: 34227 - RNA, 24 nt, Human
uuauacagagcugacucaaaaaga

SEQ ID NO: 34228 - RNA, 27 nt, Human
ggagugaggaccuguaaggcaggccca

SEQ ID NO: 34229 - RNA, 21 nt, Human
uucucucuuuuaaaguauuua

SEQ ID NO: 34230 - RNA, 20 nt, Human
cccucauucccucgggaccc

SEQ ID NO: 34231 - RNA, 23 nt, Human
aagaacauaucagaaauauauag

SEQ ID NO: 34232 - RNA, 28 nt, Human
gcccgggacuggagacugaugcaugagg

SEQ ID NO: 34233 - RNA, 25 nt, Human
uggugacucaugccuguaauccuag

SEQ ID NO: 34234 - RNA, 27 nt, Human
gcagugcacuugccccuccucaugccc

SEQ ID NO: 34235 - RNA, 29 nt, Human
ggcuggagccuccugauuggguuucggag

SEQ ID NO: 34236 - RNA, 22 nt, Human
caaggcccaggcugggguucag

SEQ ID NO: 34237 - RNA, 18 nt, Human
ccucuuccucugagaacc

SEQ ID NO: 34238 - RNA, 27 nt, Human
ggaggcugaaggaggggagaacaaaau

SEQ ID NO: 34239 - RNA, 22 nt, Human
gauuauccaggcugagauggaa

SEQ ID NO: 34240 - RNA, 27 nt, Human
ugcaaauagaaaucagcacauuccucc

SEQ ID NO: 34241 - RNA, 24 nt, Human
guagcuuuaaaaccacagcugggc

SEQ ID NO: 34242 - RNA, 24 nt, Human
cggcagaggcagagaugggaguga

SEQ ID NO: 34243 - RNA, 22 nt, Human
gcaucggucagaagcaccaaga

SEQ ID NO: 34244 - RNA, 19 nt, Human
cccugcgggagcaggcugg

SEQ ID NO: 34245 - RNA, 22 nt, Human
ggacucggcacgcccgcaacaa

SEQ ID NO: 34246 - RNA, 23 nt, Human
gcuuuucuuccucuucccccaac

SEQ ID NO: 34247 - RNA, 21 nt, Human
ggccccuggacaccucuguca

SEQ ID NO: 34248 - RNA, 23 nt, Human
uugcucuuuguaacuaugucugu

SEQ ID NO: 34249 - RNA, 23 nt, Human
ccagacuuccuccuggaaaacgc

SEQ ID NO: 34250 - RNA, 21 nt, Human
uuuccaauuauccuuuuucaa

SEQ ID NO: 34251 - RNA, 26 nt, Human
gcagacacaacagcguggcuuagauu

SEQ ID NO: 34252 - RNA, 16 nt, Human
gaucccuuaccaguca

SEQ ID NO: 34253 - RNA, 24 nt, Human
agcuaucuccccugcuccucugcu

SEQ ID NO: 34254 - RNA, 31 nt, Human
gcgcaggccgcccuggcugagcagcaccgcc

SEQ ID NO: 34255 - RNA, 23 nt, Human
aggagaugaagccauuucuuauc

SEQ ID NO: 34256 - RNA, 24 nt, Human
gcaucucuuccucuucuguugcca

SEQ ID NO: 34257 - RNA, 20 nt, Human
cccugcagugcccuagacug

SEQ ID NO: 34258 - RNA, 26 nt, Human
aaaugaugcagauguuguuuucaggu

SEQ ID NO: 34259 - RNA, 27 nt, Human
cugggcccugggugaggugggggucug

SEQ ID NO: 34260 - RNA, 22 nt, Human
cucuacccucagcauccuggcc

SEQ ID NO: 34261 - RNA, 27 nt, Human
uacaagugccaugauugauuagcaaug

SEQ ID NO: 34262 - RNA, 22 nt, Human
cucauucuucuuuuaugauuca

SEQ ID NO: 34263 - RNA, 18 nt, Human
uguuuaucuugcuuuuca

SEQ ID NO: 34264 - RNA, 30 nt, Human
gccugugcuuuuucucccagcacugcggac

SEQ ID NO: 34265 - RNA, 25 nt, Human
ucaucccuagaggcagcugcuccag

SEQ ID NO: 34266 - RNA, 21 nt, Human
uccuucaguuaacugcuuugu

SEQ ID NO: 34267 - RNA, 23 nt, Human
ccucugaacucugaccucaggag

SEQ ID NO: 34268 - RNA, 27 nt, Human
guggcaaaaaaggcauagcuaaaggcu

SEQ ID NO: 34269 - RNA, 28 nt, Human
ucguccaaaccacuggagugugcuggug

SEQ ID NO: 34270 - RNA, 17 nt, Human
ucuucccucucccaucg

SEQ ID NO: 34271 - RNA, 21 nt, Human
ccucugucuguuaauucuuuc

SEQ ID NO: 34272 - RNA, 27 nt, Human
aaaacauuugccaacacauuaugaagu

SEQ ID NO: 34273 - RNA, 22 nt, Human
uggccaacacagugaaacccca

SEQ ID NO: 34274 - RNA, 25 nt, Human
cgccccccuccucacuugcgcugcu

SEQ ID NO: 34275 - RNA, 23 nt, Human
gaccggcgugacagccuccaggu

SEQ ID NO: 34276 - RNA, 22 nt, Human
gagcccaggaggcagcaucucc

SEQ ID NO: 34277 - RNA, 21 nt, Human
gccagccccacacagcuacag

SEQ ID NO: 34278 - RNA, 23 nt, Human
guugcccaggcuagcaugcaaug

SEQ ID NO: 34279 - RNA, 24 nt, Human
gucucuuggugauggagugugcgu

SEQ ID NO: 34280 - RNA, 20 nt, Human
ucucccuuacccaucuugcu

SEQ ID NO: 34281 - RNA, 20 nt, Human
uuuugaaaacaucucaguuu

SEQ ID NO: 34282 - RNA, 22 nt, Human
auggaagcagcauccugaccac

SEQ ID NO: 34283 - RNA, 14 nt, Human
cauauguguguaua

SEQ ID NO: 34284 - RNA, 24 nt, Human
uccagcagguagugggugaaugug

SEQ ID NO: 34285 - RNA, 24 nt, Human
gggcggggaccaggagggagcggg

SEQ ID NO: 34286 - RNA, 21 nt, Human
aacccagcaaucugugcuuuc

SEQ ID NO: 34287 - RNA, 22 nt, Human
uguguggguguggggcugccag

SEQ ID NO: 34288 - RNA, 21 nt, Human
gggauguucuccuaagccgca

SEQ ID NO: 34289 - RNA, 27 nt, Human
uucucucucaccucuaggcccucugcu

SEQ ID NO: 34290 - RNA, 21 nt, Human
cuuauuuauccugcagucaca

SEQ ID NO: 34291 - RNA, 25 nt, Human
cucucccucccuuccucaggcauca

SEQ ID NO: 34292 - RNA, 20 nt, Human
gcacaccauuugugcugcug

SEQ ID NO: 34293 - RNA, 20 nt, Human
agccagcucuggggugccau

SEQ ID NO: 34294 - RNA, 21 nt, Human
aguauguuuagaaauagaaca

SEQ ID NO: 34295 - RNA, 23 nt, Human
aacugaaaaccuucuuaacuucu

SEQ ID NO: 34296 - RNA, 20 nt, Human
cgaugaggagugcacugccu

SEQ ID NO: 34297 - RNA, 27 nt, Human
ccagcagcaaccaggacgucuguucuu

SEQ ID NO: 34298 - RNA, 27 nt, Human
aaggcauucaucugccauuuuucaauu

SEQ ID NO: 34299 - RNA, 28 nt, Human
cuucccuuuccaaagguuucugaggacu

SEQ ID NO: 34300 - RNA, 22 nt, Human
ggaggagcagaaggcagaggcc

SEQ ID NO: 34301 - RNA, 22 nt, Human
ccagugagaggggcaggggcag

SEQ ID NO: 34302 - RNA, 15 nt, Human
uggaagcuaugaagc

SEQ ID NO: 34303 - RNA, 23 nt, Human
uucaagacugacauuuuuuccua

SEQ ID NO: 34304 - RNA, 24 nt, Human
gcccccagcccaccagcccagccc

SEQ ID NO: 34305 - RNA, 26 nt, Human
ugaacaaacaagcugcccccagggua

SEQ ID NO: 34306 - RNA, 22 nt, Human
ggacuucagccccucugcucug

SEQ ID NO: 34307 - RNA, 28 nt, Human
gucuacccagacccuugugcggcccaug

SEQ ID NO: 34308 - RNA, 21 nt, Human
agcaccaccacacagucaccc

SEQ ID NO: 34309 - RNA, 20 nt, Human
uggugaggacuagggguaag

SEQ ID NO: 34310 - RNA, 20 nt, Human
uucaaugcccuguucuucca

SEQ ID NO: 34311 - RNA, 22 nt, Human
cagggccuuuugaacaguagug

SEQ ID NO: 34312 - RNA, 26 nt, Human
uucuuguuugcugcuauuuucugucc

SEQ ID NO: 34313 - RNA, 20 nt, Human
cgugcagaaaaaugggugaa

SEQ ID NO: 34314 - RNA, 20 nt, Human
uuccacuguacucauucaua

SEQ ID NO: 34315 - RNA, 20 nt, Human
cccuacugcuuacauucccc

SEQ ID NO: 34316 - RNA, 22 nt, Human
uucuguguccccucugcaugcc

SEQ ID NO: 34317 - RNA, 23 nt, Human
cuaucuucacaccugccaccuca

SEQ ID NO: 34318 - RNA, 24 nt, Human
uacaugguuuaggauuaaagccag

SEQ ID NO: 34319 - RNA, 24 nt, Human
uuguccacccaccuaugugccaac

SEQ ID NO: 34320 - RNA, 26 nt, Human
uaguuggagagcagaaccuugcgcgg

SEQ ID NO: 34321 - RNA, 21 nt, Human
aggugacaucaccuaugcaca

SEQ ID NO: 34322 - RNA, 21 nt, Human
agaccaggaagucaccugccu

SEQ ID NO: 34323 - RNA, 20 nt, Human
ccuaaauguuaaccaagcag

SEQ ID NO: 34324 - RNA, 19 nt, Human
acacuccuccaaggcacaa

SEQ ID NO: 34325 - RNA, 24 nt, Human
uccuccagguaacugugaugcggg

SEQ ID NO: 34326 - RNA, 20 nt, Human
cuuaguuuuuucaguugcag

SEQ ID NO: 34327 - RNA, 22 nt, Human
gccuaagccgccuccauggccc

SEQ ID NO: 34328 - RNA, 23 nt, Human
gaccacaggcugguguguaggug

SEQ ID NO: 34329 - RNA, 21 nt, Human
acucugggcucuuggcucaga

SEQ ID NO: 34330 - RNA, 26 nt, Human
ccggagagcagcuucacacuggcgcc

SEQ ID NO: 34331 - RNA, 26 nt, Human
auguuuguacuuuuguguuacugcag

SEQ ID NO: 34332 - RNA, 27 nt, Human
cucugcaggauacaguucaauaugaug

SEQ ID NO: 34333 - RNA, 21 nt, Human
uuagcauuugauaugcauuuc

SEQ ID NO: 34334 - RNA, 22 nt, Human
gauuacaggcgccugccaccac

SEQ ID NO: 34335 - RNA, 22 nt, Human
gauuacaggcgcccgccaccau

SEQ ID NO: 34336 - RNA, 21 nt, Human
gccccccaccaguggcuucua

SEQ ID NO: 34337 - RNA, 21 nt, Human
uuaggcugggcgcuguggcuc

SEQ ID NO: 34338 - RNA, 17 nt, Human
gaauguuggaccccaaa

SEQ ID NO: 34339 - RNA, 16 nt, Human
uuucuucauugcagug

SEQ ID NO: 34340 - RNA, 24 nt, Human
caguguggcuggauucucugcuca

SEQ ID NO: 34341 - RNA, 22 nt, Human
gggagcucgcgccgaggacugg

SEQ ID NO: 34342 - RNA, 25 nt, Human
ucucacagaaucaccccucuaccuu

SEQ ID NO: 34343 - RNA, 22 nt, Human
aucugaaaauacauuucccucc

SEQ ID NO: 34344 - RNA, 22 nt, Human
gcaugugggggacagaacagua

SEQ ID NO: 34345 - RNA, 22 nt, Human
uagggcuuauggccaggggaca

SEQ ID NO: 34346 - RNA, 21 nt, Human
ucagaauccggagcaguaagu

SEQ ID NO: 34347 - RNA, 22 nt, Human
ccacuaaggccaaggacauaua

SEQ ID NO: 34348 - RNA, 24 nt, Human
uuccucagcugaggugacacuguu

SEQ ID NO: 34349 - RNA, 18 nt, Human
gccgcggaccaggcucca

SEQ ID NO: 34350 - RNA, 24 nt, Human
ccacaaacccuaugggggcugcca

SEQ ID NO: 34351 - RNA, 20 nt, Human
guggcuuucaaaagagacac

SEQ ID NO: 34352 - RNA, 22 nt, Human
ugaccuuuugggcucaagugau

SEQ ID NO: 34353 - RNA, 24 nt, Human
gcaaggguuggugccuuaaggucc

SEQ ID NO: 34354 - RNA, 21 nt, Human
caccuccagaguccaaggguc

SEQ ID NO: 34355 - RNA, 21 nt, Human
ccugucuuccuuccuccucau

SEQ ID NO: 34356 - RNA, 14 nt, Human
ugggagcagaggaa

SEQ ID NO: 34357 - RNA, 27 nt, Human
gaggaagagaggccaaguucagagcuc

SEQ ID NO: 34358 - RNA, 20 nt, Human
ccuacuuccugccaagcauu

SEQ ID NO: 34359 - RNA, 21 nt, Human
cuuugggccuccccagccaga

SEQ ID NO: 34360 - RNA, 21 nt, Human
uaggauagcaaagugagccau

SEQ ID NO: 34361 - RNA, 30 nt, Human
ucuccagccggccaccucaggccccuguug

SEQ ID NO: 34362 - RNA, 22 nt, Human
uucucagacccuuggagagaaa

SEQ ID NO: 34363 - RNA, 27 nt, Human
ugauguuaagaaauuuguauggugugg

SEQ ID NO: 34364 - RNA, 19 nt, Human
cugggguccugguuccuca

SEQ ID NO: 34365 - RNA, 18 nt, Human
uauaacugcuuuugugcu

SEQ ID NO: 34366 - RNA, 22 nt, Human
ugccucugggcugcugugcaaa

SEQ ID NO: 34367 - RNA, 21 nt, Human
cccuucccagccccagcccug

SEQ ID NO: 34368 - RNA, 22 nt, Human
uugucucuuccucugcaggaca

SEQ ID NO: 34369 - RNA, 27 nt, Human
gcucacugucuuacaaucacugcugug

SEQ ID NO: 34370 - RNA, 24 nt, Human
uccuccaaaaagcacaagcccaga

SEQ ID NO: 34371 - RNA, 23 nt, Human
uaaacugaagccaacugugaaua

SEQ ID NO: 34372 - RNA, 23 nt, Human
aacacaagaucagggcugagggu

SEQ ID NO: 34373 - RNA, 23 nt, Human
ccacugcauccagccaauaggag

SEQ ID NO: 34374 - RNA, 25 nt, Human
caaagucaagacccugaucucucca

SEQ ID NO: 34375 - RNA, 20 nt, Human
aacacaaaccacaacugaca

SEQ ID NO: 34376 - RNA, 21 nt, Human
uuugauugucauagugaccuu

SEQ ID NO: 34377 - RNA, 22 nt, Human
uggggacugucugcucuucucg

SEQ ID NO: 34378 - RNA, 19 nt, Human
auauauuugaaaaaugcac

SEQ ID NO: 34379 - RNA, 26 nt, Human
uauguucuuuaaauguguguuuaguu

SEQ ID NO: 34380 - RNA, 18 nt, Human
uggcagagccucugagau

SEQ ID NO: 34381 - RNA, 19 nt, Human
acucagaaaugaagaugag

SEQ ID NO: 34382 - RNA, 21 nt, Human
uucucgaacuccugaccucag

SEQ ID NO: 34383 - RNA, 23 nt, Human
ggccuggcaucuucuggagaagc

SEQ ID NO: 34384 - RNA, 23 nt, Human
uagauccaguugcacuaaauucc

SEQ ID NO: 34385 - RNA, 27 nt, Human
cgcgcgagcgcuucccuucccccugca

SEQ ID NO: 34386 - RNA, 24 nt, Human
ugucaggggagguuguacagguga

SEQ ID NO: 34387 - RNA, 20 nt, Human
ggagaggcgcggggagccag

SEQ ID NO: 34388 - RNA, 22 nt, Human
uuuucugcagccucuuuuugcc

SEQ ID NO: 34389 - RNA, 21 nt, Human
agcaggacugagcagaggcgg

SEQ ID NO: 34390 - RNA, 23 nt, Human
gaauguugaugaacaaauguaaa

SEQ ID NO: 34391 - RNA, 22 nt, Human
gacuacaggugugagucaccaa

SEQ ID NO: 34392 - RNA, 27 nt, Human
ugcuguuggcgaccccucugucugucu

SEQ ID NO: 34393 - RNA, 22 nt, Human
gcauuuggcaccacucucugaa

SEQ ID NO: 34394 - RNA, 25 nt, Human
auguugauucuuguaagcacuggac

SEQ ID NO: 34395 - RNA, 24 nt, Human
guggcagaucuuguuuuacacucc

SEQ ID NO: 34396 - RNA, 21 nt, Human
agguuaaacuuucaccaaugu

SEQ ID NO: 34397 - RNA, 22 nt, Human
guacagacuuguauuuuuucuc

SEQ ID NO: 34398 - RNA, 24 nt, Human
ggucccugggaucccuucaucucu

SEQ ID NO: 34399 - RNA, 21 nt, Human
ugccuguagagccagccuugg

SEQ ID NO: 34400 - RNA, 27 nt, Human
gcuggucacuucuucuguccaagcaga

SEQ ID NO: 34401 - RNA, 23 nt, Human
cucagaugacccaccugccucgg

SEQ ID NO: 34402 - RNA, 25 nt, Human
guggcagccucacagggaacacggg

SEQ ID NO: 34403 - RNA, 22 nt, Human
gugggcacaaagacacuuuuuc

SEQ ID NO: 34404 - RNA, 26 nt, Human
uggacuugccuccagagacugcucca

SEQ ID NO: 34405 - RNA, 19 nt, Human
aggaagcucacagcugggc

SEQ ID NO: 34406 - RNA, 22 nt, Human
guuggcaugaugacauuucauu

SEQ ID NO: 34407 - RNA, 21 nt, Human
gcugucuccacggaacagccu

SEQ ID NO: 34408 - RNA, 23 nt, Human
gaagaaagaagaagcgcugcagg

SEQ ID NO: 34409 - RNA, 22 nt, Human
uuuuaugauuuuucugucaucu

SEQ ID NO: 34410 - RNA, 21 nt, Human
aagggagggguggagaugggu

SEQ ID NO: 34411 - RNA, 24 nt, Human
ggauacuuccaggagacagagcca

SEQ ID NO: 34412 - RNA, 23 nt, Human
cugggagucccggaggccaggcu

SEQ ID NO: 34413 - RNA, 20 nt, Human
aacacauagugguaauugga

SEQ ID NO: 34414 - RNA, 27 nt, Human
cccagugagagcgcacccuggagcagc

SEQ ID NO: 34415 - RNA, 21 nt, Human
caaugcuggugccauuguugu

SEQ ID NO: 34416 - RNA, 23 nt, Human
aaggaccuuuugucacagcacuu

SEQ ID NO: 34417 - RNA, 27 nt, Human
uagauggugcaggugaguuugcaauga

SEQ ID NO: 34418 - RNA, 25 nt, Human
uugucagcuaaggucacauugugcc

SEQ ID NO: 34419 - RNA, 22 nt, Human
ugcgcagguuaacuacagcucc

SEQ ID NO: 34420 - RNA, 25 nt, Human
uguugagagcguguguagugcugca

SEQ ID NO: 34421 - RNA, 27 nt, Human
agcauuuuaagaaaucuuguugcuuuu

SEQ ID NO: 34422 - RNA, 22 nt, Human
cgcaaccuccgcccccuggguu

SEQ ID NO: 34423 - RNA, 23 nt, Human
aauuaucauuguuuguccuuuau

SEQ ID NO: 34424 - RNA, 25 nt, Human
cccaccccacccuguuguagccccu

SEQ ID NO: 34425 - RNA, 19 nt, Human
ugcucacugcuucugcuuu

SEQ ID NO: 34426 - RNA, 27 nt, Human
gcauuuguauuuucucucucuagguau

SEQ ID NO: 34427 - RNA, 25 nt, Human
uucaaguguucaccaaccacugaug

SEQ ID NO: 34428 - RNA, 18 nt, Human
uuaguauuucauuacaaa

SEQ ID NO: 34429 - RNA, 23 nt, Human
auccuguuaugauuauauuauua

SEQ ID NO: 34430 - RNA, 24 nt, Human
acauaggaaaauaaccaagcacaa

SEQ ID NO: 34431 - RNA, 22 nt, Human
ccugcucuccuugcccugggcc

SEQ ID NO: 34432 - RNA, 22 nt, Human
guccaggcuggagugcaauggc

SEQ ID NO: 34433 - RNA, 22 nt, Human
guccaggcuagagugcaguggc

SEQ ID NO: 34434 - RNA, 22 nt, Human
aauaggcagagcaacuguuacc

SEQ ID NO: 34435 - RNA, 24 nt, Human
gaccuauacagaacagagggccag

SEQ ID NO: 34436 - RNA, 19 nt, Human
uggguaguguagaagcaac

SEQ ID NO: 34437 - RNA, 21 nt, Human
uaucagaaucuuguccaaguu

SEQ ID NO: 34438 - RNA, 26 nt, Human
cacccaggcuggagugcaguagcgcg

SEQ ID NO: 34439 - RNA, 20 nt, Human
accaaaacaauuuauaccuu

SEQ ID NO: 34440 - RNA, 22 nt, Human
uucuuguaauuaaaagauuuca

SEQ ID NO: 34441 - RNA, 26 nt, Human
gggugagggcaaaggcugacgaagag

SEQ ID NO: 34442 - RNA, 21 nt, Human
uagcuuuguuuaaugucuuau

SEQ ID NO: 34443 - RNA, 26 nt, Human
gcccugcugauuguacuuuccccucc

SEQ ID NO: 34444 - RNA, 23 nt, Human
ugcuacagccaugucacuccugg

SEQ ID NO: 34445 - RNA, 26 nt, Human
uaggaagagaauggcugccaguggcu

SEQ ID NO: 34446 - RNA, 26 nt, Human
cugccuggccaggcccugggucuugc

SEQ ID NO: 34447 - RNA, 24 nt, Human
uaaucagucuucauuuuccacagu

SEQ ID NO: 34448 - RNA, 26 nt, Human
gguucaucugaggauguucaggcugg

SEQ ID NO: 34449 - RNA, 20 nt, Human
guuccaggacuggguguucu

SEQ ID NO: 34450 - RNA, 22 nt, Human
uuaggcucucaacaugacuaua

SEQ ID NO: 34451 - RNA, 22 nt, Human
cggcccugcugggugaccucag

SEQ ID NO: 34452 - RNA, 26 nt, Human
aacuauacacaaaccuugaacauuuu

SEQ ID NO: 34453 - RNA, 22 nt, Human
aagcucuucgaggcucaggaga

SEQ ID NO: 34454 - RNA, 21 nt, Human
ggcagggagggggcagaggca

SEQ ID NO: 34455 - RNA, 25 nt, Human
acagguuuuuacaguccagcaaggg

SEQ ID NO: 34456 - RNA, 24 nt, Human
agcacucugaauucaguggcagua

SEQ ID NO: 34457 - RNA, 25 nt, Human
caggaaaggaagaaaggcagcuuca

SEQ ID NO: 34458 - RNA, 26 nt, Human
cauggacuguaucuuaucuaccacua

SEQ ID NO: 34459 - RNA, 19 nt, Human
ccugccugccggccuccgc

SEQ ID NO: 34460 - RNA, 27 nt, Human
uuccggcggccucucuccucucccuca

SEQ ID NO: 34461 - RNA, 27 nt, Human
ggaccugccacccagagccccaugaag

SEQ ID NO: 34462 - RNA, 22 nt, Human
ucugccagaaguuggugucucu

SEQ ID NO: 34463 - RNA, 24 nt, Human
cuaggaaugggggacagggggagg

SEQ ID NO: 34464 - RNA, 19 nt, Human
ugucuccuccccagaaaga

SEQ ID NO: 34465 - RNA, 27 nt, Human
ucuccccugguuugugaagugcggaaa

SEQ ID NO: 34466 - RNA, 22 nt, Human
gacuugcccaaggucagagcca

SEQ ID NO: 34467 - RNA, 19 nt, Human
uguacuccacagagccuca

SEQ ID NO: 34468 - RNA, 22 nt, Human
ugcauggucagaaugggugcag

SEQ ID NO: 34469 - RNA, 23 nt, Human
ggcagcgggcggcggggagcagc

SEQ ID NO: 34470 - RNA, 21 nt, Human
agacucucugagaguauuuga

SEQ ID NO: 34471 - RNA, 26 nt, Human
cuccugccuaugcuccugggauacgc

SEQ ID NO: 34472 - RNA, 26 nt, Human
cagcacacuuagauauuccuggacau

SEQ ID NO: 34473 - RNA, 24 nt, Human
uauaaguagaucagagugggaaga

SEQ ID NO: 34474 - RNA, 20 nt, Human
auaccuuguaaaucuuccca

SEQ ID NO: 34475 - RNA, 25 nt, Human
ccaggggaccuccugggagaugcag

SEQ ID NO: 34476 - RNA, 26 nt, Human
cuggggcagggcccagggagguggca

SEQ ID NO: 34477 - RNA, 17 nt, Human
agugcuuacugcagccu

SEQ ID NO: 34478 - RNA, 17 nt, Human
uuuucacccucuucgcc

SEQ ID NO: 34479 - RNA, 18 nt, Human
acuggcugucugccugua

SEQ ID NO: 34480 - RNA, 21 nt, Human
gccugcucccuccugcuugcc

SEQ ID NO: 34481 - RNA, 24 nt, Human
uguccucccuucauccugcggggc

SEQ ID NO: 34482 - RNA, 27 nt, Human
gaacagcucaccacugugccuacauuu

SEQ ID NO: 34483 - RNA, 29 nt, Human
ccucuccuuccuguguguccaaaacugcc

SEQ ID NO: 34484 - RNA, 21 nt, Human
auucuauguguuuugucuuuu

SEQ ID NO: 34485 - RNA, 23 nt, Human
ugcucugccacucagcugcccuc

SEQ ID NO: 34486 - RNA, 19 nt, Human
guacauuccuucuuccucc

SEQ ID NO: 34487 - RNA, 26 nt, Human
cggggaauguguagccuucaggaaaa

SEQ ID NO: 34488 - RNA, 22 nt, Human
ucucagcagcucaacugcccag

SEQ ID NO: 34489 - RNA, 21 nt, Human
caguucugccacaggucugcc

SEQ ID NO: 34490 - RNA, 22 nt, Human
ggaaggagggaggcuuggauga

SEQ ID NO: 34491 - RNA, 18 nt, Human
ucccucccacccaccuca

SEQ ID NO: 34492 - RNA, 27 nt, Human
guucuccauucucuagcaucccucccc

SEQ ID NO: 34493 - RNA, 23 nt, Human
aggcuggagugcgguggcaugau

SEQ ID NO: 34494 - RNA, 25 nt, Human
cuccaaugucgaacucuucuuugcu

SEQ ID NO: 34495 - RNA, 30 nt, Human
gucagagccuuaacaccagcaggugaccau

SEQ ID NO: 34496 - RNA, 22 nt, Human
cacugcuggaggaauuuuguca

SEQ ID NO: 34497 - RNA, 22 nt, Human
aaggaugaauccccuuuuuaaa

SEQ ID NO: 34498 - RNA, 22 nt, Human
auucagucccaaauauguauuu

SEQ ID NO: 34499 - RNA, 22 nt, Human
ucugucacccaggcuugagugc

SEQ ID NO: 34500 - RNA, 25 nt, Human
ucaugggagcagccucuaauuagac

SEQ ID NO: 34501 - RNA, 16 nt, Human
cagucucuaggguugu

SEQ ID NO: 34502 - RNA, 19 nt, Human
gaaaguuaauccacuguga

SEQ ID NO: 34503 - RNA, 24 nt, Human
gccgcugcuuccaggcugggcagc

SEQ ID NO: 34504 - RNA, 25 nt, Human
agucuugccuuacacaaaggggauc

SEQ ID NO: 34505 - RNA, 26 nt, Human
uguuuagagcaguuaacaucugaagu

SEQ ID NO: 34506 - RNA, 21 nt, Human
uccuuuaacaaccaagcaguu

SEQ ID NO: 34507 - RNA, 19 nt, Human
gccaggcuggagugcagug

SEQ ID NO: 34508 - RNA, 24 nt, Human
ggggagggaaagcgccuuuuccug

SEQ ID NO: 34509 - RNA, 24 nt, Human
cuauuuuuguaaaagacauuugau

SEQ ID NO: 34510 - RNA, 20 nt, Human
auucagcaaccucguaccuc

SEQ ID NO: 34511 - RNA, 22 nt, Human
gucgcccaggcuggaguacagu

SEQ ID NO: 34512 - RNA, 22 nt, Human
gucgcccagacuggagugcagu

SEQ ID NO: 34513 - RNA, 18 nt, Human
acggauuuauuuuuccau

SEQ ID NO: 34514 - RNA, 22 nt, Human
ccugcaggaagagauuuggcug

SEQ ID NO: 34515 - RNA, 26 nt, Human
cacugugggacugggacacuuuuaug

SEQ ID NO: 34516 - RNA, 19 nt, Human
gagguaggaaugagcaggu

SEQ ID NO: 34517 - RNA, 21 nt, Human
caguguccuuagaacauuuua

SEQ ID NO: 34518 - RNA, 20 nt, Human
uuuuggcugcucuccaucuc

SEQ ID NO: 34519 - RNA, 23 nt, Human
gcgccggcucaccaugcacugcc

SEQ ID NO: 34520 - RNA, 23 nt, Human
ucaaauccucaccuaagcuuuca

SEQ ID NO: 34521 - RNA, 22 nt, Human
ggacaggagagggagggguggg

SEQ ID NO: 34522 - RNA, 23 nt, Human
cuuacauuccccucccccuggcc

SEQ ID NO: 34523 - RNA, 22 nt, Human
auuugcgugaccuuacugcccu

SEQ ID NO: 34524 - RNA, 26 nt, Human
gcucacugcaaccuucgccaccuggg

SEQ ID NO: 34525 - RNA, 23 nt, Human
gcaaccaggaacagcaaaugcaa

SEQ ID NO: 34526 - RNA, 26 nt, Human
gcuuccaaggagcuacuuaguuuuag

SEQ ID NO: 34527 - RNA, 22 nt, Human
cuggaaccaggcuugccuggga

SEQ ID NO: 34528 - RNA, 22 nt, Human
aggcugaggcaggaggaucgcu

SEQ ID NO: 34529 - RNA, 22 nt, Human
aggcugaggcaugaggaucucu

SEQ ID NO: 34530 - RNA, 19 nt, Human
cucaugaucacaauucaua

SEQ ID NO: 34531 - RNA, 23 nt, Human
ccaaugcccgccagccuagcucc

SEQ ID NO: 34532 - RNA, 19 nt, Human
cacuaucuauuaugcagcu

SEQ ID NO: 34533 - RNA, 23 nt, Human
gaccagcccagccaacaugguga

SEQ ID NO: 34534 - RNA, 22 nt, Human
agacuagccugggaaacauagg

SEQ ID NO: 34535 - RNA, 20 nt, Human
agagacgggguuuugccaug

SEQ ID NO: 34536 - RNA, 21 nt, Human
auggugacagcugcaagccag

SEQ ID NO: 34537 - RNA, 22 nt, Human
uggccaacguggugaaacccca

SEQ ID NO: 34538 - RNA, 26 nt, Human
uuuugcccugaguauucucaggaggg

SEQ ID NO: 34539 - RNA, 22 nt, Human
uucaagcgauucuccugccuca

SEQ ID NO: 34540 - RNA, 21 nt, Human
cuugugggcgcucacacugcc

SEQ ID NO: 34541 - RNA, 25 nt, Human
acugcccaggccugccuguucccau

SEQ ID NO: 34542 - RNA, 24 nt, Human
acaguuacauugguaauucuggca

SEQ ID NO: 34543 - RNA, 22 nt, Human
gcuugcuccccuccggcacgcc

SEQ ID NO: 34544 - RNA, 23 nt, Human
uccucaucugcaaaaugggaaca

SEQ ID NO: 34545 - RNA, 19 nt, Human
ccagggacguaccccaaau

SEQ ID NO: 34546 - RNA, 24 nt, Human
gguggcugcuccaugagggugggg

SEQ ID NO: 34547 - RNA, 20 nt, Human
ugccugcuuugugcuuucug

SEQ ID NO: 34548 - RNA, 20 nt, Human
gcugcaugcugccauggccc

SEQ ID NO: 34549 - RNA, 22 nt, Human
cccaggaggcgacugcauggug

SEQ ID NO: 34550 - RNA, 22 nt, Human
ugcccccagacuuccuccuuuc

SEQ ID NO: 34551 - RNA, 25 nt, Human
ggaggugggguuggagcaggaaggg

SEQ ID NO: 34552 - RNA, 22 nt, Human
auuguuugaacccgggaggcag

SEQ ID NO: 34553 - RNA, 27 nt, Human
ucuacgugcuucccaugauauguucuc

SEQ ID NO: 34554 - RNA, 21 nt, Human
uuuuuagcaaaagcguccaga

SEQ ID NO: 34555 - RNA, 23 nt, Human
cauugcugagccuuacuggguug

SEQ ID NO: 34556 - RNA, 22 nt, Human
ucaugccacugcacccuagcuu

SEQ ID NO: 34557 - RNA, 21 nt, Human
ugggggugcgggggugucaug

SEQ ID NO: 34558 - RNA, 27 nt, Human
accuuaucagcuuccuguuucuuccca

SEQ ID NO: 34559 - RNA, 21 nt, Human
ccuuucuccaguuuuuguucc

SEQ ID NO: 34560 - RNA, 22 nt, Human
gggguuaggcuuuugagcuuga

SEQ ID NO: 34561 - RNA, 19 nt, Human
cuuggaauugugugcugcu

SEQ ID NO: 34562 - RNA, 19 nt, Human
augucuagcuuucaccucc

SEQ ID NO: 34563 - RNA, 20 nt, Human
gcuaaccuguaaucccagcu

SEQ ID NO: 34564 - RNA, 22 nt, Human
agucaucuccauccauccacag

SEQ ID NO: 34565 - RNA, 22 nt, Human
caggcuggguucccugugggca

SEQ ID NO: 34566 - RNA, 21 nt, Human
gagauguuuugacacaggcau

SEQ ID NO: 34567 - RNA, 21 nt, Human
uuagauggguguaguggcaca

SEQ ID NO: 34568 - RNA, 21 nt, Human
gagacaccaacauggagcccg

SEQ ID NO: 34569 - RNA, 24 nt, Human
ccaugaauggaugcaggaauugug

SEQ ID NO: 34570 - RNA, 19 nt, Human
gcagagcagggaguggaca

SEQ ID NO: 34571 - RNA, 23 nt, Human
gcagcaccugguagaagaaggca

SEQ ID NO: 34572 - RNA, 23 nt, Human
ugccuucaggaaauacaacuaac

SEQ ID NO: 34573 - RNA, 24 nt, Human
ugagcucgggugacugcagauuau

SEQ ID NO: 34574 - RNA, 21 nt, Human
ggguucugcuguccugugcca

SEQ ID NO: 34575 - RNA, 17 nt, Human
ucucucccucuccugca

SEQ ID NO: 34576 - RNA, 22 nt, Human
cacuugaacgugggaggcagag

SEQ ID NO: 34577 - RNA, 28 nt, Human
ugugagcucugguguucaaagaguccug

SEQ ID NO: 34578 - RNA, 27 nt, Human
ggggugagauaggggcagauaggagcu

SEQ ID NO: 34579 - RNA, 21 nt, Human
gagcgacucugugucccaggc

SEQ ID NO: 34580 - RNA, 24 nt, Human
gaggugcuuaagcagaagcauuaa

SEQ ID NO: 34581 - RNA, 22 nt, Human
gucacugugggacccagaucug

SEQ ID NO: 34582 - RNA, 19 nt, Human
aguuaggagaaauauuuca

SEQ ID NO: 34583 - RNA, 28 nt, Human
ugguccaaaaacagccuuaaaucaagaa

SEQ ID NO: 34584 - RNA, 20 nt, Human
ugcuguugguggcagugacu

SEQ ID NO: 34585 - RNA, 23 nt, Human
gccuauaaucccagcacuuuugg

SEQ ID NO: 34586 - RNA, 22 nt, Human
acgccugcaaucccagcacuuu

SEQ ID NO: 34587 - RNA, 28 nt, Human
ucagccggcccuggagugcgggcggggg

SEQ ID NO: 34588 - RNA, 20 nt, Human
gacaacuauucacccuaccu

SEQ ID NO: 34589 - RNA, 18 nt, Human
ucuuucuacuaaagcacu

SEQ ID NO: 34590 - RNA, 25 nt, Human
ugcugcucuccuugcuuucugagua

SEQ ID NO: 34591 - RNA, 21 nt, Human
ccucuugcaauuugggcauca

SEQ ID NO: 34592 - RNA, 27 nt, Human
uugcccagaaagacugucugggugaga

SEQ ID NO: 34593 - RNA, 18 nt, Human
gguggcuuuggggugggg

SEQ ID NO: 34594 - RNA, 24 nt, Human
cacagugcuuuuuaccacugugga

SEQ ID NO: 34595 - RNA, 22 nt, Human
acuauuuagucucagguucaag

SEQ ID NO: 34596 - RNA, 21 nt, Human
ccuucaguuucuuccuaggcc

SEQ ID NO: 34597 - RNA, 19 nt, Human
gcucugggagccacugccu

SEQ ID NO: 34598 - RNA, 29 nt, Human
cuuugauuuuuguaccauggaaauuguau

SEQ ID NO: 34599 - RNA, 22 nt, Human
uucucccuucucucuuuucuuc

SEQ ID NO: 34600 - RNA, 23 nt, Human
ccauaucuucuuuugugguacca

SEQ ID NO: 34601 - RNA, 22 nt, Human
gugacaaaagcacaaccauucu

SEQ ID NO: 34602 - RNA, 21 nt, Human
ccuugccccuaacccaaaaag

SEQ ID NO: 34603 - RNA, 23 nt, Human
auaagcugcccaaaugcacgcac

SEQ ID NO: 34604 - RNA, 22 nt, Human
uuauuaacuauggucucuuuca

SEQ ID NO: 34605 - RNA, 22 nt, Human
cucgcccgcgcccugcugcugu

SEQ ID NO: 34606 - RNA, 27 nt, Human
gaagugcuguuggagccgcugugguug

SEQ ID NO: 34607 - RNA, 20 nt, Human
cucaggcuggaguacagugg

SEQ ID NO: 34608 - RNA, 27 nt, Human
gagguuuggcuucuacaaaccaaggga

SEQ ID NO: 34609 - RNA, 19 nt, Human
gagaggauuaugcaaguga

SEQ ID NO: 34610 - RNA, 22 nt, Human
guauuuuuguuacaaaucuucu

SEQ ID NO: 34611 - RNA, 21 nt, Human
acauaaccuuuuuuacugccu

SEQ ID NO: 34612 - RNA, 19 nt, Human
cuaaaucuaaaacccagag

SEQ ID NO: 34613 - RNA, 24 nt, Human
uuucauccugcucagaaaaccaac

SEQ ID NO: 34614 - RNA, 23 nt, Human
ugguggugggcaccuguacuggg

SEQ ID NO: 34615 - RNA, 23 nt, Human
ucucccugccaugucccuugcca

SEQ ID NO: 34616 - RNA, 21 nt, Human
uugucuccccugguuugugaa

SEQ ID NO: 34617 - RNA, 22 nt, Human
agcaguuuuauaaaguccguca

SEQ ID NO: 34618 - RNA, 23 nt, Human
caacagcacuugaaaguuuuuca

SEQ ID NO: 34619 - RNA, 22 nt, Human
ccaagguucaugaguugccuga

SEQ ID NO: 34620 - RNA, 26 nt, Human
uucuccucagcuuggggcagccauug

SEQ ID NO: 34621 - RNA, 22 nt, Human
aaccaauuucaaaaauagacua

SEQ ID NO: 34622 - RNA, 21 nt, Human
ucauuaaaguucuagugaccg

SEQ ID NO: 34623 - RNA, 22 nt, Human
auuugguauuaaaaauuaaaug

SEQ ID NO: 34624 - RNA, 27 nt, Human
cuucugcucuggaccaguguuuccaua

SEQ ID NO: 34625 - RNA, 24 nt, Human
aaguccuugaucugccugucugug

SEQ ID NO: 34626 - RNA, 27 nt, Human
aacuauacaguaagcauuuguauuuuc

SEQ ID NO: 34627 - RNA, 26 nt, Human
cccacauuuuuucauuccuucucccu

SEQ ID NO: 34628 - RNA, 27 nt, Human
cucgugaaauucucacugaaagccaca

SEQ ID NO: 34629 - RNA, 24 nt, Human
gcagcguccuguguuggaaugugc

SEQ ID NO: 34630 - RNA, 27 nt, Human
uggaggucuaggugucugaagugccuu

SEQ ID NO: 34631 - RNA, 22 nt, Human
agcuuugcuaccaaagcaccuu

SEQ ID NO: 34632 - RNA, 23 nt, Human
uucagccuuucccugugcugccc

SEQ ID NO: 34633 - RNA, 21 nt, Human
cugggcccucucuucucaccu

SEQ ID NO: 34634 - RNA, 21 nt, Human
gagagcgagaccugggaggga

SEQ ID NO: 34635 - RNA, 17 nt, Human
ggccuugccccaccucc

SEQ ID NO: 34636 - RNA, 24 nt, Human
ugcuaucugcucugcucagcgacu

SEQ ID NO: 34637 - RNA, 24 nt, Human
gagggagggggcuccaugaaaggu

SEQ ID NO: 34638 - RNA, 21 nt, Human
cucacgcugcacacugcccag

SEQ ID NO: 34639 - RNA, 27 nt, Human
cuggucucucucauuacagccugggcc

SEQ ID NO: 34640 - RNA, 28 nt, Human
aaccuugacagaaaacuacuuugagucu

SEQ ID NO: 34641 - RNA, 22 nt, Human
gcaaucacacguggugaccuca

SEQ ID NO: 34642 - RNA, 22 nt, Human
gggcucagguuccaagacucag

SEQ ID NO: 34643 - RNA, 20 nt, Human
cccuuuauacagagaauucu

SEQ ID NO: 34644 - RNA, 21 nt, Human
cccuccugcaaccucucaccc

SEQ ID NO: 34645 - RNA, 19 nt, Human
gaggaaggaaugauaaugg

SEQ ID NO: 34646 - RNA, 19 nt, Human
uaacucaagaaaacucuag

SEQ ID NO: 34647 - RNA, 19 nt, Human
uauauguugaauguuaaca

SEQ ID NO: 34648 - RNA, 29 nt, Human
gccacaggccuggccucauauggcaugag

SEQ ID NO: 34649 - RNA, 25 nt, Human
uccaccuccagccucugguccuacc

SEQ ID NO: 34650 - RNA, 17 nt, Human
acccucucugugcuguc

SEQ ID NO: 34651 - RNA, 27 nt, Human
acugcaaccuccgccucccagauucaa

SEQ ID NO: 34652 - RNA, 23 nt, Human
cacuugcauuuccagucuuggcc

SEQ ID NO: 34653 - RNA, 19 nt, Human
gccaguauucuuuuauaaa

SEQ ID NO: 34654 - RNA, 23 nt, Human
uaggacuuuuaaagaugagccau

SEQ ID NO: 34655 - RNA, 28 nt, Human
cugcuccucccugggccugaaaguuccu

SEQ ID NO: 34656 - RNA, 22 nt, Human
caccacugcacuccagccuggg

SEQ ID NO: 34657 - RNA, 23 nt, Human
ccugcagcugugccguccacacc

SEQ ID NO: 34658 - RNA, 18 nt, Human
uuugguuuguuuccucuu

SEQ ID NO: 34659 - RNA, 20 nt, Human
caaaacacaggaagucaguc

SEQ ID NO: 34660 - RNA, 24 nt, Human
aagggagggaugggucuagggagu

SEQ ID NO: 34661 - RNA, 24 nt, Human
gugcaaugcauuaagaaacccauc

SEQ ID NO: 34662 - RNA, 27 nt, Human
cccuaaaacauguguugccugaaagca

SEQ ID NO: 34663 - RNA, 22 nt, Human
auuacagaugucauuucccagu

SEQ ID NO: 34664 - RNA, 21 nt, Human
uauaccaccucucaaccauua

SEQ ID NO: 34665 - RNA, 22 nt, Human
ucugaggucaggaguuugagac

SEQ ID NO: 34666 - RNA, 20 nt, Human
gaaagggugaugguacugga

SEQ ID NO: 34667 - RNA, 23 nt, Human
agccuaaggguugucccaccucg

SEQ ID NO: 34668 - RNA, 21 nt, Human
uauuauaauuggaagugcagu

SEQ ID NO: 34669 - RNA, 24 nt, Human
uacuuugcaaagaaggaagauggu

SEQ ID NO: 34670 - RNA, 22 nt, Human
gcccaggcaagagugcaguggu

SEQ ID NO: 34671 - RNA, 22 nt, Human
ugaccucauaauaaagacugug

SEQ ID NO: 34672 - RNA, 28 nt, Human
ccugguucuguauugaggagaaggaugu

SEQ ID NO: 34673 - RNA, 21 nt, Human
ccuguaaucccagcacugugg

SEQ ID NO: 34674 - RNA, 21 nt, Human
ggugcucugaccacacccagc

SEQ ID NO: 34675 - RNA, 22 nt, Human
cacuacugcacuccagccuggg

SEQ ID NO: 34676 - RNA, 22 nt, Human
caccauugcacccuagccuggg

SEQ ID NO: 34677 - RNA, 23 nt, Human
cgcuaccccgucccccuccagac

SEQ ID NO: 34678 - RNA, 22 nt, Human
cacugcaauccagccugggcga

SEQ ID NO: 34679 - RNA, 19 nt, Human
agagugcccaggaggcagg

SEQ ID NO: 34680 - RNA, 22 nt, Human
gucacccagacuggagugcagg

SEQ ID NO: 34681 - RNA, 22 nt, Human
agccucucccacccggccacag

SEQ ID NO: 34682 - RNA, 19 nt, Human
cugccaccuggucugccac

SEQ ID NO: 34683 - RNA, 22 nt, Human
acucuucccucucccugccuca

SEQ ID NO: 34684 - RNA, 22 nt, Human
ccagaucacacaucaucaucga

SEQ ID NO: 34685 - RNA, 27 nt, Human
ccagcacugacucacuccugccuggga

SEQ ID NO: 34686 - RNA, 24 nt, Human
ucucaccucagcucccgagcagcu

SEQ ID NO: 34687 - RNA, 20 nt, Human
ugggauuugggaaaggugaa

SEQ ID NO: 34688 - RNA, 27 nt, Human
cacaggcauuaucucugcaauuuuaga

SEQ ID NO: 34689 - RNA, 23 nt, Human
ccuuucccaccauuccugccuuu

SEQ ID NO: 34690 - RNA, 23 nt, Human
ucaugaaagaguauuuggcugaa

SEQ ID NO: 34691 - RNA, 21 nt, Human
ugcccuucuuguugcuccugu

SEQ ID NO: 34692 - RNA, 20 nt, Human
ccucuacugcccugaggacu

SEQ ID NO: 34693 - RNA, 20 nt, Human
cgccccgccuggaguggaug

SEQ ID NO: 34694 - RNA, 29 nt, Human
uucccaugccagcucuccccaagugcucc

SEQ ID NO: 34695 - RNA, 18 nt, Human
agauuauguccucacuua

SEQ ID NO: 34696 - RNA, 32 nt, Human; identical to SEQ ID NO: 6074

SEQ ID NO: 34697 - RNA, 23 nt, Human
gguuaugauuauuucaacacaau

SEQ ID NO: 34698 - RNA, 21 nt, Human
uauucagaggaguaagauggu

SEQ ID NO: 34699 - RNA, 22 nt, Human
ggcccggaggucccaagguccc

SEQ ID NO: 34700 - RNA, 26 nt, Human
ccugcucugccacugggacggcuccu

SEQ ID NO: 34701 - RNA, 22 nt, Human
ggccuugagacuugaaaccaga

SEQ ID NO: 34702 - RNA, 21 nt, Human
cugcccauuugggccugcaua

SEQ ID NO: 34703 - RNA, 22 nt, Human
uugaucccuguugggggugggg

SEQ ID NO: 34704 - RNA, 21 nt, Human
gcaaucccaggcuggggucag

SEQ ID NO: 34705 - RNA, 22 nt, Human
ggcagcgaaacggaacagucgg

SEQ ID NO: 34706 - RNA, 22 nt, Human
cauuccccucuucccucaagac

SEQ ID NO: 34707 - RNA, 22 nt, Human
ccaccgcacccagccuacaaua

SEQ ID NO: 34708 - RNA, 25 nt, Human
cucauuucugucgcucacgugccca

SEQ ID NO: 34709 - RNA, 27 nt, Human
ucccacauacuaggugcucaauucaug

SEQ ID NO: 34710 - RNA, 22 nt, Human
gagccagagggaaucaauuccc

SEQ ID NO: 34711 - RNA, 22 nt, Human
ccacagcucuccagccugggcg

SEQ ID NO: 34712 - RNA, 26 nt, Human
gcugccucuccagcggcuugggccgg

SEQ ID NO: 34713 - RNA, 20 nt, Human
guggcaccagaguaacucua

SEQ ID NO: 34714 - RNA, 26 nt, Human
cucacacacagauuuuuauguuuucu

SEQ ID NO: 34715 - RNA, 21 nt, Human
ggucuguccuaggagcuguau

SEQ ID NO: 34716 - RNA, 24 nt, Human
ucugccuggcucgaugucugcuuc

SEQ ID NO: 34717 - RNA, 20 nt, Human
uuagaccuguagauagugau

SEQ ID NO: 34718 - RNA, 22 nt, Human
cucagaauccuggugccuugaa

SEQ ID NO: 34719 - RNA, 19 nt, Human
cacugccuaucgcuugucu

SEQ ID NO: 34720 - RNA, 26 nt, Human
ccaccguacccagccuggucccauau

SEQ ID NO: 34721 - RNA, 21 nt, Human
ggccucgggccucccuucucc

SEQ ID NO: 34722 - RNA, 21 nt, Human
gcagcuugugauuucuuccag

SEQ ID NO: 34723 - RNA, 25 nt, Human
uaaugagcucacaucgugucugaag

SEQ ID NO: 34724 - RNA, 27 nt, Human
ggucaucuuuuucucuaaaauagccac

SEQ ID NO: 34725 - RNA, 23 nt, Human
uucaauaacagauggugcugcua

SEQ ID NO: 34726 - RNA, 23 nt, Human
gaggccuuuagccucugaaugau

SEQ ID NO: 34727 - RNA, 22 nt, Human
ccccucccacacacacccacac

SEQ ID NO: 34728 - RNA, 22 nt, Human
ucuuaaaacuuacucagcuggu

SEQ ID NO: 34729 - RNA, 22 nt, Human
gugaaucggagaggucccacug

SEQ ID NO: 34730 - RNA, 27 nt, Human
ccacagcuguaugauucccagccagac

SEQ ID NO: 34731 - RNA, 19 nt, Human
gccccugaauuaagcagaa

SEQ ID NO: 34732 - RNA, 23 nt, Human
ccuccucgccacuccugcucuuu

SEQ ID NO: 34733 - RNA, 22 nt, Human
caugaggucagggguucaagac

SEQ ID NO: 34734 - RNA, 30 nt, Human
uagccagugaaaaacuauuaacaacuuguc

SEQ ID NO: 34735 - RNA, 22 nt, Human
gcucacugcauccuccgccucc

SEQ ID NO: 34736 - RNA, 25 nt, Human
uuucuucaugacccugcccuugcca

SEQ ID NO: 34737 - RNA, 23 nt, Human
gucucucuggcucucuggcauuc

SEQ ID NO: 34738 - RNA, 27 nt, Human
gaccagccuggccaacaugguaaaauc

SEQ ID NO: 34739 - RNA, 24 nt, Human
agaaaaugagaaaggacagagcca

SEQ ID NO: 34740 - RNA, 22 nt, Human
aguggcaugaucucggcucacu

SEQ ID NO: 34741 - RNA, 22 nt, Human
aguggcgugaucucagcucacu

SEQ ID NO: 34742 - RNA, 22 nt, Human
gcuuggcugggagagauggaug

SEQ ID NO: 34743 - RNA, 26 nt, Human
ugcugccccucuccccuaccuggccc

SEQ ID NO: 34744 - RNA, 22 nt, Human
cuugagcuccuuuucacuccug

SEQ ID NO: 34745 - RNA, 20 nt, Human
ucgagcucccgccaucccag

SEQ ID NO: 34746 - RNA, 22 nt, Human
aaaccugauucucccuccagcu

SEQ ID NO: 34747 - RNA, 22 nt, Human
agagugcagggauuacaggcgu

SEQ ID NO: 34748 - RNA, 19 nt, Human
ugcuccaccucucuguauc

SEQ ID NO: 34749 - RNA, 24 nt, Human
gccgaaucucuuuuucuagcuuug

SEQ ID NO: 34750 - RNA, 28 nt, Human
aagaauucuaucaucacaaaaauaauuc

SEQ ID NO: 34751 - RNA, 23 nt, Human
uugcccaggcuggucuugaaccc

SEQ ID NO: 34752 - RNA, 21 nt, Human
accugccuguccuuccugggc

SEQ ID NO: 34753 - RNA, 27 nt, Human
gggagagaaggggagugcggagccccg

SEQ ID NO: 34754 - RNA, 21 nt, Human
gagagggacagaaggggcggu

SEQ ID NO: 34755 - RNA, 22 nt, Human
aggcugaggcaggaggaucgcc

SEQ ID NO: 34756 - RNA, 21 nt, Human
uugcuguuucuccucugacca

SEQ ID NO: 34757 - RNA, 22 nt, Human
aaaugcacguagcugaggccgg

SEQ ID NO: 34758 - RNA, 27 nt, Human
cacuccaggcugggugacagagcgaga

SEQ ID NO: 34759 - RNA, 21 nt, Human
auauuuacagaagaaaagcau

SEQ ID NO: 34760 - RNA, 21 nt, Human
aggaggcaagguucucagggg

SEQ ID NO: 34761 - RNA, 22 nt, Human
cacucacugaagauccuauuau

SEQ ID NO: 34762 - RNA, 19 nt, Human
agaaccaggaaacuagcug

SEQ ID NO: 34763 - RNA, 21 nt, Human
gccggcgcgcaccugcccgca

SEQ ID NO: 34764 - RNA, 21 nt, Human
ccugccgcccugccgcccugc

SEQ ID NO: 34765 - RNA, 21 nt, Human
acugagccacgcagccccgcc

SEQ ID NO: 34766 - RNA, 25 nt, Human
acaaagcaugucuuugaguaacaau

SEQ ID NO: 34767 - RNA, 25 nt, Human
aguuuuuccuggaauugccagcuga

SEQ ID NO: 34768 - RNA, 26 nt, Human
cccuccaguguccccggagcugaaag

SEQ ID NO: 34769 - RNA, 22 nt, Human
ugugacucugggcaagucacuc

SEQ ID NO: 34770 - RNA, 22 nt, Human
acugcaacuuccgccucccggg

SEQ ID NO: 34771 - RNA, 26 nt, Human
gcgccuccugggccacuggcccagcc

SEQ ID NO: 34772 - RNA, 20 nt, Human
ugauccagagacauguggca

SEQ ID NO: 34773 - RNA, 22 nt, Human
gcuucuaaucccagcacuuugg

SEQ ID NO: 34774 - RNA, 24 nt, Human
cacaugcugaucuauuggggaaca

SEQ ID NO: 34775 - RNA, 24 nt, Human
cugggccuccauggccccaaaaac

SEQ ID NO: 34776 - RNA, 26 nt, Human
cggcucuuccuuuuaggaaggcucug

SEQ ID NO: 34777 - RNA, 25 nt, Human
cucauuuccauuccacuauuuccca

SEQ ID NO: 34778 - RNA, 27 nt, Human
ucccagccaaguccaagagggcagggc

SEQ ID NO: 34779 - RNA, 21 nt, Human
ucaccuuccuccucugcucug

SEQ ID NO: 34780 - RNA, 19 nt, Human
acaggcuggagugcagugg

SEQ ID NO: 34781 - RNA, 24 nt, Human
ggccccagccuccaucuucgucuc

SEQ ID NO: 34782 - RNA, 27 nt, Human
uucauuucucuucaccauguauccugc

SEQ ID NO: 34783 - RNA, 22 nt, Human
agccucucgaguagcugggacc

SEQ ID NO: 34784 - RNA, 26 nt, Human
gccagguggacuguggcagaucaaua

SEQ ID NO: 34785 - RNA, 22 nt, Human
uucucucuugauccuacaaaca

SEQ ID NO: 34786 - RNA, 21 nt, Human
uacaugucauggagugcauug

SEQ ID NO: 34787 - RNA, 27 nt, Human
uacaugaaagaacucaucauggagaaa

SEQ ID NO: 34788 - RNA, 24 nt, Human
cugccucccaggcucaagcacuuu

SEQ ID NO: 34789 - RNA, 22 nt, Human
gcccugacuccuggacuccgga

SEQ ID NO: 34790 - RNA, 18 nt, Human
agagugagacacagcagg

SEQ ID NO: 34791 - RNA, 22 nt, Human
aguggugugaucccagcucacu

SEQ ID NO: 34792 - RNA, 22 nt, Human
ugccccuugcuggccgcccuca

SEQ ID NO: 34793 - RNA, 27 nt, Human
ucuccuggguguguuuggcuuggccuu

SEQ ID NO: 34794 - RNA, 22 nt, Human
agcuggucacugaaaugagccu

SEQ ID NO: 34795 - RNA, 26 nt, Human
ucaccuaggcuggagugcagcggcau

SEQ ID NO: 34796 - RNA, 20 nt, Human
agaguguuguuuuuuauuca

SEQ ID NO: 34797 - RNA, 21 nt, Human
aucacccaggcuggagugcag

SEQ ID NO: 34798 - RNA, 26 nt, Human
uaccugucuccuuucucagccacaaa

SEQ ID NO: 34799 - RNA, 26 nt, Human
aguugagugucaggggacaugaugag

SEQ ID NO: 34800 - RNA, 19 nt, Human
ggaaaaagaaacugccuau

SEQ ID NO: 34801 - RNA, 26 nt, Human
uugagacggagucucgcucugucauc

SEQ ID NO: 34802 - RNA, 26 nt, Human
cugagacagagucucacucugucacc

SEQ ID NO: 34803 - RNA, 24 nt, Human
ucggauggauuuggaaguuggaau

SEQ ID NO: 34804 - RNA, 21 nt, Human
accuguaaugccagcacuuug

SEQ ID NO: 34805 - RNA, 20 nt, Human
agaggaagaauuuguuauca

SEQ ID NO: 34806 - RNA, 23 nt, Human
uggccuuauggggauccuggagc

SEQ ID NO: 34807 - RNA, 21 nt, Human
uuuaaaaugaagugcuuucca

SEQ ID NO: 34808 - RNA, 25 nt, Human
gcuguauuaacacaucacuugcugu

SEQ ID NO: 34809 - RNA, 27 nt, Human
aaggccauggaugaagaugggcuugaa

SEQ ID NO: 34810 - RNA, 23 nt, Human
uccaaaagugcugggauuacagg

SEQ ID NO: 34811 - RNA, 21 nt, Human
aucuccauggcuuccuccucc

SEQ ID NO: 34812 - RNA, 22 nt, Human
acuuaggacaauggagacuuuu

SEQ ID NO: 34813 - RNA, 25 nt, Human
gggaagagagugagggacagaggaa

SEQ ID NO: 34814 - RNA, 25 nt, Human
ugaaaacaaaggccagauucugcca

SEQ ID NO: 34815 - RNA, 18 nt, Human
cucugcugagcugggccc

SEQ ID NO: 34816 - RNA, 27 nt, Human
gauuacaucaucugcuguaacaacugc

SEQ ID NO: 34817 - RNA, 24 nt, Human
uaaacaaugcaauucuguguggua

SEQ ID NO: 34818 - RNA, 19 nt, Human
cuugcugucucucagaauu

SEQ ID NO: 34819 - RNA, 26 nt, Human
uucaugccauucuccugccucagccu

SEQ ID NO: 34820 - RNA, 27 nt, Human
cacuguacuccagccuggacaacagcg

SEQ ID NO: 34821 - RNA, 24 nt, Human
uggacauuaaccccugaggcucca

SEQ ID NO: 34822 - RNA, 24 nt, Human
accacagaacauggaucuauuaaa

SEQ ID NO: 34823 - RNA, 16 nt, Human
uagguguccaugcaga

SEQ ID NO: 34824 - RNA, 23 nt, Human
agcuaauuuuuaaguuuucuugu

SEQ ID NO: 34825 - RNA, 22 nt, Human
acugcuguuccuccaguuccau

SEQ ID NO: 34826 - RNA, 19 nt, Human
auauucuccaugggccugu

SEQ ID NO: 34827 - RNA, 27 nt, Human
ccagcuccgugugaugcccaguaaagc

SEQ ID NO: 34828 - RNA, 23 nt, Human
ugguuaucaugcaguugcaguga

SEQ ID NO: 34829 - RNA, 22 nt, Human
auggauggcugcuggaaacccc

SEQ ID NO: 34830 - RNA, 22 nt, Human
ucuccaaugaaaccaucaguag

SEQ ID NO: 34831 - RNA, 23 nt, Human
aaaaggcagggaguuaauaacau

SEQ ID NO: 34832 - RNA, 21 nt, Human
gacuuuccuccuucccgccug

SEQ ID NO: 34833 - RNA, 23 nt, Human
ggagagugaacugacagacucag

SEQ ID NO: 34834 - RNA, 21 nt, Human
ccugguuauauguaaugugau

SEQ ID NO: 34835 - RNA, 23 nt, Human
gccaugccauuguaaauuguuag

SEQ ID NO: 34836 - RNA, 22 nt, Human
cgcaucccagguucaagcgauu

SEQ ID NO: 34837 - RNA, 23 nt, Human
caggacggccucugugcugcugg

SEQ ID NO: 34838 - RNA, 26 nt, Human
uagaaacacugggacagugguuugaa

SEQ ID NO: 34839 - RNA, 22 nt, Human
agccucuuucauagugugcaaa

SEQ ID NO: 34840 - RNA, 28 nt, Human
gaugcacagccaccucagccagccccca

SEQ ID NO: 34841 - RNA, 27 nt, Human
ggccaucugucuccuguauguggguca

SEQ ID NO: 34842 - RNA, 27 nt, Human
cugagauauggacucucuaaggaaggg

SEQ ID NO: 34843 - RNA, 23 nt, Human
cugugccaggcugaauuacagug

SEQ ID NO: 34844 - RNA, 20 nt, Human
accaccuucucaacacugcu

SEQ ID NO: 34845 - RNA, 25 nt, Human
cauuccccuucuacuaccgacaucc

SEQ ID NO: 34846 - RNA, 27 nt, Human
gugucaggcuacacauaaaagccacuu

SEQ ID NO: 34847 - RNA, 24 nt, Human
cugagauauuuauuguuuauuuau

SEQ ID NO: 34848 - RNA, 22 nt, Human
gugacacacgcugaguggggug

SEQ ID NO: 34849 - RNA, 23 nt, Human
cucuuaaaacuguaacuggccuu

SEQ ID NO: 34850 - RNA, 24 nt, Human
uuaaaagccuuaacuguuaguuau

SEQ ID NO: 34851 - RNA, 21 nt, Human
uucaagcaauuuccugccuca

SEQ ID NO: 34852 - RNA, 26 nt, Human
ucugacuacucuugucuuccucucuc

SEQ ID NO: 34853 - RNA, 22 nt, Human
uggcucaugucuauaaucccag

SEQ ID NO: 34854 - RNA, 24 nt, Human
ccacacugcacacagugacuuccu

SEQ ID NO: 34855 - RNA, 23 nt, Human
cugggucugcccaccucuugggc

SEQ ID NO: 34856 - RNA, 26 nt, Human
ugcuaccuugugacccagcacugccc

SEQ ID NO: 34857 - RNA, 21 nt, Human
caaacacacacaucucacuca

SEQ ID NO: 34858 - RNA, 17 nt, Human
cuuugugccucaguuua

SEQ ID NO: 34859 - RNA, 20 nt, Human
cccugcucacucccggggcc

SEQ ID NO: 34860 - RNA, 32 nt, Human
uuuucuuucuuuucuuuuuuaaaguaaacuug

SEQ ID NO: 34861 - RNA, 29 nt, Human
ugccgucauccaggcuggacaguucagug

SEQ ID NO: 34862 - RNA, 23 nt, Human
caggaauaugagacgugcacuga

SEQ ID NO: 34863 - RNA, 19 nt, Human
ucugucccugucccugccc

SEQ ID NO: 34864 - RNA, 21 nt, Human
uccugucuuaugguccagaaa

SEQ ID NO: 34865 - RNA, 22 nt, Human
gaccagccugggcaacaaagug

SEQ ID NO: 34866 - RNA, 21 nt, Human
cuggagcagagagcaugggcc

SEQ ID NO: 34867 - RNA, 29 nt, Human
ccagggggaaagggagcaagaguugucca

SEQ ID NO: 34868 - RNA, 24 nt, Human
ucuggguauacuaccagucacaga

SEQ ID NO: 34869 - RNA, 21 nt, Human
guuugaagguaacugagagca

SEQ ID NO: 34870 - RNA, 27 nt, Human
gccccuacaggcuggcccugcaauggg

SEQ ID NO: 34871 - RNA, 23 nt, Human
gguccgugugggcuuccaccuca

SEQ ID NO: 34872 - RNA, 21 nt, Human
gccacacacccauuuuccuca

SEQ ID NO: 34873 - RNA, 21 nt, Human
cuccaacauggaggaaacgca

SEQ ID NO: 34874 - RNA, 18 nt, Human
aaacauaucaucucuuca

SEQ ID NO: 34875 - RNA, 18 nt, Human
gacaagaagucugucaug

SEQ ID NO: 34876 - RNA, 21 nt, Human
ccuaaaauggugagcgagagu

SEQ ID NO: 34877 - RNA, 28 nt, Human
acagcugagucccugaugucauccuuac

SEQ ID NO: 34878 - RNA, 23 nt, Human
ucagcucugccucuguccucuuu

SEQ ID NO: 34879 - RNA, 23 nt, Human
ccauccaucugugucugucuguu

SEQ ID NO: 34880 - RNA, 24 nt, Human
ggcaggaccauacagaguguggga

SEQ ID NO: 34881 - RNA, 29 nt, Human
agacucaaggccuccagccacuuauuucc

SEQ ID NO: 34882 - RNA, 22 nt, Human
ccaggagcaagcucaccaggcc

SEQ ID NO: 34883 - RNA, 27 nt, Human
guauuugcacuauuuugggagcaaguu

SEQ ID NO: 34884 - RNA, 23 nt, Human
uagucccauuugacucacuucag

SEQ ID NO: 34885 - RNA, 22 nt, Human
uguuacagaguaacuucacaua

SEQ ID NO: 34886 - RNA, 23 nt, Human
caaucagaugagaacaacagaug

SEQ ID NO: 34887 - RNA, 22 nt, Human
cccaaggugcuaggauuacagg

SEQ ID NO: 34888 - RNA, 25 nt, Human
ccucuguuuagaauaccuacguaug

SEQ ID NO: 34889 - RNA, 25 nt, Human
gagggagggggaaaaggugucuagc

SEQ ID NO: 34890 - RNA, 23 nt, Human
cuggcucuuccccaucuaggccu

SEQ ID NO: 34891 - RNA, 22 nt, Human
gauuugacucaguuugcucacu

SEQ ID NO: 34892 - RNA, 27 nt, Human
uaaucugaauauuccauaaauaagcac

SEQ ID NO: 34893 - RNA, 19 nt, Human
agcacaccacugcaugucu

SEQ ID NO: 34894 - RNA, 24 nt, Human
ugguugucauuuggcaaaggagau

SEQ ID NO: 34895 - RNA, 19 nt, Human
ccuaacuuuucacacaucc

SEQ ID NO: 34896 - RNA, 19 nt, Human
ccugccugccugucucuag

SEQ ID NO: 34897 - RNA, 22 nt, Human
ccuucauuuuacauucugucug

SEQ ID NO: 34898 - RNA, 26 nt, Human
cggcuugccauuuucuuaguguuuuu

SEQ ID NO: 34899 - RNA, 22 nt, Human
aggaagaaucaguaaucacuuu

SEQ ID NO: 34900 - RNA, 26 nt, Human
caggaggcagacuguugggggaugug

SEQ ID NO: 34901 - RNA, 22 nt, Human
ugccauucaggaauucugagug

SEQ ID NO: 34902 - RNA, 22 nt, Human
cucaggccagacuccccugggc

SEQ ID NO: 34903 - RNA, 21 nt, Human
uggaaacuuccuucaaacugc

SEQ ID NO: 34904 - RNA, 25 nt, Human
gccauuggugacccaaagaugauga

SEQ ID NO: 34905 - RNA, 22 nt, Human
uccuauaaucccaauauuuugg

SEQ ID NO: 34906 - RNA, 24 nt, Human
ugagugugaagauggugguuagca

SEQ ID NO: 34907 - RNA, 26 nt, Human
aguuugaauagaauacauuauaccuc

SEQ ID NO: 34908 - RNA, 27 nt, Human
cagucucuaccauaucuggucccauca

SEQ ID NO: 34909 - RNA, 31 nt, Human
aagauuucugccuguuuggacaauagguuuu

SEQ ID NO: 34910 - RNA, 21 nt, Human
aucuggagcaacagcugggaa

SEQ ID NO: 34911 - RNA, 18 nt, Human
ccagaagcaggaguguga

SEQ ID NO: 34912 - RNA, 26 nt, Human
gcagcugagggccaggaaagauguga

SEQ ID NO: 34913 - RNA, 19 nt, Human
acagccuggcaucuucuug

SEQ ID NO: 34914 - RNA, 26 nt, Human
gccuggcagaacauaccacugaacua

SEQ ID NO: 34915 - RNA, 27 nt, Human
cacugugcuccagccugggcaacagag

SEQ ID NO: 34916 - RNA, 29 nt, Human
cuuuguuguauuuuccaugauguuucuua

SEQ ID NO: 34917 - RNA, 23 nt, Human
uucauuucucaguauauauuuca

SEQ ID NO: 34918 - RNA, 21 nt, Human
acagaucucucugcucaucau

SEQ ID NO: 34919 - RNA, 22 nt, Human
gagaucuaaguguggaucuucu

SEQ ID NO: 34920 - RNA, 23 nt, Human
ccacuggccccuggccugccgga

SEQ ID NO: 34921 - RNA, 27 nt, Human
ccaacauuccucauucuaggauccuag

SEQ ID NO: 34922 - RNA, 26 nt, Human
gaagcagcagcgaauggcaauggguu

SEQ ID NO: 34923 - RNA, 21 nt, Human
uuuguguaggugucugccuuc

SEQ ID NO: 34924 - RNA, 23 nt, Human
gcugggggaaugagcccagagaa

SEQ ID NO: 34925 - RNA, 21 nt, Human
gcucagugcaaccucugccuc

SEQ ID NO: 34926 - RNA, 22 nt, Human
ugcuuguaaucccagcacuuug

SEQ ID NO: 34927 - RNA, 22 nt, Human
ugccuguaaucccagcacucug

SEQ ID NO: 34928 - RNA, 22 nt, Human
ugccuguaaucucagcacuuug

SEQ ID NO: 34929 - RNA, 25 nt, Human
agguccgagaucggggguuggagug

SEQ ID NO: 34930 - RNA, 27 nt, Human
gacugggugacagagugagacuccauc

SEQ ID NO: 34931 - RNA, 21 nt, Human
uccuggacuucauccugggug

SEQ ID NO: 34932 - RNA, 22 nt, Human
gcuucucuguccgcccuucaca

SEQ ID NO: 34933 - RNA, 21 nt, Human
cuccucagcucucucaucucc

SEQ ID NO: 34934 - RNA, 22 nt, Human
agcccaggcuggagugcaaugg

SEQ ID NO: 34935 - RNA, 26 nt, Human
aagacaccuucgaauuaagcacauuc

SEQ ID NO: 34936 - RNA, 21 nt, Human
guucagagcaugggugcucug

SEQ ID NO: 34937 - RNA, 27 nt, Human
gcuccgagcgugggucuccgcccagcu

SEQ ID NO: 34938 - RNA, 21 nt, Human
aaggcauucuuguuagcuuug

SEQ ID NO: 34939 - RNA, 20 nt, Human
uucuggguugcuuguuuuuu

SEQ ID NO: 34940 - RNA, 26 nt, Human
cauguaugagaaccaaaaaacagcug

SEQ ID NO: 34941 - RNA, 20 nt, Human
ggcucacugcaaccucgccu

SEQ ID NO: 34942 - RNA, 27 nt, Human
aggguucccagcaccaugagggccugg

SEQ ID NO: 34943 - RNA, 23 nt, Human
uugaggcacacagaggggcuugu

SEQ ID NO: 34944 - RNA, 21 nt, Human
gcccucaugaucauucucagu

SEQ ID NO: 34945 - RNA, 23 nt, Human
cauauccaacaugugcucaggga

SEQ ID NO: 34946 - RNA, 19 nt, Human
auguuggguggcuuuuguu

SEQ ID NO: 34947 - RNA, 26 nt, Human
cuuagccaugggcugggcucaagaac

SEQ ID NO: 34948 - RNA, 22 nt, Human
ggucaucuguaccucugccucc

SEQ ID NO: 34949 - RNA, 27 nt, Human
ugcacuucagucugugugacugagcaa

SEQ ID NO: 34950 - RNA, 23 nt, Human
ugucgccaggcuggagugcagug

SEQ ID NO: 34951 - RNA, 22 nt, Human
gcucuuuuugcuuucauggccc

SEQ ID NO: 34952 - RNA, 23 nt, Human
ugcguccuccuucagcugccccu

SEQ ID NO: 34953 - RNA, 22 nt, Human
cugcagccucagagacaucagc

SEQ ID NO: 34954 - RNA, 18 nt, Human
ccagaacucuggucucca

SEQ ID NO: 34955 - RNA, 21 nt, Human
uuugacugaagaugcagcuca

SEQ ID NO: 34956 - RNA, 18 nt, Human
agccaaaggcaaugggaa

SEQ ID NO: 34957 - RNA, 21 nt, Human
gcauuuggcuggagcccggug

SEQ ID NO: 34958 - RNA, 22 nt, Human
aucaguccucgcggcucuccag

SEQ ID NO: 34959 - RNA, 22 nt, Human
gagcccaggaguuugaggguga

SEQ ID NO: 34960 - RNA, 27 nt, Human
uucauuucugucacauuucauuucuug

SEQ ID NO: 34961 - RNA, 21 nt, Human
agccauccucccuccaccuca

SEQ ID NO: 34962 - RNA, 26 nt, Human
ugccuucagcucuacagcuaaucagc

SEQ ID NO: 34963 - RNA, 31 nt, Human
gcuguccuugcuugugccugccucuuucacu

SEQ ID NO: 34964 - RNA, 21 nt, Human
cugccgcucuggcuugccgcc

SEQ ID NO: 34965 - RNA, 20 nt, Human
cucuccucagguugcuuguc

SEQ ID NO: 34966 - RNA, 22 nt, Human
gguucauugcaaccuccgccuc

SEQ ID NO: 34967 - RNA, 25 nt, Human
agccuaccucauacucucaagccag

SEQ ID NO: 34968 - RNA, 22 nt, Human
ucugauauaggugagucuugug

SEQ ID NO: 34969 - RNA, 18 nt, Human
uugucaugggggaacugc

SEQ ID NO: 34970 - RNA, 26 nt, Human
gguguuuggcacccaaaucacaucuc

SEQ ID NO: 34971 - RNA, 19 nt, Human
aauguaguuuucccgccuu

SEQ ID NO: 34972 - RNA, 21 nt, Human
gacccagccccuuuuccucca

SEQ ID NO: 34973 - RNA, 19 nt, Human
aaacucauuuauugaguca

SEQ ID NO: 34974 - RNA, 26 nt, Human
gaguguaaguuuggauuuucaacuug

SEQ ID NO: 34975 - RNA, 24 nt, Human
auucaugaguccauguggccaagu

SEQ ID NO: 34976 - RNA, 21 nt, Human
ucccucacuggcucucaggag

SEQ ID NO: 34977 - RNA, 22 nt, Human
aggcgccuccuagaccuccucg

SEQ ID NO: 34978 - RNA, 25 nt, Human
uccuugagacucuuuagcauucaua

SEQ ID NO: 34979 - RNA, 23 nt, Human
uucuuugaaauucauaguuuaca

SEQ ID NO: 34980 - RNA, 22 nt, Human
uaggcccgccucaacaacccag

SEQ ID NO: 34981 - RNA, 22 nt, Human
cgcucagccuggagugcaguga

SEQ ID NO: 34982 - RNA, 23 nt, Human
gccagggcucucuggaugccuuc

SEQ ID NO: 34983 - RNA, 22 nt, Human
caaguuaauggucuguggaucc

SEQ ID NO: 34984 - RNA, 21 nt, Human
aaaaucuaaaaauuagcuggg

SEQ ID NO: 34985 - RNA, 20 nt, Human
aggauuuucacacccccucc

SEQ ID NO: 34986 - RNA, 26 nt, Human
cccuacagacuugcugugugaccuca

SEQ ID NO: 34987 - RNA, 21 nt, Human
cuucugcuucagccucccgag

SEQ ID NO: 34988 - RNA, 20 nt, Human
ucuaguauuuuuguuacuuu

SEQ ID NO: 34989 - RNA, 24 nt, Human
uguuuuuauaaaaauuauucccua

SEQ ID NO: 34990 - RNA, 23 nt, Human
cacagccuugaugaucucaggga

SEQ ID NO: 34991 - RNA, 21 nt, Human
agauucaagaaagaagaucag

SEQ ID NO: 34992 - RNA, 20 nt, Human
agagagacacuugcuuucca

SEQ ID NO: 34993 - RNA, 26 nt, Human
augaaacuugguuaggauggcugggg

SEQ ID NO: 34994 - RNA, 27 nt, Human
cacaagucuguggggcaagaggcugca

SEQ ID NO: 34995 - RNA, 19 nt, Human
auauucuguacuguguaca

SEQ ID NO: 34996 - RNA, 27 nt, Human
uccuagaggagaggaaagggagucauu

SEQ ID NO: 34997 - RNA, 22 nt, Human
uauuccgauaaucucaugaagc

SEQ ID NO: 34998 - RNA, 21 nt, Human
ggggaaagagaggugggggga

SEQ ID NO: 34999 - RNA, 23 nt, Human
gcgaagugacucccuuaccgccg

SEQ ID NO: 35000 - RNA, 23 nt, Human
uaccccugcuuguaccucuggca

SEQ ID NO: 35001 - RNA, 24 nt, Human
uagguguuucgucucccacccauu

SEQ ID NO: 35002 - RNA, 21 nt, Human
gccagggagagcagggacagu

SEQ ID NO: 35003 - RNA, 25 nt, Human
agucaucuuuguaugucuuuagcag

SEQ ID NO: 35004 - RNA, 25 nt, Human
cggggacacaccuguguccuccuca

SEQ ID NO: 35005 - RNA, 22 nt, Human
gcucacugcaacccccaucucc

SEQ ID NO: 35006 - RNA, 27 nt, Human
uugccggugccuaggauugugccugua

SEQ ID NO: 35007 - RNA, 20 nt, Human
uguggacaggagcugggacc

SEQ ID NO: 35008 - RNA, 22 nt, Human
gcccaccagccuugcucucuuc

SEQ ID NO: 35009 - RNA, 20 nt, Human
ugaaacaagugcaagggagg

SEQ ID NO: 35010 - RNA, 22 nt, Human
cccugggacaggcacaggcugg

SEQ ID NO: 35011 - RNA, 25 nt, Human
agacugccagaauccagacaauugg

SEQ ID NO: 35012 - RNA, 23 nt, Human
uauuccuggccauacucaggggu

SEQ ID NO: 35013 - RNA, 20 nt, Human
ggggaguguggcagggagga

SEQ ID NO: 35014 - RNA, 22 nt, Human
uuuccaaaaagaguaauaguug

SEQ ID NO: 35015 - RNA, 27 nt, Human
gcagcagggaggaaaguccccagaaau

SEQ ID NO: 35016 - RNA, 25 nt, Human
acacuucucaagauuugacuggauc

SEQ ID NO: 35017 - RNA, 22 nt, Human
gauaaucuccccuuugguuucc

SEQ ID NO: 35018 - RNA, 29 nt, Human
cuguaccuguuuccuacagacacccaucg

SEQ ID NO: 35019 - RNA, 20 nt, Human
ucuuaacugaggcucaggcc

SEQ ID NO: 35020 - RNA, 22 nt, Human
aacuauuaaaaugaaugagcuu

SEQ ID NO: 35021 - RNA, 19 nt, Human
gggggcagcuaaaugugau

SEQ ID NO: 35022 - RNA, 23 nt, Human
aacucaguccuaggaacgucggg

SEQ ID NO: 35023 - RNA, 23 nt, Human
uugagugggagacaggcggcagg

SEQ ID NO: 35024 - RNA, 25 nt, Human
ggcaggugggggcugggugggggac

SEQ ID NO: 35025 - RNA, 20 nt, Human
ugaggugaaaaggccaagag

SEQ ID NO: 35026 - RNA, 22 nt, Human
cugcaccuggauuuguacugca

SEQ ID NO: 35027 - RNA, 22 nt, Human
uuuucauuuucugcaagccugc

SEQ ID NO: 35028 - RNA, 21 nt, Human
ccgggagcggagguugcagug

SEQ ID NO: 35029 - RNA, 19 nt, Human
ugauccauuacugaacaug

SEQ ID NO: 35030 - RNA, 21 nt, Human
gcccaugcuggagggcagugg

SEQ ID NO: 35031 - RNA, 30 nt, Human
ggcuccagguggccuggugacuccaugaug

SEQ ID NO: 35032 - RNA, 22 nt, Human
caggccuggccucccggggccu

SEQ ID NO: 35033 - RNA, 25 nt, Human
guggguggugggcaaggugggaccu

SEQ ID NO: 35034 - RNA, 22 nt, Human
uaccuguaauccuagcacucug

SEQ ID NO: 35035 - RNA, 21 nt, Human
ucugauauacacauaaaacaa

SEQ ID NO: 35036 - RNA, 23 nt, Human
aggggagaauucauuucuggccu

SEQ ID NO: 35037 - RNA, 24 nt, Human
ugggccauuaaacaugaacugaac

SEQ ID NO: 35038 - RNA, 19 nt, Human
uuguugucuaaaggugcug

SEQ ID NO: 35039 - RNA, 18 nt, Human
acaaucagcugcuuuguu

SEQ ID NO: 35040 - RNA, 21 nt, Human
gggcagccaggccucucgggu

SEQ ID NO: 35041 - RNA, 23 nt, Human
cugccuggcucugcucgcuccgg

SEQ ID NO: 35042 - RNA, 22 nt, Human
ggaccccagagcccaccugugu

SEQ ID NO: 35043 - RNA, 18 nt, Human
guaucuguacagcacuuu

SEQ ID NO: 35044 - RNA, 24 nt, Human
ucuggagaagguauuagcaaagca

SEQ ID NO: 35045 - RNA, 19 nt, Human
guuguccaagcugugccuc

SEQ ID NO: 35046 - RNA, 22 nt, Human
acugcaaccuccaccuccuggg

SEQ ID NO: 35047 - RNA, 22 nt, Human
auuacauggcuucaucuaccuc

SEQ ID NO: 35048 - RNA, 28 nt, Human
ucucgaaugucugaccucaggugaucca

SEQ ID NO: 35049 - RNA, 26 nt, Human
cagugcggaugcaagagcaccuggcc

SEQ ID NO: 35050 - RNA, 27 nt, Human
aggacuugccacccccaguuccuauga

SEQ ID NO: 35051 - RNA, 22 nt, Human
agaccaucuugucuuucugggg

SEQ ID NO: 35052 - RNA, 20 nt, Human
gagggaggaggaggcuggga

SEQ ID NO: 35053 - RNA, 28 nt, Human
ccuccugccagcaucucuuggguuugcu

SEQ ID NO: 35054 - RNA, 26 nt, Human
ggauucagcagacauuggagguggca

SEQ ID NO: 35055 - RNA, 22 nt, Human
ggagaugggugcgguccucagu

SEQ ID NO: 35056 - RNA, 22 nt, Human
cccugcucuacaauguugcauc

SEQ ID NO: 35057 - RNA, 22 nt, Human
cuggacuuggggggaacugaga

SEQ ID NO: 35058 - RNA, 19 nt, Human
cccaggauggagugcagug

SEQ ID NO: 35059 - RNA, 25 nt, Human
uugcaugcucaacuuaggauaagca

SEQ ID NO: 35060 - RNA, 21 nt, Human
ccugaauccugucccugccau

SEQ ID NO: 35061 - RNA, 24 nt, Human
ggucugugcauuucugguugcacc

SEQ ID NO: 35062 - RNA, 21 nt, Human
ggaucucaggcuggagugcag

SEQ ID NO: 35063 - RNA, 22 nt, Human
cacuuauaaucagaaagcaauu

SEQ ID NO: 35064 - RNA, 22 nt, Human
gauaaauccagaaccaccugcc

SEQ ID NO: 35065 - RNA, 31 nt, Human
uacaauccacaauucauucaccagauauuuu

SEQ ID NO: 35066 - RNA, 24 nt, Human
gccagaauggaaaauucaccagga

SEQ ID NO: 35067 - RNA, 21 nt, Human
gccugucucugcucaguugca

SEQ ID NO: 35068 - RNA, 21 nt, Human
agguggaguucuuccaugcag

SEQ ID NO: 35069 - RNA, 22 nt, Human
auugcccaagagagagggcagg

SEQ ID NO: 35070 - RNA, 21 nt, Human
aguagaagaaaguaaacugua

SEQ ID NO: 35071 - RNA, 27 nt, Human
ccgccaucgucccggcugaagugcagu

SEQ ID NO: 35072 - RNA, 25 nt, Human
gcacacacccauguaaccacugcac

SEQ ID NO: 35073 - RNA, 24 nt, Human
uuucuccauguguuugauuucucc

SEQ ID NO: 35074 - RNA, 27 nt, Human
gccuauuguuaaagauuugcaugugaa

SEQ ID NO: 35075 - RNA, 24 nt, Human
accacaccuggcuaauuuuugugu

SEQ ID NO: 35076 - RNA, 21 nt, Human
ggagagggggcgcugagcugu

SEQ ID NO: 35077 - RNA, 23 nt, Human
auucuaggggcuuccugccuuau

SEQ ID NO: 35078 - RNA, 21 nt, Human
ugucaggggugucuucugccu

SEQ ID NO: 35079 - RNA, 29 nt, Human
gagaccccaucuuccagccaccuaguccc

SEQ ID NO: 35080 - RNA, 20 nt, Human
uaccauguaaaauugcugua

SEQ ID NO: 35081 - RNA, 25 nt, Human
uuuucuuuguaacauugaaugguuu

SEQ ID NO: 35082 - RNA, 27 nt, Human
agcucacuccgaaagccucugcucaga

SEQ ID NO: 35083 - RNA, 20 nt, Human
guucagcuccugcacaguug

SEQ ID NO: 35084 - RNA, 21 nt, Human
aaacaguggggaacuacugcu

SEQ ID NO: 35085 - RNA, 26 nt, Human
cuucugggcaucuguucugguuuuua

SEQ ID NO: 35086 - RNA, 22 nt, Human
uggugagucaccacuucagggc

SEQ ID NO: 35087 - RNA, 26 nt, Human
acugcacuuccagucacccaggccuu

SEQ ID NO: 35088 - RNA, 24 nt, Human
agcaguuuacagaaaagaagaugg

SEQ ID NO: 35089 - RNA, 22 nt, Human
ccgggaggcggagguugcgacc

SEQ ID NO: 35090 - RNA, 22 nt, Human
cccagccccaagccaggaggac

SEQ ID NO: 35091 - RNA, 23 nt, Human
ccaugaccaccuccauccgccag

SEQ ID NO: 35092 - RNA, 20 nt, Human
uccugccuuccagugcccca

SEQ ID NO: 35093 - RNA, 22 nt, Human
guguggcugcaucuugcugcua

SEQ ID NO: 35094 - RNA, 22 nt, Human
ugagauuaugugaauguuuuga

SEQ ID NO: 35095 - RNA, 22 nt, Human
aggaggaggaagaggaggcugg

SEQ ID NO: 35096 - RNA, 17 nt, Human
uccacgcaggugugugg

SEQ ID NO: 35097 - RNA, 22 nt, Human
aguccagccugggugacauagc

SEQ ID NO: 35098 - RNA, 25 nt, Human
caugcccccgugaccugccugcugu

SEQ ID NO: 35099 - RNA, 22 nt, Human
ucccugcacuagcagaagagaa

SEQ ID NO: 35100 - RNA, 24 nt, Human
ugucuuauuguucagaaaugggua

SEQ ID NO: 35101 - RNA, 17 nt, Human
ccuaaggaaacugcuuu

SEQ ID NO: 35102 - RNA, 22 nt, Human
auugcccuuggaacacauggug

SEQ ID NO: 35103 - RNA, 22 nt, Human
accaaagccaccaagacaggcu

SEQ ID NO: 35104 - RNA, 20 nt, Human
aacaaccaggaggagcuuga

SEQ ID NO: 35105 - RNA, 20 nt, Human
ggcuaugguuuccugccucc

SEQ ID NO: 35106 - RNA, 21 nt, Human
ucuucagguaaagaagcagcu

SEQ ID NO: 35107 - RNA, 18 nt, Human
acugugucaccuuugcca

SEQ ID NO: 35108 - RNA, 27 nt, Human
ccccaacagcccccaacuauagccucc

SEQ ID NO: 35109 - RNA, 26 nt, Human
ggcucacaccuguaauccuaaguaac

SEQ ID NO: 35110 - RNA, 22 nt, Human
ugugggugucugaguccaugag

SEQ ID NO: 35111 - RNA, 19 nt, Human
caucaggaaauacaacccu

SEQ ID NO: 35112 - RNA, 20 nt, Human
uuccuguagugagcacuuug

SEQ ID NO: 35113 - RNA, 27 nt, Human
cuuccuuucuuucuucccucuguuauu

SEQ ID NO: 35114 - RNA, 25 nt, Human
uaggacccaagcagagaagcucucg

SEQ ID NO: 35115 - RNA, 26 nt, Human
uucucauuacugugcugaaagucagc

SEQ ID NO: 35116 - RNA, 28 nt, Human
ucaaguccauguuauucucucacagugu

SEQ ID NO: 35117 - RNA, 21 nt, Human
uuaaguguucacuuauacaaa

SEQ ID NO: 35118 - RNA, 22 nt, Human
uggcaggcggagguugcaguga

SEQ ID NO: 35119 - RNA, 23 nt, Human
cagggagcagagguuuguacuuu

SEQ ID NO: 35120 - RNA, 25 nt, Human
uuguuuggaggaaacaggaaagaga

SEQ ID NO: 35121 - RNA, 22 nt, Human
acucauucaacacauacauuca

SEQ ID NO: 35122 - RNA, 18 nt, Human
ucaaugacaaccaaacca

SEQ ID NO: 35123 - RNA, 22 nt, Human
acaggguacuuaacacuggaca

SEQ ID NO: 35124 - RNA, 26 nt, Human
ccacagccaagcacugccacgguccu

SEQ ID NO: 35125 - RNA, 23 nt, Human
uggaaguaggggcaagcucuugc

SEQ ID NO: 35126 - RNA, 22 nt, Human
ccuccccagcccugcccggugc

SEQ ID NO: 35127 - RNA, 24 nt, Human
acaagugugucccaacacaguccu

SEQ ID NO: 35128 - RNA, 27 nt, Human
ugccaugucacaauaggccaggggagu

SEQ ID NO: 35129 - RNA, 21 nt, Human
uacuguugaaaaagauaaaga

SEQ ID NO: 35130 - RNA, 20 nt, Human
guuaucugaguauauguuug

SEQ ID NO: 35131 - RNA, 23 nt, Human
auguguaucauuuguaauugugu

SEQ ID NO: 35132 - RNA, 22 nt, Human
gacagaucaaaaucauuugaua

SEQ ID NO: 35133 - RNA, 24 nt, Human
ugaacccaccagcuggcuguaccc

SEQ ID NO: 35134 - RNA, 18 nt, Human
uucucuugaaggaucauu

SEQ ID NO: 35135 - RNA, 24 nt, Human
cugagcuuaaacauuuucucaauu

SEQ ID NO: 35136 - RNA, 19 nt, Human
uugcucugugcugacugug

SEQ ID NO: 35137 - RNA, 20 nt, Human
cuuggcagagccucaggaug

SEQ ID NO: 35138 - RNA, 23 nt, Human
caucaccaaagccuccguuuuua

SEQ ID NO: 35139 - RNA, 19 nt, Human
gcaaaauugaauuuuuuca

SEQ ID NO: 35140 - RNA, 20 nt, Human
ggagacuggccgcuggggcu

SEQ ID NO: 35141 - RNA, 22 nt, Human
ucugacuuucucucucuuucga

SEQ ID NO: 35142 - RNA, 27 nt, Human
cgggcaaagggucuuuugcagcuuuug

SEQ ID NO: 35143 - RNA, 22 nt, Human
caccugagccuucguucuucag

SEQ ID NO: 35144 - RNA, 22 nt, Human
uucagugagcuaugaucgcgcc

SEQ ID NO: 35145 - RNA, 20 nt, Human
aaauccagaccuuauccaca

SEQ ID NO: 35146 - RNA, 23 nt, Human
ccaccgcacccagccagggggaa

SEQ ID NO: 35147 - RNA, 22 nt, Human
aauuuaaaaacaaauuggcuuu

SEQ ID NO: 35148 - RNA, 27 nt, Human
auggaaaguugauggcagcagggccga

SEQ ID NO: 35149 - RNA, 24 nt, Human
gccaggcuggagugcaguggcgcg

SEQ ID NO: 35150 - RNA, 24 nt, Human
gccagacuggagugcaguggcacg

SEQ ID NO: 35151 - RNA, 20 nt, Human
uguuuuuaaaaauuagccua

SEQ ID NO: 35152 - RNA, 18 nt, Human
ucucuucaggaaaccaga

SEQ ID NO: 35153 - RNA, 22 nt, Human
aucgcuugaacucgggaggcag

SEQ ID NO: 35154 - RNA, 24 nt, Human
cagccuauuuguaauaugucugcc

SEQ ID NO: 35155 - RNA, 29 nt, Human
aacauuaugaagacauucuuuuguaccuu

SEQ ID NO: 35156 - RNA, 24 nt, Human
ccugucuuuuaucccaggaggcag

SEQ ID NO: 35157 - RNA, 27 nt, Human
gcucacccuacucugaccuccuucacg

SEQ ID NO: 35158 - RNA, 26 nt, Human
gcccuugccagaucucccucccucuc

SEQ ID NO: 35159 - RNA, 23 nt, Human
ccuguaaugguugggaccaggcc

SEQ ID NO: 35160 - RNA, 22 nt, Human
ccgacaccucgggcacaucgca

SEQ ID NO: 35161 - RNA, 20 nt, Human
ucucccucucugcaccuguc

SEQ ID NO: 35162 - RNA, 22 nt, Human
aacguacugggauuacaggcgu

SEQ ID NO: 35163 - RNA, 23 nt, Human
uuugaaauagcaccuuccuuagg

SEQ ID NO: 35164 - RNA, 22 nt, Human
aggaaaucccuucauacuugaa

SEQ ID NO: 35165 - RNA, 25 nt, Human
ugucucccaggcugcuggagugcag

SEQ ID NO: 35166 - RNA, 32 nt, Human
ucucacggcugcugcuccucuggacuccccaa

SEQ ID NO: 35167 - RNA, 23 nt, Human
ucuguccugucuucccugcucca

SEQ ID NO: 35168 - RNA, 23 nt, Human
caccguccacugugcguuuguau

SEQ ID NO: 35169 - RNA, 23 nt, Human
caucacagcgaaccaggucucuc

SEQ ID NO: 35170 - RNA, 22 nt, Human
gucucggaacuccugaccucag

SEQ ID NO: 35171 - RNA, 21 nt, Human
gcaaaguccgauuauauuggu

SEQ ID NO: 35172 - RNA, 23 nt, Human
aucuguuucuuuaaagcacuuug

SEQ ID NO: 35173 - RNA, 21 nt, Human
uucuccacaaccuccuccucc

SEQ ID NO: 35174 - RNA, 22 nt, Human
ccaaauaggagaaccucucaca

SEQ ID NO: 35175 - RNA, 24 nt, Human
cuguuacccaggcuggagugcaau

SEQ ID NO: 35176 - RNA, 22 nt, Human
gcgugagccaccacacccagcu

SEQ ID NO: 35177 - RNA, 22 nt, Human
gcgugaaccaccaugcccagcc

SEQ ID NO: 35178 - RNA, 21 nt, Human
aggucaagagcccaaccuucu

SEQ ID NO: 35179 - RNA, 21 nt, Human
cauagcaaagaugcuucaguc

SEQ ID NO: 35180 - RNA, 21 nt, Human
uuuccuuauccucuccaugcu

SEQ ID NO: 35181 - RNA, 20 nt, Human
cgccucccuagaagugccuu

SEQ ID NO: 35182 - RNA, 22 nt, Human
ccaacuagcugggacuacaggu

SEQ ID NO: 35183 - RNA, 23 nt, Human
acacuucacaggacacuugagca

SEQ ID NO: 35184 - RNA, 24 nt, Human
gcauauuuaacuuauuuaauguau

SEQ ID NO: 35185 - RNA, 26 nt, Human
aauuuauuccuucuuguggguucucg

SEQ ID NO: 35186 - RNA, 23 nt, Human
aaagucuauuuuuccuucacuuu

SEQ ID NO: 35187 - RNA, 22 nt, Human
ucagguaggcugggcugugaac

SEQ ID NO: 35188 - RNA, 24 nt, Human
ugggcagauuucaaacugaauaug

SEQ ID NO: 35189 - RNA, 20 nt, Human
aauugauacuucaggugcuu

SEQ ID NO: 35190 - RNA, 24 nt, Human
ccucaggccccagccccugccucu

SEQ ID NO: 35191 - RNA, 22 nt, Human
acugcaaccucugcuucccggg

SEQ ID NO: 35192 - RNA, 27 nt, Human
agggccagagugaccacagcagggcag

SEQ ID NO: 35193 - RNA, 29 nt, Human
cacagaagcgccucacgcugcacacugcc

SEQ ID NO: 35194 - RNA, 23 nt, Human
uucuugauuuuucucacugcuuu

SEQ ID NO: 35195 - RNA, 24 nt, Human
cacuccggaaacuaaagugaggcu

SEQ ID NO: 35196 - RNA, 22 nt, Human
uuagaccacagaaguggaauuu

SEQ ID NO: 35197 - RNA, 18 nt, Human
gcgucucucuguccugcc

SEQ ID NO: 35198 - RNA, 27 nt, Human
ucacgaagcagaggcugggcguggugg

SEQ ID NO: 35199 - RNA, 27 nt, Human
gcccugggaggcuggugggaggcaggg

SEQ ID NO: 35200 - RNA, 23 nt, Human
gguuaggcaaucauucuagggca

SEQ ID NO: 35201 - RNA, 22 nt, Human
caucagccaggcuggagugcag

SEQ ID NO: 35202 - RNA, 26 nt, Human
cacuccacuccagucugggcgacaga

SEQ ID NO: 35203 - RNA, 24 nt, Human
cugauuacucaugauaaacugaca

SEQ ID NO: 35204 - RNA, 25 nt, Human
cuuccuguagcccagucucaggcuu

SEQ ID NO: 35205 - RNA, 22 nt, Human
accaguuucuccaaaugccuuu

SEQ ID NO: 35206 - RNA, 25 nt, Human
aauuaaaauauacaguguuuuucca

SEQ ID NO: 35207 - RNA, 21 nt, Human
cagagcugggccuggggaagg

SEQ ID NO: 35208 - RNA, 23 nt, Human
agcugaaauacugucuaucucua

SEQ ID NO: 35209 - RNA, 27 nt, Human
cgggaggugaggcgggagguucagcag

SEQ ID NO: 35210 - RNA, 24 nt, Human
gcagugccaugaucacagcucacu

SEQ ID NO: 35211 - RNA, 22 nt, Human
gcggaaauguguguguauacuu

SEQ ID NO: 35212 - RNA, 27 nt, Human
gaacccaugggaaacaggagguacuaa

SEQ ID NO: 35213 - RNA, 22 nt, Human
gggcuuuggagcugucccaccu

SEQ ID NO: 35214 - RNA, 21 nt, Human
cccagugcuacaccugagguu

SEQ ID NO: 35215 - RNA, 24 nt, Human
guccccuccccaccaaauaaacau

SEQ ID NO: 35216 - RNA, 24 nt, Human
uuugggaggcuacggugggcagau

SEQ ID NO: 35217 - RNA, 27 nt, Human
cacuggccuucugaugaaauguuaaca

SEQ ID NO: 35218 - RNA, 24 nt, Human
guccaggcuggagugcaauggcag

SEQ ID NO: 35219 - RNA, 27 nt, Human
gucuugaauuccugggcucaagcuucc

SEQ ID NO: 35220 - RNA, 24 nt, Human
aacucacugauucucuacaugcuc

SEQ ID NO: 35221 - RNA, 25 nt, Human
agagaaacuguacaaaugugaagaa

SEQ ID NO: 35222 - RNA, 20 nt, Human
cccaccccccagggcucccu

SEQ ID NO: 35223 - RNA, 22 nt, Human
uccccuccagguuacuaaaggg

SEQ ID NO: 35224 - RNA, 22 nt, Human
agucuccucaguagcuggggcu

SEQ ID NO: 35225 - RNA, 29 nt, Human
guugcagggcaguaggagugcagacugaa

SEQ ID NO: 35226 - RNA, 27 nt, Human
guuauguuugcuguaagaauaagauau

SEQ ID NO: 35227 - RNA, 25 nt, Human
ucaggcugugaggugcucguguaga

SEQ ID NO: 35228 - RNA, 23 nt, Human
aggcguuacaaaacauggagauu

SEQ ID NO: 35229 - RNA, 29 nt, Human
gacccuggacguuuuucugcucucuucug

SEQ ID NO: 35230 - RNA, 20 nt, Human
gcuagugccgacucccgccu

SEQ ID NO: 35231 - RNA, 22 nt, Human
uccuuguacucuccaagcuccu

SEQ ID NO: 35232 - RNA, 24 nt, Human
caggaucugacaagaguccagguu

SEQ ID NO: 35233 - RNA, 23 nt, Human
uacauucuucaccuccuggugcc

SEQ ID NO: 35234 - RNA, 21 nt, Human
uucccuguauuuucuuucucu

SEQ ID NO: 35235 - RNA, 23 nt, Human
cagggcuggccugcuagcgcuuc

SEQ ID NO: 35236 - RNA, 26 nt, Human
ccuuccuccagugccugcugaaccau

SEQ ID NO: 35237 - RNA, 20 nt, Human
gcauugaaacucacagcccu

SEQ ID NO: 35238 - RNA, 24 nt, Human
ccagcccccaacauggugccaaag

SEQ ID NO: 35239 - RNA, 20 nt, Human
gcuuauuucagccacuucua

SEQ ID NO: 35240 - RNA, 24 nt, Human
cgggucuguacuuauuuuguuuac

SEQ ID NO: 35241 - RNA, 27 nt, Human
uucauucucuaccauaccacuugugca

SEQ ID NO: 35242 - RNA, 21 nt, Human
gaaggcagagguugcagugag

SEQ ID NO: 35243 - RNA, 21 nt, Human
uuccauagggagggagcuaga

SEQ ID NO: 35244 - RNA, 24 nt, Human
ugucauccagagcuggagugcagc

SEQ ID NO: 35245 - RNA, 19 nt, Human
uccucggggauagaccaaa

SEQ ID NO: 35246 - RNA, 23 nt, Human
uuccaaacaccacagcaucagca

SEQ ID NO: 35247 - RNA, 25 nt, Human
ugggcagugcacugucccaucugua

SEQ ID NO: 35248 - RNA, 29 nt, Human
caggaauagagaaauacaauuagauuaaa

SEQ ID NO: 35249 - RNA, 32 nt, Human
uguggguaucccccuggcagggccagcuaggc

SEQ ID NO: 35250 - RNA, 26 nt, Human
ugcucacuuguuaguauuucugagua

SEQ ID NO: 35251 - RNA, 23 nt, Human
ucuguguucaaaaauauauucau

SEQ ID NO: 35252 - RNA, 20 nt, Human
gguuaacauucaccuuccuc

SEQ ID NO: 35253 - RNA, 22 nt, Human
cugcagccuccuucuccugggu

SEQ ID NO: 35254 - RNA, 25 nt, Human
gugagcaggacuguucuucccacug

SEQ ID NO: 35255 - RNA, 23 nt, Human
ccagcaggaagagcuacaagcac

SEQ ID NO: 35256 - RNA, 20 nt, Human
gacuauguucuacaauugca

SEQ ID NO: 35257 - RNA, 22 nt, Human
agccuuuccacaaccucuaccu

SEQ ID NO: 35258 - RNA, 26 nt, Human
ugggacccucucauauccucuuauag

SEQ ID NO: 35259 - RNA, 27 nt, Human
cugaccuacucuugccugcuggagggu

SEQ ID NO: 35260 - RNA, 26 nt, Human
gcccaccuguggaaggacauggcggg

SEQ ID NO: 35261 - RNA, 23 nt, Human
cagugaauuccuggucaaucucu

SEQ ID NO: 35262 - RNA, 27 nt, Human
gcuucuauucaaauuuucuuuagugcu

SEQ ID NO: 35263 - RNA, 27 nt, Human
uugccuuugucgcccaggcuggagugc

SEQ ID NO: 35264 - RNA, 22 nt, Human
cacccacgcuggagugcuguga

SEQ ID NO: 35265 - RNA, 21 nt, Human
aggcacuguuagaugaaguaa

SEQ ID NO: 35266 - RNA, 31 nt, Human
uggagacagucaugugcaaugcuuaagaugg

SEQ ID NO: 35267 - RNA, 23 nt, Human
aggagacagcacaccaccaggcu

SEQ ID NO: 35268 - RNA, 21 nt, Human
guuuucaggaaucaaaagaua

SEQ ID NO: 35269 - RNA, 23 nt, Human
guuucuggggcaacugagagcug

SEQ ID NO: 35270 - RNA, 23 nt, Human
cuuccuggcuuuuuaacuccccu

SEQ ID NO: 35271 - RNA, 22 nt, Human
acacauacauugccaauuuucc

SEQ ID NO: 35272 - RNA, 24 nt, Human
ugccugccuccgggagggaaggag

SEQ ID NO: 35273 - RNA, 22 nt, Human
ugcccccagagccacaguuccc

SEQ ID NO: 35274 - RNA, 22 nt, Human
gguccuccacuguccucuguca

SEQ ID NO: 35275 - RNA, 22 nt, Human
cccagaaaacuauagaccauuc

SEQ ID NO: 35276 - RNA, 19 nt, Human
gaaagagauggggcuguau

SEQ ID NO: 35277 - RNA, 25 nt, Human
ggggucacaugggaagcaauguguu

SEQ ID NO: 35278 - RNA, 19 nt, Human
ggguuuaagaguccuggcc

SEQ ID NO: 35279 - RNA, 23 nt, Human
aagagugagggagggaaggaagg

SEQ ID NO: 35280 - RNA, 22 nt, Human
cacacucaugggucacuggggc

SEQ ID NO: 35281 - RNA, 27 nt, Human
ugcggugagcuauguuuacauugacac

SEQ ID NO: 35282 - RNA, 22 nt, Human
uucaagcaagucuccugccuca

SEQ ID NO: 35283 - RNA, 22 nt, Human
ucucaggauccugcucuuuccc

SEQ ID NO: 35284 - RNA, 20 nt, Human
uuuguuaaaacaggaggcag

SEQ ID NO: 35285 - RNA, 22 nt, Human
uguaauucagauuaggacacag

SEQ ID NO: 35286 - RNA, 26 nt, Human
cccacuagugccugguucucuugcuc

SEQ ID NO: 35287 - RNA, 21 nt, Human
cacccaggcuugaggcagcgg

SEQ ID NO: 35288 - RNA, 20 nt, Human
agggaaagcuuugccugaga

SEQ ID NO: 35289 - RNA, 27 nt, Human
uggaaggcagaaaaguugggagcaugg

SEQ ID NO: 35290 - RNA, 22 nt, Human
ccgcagcugcugccacucugcu

SEQ ID NO: 35291 - RNA, 19 nt, Human
cccuccaaucugcacuuug

SEQ ID NO: 35292 - RNA, 22 nt, Human
cagggucuugcucugucaccca

SEQ ID NO: 35293 - RNA, 26 nt, Human
cugccuggagguucucccugggggug

SEQ ID NO: 35294 - RNA, 22 nt, Human
guguaaacucuaauuucuauca

SEQ ID NO: 35295 - RNA, 27 nt, Human
cuuguacagugucugugccauggauuu

SEQ ID NO: 35296 - RNA, 22 nt, Human
uugugccucaaaccccaaggag

SEQ ID NO: 35297 - RNA, 25 nt, Human
ccgugcccggccuccccugugucau

SEQ ID NO: 35298 - RNA, 22 nt, Human
gaggaggcccugggcaaagaag

SEQ ID NO: 35299 - RNA, 26 nt, Human
ccagugcuggcugcagguauuaaguc

SEQ ID NO: 35300 - RNA, 22 nt, Human
cagaggcuucuucagaucaaug

SEQ ID NO: 35301 - RNA, 22 nt, Human
cacuuugguagugccaguguga

SEQ ID NO: 35302 - RNA, 19 nt, Human
cuacuugaauacucucaca

SEQ ID NO: 35303 - RNA, 27 nt, Human
gguuaacccuugugugaaaugaaggaa

SEQ ID NO: 35304 - RNA, 27 nt, Human
ccugggcaacagagcgagacucagucu

SEQ ID NO: 35305 - RNA, 22 nt, Human
caagcauuaccuaacaugguga

SEQ ID NO: 35306 - RNA, 22 nt, Human
ccuagguguccucccuaguuuc

SEQ ID NO: 35307 - RNA, 23 nt, Human
agcuagcaauaaggugacuuaca

SEQ ID NO: 35308 - RNA, 20 nt, Human
gggagcuggcgggagggugg

SEQ ID NO: 35309 - RNA, 20 nt, Human
ugauagcagagguuuggugg

SEQ ID NO: 35310 - RNA, 21 nt, Human
gugacuuccugguagcccaag

SEQ ID NO: 35311 - RNA, 24 nt, Human
uguguuuccuccagcccuugucuc

SEQ ID NO: 35312 - RNA, 20 nt, Human
cccagccucccgcucugggc

SEQ ID NO: 35313 - RNA, 20 nt, Human
caacuaaucaagagugagug

SEQ ID NO: 35314 - RNA, 24 nt, Human
uuacugacuuggaucccaaagcaa

SEQ ID NO: 35315 - RNA, 22 nt, Human
aagauguaaaacaagaaaugcu

SEQ ID NO: 35316 - RNA, 22 nt, Human
cauucauccuccuucuccaaga

SEQ ID NO: 35317 - RNA, 20 nt, Human
cucucagagauaagguuuuu

SEQ ID NO: 35318 - RNA, 22 nt, Human
gcagagcuggcucugagcgccu

SEQ ID NO: 35319 - RNA, 27 nt, Human
guugcccaagguugcacagcaagaaaa

SEQ ID NO: 35320 - RNA, 27 nt, Human
uucacuacuucuuuucuuaguuugaaa

SEQ ID NO: 35321 - RNA, 18 nt, Human
ugauucuagaagcaccca

SEQ ID NO: 35322 - RNA, 23 nt, Human
uccaaaagcagaaaugagaggaa

SEQ ID NO: 35323 - RNA, 20 nt, Human
gcugcagaaaaggugucaca

SEQ ID NO: 35324 - RNA, 27 nt, Human
ggcuagccauauuuaggacaacugaag

SEQ ID NO: 35325 - RNA, 19 nt, Human
cccaggcuggaggucagug

SEQ ID NO: 35326 - RNA, 20 nt, Human
cacaaggugcaaaucaaugc

SEQ ID NO: 35327 - RNA, 22 nt, Human
acaacaaaagugccuggcaucc

SEQ ID NO: 35328 - RNA, 19 nt, Human
gccgauccuguuuaccuca

SEQ ID NO: 35329 - RNA, 22 nt, Human
ucggccgggugcuaggccgggg

SEQ ID NO: 35330 - RNA, 21 nt, Human
agucuacagcacauagucuuu

SEQ ID NO: 35331 - RNA, 21 nt, Human
ccucaucugcuuucccgccac

SEQ ID NO: 35332 - RNA, 18 nt, Human
cacuacacaacugccuuc

SEQ ID NO: 35333 - RNA, 20 nt, Human
cucauaaagaaauagugaaa

SEQ ID NO: 35334 - RNA, 21 nt, Human
ugggauguaaaaaugaaauga

SEQ ID NO: 35335 - RNA, 23 nt, Human
uuucaugagcccgaccucucucg

SEQ ID NO: 35336 - RNA, 24 nt, Human
ccucauugccagcuucagggagcu

SEQ ID NO: 35337 - RNA, 23 nt, Human
cauuaaagccugaguuugcuuuc

SEQ ID NO: 35338 - RNA, 27 nt, Human
cacugccugcccucugucugucuucuc

SEQ ID NO: 35339 - RNA, 18 nt, Human
aauggguuucacugugaa

SEQ ID NO: 35340 - RNA, 20 nt, Human
ugcuaggauuuuuucugcua

SEQ ID NO: 35341 - RNA, 20 nt, Human
aguccugaacaugauugugg

SEQ ID NO: 35342 - RNA, 23 nt, Human
agaccugacugccugguucagcc

SEQ ID NO: 35343 - RNA, 19 nt, Human
uugggaagacguggaggaa

SEQ ID NO: 35344 - RNA, 26 nt, Human
uacugcacuugaugccaguaggaaag

SEQ ID NO: 35345 - RNA, 23 nt, Human
uccagagagaaaaaugaggcgga

SEQ ID NO: 35346 - RNA, 21 nt, Human
aguauaucucagugugugaga

SEQ ID NO: 35347 - RNA, 22 nt, Human
cccucaggucacauucuuuggg

SEQ ID NO: 35348 - RNA, 27 nt, Human
aucagggucucgugcugcccuucccuc

SEQ ID NO: 35349 - RNA, 25 nt, Human
accugguacaugauacaugacccca

SEQ ID NO: 35350 - RNA, 19 nt, Human
cccaggccagagugcagug

SEQ ID NO: 35351 - RNA, 22 nt, Human
cccugcagcaucccucagccug

SEQ ID NO: 35352 - RNA, 23 nt, Human
ggcuucucaucgucugcuccucc

SEQ ID NO: 35353 - RNA, 21 nt, Human
gcucacugccaccuccgccuc

SEQ ID NO: 35354 - RNA, 28 nt, Human
aagagucaguguugcuguggauuugacg

SEQ ID NO: 35355 - RNA, 22 nt, Human
accauccuagccaacaucguga

SEQ ID NO: 35356 - RNA, 20 nt, Human
agcagguagcuucuuuuuuc

SEQ ID NO: 35357 - RNA, 20 nt, Human
cccuggagcacaaucaacaa

SEQ ID NO: 35358 - RNA, 20 nt, Human
uucuacuucagcuaaaacag

SEQ ID NO: 35359 - RNA, 29 nt, Human
cgccacucagccauuucccccuccucaga

SEQ ID NO: 35360 - RNA, 22 nt, Human
gcucaugccaucaugcccagcu

SEQ ID NO: 35361 - RNA, 24 nt, Human
ugccuggcugcuggaguacaugug

SEQ ID NO: 35362 - RNA, 23 nt, Human
aagcacaaguucccauggcuguc

SEQ ID NO: 35363 - RNA, 27 nt, Human
caggcagccccaggcuuugcagaaacc

SEQ ID NO: 35364 - RNA, 22 nt, Human
gcaacauggcaaagccccaucu

SEQ ID NO: 35365 - RNA, 27 nt, Human
cccuagguucccggucccgaguacagu

SEQ ID NO: 35366 - RNA, 27 nt, Human
ccccugccaucacugccccacauggac

SEQ ID NO: 35367 - RNA, 27 nt, Human
ggucaggauugaaagagaaauauuuca

SEQ ID NO: 35368 - RNA, 23 nt, Human
uguagcccaggccagagugcagu

SEQ ID NO: 35369 - RNA, 23 nt, Human
aaaaggagaaguuuaacuuugcu

SEQ ID NO: 35370 - RNA, 24 nt, Human
ccugcugcugccugccuuggccug

SEQ ID NO: 35371 - RNA, 22 nt, Human
agaagagcaaacaggcacuuug

SEQ ID NO: 35372 - RNA, 27 nt, Human
ugcccagucaguacaaggaggcccaca

SEQ ID NO: 35373 - RNA, 21 nt, Human
cacaggggcuaucccuucuca

SEQ ID NO: 35374 - RNA, 29 nt, Human
ccucaacacugcugaccaugaucagcgca

SEQ ID NO: 35375 - RNA, 23 nt, Human
gguuucuguuugauucagaaauu

SEQ ID NO: 35376 - RNA, 24 nt, Human
auacaaaaaauuagcugggcaugg

SEQ ID NO: 35377 - RNA, 22 nt, Human
ugcuuuccuagauccacacuuu

SEQ ID NO: 35378 - RNA, 24 nt, Human
ccaaagcagcuacaauaauagaga

SEQ ID NO: 35379 - RNA, 23 nt, Human
caggcagcuucaccugcggcugc

SEQ ID NO: 35380 - RNA, 21 nt, Human
gugcauuuguaaaugcugugu

SEQ ID NO: 35381 - RNA, 27 nt, Human
uucacaguaguuucaauauagaaggaa

SEQ ID NO: 35382 - RNA, 22 nt, Human
ugcuuuuccuuuguuuuuauga

SEQ ID NO: 35383 - RNA, 20 nt, Human
cauagcacugggcucugaug

SEQ ID NO: 35384 - RNA, 19 nt, Human
acaaaugaucuaguucaga

SEQ ID NO: 35385 - RNA, 23 nt, Human
augcuguggagucccaaccccag

SEQ ID NO: 35386 - RNA, 21 nt, Human
ucccuguggacaaaagcacau

SEQ ID NO: 35387 - RNA, 20 nt, Human
aggucaggaguuugagacua

SEQ ID NO: 35388 - RNA, 26 nt, Human
cacagccccugcugggcccaccaccu

SEQ ID NO: 35389 - RNA, 19 nt, Human
ugaaauauauuuugcauua

SEQ ID NO: 35390 - RNA, 23 nt, Human
ccgccagcuggcaccugccucua

SEQ ID NO: 35391 - RNA, 20 nt, Human
gcucacuggucccugccucu

SEQ ID NO: 35392 - RNA, 22 nt, Human
uuuugcccaggcuggagugcag

SEQ ID NO: 35393 - RNA, 21 nt, Human
cagauuauuaaauaaagcugc

SEQ ID NO: 35394 - RNA, 22 nt, Human
cagaguuuuaaaccccaggaac

SEQ ID NO: 35395 - RNA, 20 nt, Human
ucgagcccucccccaaacag

SEQ ID NO: 35396 - RNA, 23 nt, Human
uccaagaaaaacuaccucgaagg

SEQ ID NO: 35397 - RNA, 22 nt, Human
gggauuacaggugugagccacu

SEQ ID NO: 35398 - RNA, 28 nt, Human
ccagcuuugugucuucucucaauuacau

SEQ ID NO: 35399 - RNA, 26 nt, Human
aggaagaggcuugguucuagccuggc

SEQ ID NO: 35400 - RNA, 27 nt, Human
gccgaauccccuccaccgggacgcccc

SEQ ID NO: 35401 - RNA, 20 nt, Human
uuucuucaggaagaaccagg

SEQ ID NO: 35402 - RNA, 27 nt, Human
ggucucgaacuccugaccuugugaucu

SEQ ID NO: 35403 - RNA, 26 nt, Human
cucuccaguuccccaggagguccaag

SEQ ID NO: 35404 - RNA, 28 nt, Human
gauauggauauaaaaagcauucuuaccg

SEQ ID NO: 35405 - RNA, 19 nt, Human
ucaguuaccucauucugca

SEQ ID NO: 35406 - RNA, 18 nt, Human
ugggugagguaggggugg

SEQ ID NO: 35407 - RNA, 23 nt, Human
agugguugccaaugucucaggga

SEQ ID NO: 35408 - RNA, 20 nt, Human
ggcucugauaccugcuuuua

SEQ ID NO: 35409 - RNA, 20 nt, Human
caugcaggcugguggugaug

SEQ ID NO: 35410 - RNA, 22 nt, Human
uuuagauucacugaaauucauu

SEQ ID NO: 35411 - RNA, 22 nt, Human
cgccguuguacuccagccuggg

SEQ ID NO: 35412 - RNA, 22 nt, Human
gagccgagauuucuguugcucu

SEQ ID NO: 35413 - RNA, 24 nt, Human
ucugcccucuagaaguaggcugug

SEQ ID NO: 35414 - RNA, 25 nt, Human
uaaauugaauaaugguaccagauaa

SEQ ID NO: 35415 - RNA, 27 nt, Human
gucacacucuccaggcuggagugcagu

SEQ ID NO: 35416 - RNA, 27 nt, Human
ucccggguucaagccauucugccucag

SEQ ID NO: 35417 - RNA, 21 nt, Human
ucuacuacccucucagucacc

SEQ ID NO: 35418 - RNA, 22 nt, Human
ggugcagaauggcugaccucag

SEQ ID NO: 35419 - RNA, 23 nt, Human
uuggcucccagucaccauaucca

SEQ ID NO: 35420 - RNA, 23 nt, Human
aucuacucugccuuuucagugcc

SEQ ID NO: 35421 - RNA, 25 nt, Human
uugaaacuuacacuguuucaucuca

SEQ ID NO: 35422 - RNA, 18 nt, Human
uuucaagcuuauuuugga

SEQ ID NO: 35423 - RNA, 23 nt, Human
cucaucuuuaagaugaaucaucu

SEQ ID NO: 35424 - RNA, 22 nt, Human
guccucccaggcucaagcuauc

SEQ ID NO: 35425 - RNA, 22 nt, Human
ggcaggcagggacuguggcagc

SEQ ID NO: 35426 - RNA, 22 nt, Human
cauaauaccaucugcaguauua

SEQ ID NO: 35427 - RNA, 26 nt, Human
ucugucacccaaguuggagugcagug

SEQ ID NO: 35428 - RNA, 22 nt, Human
ucauuaaacaaauaaaauacuu

SEQ ID NO: 35429 - RNA, 26 nt, Human
ccuccgccuccuggguucacaugauu

SEQ ID NO: 35430 - RNA, 23 nt, Human
agccccucauucccuccuugcac

SEQ ID NO: 35431 - RNA, 22 nt, Human
ugcagugagcugagauggcacc

SEQ ID NO: 35432 - RNA, 22 nt, Human
agaacauggagaacuugcucaa

SEQ ID NO: 35433 - RNA, 21 nt, Human
uuccacccugcucgugcugcc

SEQ ID NO: 35434 - RNA, 22 nt, Human
acauaagcuaccuucccauuua

SEQ ID NO: 35435 - RNA, 22 nt, Human
aggcuggaacuguuucuuuaaa

SEQ ID NO: 35436 - RNA, 21 nt, Human
uuuuaccacguuuuguccuca

SEQ ID NO: 35437 - RNA, 21 nt, Human
gaucacugcaaaccugccuca

SEQ ID NO: 35438 - RNA, 21 nt, Human
gcucaguaucauuguggagaa

SEQ ID NO: 35439 - RNA, 22 nt, Human
cgccccuugaacaugaccgugg

SEQ ID NO: 35440 - RNA, 26 nt, Human
gaucagauaccugcuccaguaguugu

SEQ ID NO: 35441 - RNA, 22 nt, Human
cgaaucugugugaaacuuucau

SEQ ID NO: 35442 - RNA, 21 nt, Human
ucacucaggcuggagcacagu

SEQ ID NO: 35443 - RNA, 24 nt, Human
gccaugaaaugaaugaauuaggaa

SEQ ID NO: 35444 - RNA, 22 nt, Human
cuuuuaacuuccaucauuuucc

SEQ ID NO: 35445 - RNA, 29 nt, Human
aaagcgggaccuccucucugguagaggug

SEQ ID NO: 35446 - RNA, 29 nt, Human
uccaucacuaaucuaaaacaaagguggca

SEQ ID NO: 35447 - RNA, 21 nt, Human
ugaguccucugucaugugucc

SEQ ID NO: 35448 - RNA, 24 nt, Human
uacuaccacuuuagaugauuuuaa

SEQ ID NO: 35449 - RNA, 27 nt, Human
caugccuuuuaaaaguucuuuaagcaa

SEQ ID NO: 35450 - RNA, 14 nt, Human
cuucccuuuggaaa

SEQ ID NO: 35451 - RNA, 26 nt, Human
gaagcaucugacugucaccacugcca

SEQ ID NO: 35452 - RNA, 27 nt, Human
gacuguuguaaccuuagguuguaaucu

SEQ ID NO: 35453 - RNA, 19 nt, Human
augguauuugcucugugau

SEQ ID NO: 35454 - RNA, 24 nt, Human
uuuaccagcacacggcucuucuuc

SEQ ID NO: 35455 - RNA, 27 nt, Human
cauugcauuccagccuaggcaacacga

SEQ ID NO: 35456 - RNA, 27 nt, Human
ggagaugcugugguucauggaaucucu

SEQ ID NO: 35457 - RNA, 23 nt, Human
ggcucaaaucuucauuuaucucu

SEQ ID NO: 35458 - RNA, 26 nt, Human
gcugcucuacggucaucuuugcuuag

SEQ ID NO: 35459 - RNA, 17 nt, Human
ccgacucagugugucau

SEQ ID NO: 35460 - RNA, 20 nt, Human
ucauuuuucccccagugaau

SEQ ID NO: 35461 - RNA, 26 nt, Human
acuaggguaaggugagugucuuagca

SEQ ID NO: 35462 - RNA, 22 nt, Human
gaguggcugggauuagcggcau

SEQ ID NO: 35463 - RNA, 22 nt, Human
guuuugacugguugaaaccgga

SEQ ID NO: 35464 - RNA, 22 nt, Human
cacgccuguaauccuaacacuu

SEQ ID NO: 35465 - RNA, 27 nt, Human
ccagaaacgacgguacccaggagaagg

SEQ ID NO: 35466 - RNA, 23 nt, Human
cuugcugcugagugcaccacuuc

SEQ ID NO: 35467 - RNA, 22 nt, Human
uugauucagacuggaguggaua

SEQ ID NO: 35468 - RNA, 26 nt, Human
ggucucaaccugugcugacccuggga

SEQ ID NO: 35469 - RNA, 22 nt, Human
uguugccuaggcuggaggacag

SEQ ID NO: 35470 - RNA, 22 nt, Human
uagaagccucauuucuuuucuc

SEQ ID NO: 35471 - RNA, 19 nt, Human
cccauucaaccauuuuaua

SEQ ID NO: 35472 - RNA, 20 nt, Human
gcucaucacuggccugggga

SEQ ID NO: 35473 - RNA, 26 nt, Human
gggaaaggaacaggcuuggagggaag

SEQ ID NO: 35474 - RNA, 30 nt, Human
auggcaccugucgcccagugcccuggggcu

SEQ ID NO: 35475 - RNA, 27 nt, Human
uuccuucugucccuccccaccuuucuc

SEQ ID NO: 35476 - RNA, 20 nt, Human
uaaacaacaguccuaacuuu

SEQ ID NO: 35477 - RNA, 32 nt, Human
gaacgucagagaucagcaggcacuguacuggg

SEQ ID NO: 35478 - RNA, 22 nt, Human
ccugccugggaaugaaugaagc

SEQ ID NO: 35479 - RNA, 31 nt, Human
gcacccacaugacugcccugccucugaccag

SEQ ID NO: 35480 - RNA, 22 nt, Human
gggggaggaagaggaggaaggu

SEQ ID NO: 35481 - RNA, 22 nt, Human
ccaguauuaucuuacuugcaaa

SEQ ID NO: 35482 - RNA, 20 nt, Human
auuuuuaaagcugcuuccug

SEQ ID NO: 35483 - RNA, 20 nt, Human
aaggaauagagaagggcuuu

SEQ ID NO: 35484 - RNA, 19 nt, Human
cagcuccccuccccaucuc

SEQ ID NO: 35485 - RNA, 24 nt, Human
cauguaaaccuaggaagguaaagg

SEQ ID NO: 35486 - RNA, 22 nt, Human
agauggccaugaagaggaugcu

SEQ ID NO: 35487 - RNA, 21 nt, Human
uuucauagaggaaaguuuaca

SEQ ID NO: 35488 - RNA, 21 nt, Human
cugcaagugaggugugucaca

SEQ ID NO: 35489 - RNA, 19 nt, Human
ugcuuggaguuuucugccc

SEQ ID NO: 35490 - RNA, 21 nt, Human
ugcucggucgccgccuaggcg

SEQ ID NO: 35491 - RNA, 20 nt, Human
cccagcucucccucuggccc

SEQ ID NO: 35492 - RNA, 23 nt, Human
ucugggccagccaugcccacgcc

SEQ ID NO: 35493 - RNA, 25 nt, Human
ucugcuuuuucccuuccucuguggu

SEQ ID NO: 35494 - RNA, 24 nt, Human
ccccaagaauacuuaagggguggg

SEQ ID NO: 35495 - RNA, 20 nt, Human
gcuuuuaaaauggagcuaga

SEQ ID NO: 35496 - RNA, 21 nt, Human
ugccuggcauguggcacuuug

SEQ ID NO: 35497 - RNA, 27 nt, Human
ggcucacuguagccucaaccugccagg

SEQ ID NO: 35498 - RNA, 22 nt, Human
ccuccaggccacauggggcugg

SEQ ID NO: 35499 - RNA, 22 nt, Human
caucugucuaggaaucaugugc

SEQ ID NO: 35500 - RNA, 24 nt, Human
ggauccucagugcugccaaaaggc

SEQ ID NO: 35501 - RNA, 23 nt, Human
cacugccucucggugaccuccgu

SEQ ID NO: 35502 - RNA, 23 nt, Human
ccguaaaccacagacgcucucca

SEQ ID NO: 35503 - RNA, 22 nt, Human
ucugguguucuaaaugaagcag

SEQ ID NO: 35504 - RNA, 25 nt, Human
uaccuccaggggccuccaagcauag

SEQ ID NO: 35505 - RNA, 22 nt, Human
ggggugagagggaggaaaccgg

SEQ ID NO: 35506 - RNA, 29 nt, Human
ccugucuccuguaccuccugggaaagggg

SEQ ID NO: 35507 - RNA, 25 nt, Human
aauucugcuccgugcuuuuagcccu

SEQ ID NO: 35508 - RNA, 21 nt, Human
gcaccuuggaaggcacugccu

SEQ ID NO: 35509 - RNA, 24 nt, Human
agcuguucuugacagcacucugag

SEQ ID NO: 35510 - RNA, 25 nt, Human
gggcaaacauuuuuccaagucuugc

SEQ ID NO: 35511 - RNA, 25 nt, Human
caguuucauacaaccucccuccccc

SEQ ID NO: 35512 - RNA, 24 nt, Human
gcuccucuguggugucugccuguu

SEQ ID NO: 35513 - RNA, 20 nt, Human
gucuuagaaccaagaauuug

SEQ ID NO: 35514 - RNA, 20 nt, Human
aagacuugagacaggauggu

SEQ ID NO: 35515 - RNA, 20 nt, Human
uuuuuaucucucucaacuuc

SEQ ID NO: 35516 - RNA, 24 nt, Human
aagggaggaaaccuagcagaggaa

SEQ ID NO: 35517 - RNA, 28 nt, Human
ucaggaacucugcuuccuggcccagcgc

SEQ ID NO: 35518 - RNA, 27 nt, Human
uugugggggcuauugaguuuucuuguu

SEQ ID NO: 35519 - RNA, 23 nt, Human
guuugcuucaacaacgcagccag

SEQ ID NO: 35520 - RNA, 27 nt, Human
accagccugggcagcauagcaagacac

SEQ ID NO: 35521 - RNA, 21 nt, Human
ugccaaucucaagcaaagcaa

SEQ ID NO: 35522 - RNA, 21 nt, Human
cccuucagcccauucccccuc

SEQ ID NO: 35523 - RNA, 22 nt, Human
acaaagaacaucguaauaacac

SEQ ID NO: 35524 - RNA, 26 nt, Human
ucagagacccaggaguugggagcuuu

SEQ ID NO: 35525 - RNA, 23 nt, Human
agacaagagacagggagacugga

SEQ ID NO: 35526 - RNA, 20 nt, Human
gcccagccuaaauuuguauu

SEQ ID NO: 35527 - RNA, 25 nt, Human
cagggcacugacaggacaggagagc

SEQ ID NO: 35528 - RNA, 22 nt, Human
cgagcuggagugcaguggugca

SEQ ID NO: 35529 - RNA, 22 nt, Human
cuucucucccugacugccgcuc

SEQ ID NO: 35530 - RNA, 19 nt, Human
cugccucauauagcacuuu

SEQ ID NO: 35531 - RNA, 20 nt, Human
cugccugggcucccuugugc

SEQ ID NO: 35532 - RNA, 19 nt, Human
ccuaccuuagcacaggguc

SEQ ID NO: 35533 - RNA, 17 nt, Human
uagagggagggagcagc

SEQ ID NO: 35534 - RNA, 26 nt, Human
cgcuagugauguuuuuaugauauccc

SEQ ID NO: 35535 - RNA, 20 nt, Human
uccccauugccuccuccuuc

SEQ ID NO: 35536 - RNA, 27 nt, Human
ugcagugaguuuucauuuugguuuugu

SEQ ID NO: 35537 - RNA, 25 nt, Human
cuccuuccuuacccaaacuguucaa

SEQ ID NO: 35538 - RNA, 22 nt, Human
ggagcccgggauuugugggcgg

SEQ ID NO: 35539 - RNA, 23 nt, Human
uucauuucccuuuauauuucccu

SEQ ID NO: 35540 - RNA, 26 nt, Human
cuccuggaccucuuugcucguccuuc

SEQ ID NO: 35541 - RNA, 21 nt, Human
uucuaguauaaauggguaccu

SEQ ID NO: 35542 - RNA, 24 nt, Human
gccucugagggaaagcccagaaaa

SEQ ID NO: 35543 - RNA, 20 nt, Human
guuaccuuaccugaagacca

SEQ ID NO: 35544 - RNA, 22 nt, Human
uccuguaauguucagaguguug

SEQ ID NO: 35545 - RNA, 20 nt, Human
uucauucuucuaauacagca

SEQ ID NO: 35546 - RNA, 26 nt, Human
caugucgcgcucagugcugcagccca

SEQ ID NO: 35547 - RNA, 24 nt, Human
ccaccacugcuuguuccgagcucc

SEQ ID NO: 35548 - RNA, 21 nt, Human
cagaagcccaucagacugccc

SEQ ID NO: 35549 - RNA, 25 nt, Human
ugccaagcauuaagauaaacaaaua

SEQ ID NO: 35550 - RNA, 22 nt, Human
gcgcccagcuccugacacugcu

SEQ ID NO: 35551 - RNA, 23 nt, Human
cugaacugcucuggcugggcauu

SEQ ID NO: 35552 - RNA, 27 nt, Human
uccucacccccagcuuugcuaccaaag

SEQ ID NO: 35553 - RNA, 27 nt, Human
aaucauguacauuugaaaauauuugca

SEQ ID NO: 35554 - RNA, 27 nt, Human
ucagcgacugaaggugcccgcauccca

SEQ ID NO: 35555 - RNA, 25 nt, Human
gaggcagcagcggcggcggcagugg

SEQ ID NO: 35556 - RNA, 29 nt, Human
gucauauccagacuggaggccgacugccc

SEQ ID NO: 35557 - RNA, 20 nt, Human
gcguuauccauguauugccu

SEQ ID NO: 35558 - RNA, 22 nt, Human
ccaacaugguaaaaccccauuu

SEQ ID NO: 35559 - RNA, 24 nt, Human
ugucagaugcuaccugcuguuacu

SEQ ID NO: 35560 - RNA, 22 nt, Human
uucaagcaguucuccugccuca

SEQ ID NO: 35561 - RNA, 26 nt, Human
uccucuagccucugcuggagugcagu

SEQ ID NO: 35562 - RNA, 20 nt, Human
uuaccuuuguucccaaauuu

SEQ ID NO: 35563 - RNA, 21 nt, Human
ucaagccaaagaauucucaug

SEQ ID NO: 35564 - RNA, 23 nt, Human
cccguuuugacgacgcacuugua

SEQ ID NO: 35565 - RNA, 27 nt, Human
uucuccucugcuaugcauuuucuucac

SEQ ID NO: 35566 - RNA, 29 nt, Human
gucuccuuuucccccucagagggcaaaga

SEQ ID NO: 35567 - RNA, 24 nt, Human
cugcuuaggaaccggggacucagg

SEQ ID NO: 35568 - RNA, 27 nt, Human
uagaguguuggucaugacuccaagagc

SEQ ID NO: 35569 - RNA, 21 nt, Human
agaggcuaugggaagagggug

SEQ ID NO: 35570 - RNA, 22 nt, Human
gccagaccccauuuuauacuuc

SEQ ID NO: 35571 - RNA, 21 nt, Human
guugccucccguccugggcag

SEQ ID NO: 35572 - RNA, 27 nt, Human
ggaguagguuugugcaguuacagcuuu

SEQ ID NO: 35573 - RNA, 22 nt, Human
ugccuuugcugcuacuuuuucu

SEQ ID NO: 35574 - RNA, 21 nt, Human
cugcaaccuccgcauccgggg

SEQ ID NO: 35575 - RNA, 21 nt, Human
cucaucugcaacauucacacc

SEQ ID NO: 35576 - RNA, 26 nt, Human
ggaaggcagugccugcucugcuguga

SEQ ID NO: 35577 - RNA, 22 nt, Human
aggacagcucuagcauuuucuu

SEQ ID NO: 35578 - RNA, 23 nt, Human
gacuugcugugugaccucaggcc

SEQ ID NO: 35579 - RNA, 24 nt, Human
agccgauaucaacacuuguaucug

SEQ ID NO: 35580 - RNA, 24 nt, Human
cugggaucaaggauagggaguugu

SEQ ID NO: 35581 - RNA, 21 nt, Human
aggucucgcucagagcugugu

SEQ ID NO: 35582 - RNA, 22 nt, Human
gccggccacaccccucugcugc

SEQ ID NO: 35583 - RNA, 20 nt, Human
ggccuccuccucccuggugg

SEQ ID NO: 35584 - RNA, 19 nt, Human
ucaccuucagaaucauguc

SEQ ID NO: 35585 - RNA, 26 nt, Human
ccugcuggcccacuguguggcagggg

SEQ ID NO: 35586 - RNA, 24 nt, Human
acccaggcuggagugaucucagcu

SEQ ID NO: 35587 - RNA, 24 nt, Human
ugccugcuugcuucucuggcugcc

SEQ ID NO: 35588 - RNA, 24 nt, Human
ugcgccgccgagccagcugccaga

SEQ ID NO: 35589 - RNA, 20 nt, Human
cugcagcugcgcugggggcu

SEQ ID NO: 35590 - RNA, 22 nt, Human
uccuuccugccuuuuagcucua

SEQ ID NO: 35591 - RNA, 21 nt, Human
gcaggggaauuugcacuauua

SEQ ID NO: 35592 - RNA, 21 nt, Human
ccuaaucugaaaauccaagau

SEQ ID NO: 35593 - RNA, 22 nt, Human
ucuuucugccugccuguccuca

SEQ ID NO: 35594 - RNA, 22 nt, Human
gcuucucauuuuccauucccuu

SEQ ID NO: 35595 - RNA, 22 nt, Human
gagccucccuuccccauuccca

SEQ ID NO: 35596 - RNA, 23 nt, Human
cugguccccacagcccacaggau

SEQ ID NO: 35597 - RNA, 25 nt, Human
acucacugcauuucugugcucccuc

SEQ ID NO: 35598 - RNA, 21 nt, Human
aggguccaaggccacgcuugg

SEQ ID NO: 35599 - RNA, 25 nt, Human
cugcccaggcuggaauccaagagug

SEQ ID NO: 35600 - RNA, 22 nt, Human
ggacagagaauguuacugugaa

SEQ ID NO: 35601 - RNA, 23 nt, Human
guggggcaggacaagggccuggg

SEQ ID NO: 35602 - RNA, 22 nt, Human
ccgaguugcugggauugcgggc

SEQ ID NO: 35603 - RNA, 23 nt, Human
gucugguggguauggacagacag

SEQ ID NO: 35604 - RNA, 21 nt, Human
ggagaaagucgaggcagcagc

SEQ ID NO: 35605 - RNA, 22 nt, Human
cagagccacugggcacuuuguu

SEQ ID NO: 35606 - RNA, 27 nt, Human
guuuuucuccaucuccugggacguagc

SEQ ID NO: 35607 - RNA, 23 nt, Human
uguugcccaggcuggagugcaau

SEQ ID NO: 35608 - RNA, 23 nt, Human
gaccucgugaucuacccaccucg

SEQ ID NO: 35609 - RNA, 22 nt, Human
cugaggcagguggaucacuuga

SEQ ID NO: 35610 - RNA, 21 nt, Human
uacaugccugauggcaccuua

SEQ ID NO: 35611 - RNA, 22 nt, Human
aguggaggcugggaugggugag

SEQ ID NO: 35612 - RNA, 22 nt, Human
gucagccucccaaguagcuggg

SEQ ID NO: 35613 - RNA, 23 nt, Human
ugcagcucuccgggcgaugccag

SEQ ID NO: 35614 - RNA, 24 nt, Human
cucuccucugggcuccuccuugcc

SEQ ID NO: 35615 - RNA, 22 nt, Human
cugagccuucauuuccucaucu

SEQ ID NO: 35616 - RNA, 20 nt, Human
auuugguaagaagaaauacu

SEQ ID NO: 35617 - RNA, 22 nt, Human
cuaagaucgcgccauugcacuc

SEQ ID NO: 35618 - RNA, 22 nt, Human
ccaagaucgugccauugcacuc

SEQ ID NO: 35619 - RNA, 22 nt, Human
gaccccugguguaggccugggc

SEQ ID NO: 35620 - RNA, 22 nt, Human
ccccagcccaggucugcacucg

SEQ ID NO: 35621 - RNA, 25 nt, Human
uccugaagaaauaagccucaguuuu

SEQ ID NO: 35622 - RNA, 24 nt, Human
cuguggaugaggccagacuggaag

SEQ ID NO: 35623 - RNA, 26 nt, Human
cgccccucaggcccagccucuggcaa

SEQ ID NO: 35624 - RNA, 26 nt, Human
cccugucuucuccccuaggugguucc

SEQ ID NO: 35625 - RNA, 23 nt, Human
gagaggaggcuucagucucagug

SEQ ID NO: 35626 - RNA, 22 nt, Human
ugcaugcuuuggaaauuuggaa

SEQ ID NO: 35627 - RNA, 27 nt, Human
aaagcuguguugguguuuuauuguaca

SEQ ID NO: 35628 - RNA, 24 nt, Human
ucacgaaucagcugcaggucucug

SEQ ID NO: 35629 - RNA, 20 nt, Human
cucucuuccacaggaggccu

SEQ ID NO: 35630 - RNA, 20 nt, Human
agggcuccccugugugugag

SEQ ID NO: 35631 - RNA, 26 nt, Human
aaauggauaaaagguauuucacugga

SEQ ID NO: 35632 - RNA, 24 nt, Human
ugcaggccuguucccuaaggggcc

SEQ ID NO: 35633 - RNA, 21 nt, Human
uuuuacaaucuucuucaaaua

SEQ ID NO: 35634 - RNA, 22 nt, Human
aggcggcggcggcagaggagug

SEQ ID NO: 35635 - RNA, 24 nt, Human
ggcuuggaaccuaagguuguuccc

SEQ ID NO: 35636 - RNA, 26 nt, Human
uugggaggcuaaggcaggagaauggc

SEQ ID NO: 35637 - RNA, 27 nt, Human
cuccuugucuauccuuccucccccacc

SEQ ID NO: 35638 - RNA, 26 nt, Human
ucaggauauggcuuaggaaugacuua

SEQ ID NO: 35639 - RNA, 24 nt, Human
gggacaggcugaagagagggacag

SEQ ID NO: 35640 - RNA, 22 nt, Human
ggcacuagguaaagcccaguga

SEQ ID NO: 35641 - RNA, 21 nt, Human
ggagguugagaacugggcgug

SEQ ID NO: 35642 - RNA, 22 nt, Human
cugaggcagaagaauugcuuua

SEQ ID NO: 35643 - RNA, 27 nt, Human
caaaggcaagacucucucugaugguca

SEQ ID NO: 35644 - RNA, 24 nt, Human
ggcagacacacaaccuccuccucc

SEQ ID NO: 35645 - RNA, 24 nt, Human
aagaugugguggccugacaccugc

SEQ ID NO: 35646 - RNA, 21 nt, Human
ggcucaugaaggggaacaagc

SEQ ID NO: 35647 - RNA, 20 nt, Human
caggaguuugaggcugcagu

SEQ ID NO: 35648 - RNA, 25 nt, Human
gauaguuuuuauaguuccuucuguc

SEQ ID NO: 35649 - RNA, 27 nt, Human
cuccgaaugugcuccaggcgacaccau

SEQ ID NO: 35650 - RNA, 26 nt, Human
gccauccugggaccccaggcgugcag

SEQ ID NO: 35651 - RNA, 32 nt, Human
accucguagaccugaucacacuguacugaaga

SEQ ID NO: 35652 - RNA, 24 nt, Human
guguuuccuucuuugcuuucaucc

SEQ ID NO: 35653 - RNA, 22 nt, Human
gaauacugcguguucucacuua

SEQ ID NO: 35654 - RNA, 22 nt, Human
uuugagcaauucuccugccuca

SEQ ID NO: 35655 - RNA, 19 nt, Human
gggccucaggaggagggag

SEQ ID NO: 35656 - RNA, 23 nt, Human
guaaugugccagcauugugccca

SEQ ID NO: 35657 - RNA, 20 nt, Human
gcuuauagcugcuucauucu

SEQ ID NO: 35658 - RNA, 22 nt, Human
cacaaggucaagaguucgugac

SEQ ID NO: 35659 - RNA, 22 nt, Human
cauuaccagcugugauucucca

SEQ ID NO: 35660 - RNA, 19 nt, Human
uugguuagaggaaggcuga

SEQ ID NO: 35661 - RNA, 26 nt, Human
uugucuauuugcuguugauuguacca

SEQ ID NO: 35662 - RNA, 27 nt, Human
gaaaugagagccuauaagugcccagua

SEQ ID NO: 35663 - RNA, 28 nt, Human
cccucucccugcugcuucauacugaaac

SEQ ID NO: 35664 - RNA, 21 nt, Human
ccacagcuguguacuuguuug

SEQ ID NO: 35665 - RNA, 25 nt, Human
ccauccggccucugugucaagaggu

SEQ ID NO: 35666 - RNA, 23 nt, Human
caccggagucaggaguucgagac

SEQ ID NO: 35667 - RNA, 23 nt, Human
gcgggagguggguggcugcgggg

SEQ ID NO: 35668 - RNA, 23 nt, Human
caaagggcccacagugacuuuug

SEQ ID NO: 35669 - RNA, 21 nt, Human
uuauuucuuaacugugcuggg

SEQ ID NO: 35670 - RNA, 27 nt, Human
cgcugccucugcugccgggccuggacc

SEQ ID NO: 35671 - RNA, 24 nt, Human
cacugacacuccagacuaaagcag

SEQ ID NO: 35672 - RNA, 25 nt, Human
aaccaguccccccacccucauucua

SEQ ID NO: 35673 - RNA, 27 nt, Human
guuuugagcuuauuuagaguccuaguu

SEQ ID NO: 35674 - RNA, 21 nt, Human
ucauaauuaauguaguaguaa

SEQ ID NO: 35675 - RNA, 22 nt, Human
aaguagcugggaccacaggcau

SEQ ID NO: 35676 - RNA, 22 nt, Human
aaguagcugagacuacaagcac

SEQ ID NO: 35677 - RNA, 19 nt, Human
uuucgcucacacaaagccg

SEQ ID NO: 35678 - RNA, 22 nt, Human
accagccuggccaacgugguga

SEQ ID NO: 35679 - RNA, 23 nt, Human
gggaccuucgcgacacaccagau

SEQ ID NO: 35680 - RNA, 21 nt, Human
gagugacccucggcugucacc

SEQ ID NO: 35681 - RNA, 19 nt, Human
gaguguccggcaucugcug

SEQ ID NO: 35682 - RNA, 26 nt, Human
gggggcggacagauuugcacggcgga

SEQ ID NO: 35683 - RNA, 17 nt, Human
guacaguguauauuccu

SEQ ID NO: 35684 - RNA, 20 nt, Human
gguuuuagacugaacuucgg

SEQ ID NO: 35685 - RNA, 19 nt, Human
acucugggccucuggagcu

SEQ ID NO: 35686 - RNA, 21 nt, Human
cuucacuuaccugucucucca

SEQ ID NO: 35687 - RNA, 26 nt, Human
gcugccugcuuuccugggcacucaug

SEQ ID NO: 35688 - RNA, 21 nt, Human
gggaggccacgggugcugcug

SEQ ID NO: 35689 - RNA, 27 nt, Human
cccucauuuaucacucugaccuucaca

SEQ ID NO: 35690 - RNA, 21 nt, Human
aaauagccgcacaaagggguc

SEQ ID NO: 35691 - RNA, 20 nt, Human
uauuggugguuugucuucuu

SEQ ID NO: 35692 - RNA, 22 nt, Human
aaaguguugggauuacaggcau

SEQ ID NO: 35693 - RNA, 22 nt, Human
uccaaucucaaggaaucuuuaa

SEQ ID NO: 35694 - RNA, 22 nt, Human
auaaaugccuaauuucauucuu

SEQ ID NO: 35695 - RNA, 26 nt, Human
aaucaauuugaaaaucauguuuuuau

SEQ ID NO: 35696 - RNA, 18 nt, Human
ccagcagccucagcuuua

SEQ ID NO: 35697 - RNA, 21 nt, Human
uucccguggcccugccuauac

SEQ ID NO: 35698 - RNA, 23 nt, Human
aacagugaaagcacaagauuucc

SEQ ID NO: 35699 - RNA, 18 nt, Human
cuuguccuggaguaugga

SEQ ID NO: 35700 - RNA, 25 nt, Human
cggacuuaggcuacccccuccaguu

SEQ ID NO: 35701 - RNA, 21 nt, Human
gccagccccucacacucccag

SEQ ID NO: 35702 - RNA, 22 nt, Human
ccauugcacuccagccugggcg

SEQ ID NO: 35703 - RNA, 22 nt, Human
ccaucgcacuccagccugggug

SEQ ID NO: 35704 - RNA, 24 nt, Human
guugugaguagugcuuuucauucu

SEQ ID NO: 35705 - RNA, 27 nt, Human
gggccugguucugaggggucggcuuga

SEQ ID NO: 35706 - RNA, 20 nt, Human
aucaagaucuucccucucug

SEQ ID NO: 35707 - RNA, 23 nt, Human
auagugccacugcacuccagccu

SEQ ID NO: 35708 - RNA, 20 nt, Human
gucacuggcuggacuccugu

SEQ ID NO: 35709 - RNA, 23 nt, Human
cggggucgcgggacaggagaagc

SEQ ID NO: 35710 - RNA, 20 nt, Human
cugaaguuuuaaaaauguca

SEQ ID NO: 35711 - RNA, 25 nt, Human
gugccucaacauggagccuugccug

SEQ ID NO: 35712 - RNA, 21 nt, Human
gcugcagcugcugccgccgcc

SEQ ID NO: 35713 - RNA, 22 nt, Human
guuucuuagucauuacuguccu

SEQ ID NO: 35714 - RNA, 21 nt, Human
gggauuccaaccgaggcucca

SEQ ID NO: 35715 - RNA, 22 nt, Human
gcgaauacggcugcaaaagccu

SEQ ID NO: 35716 - RNA, 21 nt, Human
uccagcugaaagaaaccuuug

SEQ ID NO: 35717 - RNA, 27 nt, Human
caggaagcagagguugcaguaagcuga

SEQ ID NO: 35718 - RNA, 21 nt, Human
gcuaugcccgcggcauggccc

SEQ ID NO: 35719 - RNA, 18 nt, Human
uccuucaaaagaaccaca

SEQ ID NO: 35720 - RNA, 27 nt, Human
ucccacucuuaucaccucuccccagca

SEQ ID NO: 35721 - RNA, 22 nt, Human
aguuauuuuguucuguucuguc

SEQ ID NO: 35722 - RNA, 23 nt, Human
ucuuuuucuuggauuuccagaaa

SEQ ID NO: 35723 - RNA, 20 nt, Human
gcucagugcaaccucugccu

SEQ ID NO: 35724 - RNA, 23 nt, Human
acuuuucuuuuuaaccuucugca

SEQ ID NO: 35725 - RNA, 20 nt, Human
aaauauaacuggaucugcca

SEQ ID NO: 35726 - RNA, 31 nt, Human
cccgcugccugcccugcuccaggcuccaccu

SEQ ID NO: 35727 - RNA, 21 nt, Human
cucagugccugcucucaucca

SEQ ID NO: 35728 - RNA, 22 nt, Human
gugcaauuuguuugugcuucua

SEQ ID NO: 35729 - RNA, 23 nt, Human
cacugugaacuaaugacaaguga

SEQ ID NO: 35730 - RNA, 22 nt, Human
ucccagcccagccccgccccgu

SEQ ID NO: 35731 - RNA, 21 nt, Human
aacacagcacugcauugucca

SEQ ID NO: 35732 - RNA, 22 nt, Human
gcuagccucaaacuccugggcu

SEQ ID NO: 35733 - RNA, 20 nt, Human
auuguccuuuccauucucaa

SEQ ID NO: 35734 - RNA, 22 nt, Human
uugggggcaguguugugcccug

SEQ ID NO: 35735 - RNA, 22 nt, Human
caccacacccagccccuuucca

SEQ ID NO: 35736 - RNA, 27 nt, Human
uugccacugcacaccagccugggcaac

SEQ ID NO: 35737 - RNA, 22 nt, Human
aauaguggaggccuucaacuga

SEQ ID NO: 35738 - RNA, 27 nt, Human
uguggugaguggagcacgugagacacg

SEQ ID NO: 35739 - RNA, 21 nt, Human
agauggcacaggcaccaggug

SEQ ID NO: 35740 - RNA, 25 nt, Human
ugguuguacguuuugcacauuuugu

SEQ ID NO: 35741 - RNA, 22 nt, Human
ucuccugcugcuccuguuuguc

SEQ ID NO: 35742 - RNA, 20 nt, Human
uggcuguugagaugggugga

SEQ ID NO: 35743 - RNA, 21 nt, Human
gccucaugccuauaaucccag

SEQ ID NO: 35744 - RNA, 21 nt, Human
gccucccaggucaagugauuc

SEQ ID NO: 35745 - RNA, 20 nt, Human
cugcacccuucuuuucucau

SEQ ID NO: 35746 - RNA, 20 nt, Human
ggagcagucagcauucuucc

SEQ ID NO: 35747 - RNA, 22 nt, Human
uucaagaaaucugugccugaga

SEQ ID NO: 35748 - RNA, 24 nt, Human
ugauugaagauauauucuuucuga

SEQ ID NO: 35749 - RNA, 22 nt, Human
accagcacugcucuuccccucc

SEQ ID NO: 35750 - RNA, 28 nt, Human
cacugcgggacgguggcucugcagugga

SEQ ID NO: 35751 - RNA, 22 nt, Human
gugccucccucccuccuuccuc

SEQ ID NO: 35752 - RNA, 21 nt, Human
ugugggccaccaugucuggcu

SEQ ID NO: 35753 - RNA, 27 nt, Human
gggggaugugcgcauguucgauagcau

SEQ ID NO: 35754 - RNA, 24 nt, Human
ccugaagucugugccccacuucuc

SEQ ID NO: 35755 - RNA, 21 nt, Human
uuuggaauucaauggguaaau

SEQ ID NO: 35756 - RNA, 22 nt, Human
auauguauuugccuauauugug

SEQ ID NO: 35757 - RNA, 22 nt, Human
gaugaaagaaaugguugcugaa

SEQ ID NO: 35758 - RNA, 22 nt, Human
gggucugauuugcccagccugu

SEQ ID NO: 35759 - RNA, 21 nt, Human
ccagaggcugccccaccccuc

SEQ ID NO: 35760 - RNA, 26 nt, Human
cuuauucccuuccugccagccccugc

SEQ ID NO: 35761 - RNA, 20 nt, Human
aggguggccaaacaggucag

SEQ ID NO: 35762 - RNA, 27 nt, Human
uucuccuuccuccugcuacugauacca

SEQ ID NO: 35763 - RNA, 23 nt, Human
ucccccacugcugcccuccuguc

SEQ ID NO: 35764 - RNA, 25 nt, Human
ccuaauucucaucugucagauccag

SEQ ID NO: 35765 - RNA, 25 nt, Human
uguuauuuuccuucccuuucuugaa

SEQ ID NO: 35766 - RNA, 22 nt, Human
gcccuuccuuccauuuuugauu

SEQ ID NO: 35767 - RNA, 18 nt, Human
ggugauuucagaaagcua

SEQ ID NO: 35768 - RNA, 21 nt, Human
aagaaguuugguuauauuuca

SEQ ID NO: 35769 - RNA, 27 nt, Human
gugugcucugugucacuguggauugga

SEQ ID NO: 35770 - RNA, 24 nt, Human
aaacccagcaaacacugaagggcu

SEQ ID NO: 35771 - RNA, 22 nt, Human
aaaaggagaaggagccagagua

SEQ ID NO: 35772 - RNA, 21 nt, Human
ccguugucugucucuaguuuc

SEQ ID NO: 35773 - RNA, 26 nt, Human
gugaguuaggaagucagcagcagggg

SEQ ID NO: 35774 - RNA, 23 nt, Human
guaauuuccaguucuuacacucu

SEQ ID NO: 35775 - RNA, 23 nt, Human
uugacaucuucagcuuccagaca

SEQ ID NO: 35776 - RNA, 21 nt, Human
cagagggcuacaacuuccaua

SEQ ID NO: 35777 - RNA, 23 nt, Human
uucucuucacugguuuaucugca

SEQ ID NO: 35778 - RNA, 23 nt, Human
ccugcccagguguggagcgaggg

SEQ ID NO: 35779 - RNA, 24 nt, Human
aucuguuaaggcaaaacagagaaa

SEQ ID NO: 35780 - RNA, 22 nt, Human
acggaagggcucuuucacagcu

SEQ ID NO: 35781 - RNA, 27 nt, Human
ccaucuacaacagcagaaaagcugagg

SEQ ID NO: 35782 - RNA, 21 nt, Human
gccacaggugccacugccucc

SEQ ID NO: 35783 - RNA, 23 nt, Human
cacccaggcugcagggugaggcc

SEQ ID NO: 35784 - RNA, 23 nt, Human
aaccuauauuaacuuuauuuuug

SEQ ID NO: 35785 - RNA, 22 nt, Human
uuacuauucaagcuauaauuca

SEQ ID NO: 35786 - RNA, 20 nt, Human
ggagguggagguugcaguga

SEQ ID NO: 35787 - RNA, 20 nt, Human
aggucucaaaauauaacucg

SEQ ID NO: 35788 - RNA, 23 nt, Human
uuuucuccaucauccugauuagc

SEQ ID NO: 35789 - RNA, 20 nt, Human
ccuaucucuuggugaucccc

SEQ ID NO: 35790 - RNA, 21 nt, Human
uuuuagcauuaaaggcugaug

SEQ ID NO: 35791 - RNA, 21 nt, Human
ugugcuacugacaagugccuc

SEQ ID NO: 35792 - RNA, 24 nt, Human
acaaguguuucuaguaacaguauu

SEQ ID NO: 35793 - RNA, 21 nt, Human
ucaugcaagcuuccucccuca

SEQ ID NO: 35794 - RNA, 25 nt, Human
acccagacuggagugcagugccaca

SEQ ID NO: 35795 - RNA, 17 nt, Human
auuggcagaaacaguga

SEQ ID NO: 35796 - RNA, 23 nt, Human
agcccuucaggccugagaucaga

SEQ ID NO: 35797 - RNA, 22 nt, Human
ugcugauuuguuuacuacagca

SEQ ID NO: 35798 - RNA, 23 nt, Human
uagauucuguaaucuucacauuc

SEQ ID NO: 35799 - RNA, 21 nt, Human
uguggcugcgccccucaggcc

SEQ ID NO: 35800 - RNA, 20 nt, Human
gggugcaaugggacagcugc

SEQ ID NO: 35801 - RNA, 17 nt, Human
ggaaacacaacguugaa

SEQ ID NO: 35802 - RNA, 19 nt, Human
ggagcuuggcuuguaucca

SEQ ID NO: 35803 - RNA, 27 nt, Human
cagcucacaccaacugcagccgcggcg

SEQ ID NO: 35804 - RNA, 22 nt, Human
cugggagggcggggugggggug

SEQ ID NO: 35805 - RNA, 23 nt, Human
uggugcagaggugagcagaggag

SEQ ID NO: 35806 - RNA, 21 nt, Human
ccuccaucuucauuggcugca

SEQ ID NO: 35807 - RNA, 21 nt, Human
cucucauuuggacuugcugaa

SEQ ID NO: 35808 - RNA, 21 nt, Human
auuguucuucuccccuuucaa

SEQ ID NO: 35809 - RNA, 23 nt, Human
gucggggccugggacacuucccu

SEQ ID NO: 35810 - RNA, 22 nt, Human
ugccaggguggaugaaaaggug

SEQ ID NO: 35811 - RNA, 23 nt, Human
cuguugccagacuggagugcagu

SEQ ID NO: 35812 - RNA, 20 nt, Human
cugagcggacugcuccaagu

SEQ ID NO: 35813 - RNA, 22 nt, Human
uuugggaauaggcaucaauggg

SEQ ID NO: 35814 - RNA, 23 nt, Human
uauuaaaacugugaagcuuucuc

SEQ ID NO: 35815 - RNA, 27 nt, Human
uucagcuuucugacauguccagcccau

SEQ ID NO: 35816 - RNA, 25 nt, Human
cuugugcacaucagaacacuggacu

SEQ ID NO: 35817 - RNA, 22 nt, Human
gggauuacaggugugaaccacc

SEQ ID NO: 35818 - RNA, 19 nt, Human
guuggguuguucuggauuu

SEQ ID NO: 35819 - RNA, 23 nt, Human
cccaggcucuacuccaucccauu

SEQ ID NO: 35820 - RNA, 25 nt, Human
ccugccggccugccugccacagccg

SEQ ID NO: 35821 - RNA, 20 nt, Human
cccccagacccuucuugaaa

SEQ ID NO: 35822 - RNA, 26 nt, Human
cgaugccaccaccgucagacauuguc

SEQ ID NO: 35823 - RNA, 22 nt, Human
cugcuccaacuuccugcucuca

SEQ ID NO: 35824 - RNA, 22 nt, Human
uuuacuuccugcaaacugguga

SEQ ID NO: 35825 - RNA, 21 nt, Human
acauaguuuucuaaaaagccu

SEQ ID NO: 35826 - RNA, 22 nt, Human
gucgugugggguucucagugcc

SEQ ID NO: 35827 - RNA, 23 nt, Human
uucccuugauucaaauaacccug

SEQ ID NO: 35828 - RNA, 21 nt, Human
acccuacuggagcaauuugug

SEQ ID NO: 35829 - RNA, 21 nt, Human
aacucacugcucacccucuuc

SEQ ID NO: 35830 - RNA, 20 nt, Human
uugagucuggcucugucacc

SEQ ID NO: 35831 - RNA, 25 nt, Human
gggcgggaggaggggcacacaugcc

SEQ ID NO: 35832 - RNA, 27 nt, Human
uccuccugguguccuggccgcuggcgu

SEQ ID NO: 35833 - RNA, 22 nt, Human
cacucacuauaaaauaggucuc

SEQ ID NO: 35834 - RNA, 26 nt, Human
ucugaccuucuucaugugggcacaga

SEQ ID NO: 35835 - RNA, 22 nt, Human
uggucuuaaacuccuaaccuca

SEQ ID NO: 35836 - RNA, 23 nt, Human
ggcuggccagacuucagcuguuc

SEQ ID NO: 35837 - RNA, 23 nt, Human
ccugcucccccgaccaccuccuc

SEQ ID NO: 35838 - RNA, 28 nt, Human
gacuuaggcagaacaugccuucccuagu

SEQ ID NO: 35839 - RNA, 27 nt, Human
ugugggcccucugggcuccugccucag

SEQ ID NO: 35840 - RNA, 25 nt, Human
uucagcuuuguuuaaagugauuuga

SEQ ID NO: 35841 - RNA, 23 nt, Human
cacguugggacagggagguguga

SEQ ID NO: 35842 - RNA, 18 nt, Human
ccaacuuggucuuucaca

SEQ ID NO: 35843 - RNA, 22 nt, Human
aaaaauugaauaaccaugugaa

SEQ ID NO: 35844 - RNA, 22 nt, Human
gcagggcuuuaggauguucugg

SEQ ID NO: 35845 - RNA, 23 nt, Human
ugugaugucaaaaaguuguauca

SEQ ID NO: 35846 - RNA, 21 nt, Human
auucugccccacacccagcca

SEQ ID NO: 35847 - RNA, 23 nt, Human
cuuaugucaguugucuacucugg

SEQ ID NO: 35848 - RNA, 23 nt, Human
gcaccuugcaggcagccuucuga

SEQ ID NO: 35849 - RNA, 24 nt, Human
aacaagagggaagcaacugugaug

SEQ ID NO: 35850 - RNA, 22 nt, Human
caaggagccugagcccaggaag

SEQ ID NO: 35851 - RNA, 27 nt, Human
uugccuaaauuuuaaaaucuuccuaca

SEQ ID NO: 35852 - RNA, 23 nt, Human
ggaggguggggagggcgggggaa

SEQ ID NO: 35853 - RNA, 21 nt, Human
aggcaaaaccugaaccaccuu

SEQ ID NO: 35854 - RNA, 22 nt, Human
aaagugcugggauuacaggugu

SEQ ID NO: 35855 - RNA, 26 nt, Human
auucacauggaaauggggaagauggu

SEQ ID NO: 35856 - RNA, 23 nt, Human
uggagugagacccaggagccgga

SEQ ID NO: 35857 - RNA, 27 nt, Human
agaacaaugccaacaaagcuuacaaca

SEQ ID NO: 35858 - RNA, 22 nt, Human
uguuuuuagaaauuuauucuua

SEQ ID NO: 35859 - RNA, 27 nt, Human
auggacucuacacugugaacuugggga

SEQ ID NO: 35860 - RNA, 27 nt, Human
ggucucgaucuccugaccuugugaucu

SEQ ID NO: 35861 - RNA, 22 nt, Human
guugccuaggcuggaaauagga

SEQ ID NO: 35862 - RNA, 27 nt, Human
uggcuaacacggugaaaccccuuaucu

SEQ ID NO: 35863 - RNA, 20 nt, Human
uuuaguauuccaagugccuu

SEQ ID NO: 35864 - RNA, 20 nt, Human
ggggcgaucaccugagguua

SEQ ID NO: 35865 - RNA, 27 nt, Human
gagcaaagaaauaccaaaacuacuuua

SEQ ID NO: 35866 - RNA, 27 nt, Human
uacucaguuaggcagugcaguacucag

SEQ ID NO: 35867 - RNA, 17 nt, Human
agcuaaaauugugugcc

SEQ ID NO: 35868 - RNA, 17 nt, Human
acugggcuuaugccuua

SEQ ID NO: 35869 - RNA, 24 nt, Human
acucaggauggucaucuuggaggg

SEQ ID NO: 35870 - RNA, 23 nt, Human
ccuccacuguugaggcuggcugc

SEQ ID NO: 35871 - RNA, 21 nt, Human
ggcauuuuccuaccuuccugu

SEQ ID NO: 35872 - RNA, 25 nt, Human
ggaagggaggggaaggggccgggga

SEQ ID NO: 35873 - RNA, 22 nt, Human
uuguaagcucaccuaagauaua

SEQ ID NO: 35874 - RNA, 21 nt, Human
aagugcccucauuuguggccc

SEQ ID NO: 35875 - RNA, 27 nt, Human
gaggaagaaggaaggagaggcuuggaa

SEQ ID NO: 35876 - RNA, 22 nt, Human
cccaaguagccgggauugcagg

SEQ ID NO: 35877 - RNA, 24 nt, Human
ugugcugcaggacuccggaggcag

SEQ ID NO: 35878 - RNA, 22 nt, Human
guugcccaggcuggucucaaac

SEQ ID NO: 35879 - RNA, 23 nt, Human
aaacugucuuuucucacugcuuu

SEQ ID NO: 35880 - RNA, 21 nt, Human
uacaguuuuguuuauauugua

SEQ ID NO: 35881 - RNA, 22 nt, Human
aggauuacagguaugagccauu

SEQ ID NO: 35882 - RNA, 22 nt, Human
cacugcauuccagccugugcga

SEQ ID NO: 35883 - RNA, 26 nt, Human
accgagguucacggucugaguaacac

SEQ ID NO: 35884 - RNA, 23 nt, Human
gagucagaaauucaggagccagu

SEQ ID NO: 35885 - RNA, 24 nt, Human
auuugcugagcauguacugagccu

SEQ ID NO: 35886 - RNA, 29 nt, Human
uuuagugcucccugcaccaaccucccauc

SEQ ID NO: 35887 - RNA, 22 nt, Human
gaaugccaucugauaaaaaaga

SEQ ID NO: 35888 - RNA, 26 nt, Human
uuguaaugcuaccucuugaaacugac

SEQ ID NO: 35889 - RNA, 20 nt, Human
uucuccuccguuuccccagc

SEQ ID NO: 35890 - RNA, 21 nt, Human
uggaaguggagguugcaguga

SEQ ID NO: 35891 - RNA, 22 nt, Human
agaccagccugggcaacauagc

SEQ ID NO: 35892 - RNA, 22 nt, Human
agaccagccuggguaacauagu

SEQ ID NO: 35893 - RNA, 29 nt, Human
gugaugaggaggacaacacugccuuucaa

SEQ ID NO: 35894 - RNA, 21 nt, Human
ccuuccuggcaccccugcugc

SEQ ID NO: 35895 - RNA, 22 nt, Human
cccugcagcaagcaaaaguugu

SEQ ID NO: 35896 - RNA, 25 nt, Human
augucuggagugauugugguucuug

SEQ ID NO: 35897 - RNA, 28 nt, Human
ggcgcggaggcaggaggagcagucucau

SEQ ID NO: 35898 - RNA, 24 nt, Human
gcgucaggcccagcgcacagccug

SEQ ID NO: 35899 - RNA, 21 nt, Human
uuugaggcacauucccaguga

SEQ ID NO: 35900 - RNA, 20 nt, Human
gcagaaagcauuuucugcaa

SEQ ID NO: 35901 - RNA, 22 nt, Human
ugggacagaauuggauacauac

SEQ ID NO: 35902 - RNA, 21 nt, Human
cucggucucaaaaacaaaaca

SEQ ID NO: 35903 - RNA, 23 nt, Human
ucccucuuccugaaacuggacug

SEQ ID NO: 35904 - RNA, 26 nt, Human
auuuacuguuacucaguugguacaau

SEQ ID NO: 35905 - RNA, 22 nt, Human
aguaauuugggcccagugccuu

SEQ ID NO: 35906 - RNA, 22 nt, Human
guucaggucucuagaugucuag

SEQ ID NO: 35907 - RNA, 28 nt, Human
uuuagguucugugaacuugcgagucaug

SEQ ID NO: 35908 - RNA, 25 nt, Human
acuaacuggcguuuucuuagccaua

SEQ ID NO: 35909 - RNA, 21 nt, Human
agauccucucuggggcugugu

SEQ ID NO: 35910 - RNA, 25 nt, Human
gaagagaugcaagcaggaaaaagaa

SEQ ID NO: 35911 - RNA, 24 nt, Human
gucacccaaauagcugagugcagu

SEQ ID NO: 35912 - RNA, 21 nt, Human
uggugguggcagcugggcagg

SEQ ID NO: 35913 - RNA, 21 nt, Human
ccacccucgcuuucuccggcu

SEQ ID NO: 35914 - RNA, 27 nt, Human
ugcacugucauuguaugcaagcauuuu

SEQ ID NO: 35915 - RNA, 22 nt, Human
uuauaagauauaaauggagauu

SEQ ID NO: 35916 - RNA, 23 nt, Human
acucaggaaugggccugguaggc

SEQ ID NO: 35917 - RNA, 21 nt, Human
gaagaaaugcauauugaagua

SEQ ID NO: 35918 - RNA, 22 nt, Human
caggaguucaaagcuguaguga

SEQ ID NO: 35919 - RNA, 19 nt, Human
ccuucauauaaugccuuga

SEQ ID NO: 35920 - RNA, 18 nt, Human
uccucauuuuauauugug

SEQ ID NO: 35921 - RNA, 20 nt, Human
gugcagcugcccacccugcc

SEQ ID NO: 35922 - RNA, 23 nt, Human
cuucuugauuugggccuggugac

SEQ ID NO: 35923 - RNA, 22 nt, Human
uguaugagaggagggaggcagg

SEQ ID NO: 35924 - RNA, 21 nt, Human
ccauugaguacauaucauguc

SEQ ID NO: 35925 - RNA, 21 nt, Human
ccucacugacaggguggggcc

SEQ ID NO: 35926 - RNA, 22 nt, Human
aggcccgaucuccacuguuggg

SEQ ID NO: 35927 - RNA, 28 nt, Human
aacacguaaacaacacagacuucaagca

SEQ ID NO: 35928 - RNA, 22 nt, Human
gcaaagugguaagcacagggug

SEQ ID NO: 35929 - RNA, 21 nt, Human
aauaaugcuacaaucuucaua

SEQ ID NO: 35930 - RNA, 21 nt, Human
gguuuagguuguaauuccuua

SEQ ID NO: 35931 - RNA, 21 nt, Human
gcaccauuuguuuuuuauuuc

SEQ ID NO: 35932 - RNA, 22 nt, Human
gcccaggcuggaguacagugau

SEQ ID NO: 35933 - RNA, 22 nt, Human
agaucagccuggcuaacauggc

SEQ ID NO: 35934 - RNA, 21 nt, Human
cugcucccucgaggccagccu

SEQ ID NO: 35935 - RNA, 21 nt, Human
cuugccuccccacugcagccu

SEQ ID NO: 35936 - RNA, 21 nt, Human
aggcccaggcccucugcucug

SEQ ID NO: 35937 - RNA, 18 nt, Human
gucucaucuuccacccca

SEQ ID NO: 35938 - RNA, 25 nt, Human
uuaauaagauagcacauugacuuuu

SEQ ID NO: 35939 - RNA, 21 nt, Human
uuaggaaucacgcaaagugcu

SEQ ID NO: 35940 - RNA, 21 nt, Human
gcuacgccuguaaucccagca

SEQ ID NO: 35941 - RNA, 22 nt, Human
agaauggagaaaaugaaugaag

SEQ ID NO: 35942 - RNA, 25 nt, Human
ccacagggaggcauggagugccaug

SEQ ID NO: 35943 - RNA, 23 nt, Human
gugcugaagggccaaacguuuuc

SEQ ID NO: 35944 - RNA, 22 nt, Human
uucagucucccaaguagcuugg

SEQ ID NO: 35945 - RNA, 22 nt, Human
uacaaauauacagauauacaaa

SEQ ID NO: 35946 - RNA, 22 nt, Human
cccaccccagugagugccaaag

SEQ ID NO: 35947 - RNA, 18 nt, Human
gauggcauccacugugga

SEQ ID NO: 35948 - RNA, 25 nt, Human
ccuuuccuguuccagaaaaggggcu

SEQ ID NO: 35949 - RNA, 25 nt, Human
auacacacuggacccucucuugcug

SEQ ID NO: 35950 - RNA, 21 nt, Human
agcgagggaguugggucucca

SEQ ID NO: 35951 - RNA, 22 nt, Human
aaugagccaggagaacaaacua

SEQ ID NO: 35952 - RNA, 20 nt, Human
ccucccacuucucacuaaag

SEQ ID NO: 35953 - RNA, 21 nt, Human
cucuccggaggcagaaguugu

SEQ ID NO: 35954 - RNA, 28 nt, Human
ccguacugucuguguccuuguauaagga

SEQ ID NO: 35955 - RNA, 26 nt, Human
caccuugccaggugccguuucucuuc

SEQ ID NO: 35956 - RNA, 24 nt, Human
uacaaggggaagugguguuuaccu

SEQ ID NO: 35957 - RNA, 21 nt, Human
auuucuuaaaauucagugaga

SEQ ID NO: 35958 - RNA, 23 nt, Human
ccucuuguuuuuccucagcugac

SEQ ID NO: 35959 - RNA, 30 nt, Human
ucauuucuuaaggcugccuuccucucugag

SEQ ID NO: 35960 - RNA, 25 nt, Human
uaauucaguucugaaguuauaaacu

SEQ ID NO: 35961 - RNA, 20 nt, Human
uccagaagagacacuuuuua

SEQ ID NO: 35962 - RNA, 23 nt, Human
cccaacauugcugccacugugcu

SEQ ID NO: 35963 - RNA, 22 nt, Human
cagaaaugguagcuauucuaua

SEQ ID NO: 35964 - RNA, 27 nt, Human
uaacaccauuagcuuuugugaucuggu

SEQ ID NO: 35965 - RNA, 27 nt, Human
uucauucuccugguccugugcaucuuc

SEQ ID NO: 35966 - RNA, 21 nt, Human
aauauauuuguacuggagauu

SEQ ID NO: 35967 - RNA, 26 nt, Human
uucauccuuugcacacaguaacaucc

SEQ ID NO: 35968 - RNA, 25 nt, Human
ggagacugcuuuccagacaccuccg

SEQ ID NO: 35969 - RNA, 22 nt, Human
gcugcaggaacaggaaaaagag

SEQ ID NO: 35970 - RNA, 22 nt, Human
ggacuuccaggaggaccccaac

SEQ ID NO: 35971 - RNA, 25 nt, Human
gcucaagcccuguugugguucugca

SEQ ID NO: 35972 - RNA, 21 nt, Human
uccaggccugggaauggauua

SEQ ID NO: 35973 - RNA, 23 nt, Human
uaccuaggagcuguggauguaau

SEQ ID NO: 35974 - RNA, 19 nt, Human
acaguuugauauuuuguaa

SEQ ID NO: 35975 - RNA, 22 nt, Human
cguuggaggcuggagcgcaaug

SEQ ID NO: 35976 - RNA, 24 nt, Human
ugcuuugacucaccuguuacuuga

SEQ ID NO: 35977 - RNA, 24 nt, Human
cacugcuggacuggagcugggcuc

SEQ ID NO: 35978 - RNA, 23 nt, Human
gaaaggguggagaauggagggga

SEQ ID NO: 35979 - RNA, 25 nt, Human
ggaaagaagucacuguugcaauaaa

SEQ ID NO: 35980 - RNA, 23 nt, Human
aaaugauuuuguuaauucuguau

SEQ ID NO: 35981 - RNA, 18 nt, Human
uuucugcuaucaccuucc

SEQ ID NO: 35982 - RNA, 21 nt, Human
caggggaggggagggagcgag

SEQ ID NO: 35983 - RNA, 25 nt, Human
uacaaggucagagagaggaauggaa

SEQ ID NO: 35984 - RNA, 26 nt, Human
agguaagcagucuucugaagcccugu

SEQ ID NO: 35985 - RNA, 21 nt, Human
guugaaguuacagcauuucag

SEQ ID NO: 35986 - RNA, 23 nt, Human
cacaucugcuuuuuggcuuugug

SEQ ID NO: 35987 - RNA, 24 nt, Human
ccagggagcugggagcgagcaagc

SEQ ID NO: 35988 - RNA, 21 nt, Human
cuuuugggggaaaaaagcauu

SEQ ID NO: 35989 - RNA, 22 nt, Human
gccuguaaucccagcauuuugg

SEQ ID NO: 35990 - RNA, 22 nt, Human
gccuguaaccccagcacuuugg

SEQ ID NO: 35991 - RNA, 24 nt, Human
aaccugggagguggaguugcagug

SEQ ID NO: 35992 - RNA, 22 nt, Human
ucacaaaagugguugugauugc

SEQ ID NO: 35993 - RNA, 22 nt, Human
uggcucacgccuguaauccuag

SEQ ID NO: 35994 - RNA, 22 nt, Human
ugguucacgccuguaaucccag

SEQ ID NO: 35995 - RNA, 22 nt, Human
uggcucacgcccguaaucccag

SEQ ID NO: 35996 - RNA, 21 nt, Human
aggacuagauuccuccucaaa

SEQ ID NO: 35997 - RNA, 21 nt, Human
cagugucaaaugcugcagccu

SEQ ID NO: 35998 - RNA, 25 nt, Human
gcuauuucccaagcuggagugcagu

SEQ ID NO: 35999 - RNA, 20 nt, Human
ucuccucucagagaaaggcc

SEQ ID NO: 36000 - RNA, 27 nt, Human
accugcacagcuccccuguccuccucc

SEQ ID NO: 36001 - RNA, 27 nt, Human
uugccucuccccugcucacuccaguca

SEQ ID NO: 36002 - RNA, 24 nt, Human
uuuuccugccugguuucuucuuca

SEQ ID NO: 36003 - RNA, 18 nt, Human
ggaggaaggccagaggaa

SEQ ID NO: 36004 - RNA, 20 nt, Human
acuucaguuuuauuuuugcc

SEQ ID NO: 36005 - RNA, 23 nt, Human
cugugcaggcugaggucuggagc

SEQ ID NO: 36006 - RNA, 23 nt, Human
cucggggaguggcuuuuccagcu

SEQ ID NO: 36007 - RNA, 21 nt, Human
cuuuuuuacucuaugccccaa

SEQ ID NO: 36008 - RNA, 27 nt, Human
ggggacaccucaggagcuuuacucaug

SEQ ID NO: 36009 - RNA, 24 nt, Human
ugcagcgagcaaggggagagccag

SEQ ID NO: 36010 - RNA, 25 nt, Human
gaacccagcuucagggcaucgcgga

SEQ ID NO: 36011 - RNA, 21 nt, Human
ccaacagcaacagcagcuccu

SEQ ID NO: 36012 - RNA, 25 nt, Human
caggaguucgaagcugcagggaccu

SEQ ID NO: 36013 - RNA, 23 nt, Human
ccagauagcagagggguaagaga

SEQ ID NO: 36014 - RNA, 26 nt, Human
gggccugagucuagccugggagccag

SEQ ID NO: 36015 - RNA, 22 nt, Human
cuggugugucucacacaaugcc

SEQ ID NO: 36016 - RNA, 22 nt, Human
aaauguucauggaucaccggcu

SEQ ID NO: 36017 - RNA, 24 nt, Human
ccagcuuccucugugccuccacuc

SEQ ID NO: 36018 - RNA, 22 nt, Human
ucaugccauugcacuccagccu

SEQ ID NO: 36019 - RNA, 22 nt, Human
ucaugccacugcacucuagccu

SEQ ID NO: 36020 - RNA, 25 nt, Human
aaugcaaauacuuuuuaacuuagag

SEQ ID NO: 36021 - RNA, 32 nt, Human
ugaugacauuauuagcagacacugcuuaaagg

SEQ ID NO: 36022 - RNA, 19 nt, Human
uccucaccccuccucugac

SEQ ID NO: 36023 - RNA, 20 nt, Human
ugaccccaggcuuugcucag

SEQ ID NO: 36024 - RNA, 26 nt, Human
ucacgucacaccuuggaucucuauca

SEQ ID NO: 36025 - RNA, 22 nt, Human
cagauguuuuucaguuaucucc

SEQ ID NO: 36026 - RNA, 28 nt, Human
acaguugccuccaaagcugcagauugga

SEQ ID NO: 36027 - RNA, 21 nt, Human
gggcugugcccggggaaaggc

SEQ ID NO: 36028 - RNA, 20 nt, Human
gaggugaggucaggugccuc

SEQ ID NO: 36029 - RNA, 23 nt, Human
uuuucauauauuauuaguaauua

SEQ ID NO: 36030 - RNA, 25 nt, Human
ugguugagaaaugaauaauuuccca

SEQ ID NO: 36031 - RNA, 27 nt, Human
cacugcacuccagccugggcaacagag

SEQ ID NO: 36032 - RNA, 26 nt, Human
cugugcaaagcaugcccuucugcaca

SEQ ID NO: 36033 - RNA, 20 nt, Human
ugggugaaugggcagaggga

SEQ ID NO: 36034 - RNA, 27 nt, Human
augacuuugucccauuucuaaaggccu

SEQ ID NO: 36035 - RNA, 27 nt, Human
ggacaaccgcuacaugccccagcaggc

SEQ ID NO: 36036 - RNA, 21 nt, Human
gcuccuccuguuuaccccaca

SEQ ID NO: 36037 - RNA, 21 nt, Human
cagaggugcgaucucugcuca

SEQ ID NO: 36038 - RNA, 21 nt, Human
cggcugaccauuucugcuccg

SEQ ID NO: 36039 - RNA, 19 nt, Human
cucuggaucugcugcgucc

SEQ ID NO: 36040 - RNA, 27 nt, Human
uuaccuuuugguuaaacuaauaaacua

SEQ ID NO: 36041 - RNA, 20 nt, Human
cugagguacgguaucucucu

SEQ ID NO: 36042 - RNA, 25 nt, Human
ucucucauacuuucucccugucuac

SEQ ID NO: 36043 - RNA, 25 nt, Human
agccuucagucccuaucagcgccuc

SEQ ID NO: 36044 - RNA, 22 nt, Human
ucuuccaugggaugguuagugu

SEQ ID NO: 36045 - RNA, 27 nt, Human
gccagaacugugcccaggcccaaagga

SEQ ID NO: 36046 - RNA, 31 nt, Human
ccuuuuucugugugagaucugugcugcacac

SEQ ID NO: 36047 - RNA, 27 nt, Human
cagcuuuucucggagcgcaguccuggg

SEQ ID NO: 36048 - RNA, 20 nt, Human
aauuccuauuuucugcuuca

SEQ ID NO: 36049 - RNA, 26 nt, Human
aaccugggcaacagaacaagaaccca

SEQ ID NO: 36050 - RNA, 23 nt, Human
uuagagcuucugaguuuccaagc

SEQ ID NO: 36051 - RNA, 24 nt, Human
uuagaaaauauguuuugucacccu

SEQ ID NO: 36052 - RNA, 23 nt, Human
guggcugccacacccaggggaag

SEQ ID NO: 36053 - RNA, 27 nt, Human
cccucauuuaccuuuucuccuacaaag

SEQ ID NO: 36054 - RNA, 26 nt, Human
cuuuuugaccuugcugucuggaugag

SEQ ID NO: 36055 - RNA, 21 nt, Human
ccccuguuuggacuuagugcc

SEQ ID NO: 36056 - RNA, 22 nt, Human
gucgcucaggcuggagugcagu

SEQ ID NO: 36057 - RNA, 22 nt, Human
gucgcccaggcuggagugcagc

SEQ ID NO: 36058 - RNA, 27 nt, Human
ggucaucuaagauuuguuuacaaaugu

SEQ ID NO: 36059 - RNA, 21 nt, Human
ugggcuccuggggcucagccu

SEQ ID NO: 36060 - RNA, 22 nt, Human
cacccagucuggagugcagugg

SEQ ID NO: 36061 - RNA, 22 nt, Human
gcaggagguggaguugcagcug

SEQ ID NO: 36062 - RNA, 24 nt, Human
ugaguggugcccuucugcccacau

SEQ ID NO: 36063 - RNA, 24 nt, Human
uuaccuccguguuucucccuuucg

SEQ ID NO: 36064 - RNA, 29 nt, Human
ggguugggguggagggugcggcccggagu

SEQ ID NO: 36065 - RNA, 15 nt, Human
aaccuauaucucccu

SEQ ID NO: 36066 - RNA, 26 nt, Human
gauugcuuccuucaugucacuuucuu

SEQ ID NO: 36067 - RNA, 21 nt, Human
gcuuucucuuccucccuuagg

SEQ ID NO: 36068 - RNA, 22 nt, Human
uccuaagcuggagugcaguggc

SEQ ID NO: 36069 - RNA, 20 nt, Human
cauaggaggaagguuugcuu

SEQ ID NO: 36070 - RNA, 20 nt, Human
ggggaauggggagagagagg

SEQ ID NO: 36071 - RNA, 25 nt, Human
ugaaaucaaagaauauuuugucuga

SEQ ID NO: 36072 - RNA, 24 nt, Human
ccuggugucuuucuccugggcuuc

SEQ ID NO: 36073 - RNA, 20 nt, Human
agagaaugagauuucugcuu

SEQ ID NO: 36074 - RNA, 28 nt, Human
ucacugcauccuggagugcaaaaauaaa

SEQ ID NO: 36075 - RNA, 19 nt, Human
cuuggacagagguugcuga

SEQ ID NO: 36076 - RNA, 27 nt, Human
ccuuuccuaucuucacaccugccaccu

SEQ ID NO: 36077 - RNA, 18 nt, Human
gaagugagcuuugcugcu

SEQ ID NO: 36078 - RNA, 21 nt, Human
ugggggcagugugagcuuuga

SEQ ID NO: 36079 - RNA, 26 nt, Human
cccagccauggggaagaucaccuucu

SEQ ID NO: 36080 - RNA, 21 nt, Human
uucaagcaauuaacugccuca

SEQ ID NO: 36081 - RNA, 26 nt, Human
ucauucacaucucacaaaaucuugac

SEQ ID NO: 36082 - RNA, 20 nt, Human
uggcacauccuuaauccugu

SEQ ID NO: 36083 - RNA, 24 nt, Human
cugucgcccaggcuggagugcagg

SEQ ID NO: 36084 - RNA, 23 nt, Human
gcauuuugggugggacauauuuc

SEQ ID NO: 36085 - RNA, 20 nt, Human
ggcugaggaggacuugcuca

SEQ ID NO: 36086 - RNA, 25 nt, Human
agcucacauuccugucccuugggug

SEQ ID NO: 36087 - RNA, 17 nt, Human
cuucccuucccuguccc

SEQ ID NO: 36088 - RNA, 22 nt, Human
cccaggagggcauagggcagcc

SEQ ID NO: 36089 - RNA, 25 nt, Human
gaggcgcggcggcggcuggagcagc

SEQ ID NO: 36090 - RNA, 21 nt, Human
ggcagggagugucugcagucc

SEQ ID NO: 36091 - RNA, 23 nt, Human
auuuuaaaaacuaaaaagccauc

SEQ ID NO: 36092 - RNA, 22 nt, Human
ucucagccccucuuuucccaca

SEQ ID NO: 36093 - RNA, 22 nt, Human
ggagaaagaugaaacugaaagc

SEQ ID NO: 36094 - RNA, 27 nt, Human
gcaguguaacccaagcauuuguggaca

SEQ ID NO: 36095 - RNA, 18 nt, Human
ugaucagauuucccacug

SEQ ID NO: 36096 - RNA, 19 nt, Human
uuagagcuccaguugucac

SEQ ID NO: 36097 - RNA, 22 nt, Human
gccugcccucagcacagacucu

SEQ ID NO: 36098 - RNA, 22 nt, Human
caguuucaaacuccugaccuca

SEQ ID NO: 36099 - RNA, 22 nt, Human
gaagggagacaguggcggucgc

SEQ ID NO: 36100 - RNA, 19 nt, Human
auuugucuguggcauugga

SEQ ID NO: 36101 - RNA, 27 nt, Human
aaauguucuucauccaggccugccgug

SEQ ID NO: 36102 - RNA, 27 nt, Human
guccuuaccaauagcaggggcugcagu

SEQ ID NO: 36103 - RNA, 26 nt, Human
cugaguaugugguucaugcuguugug

SEQ ID NO: 36104 - RNA, 22 nt, Human
gaacuccuggccucaagggauc

SEQ ID NO: 36105 - RNA, 31 nt, Human
ucugcucccaucucucucuuugccucauaga

SEQ ID NO: 36106 - RNA, 22 nt, Human
cucggccucccaaagugcugga

SEQ ID NO: 36107 - RNA, 27 nt, Human
gaguagcugggauuacaggcacacacc

SEQ ID NO: 36108 - RNA, 22 nt, Human
ggcaggcagggcuuauuggggc

SEQ ID NO: 36109 - RNA, 27 nt, Human
gcaagggaaaguuucagcucacuguga

SEQ ID NO: 36110 - RNA, 23 nt, Human
aagcaccugcuacacagcaggcu

SEQ ID NO: 36111 - RNA, 21 nt, Human
uccugcuuuacaggaucaugu

SEQ ID NO: 36112 - RNA, 24 nt, Human
gucccagguugcacugcaaccaag

SEQ ID NO: 36113 - RNA, 21 nt, Human
cagauuccagguccaaaguca

SEQ ID NO: 36114 - RNA, 19 nt, Human
ugcugagacgacuacagca

SEQ ID NO: 36115 - RNA, 27 nt, Human
gggggccuaaagcgacagucucagggg

SEQ ID NO: 36116 - RNA, 26 nt, Human
uugccacuguguuucccugccucuca

SEQ ID NO: 36117 - RNA, 17 nt, Human
acucagcuauguuaaca

SEQ ID NO: 36118 - RNA, 22 nt, Human
agcaaacuaaaacuucugggca

SEQ ID NO: 36119 - RNA, 20 nt, Human
cagauguucccugucacuca

SEQ ID NO: 36120 - RNA, 24 nt, Human
uuguacugauauaauuuaguucca

SEQ ID NO: 36121 - RNA, 21 nt, Human
gcuucuccaaggccuggagcu

SEQ ID NO: 36122 - RNA, 22 nt, Human
uugauacauccucaaacuuucc

SEQ ID NO: 36123 - RNA, 21 nt, Human
ccgggaggggacuagaagagc

SEQ ID NO: 36124 - RNA, 27 nt, Human
uccagcagccaccuguggguauuuaug

SEQ ID NO: 36125 - RNA, 25 nt, Human
cucuuucaauguguuuaauuuugga

SEQ ID NO: 36126 - RNA, 21 nt, Human
ggggccaggguggggggcagu

SEQ ID NO: 36127 - RNA, 30 nt, Human
uuuguaguguugcuuagcacuuugcgcauu

SEQ ID NO: 36128 - RNA, 19 nt, Human
ucgcggaucaggagccagc

SEQ ID NO: 36129 - RNA, 24 nt, Human
ugugggugucuccaggcacgggaa

SEQ ID NO: 36130 - RNA, 21 nt, Human
cccagguaggggcaggaugga

SEQ ID NO: 36131 - RNA, 20 nt, Human
gcaaacacugaagggcugga

SEQ ID NO: 36132 - RNA, 21 nt, Human
agcaaaaugaaggaguacaca

SEQ ID NO: 36133 - RNA, 21 nt, Human
cccagccugggcaacagugcg

SEQ ID NO: 36134 - RNA, 27 nt, Human
auugccucugaaaugccucuucuuuau

SEQ ID NO: 36135 - RNA, 23 nt, Human
cugcccucucccugccugggggc

SEQ ID NO: 36136 - RNA, 20 nt, Human
guuuggagagagcagacugg

SEQ ID NO: 36137 - RNA, 21 nt, Human
ucccgccccagccuccugagu

SEQ ID NO: 36138 - RNA, 25 nt, Human
gccaguauuuuuuaacugcauaaua

SEQ ID NO: 36139 - RNA, 21 nt, Human
uccuugccccuucacaagaga

SEQ ID NO: 36140 - RNA, 27 nt, Human
uuucugggcuccuggggcucagccuag

SEQ ID NO: 36141 - RNA, 22 nt, Human
ccacugcacuccagcuugggug

SEQ ID NO: 36142 - RNA, 29 nt, Human
gaucacuuuuccuuuagcauucagaauga

SEQ ID NO: 36143 - RNA, 21 nt, Human
gcagccucucugauguuguca

SEQ ID NO: 36144 - RNA, 22 nt, Human
uccaagucuuugcuauugugaa

SEQ ID NO: 36145 - RNA, 22 nt, Human
ucugccgcaggcugggugcacg

SEQ ID NO: 36146 - RNA, 22 nt, Human
agccucccaaagugcuggaauu

SEQ ID NO: 36147 - RNA, 21 nt, Human
gaagauuuauauuuuacuuua

SEQ ID NO: 36148 - RNA, 27 nt, Human
cuucagcuucagaccccuuccccacca

SEQ ID NO: 36149 - RNA, 21 nt, Human
ccccacagugggaaaggccac

SEQ ID NO: 36150 - RNA, 22 nt, Human
agccuccucuuugguguugcgg

SEQ ID NO: 36151 - RNA, 21 nt, Human
ugggaaaaaaccccacaaaaa

SEQ ID NO: 36152 - RNA, 25 nt, Human
aaccaaaauaaaacugggucacuuu

SEQ ID NO: 36153 - RNA, 22 nt, Human
cacccaggccuuacaguccaac

SEQ ID NO: 36154 - RNA, 22 nt, Human
uaauguaguuuaugugccaaac

SEQ ID NO: 36155 - RNA, 27 nt, Human
uccagaaguucaagcagcagaaggagc

SEQ ID NO: 36156 - RNA, 25 nt, Human
ccaucuugccagcucugucuuucca

SEQ ID NO: 36157 - RNA, 21 nt, Human
uucuacgggggcaguagcuca

SEQ ID NO: 36158 - RNA, 20 nt, Human
cacgcuagggcggggcacag

SEQ ID NO: 36159 - RNA, 20 nt, Human
ccccccacucugcacagccu

SEQ ID NO: 36160 - RNA, 20 nt, Human
aaggcccuuagaggacuuga

SEQ ID NO: 36161 - RNA, 22 nt, Human
ucauccaggcuggagugcagug

SEQ ID NO: 36162 - RNA, 26 nt, Human
cugccaggcuggauaacuguugaaug

SEQ ID NO: 36163 - RNA, 23 nt, Human
ucuuauacuccaaugaguguguu

SEQ ID NO: 36164 - RNA, 23 nt, Human
acagcauuccacagccuggucag

SEQ ID NO: 36165 - RNA, 21 nt, Human
ugcauuuuaaaaacagcacug

SEQ ID NO: 36166 - RNA, 24 nt, Human
gauuuaccguccacauuccucacu

SEQ ID NO: 36167 - RNA, 19 nt, Human
ggcccauauucauucuuug

SEQ ID NO: 36168 - RNA, 24 nt, Human
auguauauaaucauucuauuugcu

SEQ ID NO: 36169 - RNA, 22 nt, Human
ugggaaagccuuuaguuugaag

SEQ ID NO: 36170 - RNA, 23 nt, Human
uuuugucuccuccuuuucuguuc

SEQ ID NO: 36171 - RNA, 20 nt, Human
uguuuccugaauuguaguau

SEQ ID NO: 36172 - RNA, 29 nt, Human
gcucugccuuuuugacuucauacuuugaa

SEQ ID NO: 36173 - RNA, 22 nt, Human
ccuggagauaccauuguggacc

SEQ ID NO: 36174 - RNA, 26 nt, Human
ucugcaguuccaggccagccagaaac

SEQ ID NO: 36175 - RNA, 22 nt, Human
ccaacaugcugaaaccucgucu

SEQ ID NO: 36176 - RNA, 23 nt, Human
auguggaaauuauuucuccauac

SEQ ID NO: 36177 - RNA, 28 nt, Human
cuccugcucccugcuccaggaugaaacc

SEQ ID NO: 36178 - RNA, 21 nt, Human
aaggggaauggcugcuuuuga

SEQ ID NO: 36179 - RNA, 19 nt, Human
ucggucuuugaaacugaca

SEQ ID NO: 36180 - RNA, 26 nt, Human
aggaagagcaguggagccuugcccac

SEQ ID NO: 36181 - RNA, 20 nt, Human
gcagucacagaagaguguau

SEQ ID NO: 36182 - RNA, 21 nt, Human
ccagccugggcaacauaguaa

SEQ ID NO: 36183 - RNA, 21 nt, Human
ggccucccaaaugcugggauu

SEQ ID NO: 36184 - RNA, 25 nt, Human
uuuuacccugaggucacugcuagag

SEQ ID NO: 36185 - RNA, 22 nt, Human
caguuagauuuacuuccucuuu

SEQ ID NO: 36186 - RNA, 22 nt, Human
ugggccuuuuggauaugcugaa

SEQ ID NO: 36187 - RNA, 26 nt, Human
uccuagagugcugggauuacaggugu

SEQ ID NO: 36188 - RNA, 21 nt, Human
uggccuuggcauuucuucuua

SEQ ID NO: 36189 - RNA, 27 nt, Human
caggcugggcuucaguggcagcugcuu

SEQ ID NO: 36190 - RNA, 27 nt, Human
ucuucuuuuucuuaccucccacuaaag

SEQ ID NO: 36191 - RNA, 24 nt, Human
agugguccacagauuugcacuacg

SEQ ID NO: 36192 - RNA, 21 nt, Human
uuguauugucugacacaugcu

SEQ ID NO: 36193 - RNA, 23 nt, Human
gcggcuccaggcugagggucggu

SEQ ID NO: 36194 - RNA, 22 nt, Human
accaguguggccaacaugguga

SEQ ID NO: 36195 - RNA, 23 nt, Human
acgcagcaccagccccggccacc

SEQ ID NO: 36196 - RNA, 19 nt, Human
uggaaagauaaggaccaga

SEQ ID NO: 36197 - RNA, 27 nt, Human
ggugaagcacuccuggcagccacacug

SEQ ID NO: 36198 - RNA, 22 nt, Human
cagcgggcuacccuggacaaag

SEQ ID NO: 36199 - RNA, 32 nt, Human
cgcugcgcaguuuuguucugcuccagcuguuc

SEQ ID NO: 36200 - RNA, 20 nt, Human
ccacuccauaccacagcccu

SEQ ID NO: 36201 - RNA, 25 nt, Human
ucuggggagcgcagcagccauggca

SEQ ID NO: 36202 - RNA, 20 nt, Human
auuaaaacauggaauauuuu

SEQ ID NO: 36203 - RNA, 24 nt, Human
cucuccuccucuuaccuuugugcc

SEQ ID NO: 36204 - RNA, 22 nt, Human
uggcuuacgccuguaauccuag

SEQ ID NO: 36205 - RNA, 21 nt, Human
uccuacucucccccgagcacc

SEQ ID NO: 36206 - RNA, 19 nt, Human
guugcuacccaaauuuuca

SEQ ID NO: 36207 - RNA, 24 nt, Human
ggugacaccuccgagaggcagcca

SEQ ID NO: 36208 - RNA, 26 nt, Human
ucauucucucauucaccaguggugac

SEQ ID NO: 36209 - RNA, 21 nt, Human
cuggccaucccaaaagggcuc

SEQ ID NO: 36210 - RNA, 21 nt, Human
gucugggcccugggugaggua

SEQ ID NO: 36211 - RNA, 22 nt, Human
auuguaaccuucagaguuuagg

SEQ ID NO: 36212 - RNA, 26 nt, Human
cuucugaacagccugccucugcccag

SEQ ID NO: 36213 - RNA, 22 nt, Human
cugugcuggacaagcuguggga

SEQ ID NO: 36214 - RNA, 16 nt, Human
gccacaucgccugaga

SEQ ID NO: 36215 - RNA, 25 nt, Human
ccuuuaguuuauuacaacaagaaga

SEQ ID NO: 36216 - RNA, 22 nt, Human
ccuguucuauguuuuuaagcua

SEQ ID NO: 36217 - RNA, 22 nt, Human
gaacccaggggucugagcaugg

SEQ ID NO: 36218 - RNA, 24 nt, Human
ggcucacugcaagcucugcguccu

SEQ ID NO: 36219 - RNA, 17 nt, Human
accccgcuccucuccgc

SEQ ID NO: 36220 - RNA, 22 nt, Human
uuguuuuaaauaaauugucugu

SEQ ID NO: 36221 - RNA, 25 nt, Human
agcggcacagucauggcucacugga

SEQ ID NO: 36222 - RNA, 14 nt, Human
accaugaugccuua

SEQ ID NO: 36223 - RNA, 25 nt, Human
gcuguagucauacaaucacauaacu

SEQ ID NO: 36224 - RNA, 21 nt, Human
caaguuggagcuugcagugag

SEQ ID NO: 36225 - RNA, 23 nt, Human
uuuuacccucaucaugcaccacu

SEQ ID NO: 36226 - RNA, 21 nt, Human
ugggaggucaagaugggagga

SEQ ID NO: 36227 - RNA, 27 nt, Human
ugaccuaggcuggacaucagaccugcc

SEQ ID NO: 36228 - RNA, 25 nt, Human
guggggaggggguuugguggcuugc

SEQ ID NO: 36229 - RNA, 21 nt, Human
uggcggggcagcaggagcggu

SEQ ID NO: 36230 - RNA, 23 nt, Human
ccaaauuccuguucccugaucaa

SEQ ID NO: 36231 - RNA, 25 nt, Human
gacuguuccuugguguuugagggaa

SEQ ID NO: 36232 - RNA, 18 nt, Human
ugucucaccaggaaauuc

SEQ ID NO: 36233 - RNA, 20 nt, Human
acugggugaugacaggggaa

SEQ ID NO: 36234 - RNA, 24 nt, Human
cucuccugauagucuuucaguuaa

SEQ ID NO: 36235 - RNA, 22 nt, Human
caggagguuguggauacaguga

SEQ ID NO: 36236 - RNA, 23 nt, Human
ugcccuuuaacuuauugggacug

SEQ ID NO: 36237 - RNA, 21 nt, Human
uuuccucugcacauuuuggcu

SEQ ID NO: 36238 - RNA, 17 nt, Human
caccuugcuuauuccca

SEQ ID NO: 36239 - RNA, 27 nt, Human
cauguccugccccaucccuauccugcc

SEQ ID NO: 36240 - RNA, 22 nt, Human
caggguggagugcaguggcaug

SEQ ID NO: 36241 - RNA, 25 nt, Human
ggagacaacagcccugucucaaaac

SEQ ID NO: 36242 - RNA, 32 nt, Human
ucucuguuuucucugucugcugucuaacccug

SEQ ID NO: 36243 - RNA, 20 nt, Human
agagagaagagagcagcucc

SEQ ID NO: 36244 - RNA, 17 nt, Human
gccauaaaauggcuuua

SEQ ID NO: 36245 - RNA, 27 nt, Human
gccugggaagaugucucacuguccacc

SEQ ID NO: 36246 - RNA, 23 nt, Human
accagcacuuucccucuguuucc

SEQ ID NO: 36247 - RNA, 22 nt, Human
caaacuccugggcucaagcaau

SEQ ID NO: 36248 - RNA, 22 nt, Human
ggaggcugaagcaggagaauca

SEQ ID NO: 36249 - RNA, 22 nt, Human
ggaggcugaggcaggaggauca

SEQ ID NO: 36250 - RNA, 27 nt, Human
ucgcccaggcuggagugcaacgguacg

SEQ ID NO: 36251 - RNA, 21 nt, Human
ugcaugaauguaaucaacauu

SEQ ID NO: 36252 - RNA, 25 nt, Human
aaaaggaggaaaaucuucauuuguu

SEQ ID NO: 36253 - RNA, 22 nt, Human
ugcaaugagcugagaucaugcc

SEQ ID NO: 36254 - RNA, 23 nt, Human
uaccuccuggguucaagcaaauc

SEQ ID NO: 36255 - RNA, 21 nt, Human
gccuguaaucucagcacuuug

SEQ ID NO: 36256 - RNA, 21 nt, Human
gcuuguaaucccagcacuuug

SEQ ID NO: 36257 - RNA, 20 nt, Human
auuuggcugcuucucuugug

SEQ ID NO: 36258 - RNA, 21 nt, Human
ccccugccagcuucccccgcu

SEQ ID NO: 36259 - RNA, 21 nt, Human
ugaacaacgaauguaaauuug

SEQ ID NO: 36260 - RNA, 23 nt, Human
gcuuguuccaaaugagcagcugg

SEQ ID NO: 36261 - RNA, 25 nt, Human
ggaugggaagaaggggcguuuguuu

SEQ ID NO: 36262 - RNA, 22 nt, Human
agaggcucuggacagaugaaua

SEQ ID NO: 36263 - RNA, 21 nt, Human
uuuagacuccagccuuggcaa

SEQ ID NO: 36264 - RNA, 23 nt, Human
cccugcacacggucuuugagaga

SEQ ID NO: 36265 - RNA, 23 nt, Human
gcucacugcaagcucugcccucc

SEQ ID NO: 36266 - RNA, 25 nt, Human
ugucuuuuagugucacagggaacag

SEQ ID NO: 36267 - RNA, 22 nt, Human
cgggagacagagguugcaguga

SEQ ID NO: 36268 - RNA, 21 nt, Human
aggaaaggaccuaccaaagca

SEQ ID NO: 36269 - RNA, 27 nt, Human
aaacccagggaaaagagcucucaauuu

SEQ ID NO: 36270 - RNA, 23 nt, Human
cugccuuagccagggcucagaga

SEQ ID NO: 36271 - RNA, 24 nt, Human
ggaacuucauugcaggccgugugu

SEQ ID NO: 36272 - RNA, 26 nt, Human
aggaagaguccaagccugaauaauaa

SEQ ID NO: 36273 - RNA, 22 nt, Human
gucgcccaggcuggagugcagu

SEQ ID NO: 36274 - RNA, 22 nt, Human
guugcccaggcuggaguguagu

SEQ ID NO: 36275 - RNA, 22 nt, Human
gucacccaggcuggagugcggu

SEQ ID NO: 36276 - RNA, 20 nt, Human
cacgcagagaagcccagucu

SEQ ID NO: 36277 - RNA, 23 nt, Human
uaugacucucuguucugcugaca

SEQ ID NO: 36278 - RNA, 23 nt, Human
cugggauguagaacuucaagaag

SEQ ID NO: 36279 - RNA, 26 nt, Human
ugagccagauguugagggcugagugg

SEQ ID NO: 36280 - RNA, 22 nt, Human
gcgugagccaccgcacccagcc

SEQ ID NO: 36281 - RNA, 23 nt, Human
cauggaaggugcaaaacucagua

SEQ ID NO: 36282 - RNA, 26 nt, Human
cacugccaccagcaaugcccugccuu

SEQ ID NO: 36283 - RNA, 23 nt, Human
ucgucugcccagggccuggagcc

SEQ ID NO: 36284 - RNA, 27 nt, Human
uuauuccucaauccuccaaaugcucug

SEQ ID NO: 36285 - RNA, 26 nt, Human
ucccuuggccucagagcugccccugc

SEQ ID NO: 36286 - RNA, 25 nt, Human
cuaaugggagaccaaaucuuugucc

SEQ ID NO: 36287 - RNA, 20 nt, Human
uguucuaaaaaauguuuuua

SEQ ID NO: 36288 - RNA, 26 nt, Human
aggcuggauuggaguggugauuauuc

SEQ ID NO: 36289 - RNA, 21 nt, Human
ucccccagcuccauuccgcuc

SEQ ID NO: 36290 - RNA, 23 nt, Human
cuuggagugggauugcuggguua

SEQ ID NO: 36291 - RNA, 27 nt, Human
ucgcccaggcuggagcuggccccgcuu

SEQ ID NO: 36292 - RNA, 23 nt, Human
ucuguuugcaccaugucuuccag

SEQ ID NO: 36293 - RNA, 25 nt, Human
uagucccaguuacucaguagacuga

SEQ ID NO: 36294 - RNA, 25 nt, Human
ucugcugcuaaggcucuauuuccuc

SEQ ID NO: 36295 - RNA, 17 nt, Human
gcugauuucaggagcua

SEQ ID NO: 36296 - RNA, 22 nt, Human
uacaacacaaacuguaugaagc

SEQ ID NO: 36297 - RNA, 24 nt, Human
augcccagcuuggagugccacaug

SEQ ID NO: 36298 - RNA, 17 nt, Human
cuucauuuaccuaguau

SEQ ID NO: 36299 - RNA, 31 nt, Human
ccuugcugccaggaagcuucggccccgcagc

SEQ ID NO: 36300 - RNA, 21 nt, Human
ugccguggaacuggaauaggc

SEQ ID NO: 36301 - RNA, 23 nt, Human
guggaccuggaggaugagagggg

SEQ ID NO: 36302 - RNA, 23 nt, Human
ugucuguaaucccagcuacucug

SEQ ID NO: 36303 - RNA, 20 nt, Human
gcuaauuaucaucaaucuuu

SEQ ID NO: 36304 - RNA, 23 nt, Human
cuuucuuccuuucuuccuuggcc

SEQ ID NO: 36305 - RNA, 24 nt, Human
cugcugcuuccgguggccccuggg

SEQ ID NO: 36306 - RNA, 23 nt, Human
gacucugguggcuguauuagcua

SEQ ID NO: 36307 - RNA, 27 nt, Human
uuuagucacaggaaauuuuuaacucua

SEQ ID NO: 36308 - RNA, 21 nt, Human
gagcuggccucaggaguggga

SEQ ID NO: 36309 - RNA, 22 nt, Human
agcugccagcccaacugugaga

SEQ ID NO: 36310 - RNA, 24 nt, Human
agacgcugaaacugcugccuuuca

SEQ ID NO: 36311 - RNA, 21 nt, Human
ugccagaagacucacugugug

SEQ ID NO: 36312 - RNA, 22 nt, Human
aauauaagcuuuuuaacagggc

SEQ ID NO: 36313 - RNA, 27 nt, Human
gacugggugugaccagaggaaaaggaa

SEQ ID NO: 36314 - RNA, 18 nt, Human
cuucccuuuccuaagccu

SEQ ID NO: 36315 - RNA, 20 nt, Human
aagccucucucucccucccu

SEQ ID NO: 36316 - RNA, 27 nt, Human
uuuccucaucuccccagccugaacugc

SEQ ID NO: 36317 - RNA, 27 nt, Human
uguugcacccacacugaaagaugaggg

SEQ ID NO: 36318 - RNA, 21 nt, Human
ucucuuggccggauguccuca

SEQ ID NO: 36319 - RNA, 23 nt, Human
ucugcuccccucuucccuuccuu

SEQ ID NO: 36320 - RNA, 27 nt, Human
ucuguaacuguggaaugggcugagacc

SEQ ID NO: 36321 - RNA, 22 nt, Human
ggcugcaacgccggugccugag

SEQ ID NO: 36322 - RNA, 25 nt, Human
ucuccacuggccaucuuguccuugg

SEQ ID NO: 36323 - RNA, 26 nt, Human
ucucccaccguaaagcgccccaggcu

SEQ ID NO: 36324 - RNA, 17 nt, Human
gcauaguucuagugcag

SEQ ID NO: 36325 - RNA, 21 nt, Human
uccuucccucccuuccuucaa

SEQ ID NO: 36326 - RNA, 23 nt, Human
cacucugucacccaggcugcagu

SEQ ID NO: 36327 - RNA, 23 nt, Human
ggcuuccaaacuccugcgcgcgg

SEQ ID NO: 36328 - RNA, 26 nt, Human
uuccucuggucucuuuuccucucuuc

SEQ ID NO: 36329 - RNA, 27 nt, Human
agaccuacagaccuggcucucagagga

SEQ ID NO: 36330 - RNA, 22 nt, Human
cacaaggucaggaguuugagac

SEQ ID NO: 36331 - RNA, 20 nt, Human
cuguuccucccuuuucucug

SEQ ID NO: 36332 - RNA, 22 nt, Human
cccaaguagcuuggacuauagg

SEQ ID NO: 36333 - RNA, 22 nt, Human
ugccuguaaucucagcaauuug

SEQ ID NO: 36334 - RNA, 23 nt, Human
cgugucuguaaucccagcuacuc

SEQ ID NO: 36335 - RNA, 21 nt, Human
aggaggcagagguugggguga

SEQ ID NO: 36336 - RNA, 23 nt, Human
cgaguaccugggauuacaggcau

SEQ ID NO: 36337 - RNA, 22 nt, Human
cccagccuugagaugcuucacu

SEQ ID NO: 36338 - RNA, 22 nt, Human
caccuagucccuccugacccag

SEQ ID NO: 36339 - RNA, 21 nt, Human
cacaaggaaacuucugccuca

SEQ ID NO: 36340 - RNA, 21 nt, Human
uauguuauuucuagaaugcug

SEQ ID NO: 36341 - RNA, 21 nt, Human
augcaagacuucacugcagcc

SEQ ID NO: 36342 - RNA, 23 nt, Human
gggcauuuuuauacucagaacug

SEQ ID NO: 36343 - RNA, 21 nt, Human
uuuuuacaugcugaauuagcc

SEQ ID NO: 36344 - RNA, 26 nt, Human
cugcagcuccggucugcucucuuggc

SEQ ID NO: 36345 - RNA, 23 nt, Human
aacaccuauaauucccagcacuu

SEQ ID NO: 36346 - RNA, 20 nt, Human
caacuggacaucacagcaga

SEQ ID NO: 36347 - RNA, 22 nt, Human
aauuuaaacaaaugguccaugg

SEQ ID NO: 36348 - RNA, 23 nt, Human
gggacccccacacacaucccagc

SEQ ID NO: 36349 - RNA, 24 nt, Human
uuguuaauucauuaaugcauucug

SEQ ID NO: 36350 - RNA, 22 nt, Human
acucacagaacaaaagcaagga

SEQ ID NO: 36351 - RNA, 26 nt, Human
gccuccucaucauggaaggggguggg

SEQ ID NO: 36352 - RNA, 20 nt, Human
gguauuuucacuuuucuuug

SEQ ID NO: 36353 - RNA, 22 nt, Human
gcccaccgcccccuccgccgcc

SEQ ID NO: 36354 - RNA, 25 nt, Human
ucuuuggccuuuguuuagcuuuaag

SEQ ID NO: 36355 - RNA, 27 nt, Human
ggggaaagauggaguuccuauccagag

SEQ ID NO: 36356 - RNA, 27 nt, Human
ggugcagccuacauggcacaggauauu

SEQ ID NO: 36357 - RNA, 21 nt, Human
gccguuucuccccagagcugc

SEQ ID NO: 36358 - RNA, 22 nt, Human
uaacugucuggaggugccucca

SEQ ID NO: 36359 - RNA, 21 nt, Human
cggcucugcugaaaccuuaau

SEQ ID NO: 36360 - RNA, 21 nt, Human
ggugcaagguacagcccacac

SEQ ID NO: 36361 - RNA, 31 nt, Human
ggcagcaguggcgccuggugucaggucuguc

SEQ ID NO: 36362 - RNA, 22 nt, Human
ucucugcugaucugagucugcc

SEQ ID NO: 36363 - RNA, 22 nt, Human
ucaauccugggcucaagugauc

SEQ ID NO: 36364 - RNA, 20 nt, Human
cauguaaacaaagauaucuu

SEQ ID NO: 36365 - RNA, 26 nt, Human
aggcagcagagccgaggagagcaggu

SEQ ID NO: 36366 - RNA, 26 nt, Human
uuuacuguuguaucgucucccugagg

SEQ ID NO: 36367 - RNA, 22 nt, Human
cuacugcacuccagcuuaggug

SEQ ID NO: 36368 - RNA, 25 nt, Human
gggcuccagggacuggaguguaaug

SEQ ID NO: 36369 - RNA, 23 nt, Human
cagaaugggugcaguuugagggg

SEQ ID NO: 36370 - RNA, 18 nt, Human
ggggagagggagggccgg

SEQ ID NO: 36371 - RNA, 20 nt, Human
cagccucuccagcucucuug

SEQ ID NO: 36372 - RNA, 22 nt, Human
cucacgucuacucccuucugca

SEQ ID NO: 36373 - RNA, 23 nt, Human
cagaaguauggaauuuucugcca

SEQ ID NO: 36374 - RNA, 22 nt, Human
agauguuaagcgcuguguggua

SEQ ID NO: 36375 - RNA, 21 nt, Human
uuaacuuugacaaaucaugcu

SEQ ID NO: 36376 - RNA, 20 nt, Human
ucccacccucuucccauguc

SEQ ID NO: 36377 - RNA, 24 nt, Human
uaagcgcuuccuggaagugaaguc

SEQ ID NO: 36378 - RNA, 25 nt, Human
ggauacuuagugguaugucucuuua

SEQ ID NO: 36379 - RNA, 26 nt, Human
cccaaaacacgcacacccugccccug

SEQ ID NO: 36380 - RNA, 27 nt, Human
aacagcauuucccugcagcuaaugcuu

SEQ ID NO: 36381 - RNA, 25 nt, Human
guuaucucccucucccugugaugcc

SEQ ID NO: 36382 - RNA, 23 nt, Human
ggucucaaucuaaaagcacuuca

SEQ ID NO: 36383 - RNA, 22 nt, Human
agggaugacucagcagacucag

SEQ ID NO: 36384 - RNA, 24 nt, Human
gguugcucaauguucaguuucuuu

SEQ ID NO: 36385 - RNA, 24 nt, Human
aggaggaaaaacaguugucugcug

SEQ ID NO: 36386 - RNA, 22 nt, Human
ccauugcauuccagccuuggcg

SEQ ID NO: 36387 - RNA, 22 nt, Human
accuguaaaucccagcacuuug

SEQ ID NO: 36388 - RNA, 22 nt, Human
uguuccaauggggagcuuggaa

SEQ ID NO: 36389 - RNA, 24 nt, Human
uuuuggugaagaugcaauauuuuu

SEQ ID NO: 36390 - RNA, 24 nt, Human
ccaaaacaaaaagucuuugggguc

SEQ ID NO: 36391 - RNA, 27 nt, Human
acaaaccugaaaagauguugugucuug

SEQ ID NO: 36392 - RNA, 19 nt, Human
ccuaccucuuccguuggaa

SEQ ID NO: 36393 - RNA, 26 nt, Human
ucuauuucuucuuauccaccuacucc

SEQ ID NO: 36394 - RNA, 20 nt, Human
ucuggucuuggggccagucu

SEQ ID NO: 36395 - RNA, 22 nt, Human
gaccucucaggcucaagcgauu

SEQ ID NO: 36396 - RNA, 20 nt, Human
ucuugaaagaaaugguguca

SEQ ID NO: 36397 - RNA, 27 nt, Human
caggcuggagcacaguggugugaucac

SEQ ID NO: 36398 - RNA, 25 nt, Human
cuugcaggaagauaugacccagcug

SEQ ID NO: 36399 - RNA, 24 nt, Human
gccauauaaaaauacaaagccucu

SEQ ID NO: 36400 - RNA, 27 nt, Human
caucuguagagucagagcccacauggc

SEQ ID NO: 36401 - RNA, 27 nt, Human
aaccaaaaauaaauagccauaauuugc

SEQ ID NO: 36402 - RNA, 25 nt, Human
ugaacauuccacaguggcuggguga

SEQ ID NO: 36403 - RNA, 23 nt, Human
ucucuuccugcugaccacaagcu

SEQ ID NO: 36404 - RNA, 17 nt, Human
agcgggacuccaggcaa

SEQ ID NO: 36405 - RNA, 24 nt, Human
cucaguuucucacagauuuucacc

SEQ ID NO: 36406 - RNA, 26 nt, Human
caccuaggcuggagugcagcggcaug

SEQ ID NO: 36407 - RNA, 24 nt, Human
gcuggcccagcccgcguccgugcu

SEQ ID NO: 36408 - RNA, 22 nt, Human
caggaggugagauggcagcugg

SEQ ID NO: 36409 - RNA, 22 nt, Human
ggugagacagcggucccagggg

SEQ ID NO: 36410 - RNA, 20 nt, Human
cccagcuaauuuuuuaauuu

SEQ ID NO: 36411 - RNA, 24 nt, Human
ugauacagagggaucuuguguacc

SEQ ID NO: 36412 - RNA, 28 nt, Human
gcagaauggggaauggagaggugggcag

SEQ ID NO: 36413 - RNA, 25 nt, Human
aucucgccacugcagcucgggucca

SEQ ID NO: 36414 - RNA, 23 nt, Human
cguaggaaugaggcuggacagau

SEQ ID NO: 36415 - RNA, 24 nt, Human
cacuuucaguuucaggagugcaag

SEQ ID NO: 36416 - RNA, 28 nt, Human
gcuggugcugcaaggaagggugggaagc

SEQ ID NO: 36417 - RNA, 27 nt, Human
ugucgcccaggcuggagguuaauggca

SEQ ID NO: 36418 - RNA, 26 nt, Human
aucuguuuuucucaucagacucugag

SEQ ID NO: 36419 - RNA, 22 nt, Human
agaaacccuccagaaauuucca

SEQ ID NO: 36420 - RNA, 22 nt, Human
ccccucgggcgcaggcagcuca

SEQ ID NO: 36421 - RNA, 23 nt, Human
gaucacauguggacuuuuauuuc

SEQ ID NO: 36422 - RNA, 23 nt, Human
acgcugcagaagacagcugagua

SEQ ID NO: 36423 - RNA, 28 nt, Human
gaugcagcacagacucagccuuggccug

SEQ ID NO: 36424 - RNA, 18 nt, Human
ggcgccuuccuggagcgc

SEQ ID NO: 36425 - RNA, 22 nt, Human
caguagcaucaccaucuguaaa

SEQ ID NO: 36426 - RNA, 24 nt, Human
uguccaauauggagaacagcuuug

SEQ ID NO: 36427 - RNA, 22 nt, Human
gucauuaucuucuacagcagug

SEQ ID NO: 36428 - RNA, 20 nt, Human
ucagguaauaaaagcuuuga

SEQ ID NO: 36429 - RNA, 23 nt, Human
ugaaacaggcacaguacccuuug

SEQ ID NO: 36430 - RNA, 16 nt, Human
ccuuggaagaucaugu

SEQ ID NO: 36431 - RNA, 18 nt, Human
acuugagaugaaaguugg

SEQ ID NO: 36432 - RNA, 22 nt, Human
ggccuccuagauaccucgggag

SEQ ID NO: 36433 - RNA, 22 nt, Human
agcuucuaaucccagcacuuug

SEQ ID NO: 36434 - RNA, 23 nt, Human
acagagccugggaagcugccagu

SEQ ID NO: 36435 - RNA, 18 nt, Human
aacuauacgaauggcuuc

SEQ ID NO: 36436 - RNA, 22 nt, Human
caagcagaggaggcugcaccuc

SEQ ID NO: 36437 - RNA, 23 nt, Human
cgcagccuccugccuccgccuuu

SEQ ID NO: 36438 - RNA, 25 nt, Human
ucuccccacugcucauuuggauccc

SEQ ID NO: 36439 - RNA, 22 nt, Human
gagguggggaggaaugagaggg

SEQ ID NO: 36440 - RNA, 21 nt, Human
cggaggcagaggccaugcuga

SEQ ID NO: 36441 - RNA, 24 nt, Human
gccuucaggcuucugucaauuuca

SEQ ID NO: 36442 - RNA, 24 nt, Human
gucucaguguuucaaccucaccag

SEQ ID NO: 36443 - RNA, 27 nt, Human
ucuuuggugaggcuguuucuggaguuu

SEQ ID NO: 36444 - RNA, 22 nt, Human
aaucucaucccucaacugaggg

SEQ ID NO: 36445 - RNA, 22 nt, Human
ccucacagacauuucucuuuca

SEQ ID NO: 36446 - RNA, 24 nt, Human
agucacuuccucgucuccuccucc

SEQ ID NO: 36447 - RNA, 23 nt, Human
cagggcucuggugaacagcaaau

SEQ ID NO: 36448 - RNA, 21 nt, Human
acaugaugcaaacuguggcaa

SEQ ID NO: 36449 - RNA, 20 nt, Human
cuuuauucucuccauguggc

SEQ ID NO: 36450 - RNA, 23 nt, Human
caggaguauaucauuugcagugc

SEQ ID NO: 36451 - RNA, 20 nt, Human
cuaucaggaaagcaaagcuu

SEQ ID NO: 36452 - RNA, 17 nt, Human
gaucuuggcuguauuua

SEQ ID NO: 36453 - RNA, 24 nt, Human
ccuccucugcucuugaucuguguu

SEQ ID NO: 36454 - RNA, 27 nt, Human
ccccauuuccuccucaucugauccccc

SEQ ID NO: 36455 - RNA, 20 nt, Human
cgagcaggcauuucugugau

SEQ ID NO: 36456 - RNA, 27 nt, Human
cagcuuuguguaauucucuuugccagc

SEQ ID NO: 36457 - RNA, 22 nt, Human
ccuaguucuauagaugaagaca

SEQ ID NO: 36458 - RNA, 24 nt, Human
uuuucuucucucugccacccacau

SEQ ID NO: 36459 - RNA, 27 nt, Human
gagaggaaguaagaagggucuguucug

SEQ ID NO: 36460 - RNA, 21 nt, Human
ccuuauuucuuaaaaaggaca

SEQ ID NO: 36461 - RNA, 25 nt, Human
uauguaacuugaaccuaugaagcaa

SEQ ID NO: 36462 - RNA, 25 nt, Human
cggcagcugcugacccgccaucgcc

SEQ ID NO: 36463 - RNA, 18 nt, Human
gagaauuuuggacaauug

SEQ ID NO: 36464 - RNA, 27 nt, Human
gggauacaagagaggagaugggguccc

SEQ ID NO: 36465 - RNA, 23 nt, Human
ucggccuugugucagcaggucau

SEQ ID NO: 36466 - RNA, 21 nt, Human
cagaaauuuugaagucagaga

SEQ ID NO: 36467 - RNA, 22 nt, Human
ccagaaguaugaugcaucuuac

SEQ ID NO: 36468 - RNA, 21 nt, Human
aacaacaaauucacggaaucu

SEQ ID NO: 36469 - RNA, 21 nt, Human
guaguuuaggcuggaaauggu

SEQ ID NO: 36470 - RNA, 24 nt, Human
ccucaccccagcucaagccauggc

SEQ ID NO: 36471 - RNA, 30 nt, Human
ccagguuccuguaacucccugccuccuccu

SEQ ID NO: 36472 - RNA, 22 nt, Human
ucuuguccaguuuuuaaauuau

SEQ ID NO: 36473 - RNA, 21 nt, Human
ucuccucucuuggcaucgacc

SEQ ID NO: 36474 - RNA, 22 nt, Human
ccucaugugugucccugugcca

SEQ ID NO: 36475 - RNA, 26 nt, Human
gagagggagagcagagaaagaagucc

SEQ ID NO: 36476 - RNA, 21 nt, Human
ugucagaaacggaccuugguu

SEQ ID NO: 36477 - RNA, 26 nt, Human
accuggguucacacagcuuuuuagcu

SEQ ID NO: 36478 - RNA, 21 nt, Human
uggggaggggcuuggcuaggu

SEQ ID NO: 36479 - RNA, 23 nt, Human
guuguuuguuuuuagauccacag

SEQ ID NO: 36480 - RNA, 24 nt, Human
aaagaacaauuuaaauuugaacau

SEQ ID NO: 36481 - RNA, 22 nt, Human
ccccaaaaggcugcccagccuu

SEQ ID NO: 36482 - RNA, 25 nt, Human
aacuaggcguggacuuacuauuuau

SEQ ID NO: 36483 - RNA, 25 nt, Human
ccugucccaucugcaguggacccca

SEQ ID NO: 36484 - RNA, 22 nt, Human
cuggaagggaugcuuuuuagcu

SEQ ID NO: 36485 - RNA, 21 nt, Human
uucagagggacccacuccuuc

SEQ ID NO: 36486 - RNA, 25 nt, Human
gcacgaggcuuugugccacagccgg

SEQ ID NO: 36487 - RNA, 25 nt, Human
cuguuggucaaaaucugcaaacucu

SEQ ID NO: 36488 - RNA, 19 nt, Human
gcuagauuuggucauucca

SEQ ID NO: 36489 - RNA, 26 nt, Human
caucuaaaaacacaaguggguuuauu

SEQ ID NO: 36490 - RNA, 22 nt, Human
uuuaggagaagccaggaauuuc

SEQ ID NO: 36491 - RNA, 27 nt, Human
cuccauuguaucuucauacaaaggaca

SEQ ID NO: 36492 - RNA, 21 nt, Human
gagggugagacacugcacaga

SEQ ID NO: 36493 - RNA, 24 nt, Human
ugucacccccacgcugaacccagc

SEQ ID NO: 36494 - RNA, 23 nt, Human
agugccccacugcacuccagccu

SEQ ID NO: 36495 - RNA, 26 nt, Human
uucuggcuucugcuucauccugcucc

SEQ ID NO: 36496 - RNA, 22 nt, Human
guacaacauuuauauauugucu

SEQ ID NO: 36497 - RNA, 27 nt, Human
ggucuugaacuccugaccucaagugau

SEQ ID NO: 36498 - RNA, 26 nt, Human
gcacagccagggcacaguuaggccug

SEQ ID NO: 36499 - RNA, 26 nt, Human
agcucaggcuggagcagguauaugag

SEQ ID NO: 36500 - RNA, 25 nt, Human
acccaggcuggagugcaguggcaug

SEQ ID NO: 36501 - RNA, 25 nt, Human
gcccaggcuggagugcgguggcaug

SEQ ID NO: 36502 - RNA, 21 nt, Human
caccacaccugcagagcgcuc

SEQ ID NO: 36503 - RNA, 18 nt, Human
ccucccuuacuucuauca

SEQ ID NO: 36504 - RNA, 27 nt, Human
uucuggcuuccuucucucaauaugcuu

SEQ ID NO: 36505 - RNA, 24 nt, Human
agcugagugucugucagcuucauu

SEQ ID NO: 36506 - RNA, 27 nt, Human
caguccaggugcugggaggcccuccuu

SEQ ID NO: 36507 - RNA, 21 nt, Human
aaaguacaaaaaauuagcugg

SEQ ID NO: 36508 - RNA, 23 nt, Human
gcagacacuccaguuugcccacc

SEQ ID NO: 36509 - RNA, 21 nt, Human
uagucaugcuuucuacucaug

SEQ ID NO: 36510 - RNA, 16 nt, Human
ucucuggauugcagug

SEQ ID NO: 36511 - RNA, 27 nt, Human
uggucucaaacuccugacccugugauc

SEQ ID NO: 36512 - RNA, 28 nt, Human
ccucugaacucugaccucaggaggcucu

SEQ ID NO: 36513 - RNA, 21 nt, Human
uucaaauuggacuggacuuug

SEQ ID NO: 36514 - RNA, 18 nt, Human
aaggagagagguugagga

SEQ ID NO: 36515 - RNA, 27 nt, Human
ugcucucuaaacuucccucuaguuggc

SEQ ID NO: 36516 - RNA, 21 nt, Human
aacuguacugcugcauuuccu

SEQ ID NO: 36517 - RNA, 27 nt, Human
aaccggagcugaauuaccuuucacuuu

SEQ ID NO: 36518 - RNA, 26 nt, Human
cccugccucagcuucagcaggcguag

SEQ ID NO: 36519 - RNA, 20 nt, Human
ggaggagggaggugcuguga

SEQ ID NO: 36520 - RNA, 25 nt, Human
cagaauugcugacagcagaggcuuu

SEQ ID NO: 36521 - RNA, 21 nt, Human
cucacacugaaacaaaggaag

SEQ ID NO: 36522 - RNA, 21 nt, Human
ccuccaucuaaacugcccccu

SEQ ID NO: 36523 - RNA, 24 nt, Human
uugagggcggggagaugacaggag

SEQ ID NO: 36524 - RNA, 25 nt, Human
augcccuaccaauauccagcacuga

SEQ ID NO: 36525 - RNA, 27 nt, Human
cuuugcucuccccucuaggcacacgcg

SEQ ID NO: 36526 - RNA, 22 nt, Human
cgccgccccucccuuugcccuu

SEQ ID NO: 36527 - RNA, 22 nt, Human
cugcuucucucccucgcucgca

SEQ ID NO: 36528 - RNA, 27 nt, Human
uucauuuguugcugaaugcuuuccaga

SEQ ID NO: 36529 - RNA, 21 nt, Human
caccuggagugcagaaucugc

SEQ ID NO: 36530 - RNA, 22 nt, Human
cugaggcaggaggaucgccuga

SEQ ID NO: 36531 - RNA, 27 nt, Human
ccugccugugguccugagcacugauca

SEQ ID NO: 36532 - RNA, 20 nt, Human
ucuccaccugcucccaggcc

SEQ ID NO: 36533 - RNA, 27 nt, Human
uugcucuugucacccaggcuggagugc

SEQ ID NO: 36534 - RNA, 21 nt, Human
gaaaaacauggacaauuccua

SEQ ID NO: 36535 - RNA, 25 nt, Human
cacccuuuccaaugcaucuucuacc

SEQ ID NO: 36536 - RNA, 27 nt, Human
ccacugcacuccaucuugggcaacaca

SEQ ID NO: 36537 - RNA, 22 nt, Human
auuuucuuuucuaucuccaucu

SEQ ID NO: 36538 - RNA, 23 nt, Human
aauaacaaaaggauaauguuuuc

SEQ ID NO: 36539 - RNA, 27 nt, Human
ggaaacgcuaccucucugucccuugcu

SEQ ID NO: 36540 - RNA, 19 nt, Human
uugagugcucuggaccgca

SEQ ID NO: 36541 - RNA, 27 nt, Human
gucaccuagcagauauguauuacuuuu

SEQ ID NO: 36542 - RNA, 22 nt, Human
agggagggcaggcucgagugcu

SEQ ID NO: 36543 - RNA, 24 nt, Human
agcguuacacuggaaacuacuuuu

SEQ ID NO: 36544 - RNA, 24 nt, Human
uccuacuuccccuuccuaauucca

SEQ ID NO: 36545 - RNA, 19 nt, Human
cacgagacucucaaccagc

SEQ ID NO: 36546 - RNA, 21 nt, Human
cccaacaacagcacugcucug

SEQ ID NO: 36547 - RNA, 24 nt, Human
cagagacagggcuugguucugcuu

SEQ ID NO: 36548 - RNA, 18 nt, Human
uauccagcaguaucugga

SEQ ID NO: 36549 - RNA, 20 nt, Human
gaacauaccacugccucuag

SEQ ID NO: 36550 - RNA, 26 nt, Human
ggggagggacaaacaaccaagcuaug

SEQ ID NO: 36551 - RNA, 21 nt, Human
cauacagcuuauauuaaaaga

SEQ ID NO: 36552 - RNA, 26 nt, Human
gcuccaggaaccaggcagugaggccu

SEQ ID NO: 36553 - RNA, 24 nt, Human
agagaaaauugaggaauugaaaug

SEQ ID NO: 36554 - RNA, 19 nt, Human
gggggaccuucacugaugu

SEQ ID NO: 36555 - RNA, 27 nt, Human
gcuaacuaacucuccuccauguugccu

SEQ ID NO: 36556 - RNA, 23 nt, Human
ggcgggcugaguccugcccaugc

SEQ ID NO: 36557 - RNA, 24 nt, Human
auguagccugaaagccacagcccu

SEQ ID NO: 36558 - RNA, 20 nt, Human
cuaaaauggagagcaagaca

SEQ ID NO: 36559 - RNA, 29 nt, Human
ucugcugcaucuucuaccuccugauuauc

SEQ ID NO: 36560 - RNA, 26 nt, Human
gggcccgagcgcagaccaggcuccag

SEQ ID NO: 36561 - RNA, 24 nt, Human
ggcacuugucgcucucccaccugg

SEQ ID NO: 36562 - RNA, 24 nt, Human
aacaacaacaaaacaaucugcucu

SEQ ID NO: 36563 - RNA, 21 nt, Human
uauguugugagcaucuuucca

SEQ ID NO: 36564 - RNA, 21 nt, Human
uccaaagcugaaaauguguau

SEQ ID NO: 36565 - RNA, 20 nt, Human
ggugacggcacugggugggg

SEQ ID NO: 36566 - RNA, 22 nt, Human
agccuggagcagcccuccagac

SEQ ID NO: 36567 - RNA, 22 nt, Human
cccacuucugguccugccaccu

SEQ ID NO: 36568 - RNA, 28 nt, Human
cugucuucuguuuuauagaaauugaucu

SEQ ID NO: 36569 - RNA, 22 nt, Human
ucccaaaccaagacaacaugua

SEQ ID NO: 36570 - RNA, 22 nt, Human
uuacccaacuccuucccccuca

SEQ ID NO: 36571 - RNA, 19 nt, Human
aggccauucaccugccucc

SEQ ID NO: 36572 - RNA, 24 nt, Human
accccauccaccaagugcgccaca

SEQ ID NO: 36573 - RNA, 24 nt, Human
gccugggggccggcccagcucucu

SEQ ID NO: 36574 - RNA, 25 nt, Human
ugaacaacaguaguuucucaggguc

SEQ ID NO: 36575 - RNA, 23 nt, Human
cuccuugucccuccuggccuccc

SEQ ID NO: 36576 - RNA, 24 nt, Human
acccacgcuggagugcugugaugc

SEQ ID NO: 36577 - RNA, 21 nt, Human
uauucagaggggccggucucu

SEQ ID NO: 36578 - RNA, 26 nt, Human
caucccucgugcggcacuugucuguc

SEQ ID NO: 36579 - RNA, 21 nt, Human
gagagggagucaggaugcugu

SEQ ID NO: 36580 - RNA, 22 nt, Human
uaagugcuuuacucacggaguu

SEQ ID NO: 36581 - RNA, 22 nt, Human
ucucaacucugcuuuucuccag

SEQ ID NO: 36582 - RNA, 26 nt, Human
gaggccaugggcuacccggaggugga

SEQ ID NO: 36583 - RNA, 24 nt, Human
auuccugcuacucuaccuguauuu

SEQ ID NO: 36584 - RNA, 22 nt, Human
aauagaaauuugauuguacuau

SEQ ID NO: 36585 - RNA, 18 nt, Human
ccucuggacacaggcugg

SEQ ID NO: 36586 - RNA, 26 nt, Human
ugggcagccuggguuugcaggccugc

SEQ ID NO: 36587 - RNA, 24 nt, Human
acaugcccaugccaccuaugccac

SEQ ID NO: 36588 - RNA, 21 nt, Human
auucuauguuaucagucucuc

SEQ ID NO: 36589 - RNA, 23 nt, Human
guuggcuucuuuggaccugcacu

SEQ ID NO: 36590 - RNA, 22 nt, Human
gggagggaaggcagagcaacca

SEQ ID NO: 36591 - RNA, 25 nt, Human
cuguauaucauaggaaacucaggga

SEQ ID NO: 36592 - RNA, 23 nt, Human
ucuccucucccugcuuucuugaa

SEQ ID NO: 36593 - RNA, 19 nt, Human
ggcccuguuagugcacuga

SEQ ID NO: 36594 - RNA, 22 nt, Human
uuggcuauaacaugucuuucag

SEQ ID NO: 36595 - RNA, 24 nt, Human
ccuucuucaccagcuccuugggac

SEQ ID NO: 36596 - RNA, 20 nt, Human
ccuccuggcccugcugcugc

SEQ ID NO: 36597 - RNA, 18 nt, Human
cagaugcaccagagacac

SEQ ID NO: 36598 - RNA, 19 nt, Human
gucuguacuccccuaggag

SEQ ID NO: 36599 - RNA, 27 nt, Human
uaaagagcugcuggugaacuccaucuc

SEQ ID NO: 36600 - RNA, 27 nt, Human
cgcugccucuaccugccugguccagcu

SEQ ID NO: 36601 - RNA, 20 nt, Human
acugcccaggccugccuguu

SEQ ID NO: 36602 - RNA, 23 nt, Human
ucauggugucaagcacauuaaua

SEQ ID NO: 36603 - RNA, 27 nt, Human
agggucugcgccagcccuguccgucuu

SEQ ID NO: 36604 - RNA, 22 nt, Human
ggggaggaauaugcuguggagc

SEQ ID NO: 36605 - RNA, 25 nt, Human
aaugucccucucuuggcuauugacc

SEQ ID NO: 36606 - RNA, 20 nt, Human
gauaaaucccgggaccugaa

SEQ ID NO: 36607 - RNA, 24 nt, Human
aaccuggaacaugacauuguuaau

SEQ ID NO: 36608 - RNA, 22 nt, Human
cccuuacgcccagagaacugcu

SEQ ID NO: 36609 - RNA, 21 nt, Human
cuguaaagcuccuuuucuucc

SEQ ID NO: 36610 - RNA, 23 nt, Human
guugcccaggcuggagugcagua

SEQ ID NO: 36611 - RNA, 23 nt, Human
guugcccaggcuggggugcagug

SEQ ID NO: 36612 - RNA, 21 nt, Human
caaaccugaaaacugcuuggc

SEQ ID NO: 36613 - RNA, 24 nt, Human
ccacucccucucuuuccugcucca

SEQ ID NO: 36614 - RNA, 26 nt, Human
gaccuguagaaccucuuuuugugggu

SEQ ID NO: 36615 - RNA, 27 nt, Human
ucuguucugcugacaggcagagaguca

SEQ ID NO: 36616 - RNA, 21 nt, Human
acucagcuaauuuucaaauuu

SEQ ID NO: 36617 - RNA, 21 nt, Human
gccugcccacccacccccuca

SEQ ID NO: 36618 - RNA, 21 nt, Human
ccggcugggcucccaccuccc

SEQ ID NO: 36619 - RNA, 32 nt, Human
cccugggcaugugugagccucaguuuccucau

SEQ ID NO: 36620 - RNA, 21 nt, Human
gcucuuucuccccucccuccc

SEQ ID NO: 36621 - RNA, 22 nt, Human
agccuaugagcucuuguccuca

SEQ ID NO: 36622 - RNA, 32 nt, Human
ugcugaagugaguagugugauccuggaggccc

SEQ ID NO: 36623 - RNA, 22 nt, Human
ugcagugagccaagaucacgcc

SEQ ID NO: 36624 - RNA, 22 nt, Human
ugcagugagccgagaucacacc

SEQ ID NO: 36625 - RNA, 27 nt, Human
ucugggagcugggcuaacaggcugaca

SEQ ID NO: 36626 - RNA, 24 nt, Human
cgugcucagccacucugcccagcu

SEQ ID NO: 36627 - RNA, 22 nt, Human
uggagaccccaaggagcugcag

SEQ ID NO: 36628 - RNA, 21 nt, Human
uggagaacacaguggcugguu

SEQ ID NO: 36629 - RNA, 26 nt, Human
uuuaaaaaacacguaauuuugccuag

SEQ ID NO: 36630 - RNA, 21 nt, Human
cugccucccaggcucaagcac

SEQ ID NO: 36631 - RNA, 27 nt, Human
cacugguuuucuuagguuucuccauuu

SEQ ID NO: 36632 - RNA, 23 nt, Human
gccaccaccauucuccuucccca

SEQ ID NO: 36633 - RNA, 25 nt, Human
gaguaccuccagucacacuccccgc

SEQ ID NO: 36634 - RNA, 22 nt, Human
acggaagugguggcuguggaag

SEQ ID NO: 36635 - RNA, 23 nt, Human
auuuagacaguucuaagcccugu

SEQ ID NO: 36636 - RNA, 22 nt, Human
caacauagugaaacccccucuc

SEQ ID NO: 36637 - RNA, 27 nt, Human
ucccuccagcccaugacccggggcuag

SEQ ID NO: 36638 - RNA, 21 nt, Human
cagccaccacauuuucaaaac

SEQ ID NO: 36639 - RNA, 23 nt, Human
agacccuugcuccaucagagagg

SEQ ID NO: 36640 - RNA, 23 nt, Human
cccuacugcugugggcugggguu

SEQ ID NO: 36641 - RNA, 24 nt, Human
aucauuuucuagcaauaacugaga

SEQ ID NO: 36642 - RNA, 23 nt, Human
uugcccuuuuggaaugugauccu

SEQ ID NO: 36643 - RNA, 26 nt, Human
caguuuguguuuuuacuuuugucccg

SEQ ID NO: 36644 - RNA, 17 nt, Human
gaccucuuucuagcucu

SEQ ID NO: 36645 - RNA, 26 nt, Human
gaaaucaagcuaccuuuuuguuguug

SEQ ID NO: 36646 - RNA, 25 nt, Human
gcggcacaggcugcacgaguacugu

SEQ ID NO: 36647 - RNA, 21 nt, Human
aacuccacucuggacagcgcc

SEQ ID NO: 36648 - RNA, 24 nt, Human
cauccugucacaggccaugcucug

SEQ ID NO: 36649 - RNA, 22 nt, Human
gugugcaccaccaugcccagcu

SEQ ID NO: 36650 - RNA, 22 nt, Human
gcaugcaccaccaugccuggcu

SEQ ID NO: 36651 - RNA, 16 nt, Human
agcacuccagcauuuu

SEQ ID NO: 36652 - RNA, 22 nt, Human
aucuguaauccuagcuacuugg

SEQ ID NO: 36653 - RNA, 22 nt, Human
gcuccucccgcccuuuuggacc

SEQ ID NO: 36654 - RNA, 22 nt, Human
cuuucucuugggaaaacgggca

SEQ ID NO: 36655 - RNA, 24 nt, Human
ugcaccaugaaugggcaagaacuu

SEQ ID NO: 36656 - RNA, 23 nt, Human
uuuaaaaaaugcagguuguagcu

SEQ ID NO: 36657 - RNA, 23 nt, Human
ucagucuuucuuagugccugugu

SEQ ID NO: 36658 - RNA, 26 nt, Human
uguuccaccuccugaccugcuccauc

SEQ ID NO: 36659 - RNA, 24 nt, Human
uugaguuguguguuacugggggug

SEQ ID NO: 36660 - RNA, 21 nt, Human
gagcccguguggaggucaaag

SEQ ID NO: 36661 - RNA, 22 nt, Human
uguccccgcaguggaugcagcu

SEQ ID NO: 36662 - RNA, 21 nt, Human
acugugaacuugacuggguga

SEQ ID NO: 36663 - RNA, 27 nt, Human
cugugaagcuugaggccacucaaguuc

SEQ ID NO: 36664 - RNA, 21 nt, Human
ugcuuccuccccuccuggcac

SEQ ID NO: 36665 - RNA, 20 nt, Human
gucagugagucagaggcaga

SEQ ID NO: 36666 - RNA, 24 nt, Human
aacccagauauuacugagaagagu

SEQ ID NO: 36667 - RNA, 28 nt, Human
gcuugaguaccuuuuuaaaucuagccca

SEQ ID NO: 36668 - RNA, 27 nt, Human
ggucuggaucuccugaccucgugaucc

SEQ ID NO: 36669 - RNA, 19 nt, Human
uuucugugcuucucuguuc

SEQ ID NO: 36670 - RNA, 22 nt, Human
ugccacugcacuccagccuggg

SEQ ID NO: 36671 - RNA, 22 nt, Human
cgccacuguacuccagccuggg

SEQ ID NO: 36672 - RNA, 22 nt, Human
uugcgaauguauaacagccaag

SEQ ID NO: 36673 - RNA, 26 nt, Human
gacaagcucaguuuucucugaaggag

SEQ ID NO: 36674 - RNA, 22 nt, Human
ggcccuguuucugggcagccuu

SEQ ID NO: 36675 - RNA, 22 nt, Human
gaucccagccauggccuuccuc

SEQ ID NO: 36676 - RNA, 20 nt, Human
aaaucaucaaaaugagauca

SEQ ID NO: 36677 - RNA, 24 nt, Human
auuugagggcuuucuucuccauaa

SEQ ID NO: 36678 - RNA, 22 nt, Human
cauggcaggaagaauggggccu

SEQ ID NO: 36679 - RNA, 23 nt, Human
agcucaucuggccuccuguucca

SEQ ID NO: 36680 - RNA, 21 nt, Human
uuaccuuucauacacuagccu

SEQ ID NO: 36681 - RNA, 19 nt, Human
agacuuccuguccugcugg

SEQ ID NO: 36682 - RNA, 26 nt, Human
ugguuaccuucaggacagugcagcug

SEQ ID NO: 36683 - RNA, 28 nt, Human
uuaccugauuucuucagggcugcugggg

SEQ ID NO: 36684 - RNA, 20 nt, Human
gcucagcucagcauugugua

SEQ ID NO: 36685 - RNA, 21 nt, Human
uugggaaggaauggaagaugg

SEQ ID NO: 36686 - RNA, 22 nt, Human
caccucccagguucaagcgacu

SEQ ID NO: 36687 - RNA, 26 nt, Human
cuucauuugucuuuuuuccuccuugc

SEQ ID NO: 36688 - RNA, 21 nt, Human
uguaagugccagacagcugaa

SEQ ID NO: 36689 - RNA, 21 nt, Human
gcuuccauaguggagacuugc

SEQ ID NO: 36690 - RNA, 21 nt, Human
cccagcuggugggaagcgucu

SEQ ID NO: 36691 - RNA, 29 nt, Human
uuuugcaaccucugcuccaaagagaaaaa

SEQ ID NO: 36692 - RNA, 22 nt, Human
agccuucugaguagcugggacu

SEQ ID NO: 36693 - RNA, 22 nt, Human
agccuccugaguagcugggacc

SEQ ID NO: 36694 - RNA, 22 nt, Human
caggacuagagagcgagccgca

SEQ ID NO: 36695 - RNA, 20 nt, Human
uuagaaucugauuucaccuc

SEQ ID NO: 36696 - RNA, 28 nt, Human
agggguuucuggcaccuaccuaccugcu

SEQ ID NO: 36697 - RNA, 21 nt, Human
uccacuggugggacaagagca

SEQ ID NO: 36698 - RNA, 22 nt, Human
cagaguguaaucgcauuucugc

SEQ ID NO: 36699 - RNA, 22 nt, Human
acauguguagaguguauguagc

SEQ ID NO: 36700 - RNA, 20 nt, Human
accucgugguacucuugccu

SEQ ID NO: 36701 - RNA, 28 nt, Human
cugagaaccuggcuucaguauauuuucu

SEQ ID NO: 36702 - RNA, 22 nt, Human
uacgaggucaggagauccagac

SEQ ID NO: 36703 - RNA, 26 nt, Human
gccagcgacugccuucuccucucugg

SEQ ID NO: 36704 - RNA, 21 nt, Human
gaggaagaggcuugggcugca

SEQ ID NO: 36705 - RNA, 19 nt, Human
cuguguacgccuguugcaa

SEQ ID NO: 36706 - RNA, 28 nt, Human
ccagcccuugaggcagaggugccgagug

SEQ ID NO: 36707 - RNA, 21 nt, Human
gcaucaggaacagugcuacuu

SEQ ID NO: 36708 - RNA, 22 nt, Human
gcagcuuugggacagaugagug

SEQ ID NO: 36709 - RNA, 21 nt, Human
ucgcccaggcgccccgcaaug

SEQ ID NO: 36710 - RNA, 24 nt, Human
gagccuuccugucaccccuaacca

SEQ ID NO: 36711 - RNA, 20 nt, Human
ggaagauggaggccaccuca

SEQ ID NO: 36712 - RNA, 22 nt, Human
ucuuguguugccagcuucuauu

SEQ ID NO: 36713 - RNA, 26 nt, Human
uccaauacuuaugcaaaagcaaaaga

SEQ ID NO: 36714 - RNA, 21 nt, Human
cugcuuccaggcugggcagca

SEQ ID NO: 36715 - RNA, 21 nt, Human
auuagugccaaccauuagucu

SEQ ID NO: 36716 - RNA, 23 nt, Human
cguccucccaaagugcugggauu

SEQ ID NO: 36717 - RNA, 23 nt, Human
ucacccaggcuggcagaucaugg

SEQ ID NO: 36718 - RNA, 23 nt, Human
gcuaggcucccagccuccuuccc

SEQ ID NO: 36719 - RNA, 21 nt, Human
aguuuugcuuucaauuuuaug

SEQ ID NO: 36720 - RNA, 17 nt, Human
caagaucauuucuuucc

SEQ ID NO: 36721 - RNA, 27 nt, Human
aggacaaggaccuccagccaggcuuca

SEQ ID NO: 36722 - RNA, 26 nt, Human
ucagccaagaucuugccacuguacuc

SEQ ID NO: 36723 - RNA, 21 nt, Human
uauuaucauuuuauucaguag

SEQ ID NO: 36724 - RNA, 27 nt, Human
cagaggcaaaguguagacaucuguagg

SEQ ID NO: 36725 - RNA, 26 nt, Human
ugacuccgugguuugaacacgaaaga

SEQ ID NO: 36726 - RNA, 25 nt, Human
ugguggcacaugcuuguaaucccag

SEQ ID NO: 36727 - RNA, 20 nt, Human
gcccuugccagaauuuccug

SEQ ID NO: 36728 - RNA, 17 nt, Human
aauaucaggaugccuua

SEQ ID NO: 36729 - RNA, 23 nt, Human
gaucauucuaaugagaagaauua

SEQ ID NO: 36730 - RNA, 27 nt, Human
uccuccugguucaagcgauucucaugu

SEQ ID NO: 36731 - RNA, 26 nt, Human
cccugccucuuccacuccacccuucu

SEQ ID NO: 36732 - RNA, 20 nt, Human
cacccaggcaggagaggggg

SEQ ID NO: 36733 - RNA, 22 nt, Human
agugauaucuucugauuuuuua

SEQ ID NO: 36734 - RNA, 20 nt, Human
augugagucuuguguucuug

SEQ ID NO: 36735 - RNA, 16 nt, Human
gccagugcggcagguu

SEQ ID NO: 36736 - RNA, 22 nt, Human
cucuccugguggcaggccacuu

SEQ ID NO: 36737 - RNA, 26 nt, Human
uugguucugaaugguucacugcagcu

SEQ ID NO: 36738 - RNA, 21 nt, Human
ggcccagccaacacagcucuu

SEQ ID NO: 36739 - RNA, 24 nt, Human
ucuaagguuuaacaccaaaauguu

SEQ ID NO: 36740 - RNA, 19 nt, Human
gaaucucaaaauuaggcag

SEQ ID NO: 36741 - RNA, 22 nt, Human
gucgcccaggcuggggugcagu

SEQ ID NO: 36742 - RNA, 21 nt, Human
accagccacagccuccccacc

SEQ ID NO: 36743 - RNA, 21 nt, Human
ugcccagcccccuggucuuug

SEQ ID NO: 36744 - RNA, 22 nt, Human
ccucucacagcuacccagcaca

SEQ ID NO: 36745 - RNA, 31 nt, Human
gcagagaacguucagcaccuuuguuccuccc

SEQ ID NO: 36746 - RNA, 22 nt, Human
acacagacacaugcauauacau

SEQ ID NO: 36747 - RNA, 23 nt, Human
ugcagugaacucaguucuuggcc

SEQ ID NO: 36748 - RNA, 23 nt, Human
uccaugaaggcagagccauggac

SEQ ID NO: 36749 - RNA, 22 nt, Human
uacagucuaaaggaaacaaaac

SEQ ID NO: 36750 - RNA, 23 nt, Human
cucuugcaaaccaauuauggaaa

SEQ ID NO: 36751 - RNA, 27 nt, Human
agccccuggcauuugcuggggaaggga

SEQ ID NO: 36752 - RNA, 22 nt, Human
cauugcccaggcuggaguacaa

SEQ ID NO: 36753 - RNA, 21 nt, Human
ucuuccucauuuuggaaacuu

SEQ ID NO: 36754 - RNA, 22 nt, Human
auugcuugaaccuggaaggcag

SEQ ID NO: 36755 - RNA, 22 nt, Human
ucugaacucaagucaccgugga

SEQ ID NO: 36756 - RNA, 26 nt, Human
ccugaaugccucccucaaaggaccug

SEQ ID NO: 36757 - RNA, 25 nt, Human
ugccuggcauucucaccaucuuucu

SEQ ID NO: 36758 - RNA, 22 nt, Human
gcgugagccaccgugcccggcc

SEQ ID NO: 36759 - RNA, 22 nt, Human
gcaugagccaccgugcccagcc

SEQ ID NO: 36760 - RNA, 22 nt, Human
gcgugagccaccgcgcccggcu

SEQ ID NO: 36761 - RNA, 26 nt, Human
aagcagcucgggcuggagacauagca

SEQ ID NO: 36762 - RNA, 22 nt, Human
gcccucugguguaccagaaaug

SEQ ID NO: 36763 - RNA, 20 nt, Human
guuguuucucucccugggcc

SEQ ID NO: 36764 - RNA, 25 nt, Human
gacucugcugcuucuuaagcuccag

SEQ ID NO: 36765 - RNA, 23 nt, Human
uucucaucuguucuaccaugcca

SEQ ID NO: 36766 - RNA, 20 nt, Human
ucuucaguuccuuccuuguu

SEQ ID NO: 36767 - RNA, 23 nt, Human
ccuguauuucaaauuugcagcug

SEQ ID NO: 36768 - RNA, 26 nt, Human
guuuuaggugacacaggaugaagcag

SEQ ID NO: 36769 - RNA, 20 nt, Human
cuggggcaaagagaacuuaa

SEQ ID NO: 36770 - RNA, 24 nt, Human
cuuugcucuccccggguagugaug

SEQ ID NO: 36771 - RNA, 26 nt, Human
ccuccaccuccuggguucaagugauu

SEQ ID NO: 36772 - RNA, 21 nt, Human
cgcucacugcaaccucugcuu

SEQ ID NO: 36773 - RNA, 24 nt, Human
uguucaggcuggggcugcugguuu

SEQ ID NO: 36774 - RNA, 26 nt, Human
ggcugauuuccaaaaaccacaugcug

SEQ ID NO: 36775 - RNA, 27 nt, Human
uacagugguuucugaagcuuuugcagg

SEQ ID NO: 36776 - RNA, 24 nt, Human
auccuagcuacucgggaggcugag

SEQ ID NO: 36777 - RNA, 30 nt, Human
gcugggcucaucuucuagaaucucguuucu

SEQ ID NO: 36778 - RNA, 21 nt, Human
cagcuugccaguuucugccca

SEQ ID NO: 36779 - RNA, 21 nt, Human
cugaguauuaaaauguaugca

SEQ ID NO: 36780 - RNA, 21 nt, Human
aagcuccagggucccugaauc

SEQ ID NO: 36781 - RNA, 26 nt, Human
auacauacacaugaaugugcauuuuu

SEQ ID NO: 36782 - RNA, 19 nt, Human
cgucgcggaagagcgaggg

SEQ ID NO: 36783 - RNA, 22 nt, Human
caccaugagcuagguggaguaa

SEQ ID NO: 36784 - RNA, 24 nt, Human
ugaagagccugaagcugacccagu

SEQ ID NO: 36785 - RNA, 25 nt, Human
ugcggaucccugaaaccaaaaagcu

SEQ ID NO: 36786 - RNA, 21 nt, Human
agugcccaggcucaggugcag

SEQ ID NO: 36787 - RNA, 25 nt, Human
uaguaaguaauaucaaagcauuuua

SEQ ID NO: 36788 - RNA, 23 nt, Human
aacccuguggccuucagggcuca

SEQ ID NO: 36789 - RNA, 22 nt, Human
ugggcgcccccucauaaaggac

SEQ ID NO: 36790 - RNA, 18 nt, Human
cuuauuucuuccugucuc

SEQ ID NO: 36791 - RNA, 20 nt, Human
gcuuggguggggguugggug

SEQ ID NO: 36792 - RNA, 21 nt, Human
cugaggcaagagaaggccaga

SEQ ID NO: 36793 - RNA, 32 nt, Human
gcaacucuuuuuaaaaaccugcccuguuguau

SEQ ID NO: 36794 - RNA, 25 nt, Human
cggagcuggaggcggaggcagcugg

SEQ ID NO: 36795 - RNA, 26 nt, Human
ccucacugcaaccuucaccuaccgag

SEQ ID NO: 36796 - RNA, 21 nt, Human
acugacucacuccugccuggg

SEQ ID NO: 36797 - RNA, 20 nt, Human
ucuucucaucguuucacugg

SEQ ID NO: 36798 - RNA, 23 nt, Human
ugcccagcuuggagugccacaug

SEQ ID NO: 36799 - RNA, 26 nt, Human
ucacuaccauuguaacuuggauguag

SEQ ID NO: 36800 - RNA, 22 nt, Human
ugaugggaagaaaagguacaug

SEQ ID NO: 36801 - RNA, 23 nt, Human
gugcacuguuguaaaccauucag

SEQ ID NO: 36802 - RNA, 20 nt, Human
ugaaaaaugccugcugcugc

SEQ ID NO: 36803 - RNA, 24 nt, Human
cagccagucugcagaagcauuuga

SEQ ID NO: 36804 - RNA, 27 nt, Human
cucuggcaacagagaggcaaaguaucu

SEQ ID NO: 36805 - RNA, 20 nt, Human
aggccaagggaguggcagaa

SEQ ID NO: 36806 - RNA, 20 nt, Human
agagagaagagagacuccag

SEQ ID NO: 36807 - RNA, 21 nt, Human
guugaccucuuucucuguaga

SEQ ID NO: 36808 - RNA, 22 nt, Human
cagcagacauuaaaagcccugu

SEQ ID NO: 36809 - RNA, 20 nt, Human
cugccucccuuguggcagca

SEQ ID NO: 36810 - RNA, 20 nt, Human
uuugaguccagccuggguga

SEQ ID NO: 36811 - RNA, 26 nt, Human
cuccuucuucgggagcgagcuguucu

SEQ ID NO: 36812 - RNA, 25 nt, Human
ccagguuccuguaacucccugccuc

SEQ ID NO: 36813 - RNA, 20 nt, Human
aacuuugccagcuuucucca

SEQ ID NO: 36814 - RNA, 23 nt, Human
ccagcucccaguuuacuugguuu

SEQ ID NO: 36815 - RNA, 19 nt, Human
guuuccagaugcuaucaca

SEQ ID NO: 36816 - RNA, 22 nt, Human
auuuuuaaaggcuucauuccua

SEQ ID NO: 36817 - RNA, 24 nt, Human
uuaacucuguagccuggcagucug

SEQ ID NO: 36818 - RNA, 20 nt, Human
aucaaauuuuuaaccacaga

SEQ ID NO: 36819 - RNA, 29 nt, Human
ucucucaucccuuucccaggauuccuucc

SEQ ID NO: 36820 - RNA, 20 nt, Human
cuaaaaauacccgacuggag

SEQ ID NO: 36821 - RNA, 24 nt, Human
cccucaaggaguucaccaguuuau

SEQ ID NO: 36822 - RNA, 21 nt, Human
uuuacaucaagcucagccugg

SEQ ID NO: 36823 - RNA, 22 nt, Human
uucuuaaaaggccuacguccuc

SEQ ID NO: 36824 - RNA, 21 nt, Human
ugacauccuuugagauauuuu

SEQ ID NO: 36825 - RNA, 27 nt, Human
cagcccaggccaccaacuucaucgccu

SEQ ID NO: 36826 - RNA, 23 nt, Human
ggauuuuccaguucugacacacg

SEQ ID NO: 36827 - RNA, 18 nt, Human
ucugcuccucccugcccc

SEQ ID NO: 36828 - RNA, 19 nt, Human
uccugugcugaccaaccaa

SEQ ID NO: 36829 - RNA, 18 nt, Human
agcaggaggaggugccaa

SEQ ID NO: 36830 - RNA, 26 nt, Human
gcugcccaggcugugcagcgcagcug

SEQ ID NO: 36831 - RNA, 26 nt, Human
auucacugcaaggagaccucuacugu

SEQ ID NO: 36832 - RNA, 20 nt, Human
caccagccaggguaugaugg

SEQ ID NO: 36833 - RNA, 21 nt, Human
cucgcccaggcuggagugcag

SEQ ID NO: 36834 - RNA, 21 nt, Human
ugggcaggucuagugagcugu

SEQ ID NO: 36835 - RNA, 25 nt, Human
aacaaucacacaggacacuuuucua

SEQ ID NO: 36836 - RNA, 24 nt, Human
ugaggcugggagacagccguagua

SEQ ID NO: 36837 - RNA, 22 nt, Human
cuacaucuucuuauucuauuua

SEQ ID NO: 36838 - RNA, 19 nt, Human
aucaauaaaugguaauacu

SEQ ID NO: 36839 - RNA, 20 nt, Human
ccgcucucccugucacgcuc

SEQ ID NO: 36840 - RNA, 18 nt, Human
caguguccuaaaguuuua

SEQ ID NO: 36841 - RNA, 21 nt, Human
ccgccugaccuuccucaguca

SEQ ID NO: 36842 - RNA, 19 nt, Human
auguugcccaggcuggugu

SEQ ID NO: 36843 - RNA, 22 nt, Human
caaacucaggugauuccaggau

SEQ ID NO: 36844 - RNA, 26 nt, Human
ucuguucucugguuucaccagcguug

SEQ ID NO: 36845 - RNA, 20 nt, Human
ggcucugcuccucccgaagg

SEQ ID NO: 36846 - RNA, 19 nt, Human
ugauauguguguaaaaugu

SEQ ID NO: 36847 - RNA, 21 nt, Human
guggccaaggugaauagcaca

SEQ ID NO: 36848 - RNA, 22 nt, Human
cugcaaccuccgccuccugggu

SEQ ID NO: 36849 - RNA, 20 nt, Human
aaaucacucuucaugcuucc

SEQ ID NO: 36850 - RNA, 22 nt, Human
ugcugagauugaguuucugccu

SEQ ID NO: 36851 - RNA, 21 nt, Human
agcacaggagagcucuuuuug

SEQ ID NO: 36852 - RNA, 21 nt, Human
gcugcuccuccuccguucauu

SEQ ID NO: 36853 - RNA, 21 nt, Human
ccuggguuggguuuagaaaga

SEQ ID NO: 36854 - RNA, 27 nt, Human
cagguucuugaagcagcugggccuggg

SEQ ID NO: 36855 - RNA, 21 nt, Human
ggcuugcauagcuuucacauu

SEQ ID NO: 36856 - RNA, 26 nt, Human
aacuauaguggccacacucugccuuc

SEQ ID NO: 36857 - RNA, 20 nt, Human
cagcauuccagcuguuucac

SEQ ID NO: 36858 - RNA, 25 nt, Human
ucaucuguuacacuggaacaccuuc

SEQ ID NO: 36859 - RNA, 26 nt, Human
acagaagucacaagccaagugagaca

SEQ ID NO: 36860 - RNA, 24 nt, Human
ccuagccauggcuggggcgagcag

SEQ ID NO: 36861 - RNA, 21 nt, Human
ccccgccccuucuccuccucc

SEQ ID NO: 36862 - RNA, 20 nt, Human
aacucugcccuuccuucugu

SEQ ID NO: 36863 - RNA, 24 nt, Human
ggaaguggugccuucagcacagaa

SEQ ID NO: 36864 - RNA, 22 nt, Human
aggccuguaaucccagcacuuu

SEQ ID NO: 36865 - RNA, 22 nt, Human
cacugcacuccacucugggcaa

SEQ ID NO: 36866 - RNA, 22 nt, Human
guuggccaccugggucacugga

SEQ ID NO: 36867 - RNA, 22 nt, Human
ucgcaaaccacagauaguacca

SEQ ID NO: 36868 - RNA, 28 nt, Human
aguucccucuguuccuuccucugaaucg

SEQ ID NO: 36869 - RNA, 20 nt, Human
uaucacaccacgucuuuuca

SEQ ID NO: 36870 - RNA, 27 nt, Human
uacagugcucaccuaaauccaucugac

SEQ ID NO: 36871 - RNA, 27 nt, Human
gccuaggcaacauagugagacugucuc

SEQ ID NO: 36872 - RNA, 23 nt, Human
ccucuccucccuguccugagccu

SEQ ID NO: 36873 - RNA, 22 nt, Human
cacugcuuuccagccugggcaa

SEQ ID NO: 36874 - RNA, 20 nt, Human
uaaagugccggauuacaggu

SEQ ID NO: 36875 - RNA, 25 nt, Human
gcccaggccgggguggagcaugggc

SEQ ID NO: 36876 - RNA, 20 nt, Human
uucaaugcauuacuaaauga

SEQ ID NO: 36877 - RNA, 21 nt, Human
cugagucuucuccuugcucug

SEQ ID NO: 36878 - RNA, 20 nt, Human
uuuagaaguagcaaagagca

SEQ ID NO: 36879 - RNA, 18 nt, Human
ugccggugggccuguguu

SEQ ID NO: 36880 - RNA, 32 nt, Human
gggaaaggcgagcagcuggcagagagcccagu

SEQ ID NO: 36881 - RNA, 22 nt, Human
ccacugcagucgagccugggcg

SEQ ID NO: 36882 - RNA, 24 nt, Human
uucugaaaggugcuuucuccauuu

SEQ ID NO: 36883 - RNA, 24 nt, Human
cuguugcugaucuguaguacagua

SEQ ID NO: 36884 - RNA, 27 nt, Human
ggcucaccacaaccucugccuacuggg

SEQ ID NO: 36885 - RNA, 21 nt, Human
ucaugugaugcaagccagcuu

SEQ ID NO: 36886 - RNA, 24 nt, Human
ggcucaaagacauucuguuauacu

SEQ ID NO: 36887 - RNA, 23 nt, Human
ggcucugcucccuccuauggagg

SEQ ID NO: 36888 - RNA, 27 nt, Human
ggagagggugugagggcagaucugggg

SEQ ID NO: 36889 - RNA, 25 nt, Human
agguuggcaaaucauacuauagcug

SEQ ID NO: 36890 - RNA, 23 nt, Human
ccucucugccuccuccugccugu

SEQ ID NO: 36891 - RNA, 20 nt, Human
cccuaguaauggauuacagg

SEQ ID NO: 36892 - RNA, 27 nt, Human
ccugaaauguuguguagacacccucuu

SEQ ID NO: 36893 - RNA, 23 nt, Human
uucagucaccugguggcuaauua

SEQ ID NO: 36894 - RNA, 27 nt, Human
uagccaucuugaucuguguuuuauuga

SEQ ID NO: 36895 - RNA, 22 nt, Human
ccugggcaaagguguucaccuu

SEQ ID NO: 36896 - RNA, 22 nt, Human
agccucccaaguagcucggacu

SEQ ID NO: 36897 - RNA, 18 nt, Human
gugaacacacgcuuucug

SEQ ID NO: 36898 - RNA, 26 nt, Human
cuguguugcccaggcuggagugcagu

SEQ ID NO: 36899 - RNA, 21 nt, Human
ggagaaagcugauggagccag

SEQ ID NO: 36900 - RNA, 24 nt, Human
agguagaggggcagaggcgggacu

SEQ ID NO: 36901 - RNA, 23 nt, Human
cggcugaagugcaguggcacgau

SEQ ID NO: 36902 - RNA, 22 nt, Human
gcuggcucuucugugcuuucca

SEQ ID NO: 36903 - RNA, 23 nt, Human
uuggagcuccugauucaaauuac

SEQ ID NO: 36904 - RNA, 27 nt, Human
gucaaugacagugucuccauugucuuc

SEQ ID NO: 36905 - RNA, 20 nt, Human
acaauucuuuuuaauuuaca

SEQ ID NO: 36906 - RNA, 28 nt, Human
ugaaggcaagggagagcaggcugcacag

SEQ ID NO: 36907 - RNA, 24 nt, Human
cuguagcccaggccagagugcagu

SEQ ID NO: 36908 - RNA, 22 nt, Human
ggucuuugugagagugagcugu

SEQ ID NO: 36909 - RNA, 20 nt, Human
uccauugucagcacagccua

SEQ ID NO: 36910 - RNA, 26 nt, Human
aauuggagaguaaaaacugaauggaa

SEQ ID NO: 36911 - RNA, 20 nt, Human
gcaucagcuaugacacaucc

SEQ ID NO: 36912 - RNA, 21 nt, Human
acaaaacuauuuacuguagug

SEQ ID NO: 36913 - RNA, 22 nt, Human
caccucccagguucaagcgauu

SEQ ID NO: 36914 - RNA, 27 nt, Human
acuguuguuucucuguggacugggcaa

SEQ ID NO: 36915 - RNA, 32 nt, Human
ucgccuaaauaucugugccuuugccuguccuu

SEQ ID NO: 36916 - RNA, 27 nt, Human
agacgcccagccccaucccuguccuca

SEQ ID NO: 36917 - RNA, 21 nt, Human
uuguggcugcuuuugcugcug

SEQ ID NO: 36918 - RNA, 22 nt, Human
agccuacccuuccugcauuucu

SEQ ID NO: 36919 - RNA, 22 nt, Human
guaacaguuuugcuauauucca

SEQ ID NO: 36920 - RNA, 27 nt, Human
guguggcagggaucguugcacuggacu

SEQ ID NO: 36921 - RNA, 21 nt, Human
ggaggggagggggcgccuugu

SEQ ID NO: 36922 - RNA, 23 nt, Human
gccaccggcgggagugcagcggc

SEQ ID NO: 36923 - RNA, 27 nt, Human
aauaacugcugcaggugugauuuuggu

SEQ ID NO: 36924 - RNA, 22 nt, Human
ggggagcagaggggcagaggcc

SEQ ID NO: 36925 - RNA, 27 nt, Human
ucuggggcucaggcuugagccacuacu

SEQ ID NO: 36926 - RNA, 22 nt, Human
uuagcacauccucuguucucua

SEQ ID NO: 36927 - RNA, 24 nt, Human
cacaccauauuucaaauauagaag

SEQ ID NO: 36928 - RNA, 27 nt, Human
ccccugccagcucuggcacugcccccu

SEQ ID NO: 36929 - RNA, 22 nt, Human
gcucacugcagguucagccuuc

SEQ ID NO: 36930 - RNA, 29 nt, Human
ggggagaagcagcauugaagugggaagau

SEQ ID NO: 36931 - RNA, 21 nt, Human
cucaggaggcugaggcgagag

SEQ ID NO: 36932 - RNA, 21 nt, Human
ggcuuccaucucagcacucug

SEQ ID NO: 36933 - RNA, 24 nt, Human
auuuaaauaaaggaaauuuagauu

SEQ ID NO: 36934 - RNA, 23 nt, Human
ggacguuacagggugaaacccuc

SEQ ID NO: 36935 - RNA, 24 nt, Human
ugcagcuaacuccucuuuaguuuu

SEQ ID NO: 36936 - RNA, 22 nt, Human
cugcucuauuucugacucucau

SEQ ID NO: 36937 - RNA, 21 nt, Human
gcuugaaguugucucacagcu

SEQ ID NO: 36938 - RNA, 22 nt, Human
ggcaggagaacugcuugaaccc

SEQ ID NO: 36939 - RNA, 23 nt, Human
ugaggacaaaaaggcaacauuaa

SEQ ID NO: 36940 - RNA, 21 nt, Human
cuugggaguggcaggagaagu

SEQ ID NO: 36941 - RNA, 22 nt, Human
caagccacaugccacuaaccac

SEQ ID NO: 36942 - RNA, 23 nt, Human
aagcagucuucucuucugccuuu

SEQ ID NO: 36943 - RNA, 19 nt, Human
ggcugucuuggcucuggaa

SEQ ID NO: 36944 - RNA, 23 nt, Human
cagaacaggaguaacugcagggg

SEQ ID NO: 36945 - RNA, 27 nt, Human
aaccugacuuuagauguuuugggauca

SEQ ID NO: 36946 - RNA, 21 nt, Human
ccagccuggucgacagaguga

SEQ ID NO: 36947 - RNA, 23 nt, Human
aagauuccuguccuucaccuuuc

SEQ ID NO: 36948 - RNA, 27 nt, Human
gccgggagcagcggaaagggacguuuu

SEQ ID NO: 36949 - RNA, 20 nt, Human
cuccgucucaaaaaagaaaa

SEQ ID NO: 36950 - RNA, 22 nt, Human
gcgccagacccagacagagcau

SEQ ID NO: 36951 - RNA, 24 nt, Human
uucacucuuggcuucuuuucuccc

SEQ ID NO: 36952 - RNA, 21 nt, Human
gcuccccaggggaguuguguc

SEQ ID NO: 36953 - RNA, 22 nt, Human
aaugucuguguuucauugucua

SEQ ID NO: 36954 - RNA, 27 nt, Human
gucuuucuccccgagcuccccuguucc

SEQ ID NO: 36955 - RNA, 24 nt, Human
cucugccuuuuagugguaucugac

SEQ ID NO: 36956 - RNA, 19 nt, Human
ccaggagaggggagcugug

SEQ ID NO: 36957 - RNA, 25 nt, Human
uggccucucccguuccuuuaggcug

SEQ ID NO: 36958 - RNA, 21 nt, Human
uuccucugaucacauucuuca

SEQ ID NO: 36959 - RNA, 20 nt, Human
cugcccuuuuugaaaucacc

SEQ ID NO: 36960 - RNA, 22 nt, Human
uguggcccuggcuggaguucag

SEQ ID NO: 36961 - RNA, 21 nt, Human
augccuuugcucaaagcuugg

SEQ ID NO: 36962 - RNA, 22 nt, Human
acacauuuauaaacauggauac

SEQ ID NO: 36963 - RNA, 21 nt, Human
gugcgggugguccgggaagug

SEQ ID NO: 36964 - RNA, 21 nt, Human
uuuucauuuuuauuuguaaac

SEQ ID NO: 36965 - RNA, 27 nt, Human
ucuaccagugaccucagggcacuuugg

SEQ ID NO: 36966 - RNA, 22 nt, Human
cauuuugcuccuaccaaggauc

SEQ ID NO: 36967 - RNA, 26 nt, Human
cuuuguccacauuggauuugguccaa

SEQ ID NO: 36968 - RNA, 26 nt, Human
accaugucacagcugugaagaucugg

SEQ ID NO: 36969 - RNA, 22 nt, Human
cacugcacuccagccagggcga

SEQ ID NO: 36970 - RNA, 22 nt, Human
ugccucuccucccucucuggca

SEQ ID NO: 36971 - RNA, 26 nt, Human
ggaggcggagggagcgauuguggccc

SEQ ID NO: 36972 - RNA, 21 nt, Human
guugcccaggauggucucgau

SEQ ID NO: 36973 - RNA, 22 nt, Human
cuuucauguccccucuggauug

SEQ ID NO: 36974 - RNA, 27 nt, Human
ucaguccuucucccagaggaaggcaga

SEQ ID NO: 36975 - RNA, 19 nt, Human
uguuuacaguacuacuuuu

SEQ ID NO: 36976 - RNA, 22 nt, Human
gacauggcgagcacagugcagg

SEQ ID NO: 36977 - RNA, 22 nt, Human
uuaucagaagaaggugcagauu

SEQ ID NO: 36978 - RNA, 20 nt, Human
uuuuagaguguuucugggcc

SEQ ID NO: 36979 - RNA, 21 nt, Human
gcucccggggauggagcaagg

SEQ ID NO: 36980 - RNA, 22 nt, Human
ucacccaggcuggaguacagug

SEQ ID NO: 36981 - RNA, 22 nt, Human
ucacccagacuggagugcagug

SEQ ID NO: 36982 - RNA, 25 nt, Human
gcaucccuuaguuuccacugccucc

SEQ ID NO: 36983 - RNA, 19 nt, Human
uuaagugccuuaaaaccuc

SEQ ID NO: 36984 - RNA, 30 nt, Human
agcaaaacuuucagcaccacuugcuggcau

SEQ ID NO: 36985 - RNA, 27 nt, Human
ccuaggcugaccuugaacuccugggcu

SEQ ID NO: 36986 - RNA, 20 nt, Human
acugaguccuucacuggcau

SEQ ID NO: 36987 - RNA, 23 nt, Human
ggagcgccaucaugucuuaccag

SEQ ID NO: 36988 - RNA, 26 nt, Human
ucccgggaaagagaacuguccugcag

SEQ ID NO: 36989 - RNA, 18 nt, Human
aauaacuguaauugugcu

SEQ ID NO: 36990 - RNA, 24 nt, Human
gccuuuucuuugaagacacacucg

SEQ ID NO: 36991 - RNA, 27 nt, Human
ccugcaguucagcaguuaacagaugac

SEQ ID NO: 36992 - RNA, 27 nt, Human
uuauauuuuacaaaugcuagauauugg

SEQ ID NO: 36993 - RNA, 28 nt, Human
uuuccgcuccucuuccgaccuguccacc

SEQ ID NO: 36994 - RNA, 21 nt, Human
aggguaugcugauccucuuuu

SEQ ID NO: 36995 - RNA, 26 nt, Human
ccucuccugucucccuccucugcccg

SEQ ID NO: 36996 - RNA, 21 nt, Human
aacagcccccacuccuccucc

SEQ ID NO: 36997 - RNA, 22 nt, Human
ccuagagugcagggauuacagg

SEQ ID NO: 36998 - RNA, 24 nt, Human
gcacaggaagccuucacacuggaa

SEQ ID NO: 36999 - RNA, 24 nt, Human
gccaccgccugcuccucguccucc

SEQ ID NO: 37000 - RNA, 22 nt, Human
aagauucagggcaagcuaaaaa

SEQ ID NO: 37001 - RNA, 21 nt, Human
ucucccagaguguggaaaugu

SEQ ID NO: 37002 - RNA, 22 nt, Human
gacaaaccauuuugcccccuca

SEQ ID NO: 37003 - RNA, 22 nt, Human
ucaucaccgagauccucccuga

SEQ ID NO: 37004 - RNA, 22 nt, Human
gggaugcaaagguugcagugag

SEQ ID NO: 37005 - RNA, 20 nt, Human
agaaacaggagcacagaccu

SEQ ID NO: 37006 - RNA, 21 nt, Human
cccagcacuaugggaggcuga

SEQ ID NO: 37007 - RNA, 25 nt, Human
accaucucaauaaaagccaggaaca

SEQ ID NO: 37008 - RNA, 21 nt, Human
acccagcuccacccagcagug

SEQ ID NO: 37009 - RNA, 19 nt, Human
agcuuauaaauuacucauc

SEQ ID NO: 37010 - RNA, 22 nt, Human
gccugaguccccaugcccugcu

SEQ ID NO: 37011 - RNA, 21 nt, Human
gccgccgccgcuacagcugcc

SEQ ID NO: 37012 - RNA, 24 nt, Human
acagcuugagggggcagagggcug

SEQ ID NO: 37013 - RNA, 20 nt, Human
uguuuauuaaaugcuucauu

SEQ ID NO: 37014 - RNA, 27 nt, Human
guuaugucccccucuaauuuagccgcu

SEQ ID NO: 37015 - RNA, 23 nt, Human
ugucccuggccgcgcccgcgggc

SEQ ID NO: 37016 - RNA, 27 nt, Human
agcuagauacaagaugcagcuaaguau

SEQ ID NO: 37017 - RNA, 24 nt, Human
gcuccuuccuucaucccgagaggc

SEQ ID NO: 37018 - RNA, 19 nt, Human
gaaguuuucugucacugga

SEQ ID NO: 37019 - RNA, 28 nt, Human
gcgugcacgguguugaacugggacacug

SEQ ID NO: 37020 - RNA, 22 nt, Human
aaaugaaaacacuguuccauuu

SEQ ID NO: 37021 - RNA, 20 nt, Human
uauguaugucucaauucucu

SEQ ID NO: 37022 - RNA, 22 nt, Human
auaggucagugaggcccaggga

SEQ ID NO: 37023 - RNA, 21 nt, Human
accuauaaucccagcacuuug

SEQ ID NO: 37024 - RNA, 23 nt, Human
gcugccucugacagcagccugug

SEQ ID NO: 37025 - RNA, 20 nt, Human
uggcucagagccagucuuuu

SEQ ID NO: 37026 - RNA, 26 nt, Human
acaccgauguacacacacagaugcac

SEQ ID NO: 37027 - RNA, 21 nt, Human
gggguggagucagggcugugc

SEQ ID NO: 37028 - RNA, 27 nt, Human
uccugcucugcccaggagguggcgucc

SEQ ID NO: 37029 - RNA, 23 nt, Human
ggugcaggccaccaugcccggcu

SEQ ID NO: 37030 - RNA, 23 nt, Human
gaugucaggaaacauucagugaa

SEQ ID NO: 37031 - RNA, 22 nt, Human
caagaucaugccacuccacucc

SEQ ID NO: 37032 - RNA, 20 nt, Human
ggucuccugcccuuguuccu

SEQ ID NO: 37033 - RNA, 26 nt, Human
agcuggggcccgauggggcuuggggg

SEQ ID NO: 37034 - RNA, 20 nt, Human
gaacugcugacgugaccacu

SEQ ID NO: 37035 - RNA, 23 nt, Human
guggguggagaagggaggguggc

SEQ ID NO: 37036 - RNA, 27 nt, Human
ccagaaacaacaacugccagcccggcc

SEQ ID NO: 37037 - RNA, 22 nt, Human
ggcgugaauccgggaggcggag

SEQ ID NO: 37038 - RNA, 22 nt, Human
caugugggagaaaaagugagga

SEQ ID NO: 37039 - RNA, 22 nt, Human
gaggucagggaaggaguaacuc

SEQ ID NO: 37040 - RNA, 20 nt, Human
uucuucugccaaggcuacuu

SEQ ID NO: 37041 - RNA, 22 nt, Human
gcacuugggcuccagucgcgcc

SEQ ID NO: 37042 - RNA, 21 nt, Human
guccacccucuacgucucccc

SEQ ID NO: 37043 - RNA, 26 nt, Human
cgcccaggcugccggugcugagggac

SEQ ID NO: 37044 - RNA, 26 nt, Human
cuaccugcccaacugugaccaacuaa

SEQ ID NO: 37045 - RNA, 29 nt, Human
gguguggucuccacuggggauugggcccc

SEQ ID NO: 37046 - RNA, 23 nt, Human
ucucucacucuucugucauuugc

SEQ ID NO: 37047 - RNA, 27 nt, Human
cuuaucucccuucacugacucucuuuu

SEQ ID NO: 37048 - RNA, 25 nt, Human
ccaggguuacagcaagagccacuga

SEQ ID NO: 37049 - RNA, 21 nt, Human
ccuguaauccuugcauuuugg

SEQ ID NO: 37050 - RNA, 26 nt, Human
cucuuggacucucggcaaccacaaca

SEQ ID NO: 37051 - RNA, 22 nt, Human
guucaaaaucacagcacgugca

SEQ ID NO: 37052 - RNA, 26 nt, Human
cagucccggcagguccuggcgccgcu

SEQ ID NO: 37053 - RNA, 23 nt, Human
gucucgaacuccuggccucguga

SEQ ID NO: 37054 - RNA, 23 nt, Human
gagcaaauuuaccuuucucucca

SEQ ID NO: 37055 - RNA, 21 nt, Human
cccaucauccucgcgcguccu

SEQ ID NO: 37056 - RNA, 26 nt, Human
uagagcacaaugggaaaugaaaguau

SEQ ID NO: 37057 - RNA, 26 nt, Human
aggcuggagcgcaauggcccugccgu

SEQ ID NO: 37058 - RNA, 23 nt, Human
ucuacccuuagaagucugaggcc

SEQ ID NO: 37059 - RNA, 27 nt, Human
ccuguacgacacguccucgcugcucca

SEQ ID NO: 37060 - RNA, 21 nt, Human
auguucugcuucugucaguua

SEQ ID NO: 37061 - RNA, 24 nt, Human
ggacaagguuguagcugugcucag

SEQ ID NO: 37062 - RNA, 26 nt, Human
gggaauuaugcccuggaauucugccu

SEQ ID NO: 37063 - RNA, 26 nt, Human
uccugccucuggucccagcauccagc

SEQ ID NO: 37064 - RNA, 24 nt, Human
accgugucucaaaacaaacaaaca

SEQ ID NO: 37065 - RNA, 26 nt, Human
ucagaagaaagccaaggugcuggacu

SEQ ID NO: 37066 - RNA, 24 nt, Human
acuuuuagauuuagugaagauggu

SEQ ID NO: 37067 - RNA, 22 nt, Human
ggucacucucaauucacuggca

SEQ ID NO: 37068 - RNA, 20 nt, Human
agcaaggagcugcugagaag

SEQ ID NO: 37069 - RNA, 22 nt, Human
aggccgaggcaggcggaucaca

SEQ ID NO: 37070 - RNA, 22 nt, Human
gccucugggcccucccagcaca

SEQ ID NO: 37071 - RNA, 22 nt, Human
ggcucacugcaacuucugccuc

SEQ ID NO: 37072 - RNA, 16 nt, Human
cccaaggaaugccuuc

SEQ ID NO: 37073 - RNA, 21 nt, Human
guuugcuugaccucugccuca

SEQ ID NO: 37074 - RNA, 23 nt, Human
uuacauuuagagauuacauuuaa

SEQ ID NO: 37075 - RNA, 20 nt, Human
uggaaggggaaaugaaggac

SEQ ID NO: 37076 - RNA, 20 nt, Human
agcugagguuuccuaccuga

SEQ ID NO: 37077 - RNA, 22 nt, Human
caccuguuuuccaguguucuuc

SEQ ID NO: 37078 - RNA, 25 nt, Human
cuuguggaagugcaucuacuugcca

SEQ ID NO: 37079 - RNA, 27 nt, Human
ugcucucaaacugcaucuuuuauuuca

SEQ ID NO: 37080 - RNA, 20 nt, Human
acauuuaugaaccaaugcga

SEQ ID NO: 37081 - RNA, 21 nt, Human
cgacccaggcaucuggggagc

SEQ ID NO: 37082 - RNA, 23 nt, Human
gagaaagggagaggaagagaagc

SEQ ID NO: 37083 - RNA, 26 nt, Human
agggggugacguggcagugacaggcg

SEQ ID NO: 37084 - RNA, 22 nt, Human
acucacaccuguaaucccagca

SEQ ID NO: 37085 - RNA, 25 nt, Human
gcugagcagggaccgggacagcccu

SEQ ID NO: 37086 - RNA, 26 nt, Human
auugcucuugcaaaccaauuauggaa

SEQ ID NO: 37087 - RNA, 21 nt, Human
aggucuucagaagcaucaagu

SEQ ID NO: 37088 - RNA, 22 nt, Human
ucuuucugugaggagauugagu

SEQ ID NO: 37089 - RNA, 23 nt, Human
uauaccaccacuuuuucccauca

SEQ ID NO: 37090 - RNA, 22 nt, Human
ugcagugagcuaugguggcacc

SEQ ID NO: 37091 - RNA, 22 nt, Human
gcuuucaucuucuguugcucuc

SEQ ID NO: 37092 - RNA, 20 nt, Human
gcuuucacacucuauccaca

SEQ ID NO: 37093 - RNA, 20 nt, Human
cuucauggcaccuucacugc

SEQ ID NO: 37094 - RNA, 25 nt, Human
cuccucugggucacauugcuucuua

SEQ ID NO: 37095 - RNA, 26 nt, Human
cugacugccugguucagccucuucgc

SEQ ID NO: 37096 - RNA, 26 nt, Human
gccacuuuuuacucucccuccugacc

SEQ ID NO: 37097 - RNA, 20 nt, Human
uguccuccaggcuggggcag

SEQ ID NO: 37098 - RNA, 26 nt, Human
ccccauccccggucuucguguugugu

SEQ ID NO: 37099 - RNA, 21 nt, Human
auuucagagaugugugcuccu

SEQ ID NO: 37100 - RNA, 24 nt, Human
gaucaaaacaaaugauuuucaagg

SEQ ID NO: 37101 - RNA, 25 nt, Human
cccaccucuaugcccugagcccugg

SEQ ID NO: 37102 - RNA, 24 nt, Human
uggcuaacacagugaaaccccauc

SEQ ID NO: 37103 - RNA, 26 nt, Human
ggcaggcggguuguacuuaguguggu

SEQ ID NO: 37104 - RNA, 22 nt, Human
aagcuuuuucuuucuuuucuuu

SEQ ID NO: 37105 - RNA, 23 nt, Human
uucuugaauguuucuucauucca

SEQ ID NO: 37106 - RNA, 23 nt, Human
gggaagaggcagagggaggcagc

SEQ ID NO: 37107 - RNA, 27 nt, Human
guucugcucuuuucuucauuccuuucc

SEQ ID NO: 37108 - RNA, 27 nt, Human
ugcaggguggggguggggaacccugag

SEQ ID NO: 37109 - RNA, 30 nt, Human
ucugaguugugccuuucuuuacucacaagg

SEQ ID NO: 37110 - RNA, 27 nt, Human
cacugccucuacugggcgugcugccaa

SEQ ID NO: 37111 - RNA, 20 nt, Human
ucgugcucagccacucugcc

SEQ ID NO: 37112 - RNA, 20 nt, Human
cuugaguuucccugcagucu

SEQ ID NO: 37113 - RNA, 27 nt, Human
uggagccauugcuggacauccuuugcc

SEQ ID NO: 37114 - RNA, 25 nt, Human
cugucucuauggcaacccaguagcu

SEQ ID NO: 37115 - RNA, 23 nt, Human
uuacccugggcuggagaguuggu

SEQ ID NO: 37116 - RNA, 18 nt, Human
uguugaaaucacuuucug

SEQ ID NO: 37117 - RNA, 20 nt, Human
cugcuuuguggucuuuuuga

SEQ ID NO: 37118 - RNA, 27 nt, Human
gggccugccucaccacggaccaaaggg

SEQ ID NO: 37119 - RNA, 23 nt, Human
ugagggagaccccgacagaggac

SEQ ID NO: 37120 - RNA, 22 nt, Human
ccaccaggaacagaaggucugg

SEQ ID NO: 37121 - RNA, 26 nt, Human
cuucuaugacucucugcuaucccacu

SEQ ID NO: 37122 - RNA, 22 nt, Human
gcuccucccugccucaguggcu

SEQ ID NO: 37123 - RNA, 22 nt, Human
uuauauuguacauagucuuuua

SEQ ID NO: 37124 - RNA, 22 nt, Human
gcucugcagaacucaaaaagaa

SEQ ID NO: 37125 - RNA, 25 nt, Human
gucccugggcucuggggcugaagga

SEQ ID NO: 37126 - RNA, 22 nt, Human
cagaaggcuucaucaccaagau

SEQ ID NO: 37127 - RNA, 26 nt, Human
gacccaggcugggcaaggaggccacg

SEQ ID NO: 37128 - RNA, 19 nt, Human
guauucaucuucccuucua

SEQ ID NO: 37129 - RNA, 21 nt, Human
ugguaguucuggaggccucgc

SEQ ID NO: 37130 - RNA, 21 nt, Human
gcagauaugggacacagcagg

SEQ ID NO: 37131 - RNA, 21 nt, Human
gaagaaaauauuuuguaaaag

SEQ ID NO: 37132 - RNA, 25 nt, Human
guuggagccugcucuuugaacuccg

SEQ ID NO: 37133 - RNA, 24 nt, Human
aacucucuccuggucgcuuugcca

SEQ ID NO: 37134 - RNA, 27 nt, Human
ccugggcaacagagugagacccugucu

SEQ ID NO: 37135 - RNA, 21 nt, Human
gagaccugauucccuguggug

SEQ ID NO: 37136 - RNA, 23 nt, Human
ccuggaacuuccuccucucucgc

SEQ ID NO: 37137 - RNA, 22 nt, Human
uauuuugaguuucagcuggaaa

SEQ ID NO: 37138 - RNA, 27 nt, Human
gagagugagagcaugugagggguagug

SEQ ID NO: 37139 - RNA, 23 nt, Human
agagucagccuggguggcaccag

SEQ ID NO: 37140 - RNA, 23 nt, Human
uugagaauuuuguuucaaaggga

SEQ ID NO: 37141 - RNA, 24 nt, Human
cuguaggacucaaagggagccagg

SEQ ID NO: 37142 - RNA, 27 nt, Human
gagcucccucuggggacggcuggcuca

SEQ ID NO: 37143 - RNA, 21 nt, Human
ugcacauccuucuuggcuucc

SEQ ID NO: 37144 - RNA, 22 nt, Human
uuccucugggaagagucgcaag

SEQ ID NO: 37145 - RNA, 23 nt, Human
cggcgggcaguugcaguggugca

SEQ ID NO: 37146 - RNA, 23 nt, Human
gcugcugcuguucagacuuuuuu

SEQ ID NO: 37147 - RNA, 22 nt, Human
gaucgguaccugcugcugguga

SEQ ID NO: 37148 - RNA, 27 nt, Human
cugggagggggugggggaucugggcaa

SEQ ID NO: 37149 - RNA, 21 nt, Human
gaugccacuguacugcagcuu

SEQ ID NO: 37150 - RNA, 19 nt, Human
ucucuuccuguccugcaca

SEQ ID NO: 37151 - RNA, 20 nt, Human
gcugucuaauuuauguaaua

SEQ ID NO: 37152 - RNA, 23 nt, Human
gaugggguuugaccauguuggcc

SEQ ID NO: 37153 - RNA, 19 nt, Human
aaaggaugugggcagcagc

SEQ ID NO: 37154 - RNA, 27 nt, Human
guucugucacucaggcuggaguacagu

SEQ ID NO: 37155 - RNA, 24 nt, Human
ugaguuauacuguuuucaaaguca

SEQ ID NO: 37156 - RNA, 27 nt, Human
ugccugucagcuccagguccuggagcc

SEQ ID NO: 37157 - RNA, 22 nt, Human
uugucuccucuauccugggcuu

SEQ ID NO: 37158 - RNA, 21 nt, Human
agcucucugguagcuggggaa

SEQ ID NO: 37159 - RNA, 21 nt, Human
gugagugccuacagaaauuuc

SEQ ID NO: 37160 - RNA, 23 nt, Human
gccacaggagugcccacagggug

SEQ ID NO: 37161 - RNA, 22 nt, Human
uugagacaaguguucaaacaga

SEQ ID NO: 37162 - RNA, 22 nt, Human
cacuccccuuccucauccccag

SEQ ID NO: 37163 - RNA, 22 nt, Human
gccagccugaccaacaugguga

SEQ ID NO: 37164 - RNA, 22 nt, Human
aacaugaggacagaaggacugg

SEQ ID NO: 37165 - RNA, 22 nt, Human
gcugggagagcagaagggcagg

SEQ ID NO: 37166 - RNA, 19 nt, Human
ccugguuccucccugcccc

SEQ ID NO: 37167 - RNA, 27 nt, Human
uacuguggucccuuguaaccucagguc

SEQ ID NO: 37168 - RNA, 22 nt, Human
gggccuuuuuugcuagcaagug

SEQ ID NO: 37169 - RNA, 21 nt, Human
cucucauacauggcuucuguu

SEQ ID NO: 37170 - RNA, 22 nt, Human
uauugggcaccuacuaugugcc

SEQ ID NO: 37171 - RNA, 23 nt, Human
gcuggugguaucugaguugacuu

SEQ ID NO: 37172 - RNA, 20 nt, Human
aguccagcaagggccaaaga

SEQ ID NO: 37173 - RNA, 22 nt, Human
ugauagugaacguguaccuugg

SEQ ID NO: 37174 - RNA, 21 nt, Human
ucucauuaaaauccaguauua

SEQ ID NO: 37175 - RNA, 19 nt, Human
cagcaaaaacuugcuuuau

SEQ ID NO: 37176 - RNA, 22 nt, Human
gaugugguggcccaggaggcgg

SEQ ID NO: 37177 - RNA, 22 nt, Human
ugccuguccuccagcugucuga

SEQ ID NO: 37178 - RNA, 25 nt, Human
cggauuacaaacgugagccaucgca

SEQ ID NO: 37179 - RNA, 20 nt, Human
cuggugagggcagaggcaga

SEQ ID NO: 37180 - RNA, 20 nt, Human
uuuaaaaaacuaaugccuga

SEQ ID NO: 37181 - RNA, 20 nt, Human
agcuaacccacccaccaaag

SEQ ID NO: 37182 - RNA, 22 nt, Human
uacuuuggaaaauauacaauca

SEQ ID NO: 37183 - RNA, 27 nt, Human
ggcucagacaguucagugggagaaucc

SEQ ID NO: 37184 - RNA, 20 nt, Human
agauaugauuuaccaccacc

SEQ ID NO: 37185 - RNA, 23 nt, Human
uucuugguuuuucagccauuccc

SEQ ID NO: 37186 - RNA, 26 nt, Human
cucaugcaccaccuaucacacucccu

SEQ ID NO: 37187 - RNA, 27 nt, Human
ccaacuuccuguugcuggccccugccc

SEQ ID NO: 37188 - RNA, 22 nt, Human
guggugguacagacuuaugagg

SEQ ID NO: 37189 - RNA, 21 nt, Human
aggugaagauuagggccagga

SEQ ID NO: 37190 - RNA, 22 nt, Human
uuugggaaaguaggucagcagc

SEQ ID NO: 37191 - RNA, 24 nt, Human
uuggguucuguaguuuucucgcga

SEQ ID NO: 37192 - RNA, 20 nt, Human
ccugccuggucuccugcccc

SEQ ID NO: 37193 - RNA, 24 nt, Human
aacuuuuagugguucugugccucu

SEQ ID NO: 37194 - RNA, 24 nt, Human
gacccaagcaaguuagcuaaacca

SEQ ID NO: 37195 - RNA, 22 nt, Human
gcucuucagcagcgagugcaga

SEQ ID NO: 37196 - RNA, 26 nt, Human
gccaugacacgauggccagaucaugg

SEQ ID NO: 37197 - RNA, 19 nt, Human
ucccuccaagcuaggguuu

SEQ ID NO: 37198 - RNA, 23 nt, Human
uuucuacugccaguggcucagcc

SEQ ID NO: 37199 - RNA, 27 nt, Human
cagaagccuacuucacaccgccuucuc

SEQ ID NO: 37200 - RNA, 24 nt, Human
aguuuuaguuucaaaauguuaaca

SEQ ID NO: 37201 - RNA, 21 nt, Human
uagguauuaagcuuuuguaau

SEQ ID NO: 37202 - RNA, 25 nt, Human
ugguuggagcagaacuggugaggau

SEQ ID NO: 37203 - RNA, 20 nt, Human
cucccgccuccaccauggag

SEQ ID NO: 37204 - RNA, 23 nt, Human
guuuguaauccuguauauuaugg

SEQ ID NO: 37205 - RNA, 23 nt, Human
ucgcagaccuuuccagagcuccg

SEQ ID NO: 37206 - RNA, 26 nt, Human
ccuaaauaucugugccuuugccuguc

SEQ ID NO: 37207 - RNA, 24 nt, Human
ggcgggucggggaggagguuuacu

SEQ ID NO: 37208 - RNA, 26 nt, Human
cuugucacccaggcuggagugcagug

SEQ ID NO: 37209 - RNA, 23 nt, Human
ccucaguguugucaccagaucug

SEQ ID NO: 37210 - RNA, 25 nt, Human
aucaugggcucugcagaacauauca

SEQ ID NO: 37211 - RNA, 26 nt, Human
ucauggauauagcaucagccauggca

SEQ ID NO: 37212 - RNA, 21 nt, Human
uuggagcuccuggggccuaac

SEQ ID NO: 37213 - RNA, 26 nt, Human
gcucugcagccccaagcaucuuucca

SEQ ID NO: 37214 - RNA, 21 nt, Human
gcucacugaaccucugccucc

SEQ ID NO: 37215 - RNA, 22 nt, Human
gggccgccuccccucuccuggg

SEQ ID NO: 37216 - RNA, 20 nt, Human
acucacugcaaaaucugccu

SEQ ID NO: 37217 - RNA, 25 nt, Human
uuugugccuuugaccaucucuuagg

SEQ ID NO: 37218 - RNA, 28 nt, Human
uccauaauuuuaagaaaugaaucugauu

SEQ ID NO: 37219 - RNA, 23 nt, Human
uucucucuccccauccccaccca

SEQ ID NO: 37220 - RNA, 23 nt, Human
cagacucugcucucccagcacug

SEQ ID NO: 37221 - RNA, 22 nt, Human
cuagagggaggcugcaccugaa

SEQ ID NO: 37222 - RNA, 20 nt, Human
ucuccaggcuggagugcagu

SEQ ID NO: 37223 - RNA, 22 nt, Human
ccucccauccucucacccacug

SEQ ID NO: 37224 - RNA, 21 nt, Human
aaauagggguuaagacugaua

SEQ ID NO: 37225 - RNA, 21 nt, Human
cccaacaaacucuacuaucca

SEQ ID NO: 37226 - RNA, 21 nt, Human
cuucuaugcuaaccgaauuaa

SEQ ID NO: 37227 - RNA, 26 nt, Human
cgccgccgccucgucccgcuucucgg

SEQ ID NO: 37228 - RNA, 27 nt, Human
ucuccaccaaaugcaugucauguauuc

SEQ ID NO: 37229 - RNA, 17 nt, Human
gaggaagaggccucgcg

SEQ ID NO: 37230 - RNA, 14 nt, Human
accauaaugccuuu

SEQ ID NO: 37231 - RNA, 22 nt, Human
aucugcuuuucacacuggguga

SEQ ID NO: 37232 - RNA, 28 nt, Human
ccucucaucugcaucuuucacaccuccc

SEQ ID NO: 37233 - RNA, 23 nt, Human
uauucucacaguaaaagaggggg

SEQ ID NO: 37234 - RNA, 21 nt, Human
gccuguggcccagccuggcug

SEQ ID NO: 37235 - RNA, 26 nt, Human
uugacaaaagcaaauccacuuuuucu

SEQ ID NO: 37236 - RNA, 24 nt, Human
ggccaucagagcaaauuugggggu

SEQ ID NO: 37237 - RNA, 24 nt, Human
cuccuccucacugccccacugugc

SEQ ID NO: 37238 - RNA, 20 nt, Human
uuuuaaaagauuacuuucua

SEQ ID NO: 37239 - RNA, 22 nt, Human
ccuuugucugauuguuaguuuu

SEQ ID NO: 37240 - RNA, 20 nt, Human
gcagggcagaggugagggaa

SEQ ID NO: 37241 - RNA, 24 nt, Human
aacauguugaacuguuuugcuuuu

SEQ ID NO: 37242 - RNA, 22 nt, Human
aggcuggaggacaguggcacaa

SEQ ID NO: 37243 - RNA, 24 nt, Human
agcucacucugcaaccuccacuuc

SEQ ID NO: 37244 - RNA, 26 nt, Human
cgggggcuugggaagcagaccagggu

SEQ ID NO: 37245 - RNA, 26 nt, Human
uuucucucacacuuuugcuugaauuu

SEQ ID NO: 37246 - RNA, 22 nt, Human
aaguggggaaggcuguacuggg

SEQ ID NO: 37247 - RNA, 19 nt, Human
ggccugccuguggugugcc

SEQ ID NO: 37248 - RNA, 23 nt, Human
ggggcuucucccucuacccaggg

SEQ ID NO: 37249 - RNA, 25 nt, Human
uaacaaugccuacuuuccauucacu

SEQ ID NO: 37250 - RNA, 21 nt, Human
ugugugcagaguccauuuccc

SEQ ID NO: 37251 - RNA, 20 nt, Human
ccggggcugggauugcgcgc

SEQ ID NO: 37252 - RNA, 17 nt, Human
gcuuccuuaccgugggc

SEQ ID NO: 37253 - RNA, 22 nt, Human
guaugccaccaacacugcucac

SEQ ID NO: 37254 - RNA, 23 nt, Human
ggauccaguggggcagaggacag

SEQ ID NO: 37255 - RNA, 23 nt, Human
accagagucacuucuccuccucc

SEQ ID NO: 37256 - RNA, 22 nt, Human
cggucaccccaaccucuggcuc

SEQ ID NO: 37257 - RNA, 22 nt, Human
ggcucaccgcaaccucugccuc

SEQ ID NO: 37258 - RNA, 19 nt, Human
gacaugcugugcucaguau

SEQ ID NO: 37259 - RNA, 20 nt, Human
caguggacagggacucagaa

SEQ ID NO: 37260 - RNA, 21 nt, Human
caucggcaggcccgagcccag

SEQ ID NO: 37261 - RNA, 18 nt, Human
uaguaccacuuuacuuga

SEQ ID NO: 37262 - RNA, 27 nt, Human
cuggcuuugggacuauuccaccuccuu

SEQ ID NO: 37263 - RNA, 23 nt, Human
ucugcucucuuggcucgggaacc

SEQ ID NO: 37264 - RNA, 22 nt, Human
agccugacagcgcagcuccuga

SEQ ID NO: 37265 - RNA, 22 nt, Human
ggaagcgguccugcuggggugg

SEQ ID NO: 37266 - RNA, 27 nt, Human
ggacgucugccuuuuuaaggcaguucc

SEQ ID NO: 37267 - RNA, 30 nt, Human
gugaaguccagcucccuugcuaaaaauaac

SEQ ID NO: 37268 - RNA, 28 nt, Human
gugggcaggaaagaaaggcuccuguuuc

SEQ ID NO: 37269 - RNA, 25 nt, Human
aacucuccccgguccuuuuuucucc

SEQ ID NO: 37270 - RNA, 23 nt, Human
cuugugacccaucaggccaguga

SEQ ID NO: 37271 - RNA, 21 nt, Human
uaaagguuuuugaaauccagg

SEQ ID NO: 37272 - RNA, 27 nt, Human
uccuuugucuuggaaccaccagucuag

SEQ ID NO: 37273 - RNA, 24 nt, Human
acauacuucuaguuguauucucca

SEQ ID NO: 37274 - RNA, 28 nt, Human
uuuugcaaaacaugcucuucuaauuuga

SEQ ID NO: 37275 - RNA, 32 nt, Human
cuuggcugguagggccugcucuuuucuaccau

SEQ ID NO: 37276 - RNA, 22 nt, Human
ugcucugccugccagugcagug

SEQ ID NO: 37277 - RNA, 21 nt, Human
ucuuuaccaguauccuuaauc

SEQ ID NO: 37278 - RNA, 20 nt, Human
cgccaucuucacauucugaa

SEQ ID NO: 37279 - RNA, 21 nt, Human
gcuauuaaaacucagccuggg

SEQ ID NO: 37280 - RNA, 19 nt, Human
acucagaaaaagaagaucc

SEQ ID NO: 37281 - RNA, 24 nt, Human
gcccagcuucuccuucucccucug

SEQ ID NO: 37282 - RNA, 20 nt, Human
cccucaaggacaaagucucc

SEQ ID NO: 37283 - RNA, 19 nt, Human
uucaaaaaugaaauucaau

SEQ ID NO: 37284 - RNA, 26 nt, Human
gugguaacaagaugaugaauguggag

SEQ ID NO: 37285 - RNA, 20 nt, Human
ugccaucaggaaaugggaag

SEQ ID NO: 37286 - RNA, 22 nt, Human
ucagugaguuaggaagucagca

SEQ ID NO: 37287 - RNA, 20 nt, Human
cuggggcagugucugucacu

SEQ ID NO: 37288 - RNA, 21 nt, Human
aaaaaccauaaaaucacuggg

SEQ ID NO: 37289 - RNA, 21 nt, Human
aguauuuucaugaaauucacc

SEQ ID NO: 37290 - RNA, 32 nt, Human
uacugccugcuguuuucuaagcauugcuccug

SEQ ID NO: 37291 - RNA, 20 nt, Human
gaaagcuacugaagugccuu

SEQ ID NO: 37292 - RNA, 26 nt, Human
ucucuuccuguccugcacauaugcau

SEQ ID NO: 37293 - RNA, 18 nt, Human
cuccaucuccaaagauaa

SEQ ID NO: 37294 - RNA, 21 nt, Human
auaauaaaaggaaguguuaga

SEQ ID NO: 37295 - RNA, 21 nt, Human
ucucucagccuuacauuugug

SEQ ID NO: 37296 - RNA, 25 nt, Human
caaggccaggcuagguuaggaaaag

SEQ ID NO: 37297 - RNA, 25 nt, Human
uuccuuuaaaaaugaaugucuuguu

SEQ ID NO: 37298 - RNA, 22 nt, Human
agcacugcccugggcaucaucu

SEQ ID NO: 37299 - RNA, 24 nt, Human
aacuaggguuuucuccugccuuag

SEQ ID NO: 37300 - RNA, 18 nt, Human
gucccauuccucagcuuc

SEQ ID NO: 37301 - RNA, 23 nt, Human
uccagugagcgauugagcuuccc

SEQ ID NO: 37302 - RNA, 22 nt, Human
cuggcuguagccgcauaugcag

SEQ ID NO: 37303 - RNA, 22 nt, Human
uuaguaauuuuaauuuagugaa

SEQ ID NO: 37304 - RNA, 20 nt, Human
cuguacccucuaccuccuuc

SEQ ID NO: 37305 - RNA, 25 nt, Human
uccagaacugugagagaauaauuuc

SEQ ID NO: 37306 - RNA, 23 nt, Human
ggccuccagccugggacugcugu

SEQ ID NO: 37307 - RNA, 21 nt, Human
cugcccuuuagcugcagagcu

SEQ ID NO: 37308 - RNA, 21 nt, Human
cacacugccacagcagcacau

SEQ ID NO: 37309 - RNA, 23 nt, Human
augccugauucuuuaauauugcc

SEQ ID NO: 37310 - RNA, 26 nt, Human
cuccugucuucauuuuccuccuucca

SEQ ID NO: 37311 - RNA, 22 nt, Human
ggcuucccaaaguccugggauu

SEQ ID NO: 37312 - RNA, 25 nt, Human
gcuacugugcccagccugcaauuau

SEQ ID NO: 37313 - RNA, 25 nt, Human
gcgcuggaucaguccacggcuuggg

SEQ ID NO: 37314 - RNA, 23 nt, Human
acuaagcauuuacuaugucauca

SEQ ID NO: 37315 - RNA, 27 nt, Human
gucacauuguaaaucuaguguaggaga

SEQ ID NO: 37316 - RNA, 27 nt, Human
cguggguggggagggagguguuuaacg

SEQ ID NO: 37317 - RNA, 22 nt, Human
ugugcauacaauuuauagugau

SEQ ID NO: 37318 - RNA, 27 nt, Human
cgccauugcacuccaaccuggacgaca

SEQ ID NO: 37319 - RNA, 25 nt, Human
augccacguuccacaguugccacca

SEQ ID NO: 37320 - RNA, 17 nt, Human
gcacagccccaggcuug

SEQ ID NO: 37321 - RNA, 27 nt, Human
ucaggaggcugaggcaggagaauugcu

SEQ ID NO: 37322 - RNA, 21 nt, Human
cgugaagggauaaccagggga

SEQ ID NO: 37323 - RNA, 27 nt, Human
gggaggcagccagcggggcgugaugca

SEQ ID NO: 37324 - RNA, 27 nt, Human
uucaaacccacauguggcuccaaaguc

SEQ ID NO: 37325 - RNA, 26 nt, Human
cacaugcgcuugucauacacgccccu

SEQ ID NO: 37326 - RNA, 26 nt, Human
agcccaaaccuuaguugaaaucagac

SEQ ID NO: 37327 - RNA, 25 nt, Human
ccuguguggcccugugaccugcagg

SEQ ID NO: 37328 - RNA, 19 nt, Human
gacugcgggaaugagggag

SEQ ID NO: 37329 - RNA, 19 nt, Human
uguccuuggucacugaggc

SEQ ID NO: 37330 - RNA, 26 nt, Human
cucuggguucacacacaagcugagau

SEQ ID NO: 37331 - RNA, 23 nt, Human
aagcgucgaaggagaucaaguga

SEQ ID NO: 37332 - RNA, 22 nt, Human
aacauaguuugugguauuucag

SEQ ID NO: 37333 - RNA, 26 nt, Human
uugccagagcuggcagugugagcugu

SEQ ID NO: 37334 - RNA, 23 nt, Human
cucaacacuuccucauguauuuc

SEQ ID NO: 37335 - RNA, 20 nt, Human
aguggggagugaugggcagg

SEQ ID NO: 37336 - RNA, 22 nt, Human
uguugcccaggcuggaguacaa

SEQ ID NO: 37337 - RNA, 23 nt, Human
acugcuuuuauguucugucuccu

SEQ ID NO: 37338 - RNA, 21 nt, Human
ccacuguccaacacugguauc

SEQ ID NO: 37339 - RNA, 20 nt, Human
ucuucuugcuuugcuuuuuc

SEQ ID NO: 37340 - RNA, 22 nt, Human
cagcucuucuuaggaauauuua

SEQ ID NO: 37341 - RNA, 21 nt, Human
uuugaaaccacuauuuacuua

SEQ ID NO: 37342 - RNA, 25 nt, Human
cugaggcuaaaacccaagacugccg

SEQ ID NO: 37343 - RNA, 25 nt, Human
gggaagaggcagggagggagcugag

SEQ ID NO: 37344 - RNA, 27 nt, Human
ccacugaacuccagccugggccacaua

SEQ ID NO: 37345 - RNA, 21 nt, Human
cgagaggggaaagccugagca

SEQ ID NO: 37346 - RNA, 24 nt, Human
uugagggcaaggucaaggggugca

SEQ ID NO: 37347 - RNA, 25 nt, Human
ggccucaugugaucugcccaccuca

SEQ ID NO: 37348 - RNA, 25 nt, Human
acgccaccauuccuggaaaccacag

SEQ ID NO: 37349 - RNA, 23 nt, Human
gaaacuuggaauaaaagaaagau

SEQ ID NO: 37350 - RNA, 22 nt, Human
aaugguguguuucccuagacuc

SEQ ID NO: 37351 - RNA, 22 nt, Human
ucccucuccccugcccaccuca

SEQ ID NO: 37352 - RNA, 20 nt, Human
uuuugcccucuccuuagcuc

SEQ ID NO: 37353 - RNA, 27 nt, Human
ucaccagacggggcuggagugugaggg

SEQ ID NO: 37354 - RNA, 22 nt, Human
ggggugggggcugggugcagug

SEQ ID NO: 37355 - RNA, 24 nt, Human
agccuugcugguccaagugcaaua

SEQ ID NO: 37356 - RNA, 22 nt, Human
aguaaauaucuacucacucaua

SEQ ID NO: 37357 - RNA, 20 nt, Human
gcugccagaauccaggcugg

SEQ ID NO: 37358 - RNA, 26 nt, Human
agcugauuuuucuuucuugcuuucau

SEQ ID NO: 37359 - RNA, 20 nt, Human
ggaacagccacuccccucca

SEQ ID NO: 37360 - RNA, 23 nt, Human
caagagaagaguuggacuuccag

SEQ ID NO: 37361 - RNA, 18 nt, Human
ggcagggaucccacuacg

SEQ ID NO: 37362 - RNA, 27 nt, Human
guccuccccuggccuccagucuccccu

SEQ ID NO: 37363 - RNA, 21 nt, Human
auuuauuguuuacauugggga

SEQ ID NO: 37364 - RNA, 27 nt, Human
uauggacacuacacuggggcccuucau

SEQ ID NO: 37365 - RNA, 22 nt, Human
gagcgaaacuccaucucaaaaa

SEQ ID NO: 37366 - RNA, 22 nt, Human
gaguaaaacucugucucaaaaa

SEQ ID NO: 37367 - RNA, 22 nt, Human
gagcaaaacuccgucucaaaaa

SEQ ID NO: 37368 - RNA, 22 nt, Human
ucagcacugcccccucucugau

SEQ ID NO: 37369 - RNA, 22 nt, Human
uuggagaacacaguggcugguu

SEQ ID NO: 37370 - RNA, 22 nt, Human
caggcugggugucuugguuguc

SEQ ID NO: 37371 - RNA, 23 nt, Human
ccucgcccugcuugcccugccgc

SEQ ID NO: 37372 - RNA, 20 nt, Human
ucauuuguuuacagggucgg

SEQ ID NO: 37373 - RNA, 24 nt, Human
gcgcugugacauuuucacagcccu

SEQ ID NO: 37374 - RNA, 22 nt, Human
aucacagacacugcacagaccu

SEQ ID NO: 37375 - RNA, 27 nt, Human
cacugcacuccagccugggcagcugaa

SEQ ID NO: 37376 - RNA, 26 nt, Human
ccucuaggccuugccccaccuccauc

SEQ ID NO: 37377 - RNA, 21 nt, Human
ggcucacugcaacuucugccu

SEQ ID NO: 37378 - RNA, 21 nt, Human
gguggaauauaguucugucag

SEQ ID NO: 37379 - RNA, 32 nt, Human
uuugccuccuuggauuuccuccagggagaaug

SEQ ID NO: 37380 - RNA, 23 nt, Human
ggugcgguggcuuacaccuguaa

SEQ ID NO: 37381 - RNA, 19 nt, Human
ugugacgugcacugugaau

SEQ ID NO: 37382 - RNA, 23 nt, Human
gaagcggggaacauguauuuuuu

SEQ ID NO: 37383 - RNA, 22 nt, Human
acagugucuauuuucaugucug

SEQ ID NO: 37384 - RNA, 24 nt, Human
cuaauuugaccaaaucuauaguca

SEQ ID NO: 37385 - RNA, 22 nt, Human
gcugcggcgccaagaugagugg

SEQ ID NO: 37386 - RNA, 20 nt, Human
cugccucugagacugcggua

SEQ ID NO: 37387 - RNA, 25 nt, Human
cacgugccugcagggccaggaaagg

SEQ ID NO: 37388 - RNA, 28 nt, Human
guuucaaggauuccugaccauaagugac

SEQ ID NO: 37389 - RNA, 18 nt, Human
uuacaacugaacauguau

SEQ ID NO: 37390 - RNA, 29 nt, Human
ugccuugggaccuggagugcugggcuugu

SEQ ID NO: 37391 - RNA, 23 nt, Human
aacauggguuaccuuugcaccag

SEQ ID NO: 37392 - RNA, 22 nt, Human
agugauaguuucugaaaccgcu

SEQ ID NO: 37393 - RNA, 24 nt, Human
aucuucuucuuggcagcugcaguc

SEQ ID NO: 37394 - RNA, 24 nt, Human
uaacucaggaacaggucucaggau

SEQ ID NO: 37395 - RNA, 20 nt, Human
aaacuauucaggaguauuca

SEQ ID NO: 37396 - RNA, 27 nt, Human
agcuagcaaaauuacuaccagagccgu

SEQ ID NO: 37397 - RNA, 23 nt, Human
gcagcucgcggaggaucuucccg

SEQ ID NO: 37398 - RNA, 22 nt, Human
ccggcacccacaagugccacug

SEQ ID NO: 37399 - RNA, 24 nt, Human
ggaggcugcaguaagcuaugauca

SEQ ID NO: 37400 - RNA, 22 nt, Human
ggcugcagcauuggaacaaaag

SEQ ID NO: 37401 - RNA, 32 nt, Human
gcucccagcuacaccuugcuguccucccuucc

SEQ ID NO: 37402 - RNA, 20 nt, Human
gcaaaacugaggcaccugau

SEQ ID NO: 37403 - RNA, 24 nt, Human
cgcugcugaguggaagagagcgca

SEQ ID NO: 37404 - RNA, 26 nt, Human
accuacugcuggccucuucaguggcc

SEQ ID NO: 37405 - RNA, 27 nt, Human
ggggaugugagcaaaauucgggcuugu

SEQ ID NO: 37406 - RNA, 27 nt, Human
auggaaagaaagaagcguaugacacau

SEQ ID NO: 37407 - RNA, 23 nt, Human
ugcaaaguguuuggugcgaggaa

SEQ ID NO: 37408 - RNA, 23 nt, Human
ccaagaaugcugagguuacaggc

SEQ ID NO: 37409 - RNA, 20 nt, Human
acagagucuccugggcacag

SEQ ID NO: 37410 - RNA, 24 nt, Human
gggccugggccucaggagccuagg

SEQ ID NO: 37411 - RNA, 24 nt, Human
cccgaguagcugggacuacaagcg

SEQ ID NO: 37412 - RNA, 22 nt, Human
aauucucuucuuuuucuuuuuu

SEQ ID NO: 37413 - RNA, 23 nt, Human
cuuuuuacugccaucugagcuac

SEQ ID NO: 37414 - RNA, 23 nt, Human
acaguguuugcuaaugauguguu

SEQ ID NO: 37415 - RNA, 23 nt, Human
gucugggcagaggcugggucagg

SEQ ID NO: 37416 - RNA, 19 nt, Human
uccugcucugcuaacccug

SEQ ID NO: 37417 - RNA, 20 nt, Human
ucuguaaauacuuaccuaca

SEQ ID NO: 37418 - RNA, 26 nt, Human
ucccaggucacugucucaccugcacu

SEQ ID NO: 37419 - RNA, 20 nt, Human
ugucacccaggcuggagugc

SEQ ID NO: 37420 - RNA, 25 nt, Human
ggagcugccuuugccccacugccuc

SEQ ID NO: 37421 - RNA, 22 nt, Human
gugaccaaggggaaaaugugca

SEQ ID NO: 37422 - RNA, 21 nt, Human
uucccaggcacccuccuuucu

SEQ ID NO: 37423 - RNA, 26 nt, Human
ggucucaaaugcgugaucagagaauc

SEQ ID NO: 37424 - RNA, 23 nt, Human
uuguuuaguuaaggugugcagug

SEQ ID NO: 37425 - RNA, 26 nt, Human
aaacugaauuggaaaaauagcuccau

SEQ ID NO: 37426 - RNA, 23 nt, Human
cugcccuuuugacaucaaagacc

SEQ ID NO: 37427 - RNA, 23 nt, Human
ucugaaucggaaaacaccgaaga

SEQ ID NO: 37428 - RNA, 22 nt, Human
agccucccaaagugcuggauua

SEQ ID NO: 37429 - RNA, 21 nt, Human
uccaaguccucccaaaggaca

SEQ ID NO: 37430 - RNA, 24 nt, Human
gggagagagagggaggaguaaaac

SEQ ID NO: 37431 - RNA, 27 nt, Human
cuguuacccuuuuaaaugucaguguuc

SEQ ID NO: 37432 - RNA, 27 nt, Human
ggcugccuggcugccccaaaccccaga

SEQ ID NO: 37433 - RNA, 22 nt, Human
gcugcuggcugccucucugcuc

SEQ ID NO: 37434 - RNA, 23 nt, Human
agaacuauaccugcuucagugaa

SEQ ID NO: 37435 - RNA, 22 nt, Human
ggucucaaacaguccugacuca

SEQ ID NO: 37436 - RNA, 22 nt, Human
gggagagagacuggagcuggca

SEQ ID NO: 37437 - RNA, 19 nt, Human
caucaagccacaucauguu

SEQ ID NO: 37438 - RNA, 20 nt, Human
ucuacccuccgcuccugggc

SEQ ID NO: 37439 - RNA, 22 nt, Human
accucauugcaaccuccgccuc

SEQ ID NO: 37440 - RNA, 26 nt, Human
cucuagggaguugguggagauauuuu

SEQ ID NO: 37441 - RNA, 20 nt, Human
ggcucugcugacaucuuccu

SEQ ID NO: 37442 - RNA, 22 nt, Human
cacgguucccaaccccaagggg

SEQ ID NO: 37443 - RNA, 21 nt, Human
cagccggcccuggagugcggg

SEQ ID NO: 37444 - RNA, 25 nt, Human
uuuuauuaggaaacaaagcuuagca

SEQ ID NO: 37445 - RNA, 28 nt, Human
ccacccaugccugccuggccugguagag

SEQ ID NO: 37446 - RNA, 28 nt, Human
aaucuagcuaugaauuacucuauauagu

SEQ ID NO: 37447 - RNA, 22 nt, Human
cuucccuggcugcggcuggcgc

SEQ ID NO: 37448 - RNA, 25 nt, Human
gccuaccaccuguccugccugggcc

SEQ ID NO: 37449 - RNA, 21 nt, Human
agcuagauacaagaugcagcu

SEQ ID NO: 37450 - RNA, 25 nt, Human
gcuggcugcuugcacccacauccuu

SEQ ID NO: 37451 - RNA, 19 nt, Human
uguuggagaaacuugggga

SEQ ID NO: 37452 - RNA, 21 nt, Human
gcugcccucccccuccucucc

SEQ ID NO: 37453 - RNA, 23 nt, Human
gcaauuucaccaccaaaugccaa

SEQ ID NO: 37454 - RNA, 23 nt, Human
acucagagcucucugaagaugug

SEQ ID NO: 37455 - RNA, 21 nt, Human
uguauucuuuuaauuguuuca

SEQ ID NO: 37456 - RNA, 26 nt, Human
agcagcuggacagagguuucugggag

SEQ ID NO: 37457 - RNA, 22 nt, Human
gccgugucaccuggccugggcc

SEQ ID NO: 37458 - RNA, 21 nt, Human
cugcgcggacucgcccccagg

SEQ ID NO: 37459 - RNA, 21 nt, Human
gucaggcaguucccagaaaga

SEQ ID NO: 37460 - RNA, 27 nt, Human
uguuguugccaaccagucucccaaagc

SEQ ID NO: 37461 - RNA, 23 nt, Human
caggcuggaggugccggugggcc

SEQ ID NO: 37462 - RNA, 26 nt, Human
ccuuuuuccuccucugcgcuccauuc

SEQ ID NO: 37463 - RNA, 20 nt, Human
gucccauugcuucguauuuc

SEQ ID NO: 37464 - RNA, 23 nt, Human
guauuuuuccaauuagcuccucc

SEQ ID NO: 37465 - RNA, 21 nt, Human
guauagccacugauggugaca

SEQ ID NO: 37466 - RNA, 24 nt, Human
uccaugaaagguauacaaaugaag

SEQ ID NO: 37467 - RNA, 19 nt, Human
agggggaggaggaggcagg

SEQ ID NO: 37468 - RNA, 24 nt, Human
gggcgccuguaaucccagauacuc

SEQ ID NO: 37469 - RNA, 27 nt, Human
cagaacacauuucaaaugaguuuuguu

SEQ ID NO: 37470 - RNA, 25 nt, Human
uugcugaauuaaggaucauagucgg

SEQ ID NO: 37471 - RNA, 28 nt, Human
ugaacaacuaggcuucagcauauuuaua

SEQ ID NO: 37472 - RNA, 20 nt, Human
gggcaccacccccuccuggg

SEQ ID NO: 37473 - RNA, 21 nt, Human
cacuugaacucgggaggugga

SEQ ID NO: 37474 - RNA, 24 nt, Human
ucgcgguggaugucugucauguag

SEQ ID NO: 37475 - RNA, 21 nt, Human
ucguaaccuccaccucccggg

SEQ ID NO: 37476 - RNA, 22 nt, Human
ggacugggguggaacuugcugu

SEQ ID NO: 37477 - RNA, 23 nt, Human
uguggggaccuggaggccuccaa

SEQ ID NO: 37478 - RNA, 30 nt, Human
ggcccaggcggggugcgaguggcgcagucg

SEQ ID NO: 37479 - RNA, 18 nt, Human
gcauuuucauauucuuua

SEQ ID NO: 37480 - RNA, 21 nt, Human
uggauuaacacggcagaggaa

SEQ ID NO: 37481 - RNA, 24 nt, Human
aaaggggcagaaaaacucugggaa

SEQ ID NO: 37482 - RNA, 18 nt, Human
aacagcauuguccucuga

SEQ ID NO: 37483 - RNA, 23 nt, Human
uuccuuugggccuccuuggucag

SEQ ID NO: 37484 - RNA, 22 nt, Human
cagaggaggaaacagaaacccc

SEQ ID NO: 37485 - RNA, 26 nt, Human
gcaugcuggggcaagucccugacucu

SEQ ID NO: 37486 - RNA, 28 nt, Human
cuuucuucaugcccuccccacugcuccu

SEQ ID NO: 37487 - RNA, 22 nt, Human
ucaugccacugcacuccacucu

SEQ ID NO: 37488 - RNA, 22 nt, Human
ucaugccacuccacuccagucu

SEQ ID NO: 37489 - RNA, 22 nt, Human
cugucucuuggaggcagggccc

SEQ ID NO: 37490 - RNA, 27 nt, Human
uugguaguuaaaucagggaacauucuu

SEQ ID NO: 37491 - RNA, 22 nt, Human
ugcuaagcugagcagugcagug

SEQ ID NO: 37492 - RNA, 21 nt, Human
cugagauauggcauugcacug

SEQ ID NO: 37493 - RNA, 27 nt, Human
cucugaggccucagagugcuuggcugc

SEQ ID NO: 37494 - RNA, 23 nt, Human
uauugcuuccuuuugcagcagug

SEQ ID NO: 37495 - RNA, 23 nt, Human
ucauagaccucucugcauaguag

SEQ ID NO: 37496 - RNA, 23 nt, Human
ccugguguucccuuucccugcug

SEQ ID NO: 37497 - RNA, 20 nt, Human
uggugauuucagguguacuu

SEQ ID NO: 37498 - RNA, 24 nt, Human
ccacugcaauccugucuuucugag

SEQ ID NO: 37499 - RNA, 24 nt, Human
ccuugucagcaucgggaagauggu

SEQ ID NO: 37500 - RNA, 22 nt, Human
guuuugucuguugaaaauguuu

SEQ ID NO: 37501 - RNA, 23 nt, Human
cccucuuuccuccuugucuucca

SEQ ID NO: 37502 - RNA, 24 nt, Human
augaaaacugcagcauaucagaca

SEQ ID NO: 37503 - RNA, 24 nt, Human
ucagccccaucugcuguuccuugg

SEQ ID NO: 37504 - RNA, 19 nt, Human
agagcaagacgccaucuca

SEQ ID NO: 37505 - RNA, 27 nt, Human
uucugaccauaagcuagaaccaugguc

SEQ ID NO: 37506 - RNA, 21 nt, Human
gcauuuucauagugugcucau

SEQ ID NO: 37507 - RNA, 26 nt, Human
agagaaaucacuaggacuacuuuuua

SEQ ID NO: 37508 - RNA, 21 nt, Human
uugcuucuugugaaaccacag

SEQ ID NO: 37509 - RNA, 30 nt, Human
uggggagggaggggaaauguaauacuggaa

SEQ ID NO: 37510 - RNA, 24 nt, Human
ggaggcggaggcggaggcggaggg

SEQ ID NO: 37511 - RNA, 19 nt, Human
cuccacccucccccuagcc

SEQ ID NO: 37512 - RNA, 21 nt, Human
uagaaaugagaaaaauacaga

SEQ ID NO: 37513 - RNA, 22 nt, Human
gucagagucuuuguagcuuuga

SEQ ID NO: 37514 - RNA, 27 nt, Human
ugaacaacuauuuauaaacuagaucuc

SEQ ID NO: 37515 - RNA, 18 nt, Human
cuucccuuuccccagcau

SEQ ID NO: 37516 - RNA, 23 nt, Human
gucuucaaagagaaagauaagaa

SEQ ID NO: 37517 - RNA, 23 nt, Human
uagggacuuagcaagcucuuuua

SEQ ID NO: 37518 - RNA, 26 nt, Human
gccgugaucuccgcucacugccaccu

SEQ ID NO: 37519 - RNA, 26 nt, Human
ucacccaggcuggagugcaaugacgc

SEQ ID NO: 37520 - RNA, 22 nt, Human
cugcgugugugcgcagggagag

SEQ ID NO: 37521 - RNA, 26 nt, Human
ucugggcccaggcugugaguuccagg

SEQ ID NO: 37522 - RNA, 23 nt, Human
ucugcugcuccugccgccgccgg

SEQ ID NO: 37523 - RNA, 22 nt, Human
agcuagcaaaauuacuaccaga

SEQ ID NO: 37524 - RNA, 22 nt, Human
uccuccaggaacugcaggucaa

SEQ ID NO: 37525 - RNA, 21 nt, Human
cuacaucuaguggccccucca

SEQ ID NO: 37526 - RNA, 23 nt, Human
gucacccaggcuguggugcagua

SEQ ID NO: 37527 - RNA, 24 nt, Human
guucucgcagauguuaccuaaaac

SEQ ID NO: 37528 - RNA, 26 nt, Human
aggagcagugcaggcacaguaugucc

SEQ ID NO: 37529 - RNA, 20 nt, Human
uggagccagcaauccuguuc

SEQ ID NO: 37530 - RNA, 27 nt, Human
ggaggcugaggcaggaggaucgccuga

SEQ ID NO: 37531 - RNA, 27 nt, Human
ucagucuccuagcaucuugugaguugc

SEQ ID NO: 37532 - RNA, 27 nt, Human
ccuccgcugggaggaaccugaaccugg

SEQ ID NO: 37533 - RNA, 21 nt, Human
gggaaagaucugucagaggag

SEQ ID NO: 37534 - RNA, 23 nt, Human
aaucuagcuaugaauuacucuau

SEQ ID NO: 37535 - RNA, 21 nt, Human
ucuugagagaaggagaggaag

SEQ ID NO: 37536 - RNA, 24 nt, Human
ugcaagccugggcaaaaaugcuuc

SEQ ID NO: 37537 - RNA, 23 nt, Human
gcggcgguagcgucucuguuucc

SEQ ID NO: 37538 - RNA, 22 nt, Human
cggcuccuggacucaagcgauu

SEQ ID NO: 37539 - RNA, 28 nt, Human
agauggcagcagcucauuuucuuuaaua

SEQ ID NO: 37540 - RNA, 23 nt, Human
uucacaguuugauuccauucuca

SEQ ID NO: 37541 - RNA, 22 nt, Human
cagagagggaagggaaagccug

SEQ ID NO: 37542 - RNA, 21 nt, Human
uucacuucucuuccucccuca

SEQ ID NO: 37543 - RNA, 22 nt, Human
uggaaagguccugcuguggaaa

SEQ ID NO: 37544 - RNA, 26 nt, Human
cuuaccucucuccaacugcuucagca

SEQ ID NO: 37545 - RNA, 26 nt, Human
cccuccagacuggcaguuucaaggau

SEQ ID NO: 37546 - RNA, 21 nt, Human
cagagcugaguguugguuccu

SEQ ID NO: 37547 - RNA, 17 nt, Human
gcucaaaaagaaaaagg

SEQ ID NO: 37548 - RNA, 19 nt, Human
uugucccaggcugggcaga

SEQ ID NO: 37549 - RNA, 26 nt, Human
acaguagauuggugaagacagacacc

SEQ ID NO: 37550 - RNA, 22 nt, Human
ugccacccggguucaagcaauu

SEQ ID NO: 37551 - RNA, 20 nt, Human
ucagguugggcuggcccuac

SEQ ID NO: 37552 - RNA, 19 nt, Human
ccccuuugucacugccucc

SEQ ID NO: 37553 - RNA, 27 nt, Human
caguucugcagaggacgggaggcugga

SEQ ID NO: 37554 - RNA, 22 nt, Human
ggcuucacauggaggagcugca

SEQ ID NO: 37555 - RNA, 23 nt, Human
ugagcauucauguucucugcuca

SEQ ID NO: 37556 - RNA, 22 nt, Human
cacuccucuggagacugagccu

SEQ ID NO: 37557 - RNA, 22 nt, Human
guggcugaacucugaucuugac

SEQ ID NO: 37558 - RNA, 19 nt, Human
acuaaaaaugaaacacaug

SEQ ID NO: 37559 - RNA, 21 nt, Human
ggcgagcaccuguaaucccag

SEQ ID NO: 37560 - RNA, 24 nt, Human
uguucuagucauuguacuagcugu

SEQ ID NO: 37561 - RNA, 27 nt, Human
cccucauuccuucaacuugugccuggg

SEQ ID NO: 37562 - RNA, 23 nt, Human
ggcggagcuccaggauggggagg

SEQ ID NO: 37563 - RNA, 21 nt, Human
accagcuguucagaaccuucu

SEQ ID NO: 37564 - RNA, 22 nt, Human
cuuccaggcugggcagcacaag

SEQ ID NO: 37565 - RNA, 26 nt, Human
cguggcagccucacagggaacacggg

SEQ ID NO: 37566 - RNA, 21 nt, Human
uggaccugaaagucagcucug

SEQ ID NO: 37567 - RNA, 27 nt, Human
gccuggaacuccugggaucaagccugg

SEQ ID NO: 37568 - RNA, 22 nt, Human
gcaaaacugccuauuacuccca

SEQ ID NO: 37569 - RNA, 23 nt, Human
gggcugcucccuccucugcuccc

SEQ ID NO: 37570 - RNA, 22 nt, Human
cauguuguuuuuuaguagaauu

SEQ ID NO: 37571 - RNA, 19 nt, Human
ccugauggccccaccccuc

SEQ ID NO: 37572 - RNA, 22 nt, Human
gcugcccaggcuggaguacagu

SEQ ID NO: 37573 - RNA, 22 nt, Human
ugcccccuggguucaagcgauu

SEQ ID NO: 37574 - RNA, 19 nt, Human
guucuugccuagcccaggu

SEQ ID NO: 37575 - RNA, 22 nt, Human
cccucgggggaggccuugccca

SEQ ID NO: 37576 - RNA, 23 nt, Human
agaaauuucuguucaaaauuuca

SEQ ID NO: 37577 - RNA, 24 nt, Human
ugccuuuacugugucaauucuggu

SEQ ID NO: 37578 - RNA, 22 nt, Human
acaucuugugcuccaugcagga

SEQ ID NO: 37579 - RNA, 21 nt, Human
caggaagagaaagagaucagg

SEQ ID NO: 37580 - RNA, 22 nt, Human
gcuuaaccuggagugaagaggu

SEQ ID NO: 37581 - RNA, 22 nt, Human
gacagggucucccuguguugac

SEQ ID NO: 37582 - RNA, 26 nt, Human
gacauacugccuggcagccugccuuc

SEQ ID NO: 37583 - RNA, 26 nt, Human
auuggguggagucuggugaucgcauu

SEQ ID NO: 37584 - RNA, 27 nt, Human
uuugugagccuggcccaagccaguaca

SEQ ID NO: 37585 - RNA, 22 nt, Human
aaucuagguggaggucuuuuua

SEQ ID NO: 37586 - RNA, 25 nt, Human
caugcaugguggcucaugccuguag

SEQ ID NO: 37587 - RNA, 22 nt, Human
cagggcugucggccaggauugc

SEQ ID NO: 37588 - RNA, 22 nt, Human
guggcugggacuacaauuguga

SEQ ID NO: 37589 - RNA, 24 nt, Human
cuuacucuaagaucuuagauucuc

SEQ ID NO: 37590 - RNA, 23 nt, Human
gggcuguccccugggcucuagaa

SEQ ID NO: 37591 - RNA, 22 nt, Human
gaggggaauuagucugucccag

SEQ ID NO: 37592 - RNA, 24 nt, Human
gacuaacaggcugcaaagugcaag

SEQ ID NO: 37593 - RNA, 22 nt, Human
gcgggugagcugcccucuccaa

SEQ ID NO: 37594 - RNA, 26 nt, Human
uauuugcacuauuuugggagcaaguu

SEQ ID NO: 37595 - RNA, 23 nt, Human
aacacacgucucccacacgugag

SEQ ID NO: 37596 - RNA, 17 nt, Human
gaugcuguuugugguga

SEQ ID NO: 37597 - RNA, 19 nt, Human
guucucucauuuccaaacc

SEQ ID NO: 37598 - RNA, 30 nt, Human
gccugccaaucaacccuccuggguguggcc

SEQ ID NO: 37599 - RNA, 27 nt, Human
ccauugcacuccagccugggcaacagu

SEQ ID NO: 37600 - RNA, 26 nt, Human
ggcagagaccuccaauaaagugccuu

SEQ ID NO: 37601 - RNA, 19 nt, Human
ccaacaugguaauucacuu

SEQ ID NO: 37602 - RNA, 26 nt, Human
cccauugcacaucaacuccugucucu

SEQ ID NO: 37603 - RNA, 26 nt, Human
cauacagaaugucuucauaucaucug

SEQ ID NO: 37604 - RNA, 30 nt, Human
cuaaaggcggccagguuugcagugcgggaa

SEQ ID NO: 37605 - RNA, 26 nt, Human
ccucauucuucauuucagaucugaac

SEQ ID NO: 37606 - RNA, 22 nt, Human
uauaggccagggcauguguaug

SEQ ID NO: 37607 - RNA, 22 nt, Human
gggaggcggagguugcagcgag

SEQ ID NO: 37608 - RNA, 18 nt, Human
aauguauauuuaacuucu

SEQ ID NO: 37609 - RNA, 22 nt, Human
aaugcuuguaauuuaaacauuu

SEQ ID NO: 37610 - RNA, 26 nt, Human
uccagcuucuggcuccugggaaaagu

SEQ ID NO: 37611 - RNA, 26 nt, Human
ccuaaccuugacucaaacagugaaug

SEQ ID NO: 37612 - RNA, 22 nt, Human
cgaugguggucuccgcucuugc

SEQ ID NO: 37613 - RNA, 19 nt, Human
ggguuaaggcgagcuguuc

SEQ ID NO: 37614 - RNA, 22 nt, Human
gcuuguaaucccagcacuuugg

SEQ ID NO: 37615 - RNA, 22 nt, Human
gccuguaaucucagcacuuugg

SEQ ID NO: 37616 - RNA, 22 nt, Human
gccuguaaucccagcacucugg

SEQ ID NO: 37617 - RNA, 22 nt, Human
uuuagugaaagcuagagauaug

SEQ ID NO: 37618 - RNA, 24 nt, Human
cuguguuugcauugucuaaugaca

SEQ ID NO: 37619 - RNA, 22 nt, Human
gcugugagccucacccugggcc

SEQ ID NO: 37620 - RNA, 27 nt, Human
cugcucugugcuuuucucucugauucu

SEQ ID NO: 37621 - RNA, 19 nt, Human
guagggaggaggaagaugc

SEQ ID NO: 37622 - RNA, 19 nt, Human
cacacucaggacagagcca

SEQ ID NO: 37623 - RNA, 22 nt, Human
ccaggagcugggagcccagggc

SEQ ID NO: 37624 - RNA, 25 nt, Human
uagcccccucaccuuucuguuuuca

SEQ ID NO: 37625 - RNA, 22 nt, Human
cuccccgcguggacuccugagc

SEQ ID NO: 37626 - RNA, 20 nt, Human
ggaaaguuguuuuugggucu

SEQ ID NO: 37627 - RNA, 20 nt, Human
uuucugcaucuccaucaucu

SEQ ID NO: 37628 - RNA, 22 nt, Human
aagggaaagcacuggggugggg

SEQ ID NO: 37629 - RNA, 22 nt, Human
gugggcagaucacuugagguca

SEQ ID NO: 37630 - RNA, 23 nt, Human
guggugguuaggaucagagcucu

SEQ ID NO: 37631 - RNA, 20 nt, Human
gcuccuucucacugcuggau

SEQ ID NO: 37632 - RNA, 26 nt, Human
ucuacuacuacacagugcagacacag

SEQ ID NO: 37633 - RNA, 24 nt, Human
uuggaacuuucuguaucucuuagg

SEQ ID NO: 37634 - RNA, 25 nt, Human
agggaaauaaggcaguauuugaauc

SEQ ID NO: 37635 - RNA, 22 nt, Human
gcccauauuaaaaagccaagug

SEQ ID NO: 37636 - RNA, 25 nt, Human
gguaaccauugccuguaagcagcac

SEQ ID NO: 37637 - RNA, 26 nt, Human
caagggcagagaacugucuuucauuu

SEQ ID NO: 37638 - RNA, 25 nt, Human
ggagguggugcaggaggcugccggc

SEQ ID NO: 37639 - RNA, 23 nt, Human
agaaggaucaagcaggcauuugg

SEQ ID NO: 37640 - RNA, 22 nt, Human
uacccagcgcagcaucuacaca

SEQ ID NO: 37641 - RNA, 22 nt, Human
gcaaaacuuuuaauuaaugcuc

SEQ ID NO: 37642 - RNA, 25 nt, Human
aggaagcagauguuucaugcuguga

SEQ ID NO: 37643 - RNA, 22 nt, Human
auuggccuggccagaccaggug

SEQ ID NO: 37644 - RNA, 19 nt, Human
cuacccaggaggcugaggc

SEQ ID NO: 37645 - RNA, 23 nt, Human
uguccugaucuucucuugcagug

SEQ ID NO: 37646 - RNA, 21 nt, Human
ucuguucugguaaucggggua

SEQ ID NO: 37647 - RNA, 26 nt, Human
aguagcugggauuacaggcaccuacc

SEQ ID NO: 37648 - RNA, 26 nt, Human
ggagcacggccgggucuaauaugccc

SEQ ID NO: 37649 - RNA, 25 nt, Human
uacugcuuuuguuguaguugucaua

SEQ ID NO: 37650 - RNA, 20 nt, Human
guccugcacuggguuacuuu

SEQ ID NO: 37651 - RNA, 13 nt, Human
ucaacaaaacucc

SEQ ID NO: 37652 - RNA, 27 nt, Human
uaggaggucaaggugggcagaucauga

SEQ ID NO: 37653 - RNA, 25 nt, Human
acauuugucccagaucugagcauuc

SEQ ID NO: 37654 - RNA, 26 nt, Human
ccaguauuugcuuauauagcaaugag

SEQ ID NO: 37655 - RNA, 20 nt, Human
gccaugauggaaaggaucuu

SEQ ID NO: 37656 - RNA, 21 nt, Human
ugucaaaggcuggagggcagg

SEQ ID NO: 37657 - RNA, 30 nt, Human
caggcucugcucugcccugcccugcacccc

SEQ ID NO: 37658 - RNA, 19 nt, Human
uucugacugacaccaucuu

SEQ ID NO: 37659 - RNA, 20 nt, Human
cgcuacccuuuuccgcucca

SEQ ID NO: 37660 - RNA, 20 nt, Human
gaucuuucauuuugcaccug

SEQ ID NO: 37661 - RNA, 22 nt, Human
gggugcucaccucuuguggaac

SEQ ID NO: 37662 - RNA, 22 nt, Human
gugaccuaggcuggacaucaga

SEQ ID NO: 37663 - RNA, 26 nt, Human
gggccccagaaaucacuguguuuuca

SEQ ID NO: 37664 - RNA, 26 nt, Human
cugggucacuaaaaacugauuuucua

SEQ ID NO: 37665 - RNA, 21 nt, Human
cugaggaggggauggaggggu

SEQ ID NO: 37666 - RNA, 26 nt, Human
ccgcagcugcuauagauagcacugcc

SEQ ID NO: 37667 - RNA, 21 nt, Human
gcucacuggaccauugucaca

SEQ ID NO: 37668 - RNA, 21 nt, Human
cacugcacuccagcucgggga

SEQ ID NO: 37669 - RNA, 22 nt, Human
ccaaagccccaaaucccuagag

SEQ ID NO: 37670 - RNA, 27 nt, Human
acucaggguucaggucuuccaggaggc

SEQ ID NO: 37671 - RNA, 23 nt, Human
ugcacacacuuucccuauauuuu

SEQ ID NO: 37672 - RNA, 22 nt, Human
cccaauccccuuccuccuggcc

SEQ ID NO: 37673 - RNA, 22 nt, Human
cccaaagagcugggauuacagg

SEQ ID NO: 37674 - RNA, 26 nt, Human
uuugaggggcauggccagucguggca

SEQ ID NO: 37675 - RNA, 20 nt, Human
cuucugcuuuaauuuucacu

SEQ ID NO: 37676 - RNA, 26 nt, Human
gauaagaagcuggauuagguguggag

SEQ ID NO: 37677 - RNA, 18 nt, Human
ggggacagagaggggcag

SEQ ID NO: 37678 - RNA, 20 nt, Human
cuuucucccaggcugagggc

SEQ ID NO: 37679 - RNA, 22 nt, Human
cccaucuccccuuccgugcccc

SEQ ID NO: 37680 - RNA, 21 nt, Human
aagaguuacaccucuggacca

SEQ ID NO: 37681 - RNA, 22 nt, Human
acuccagccuggguggcagagu

SEQ ID NO: 37682 - RNA, 25 nt, Human
cuucccggcccccacugccugcggc

SEQ ID NO: 37683 - RNA, 16 nt, Human
uucugucucuggauuu

SEQ ID NO: 37684 - RNA, 24 nt, Human
gcugcuagccugcucacgcaugca

SEQ ID NO: 37685 - RNA, 24 nt, Human
uguuacccacucugggaccagcag

SEQ ID NO: 37686 - RNA, 26 nt, Human
acucacugcagcuaucucucgccuca

SEQ ID NO: 37687 - RNA, 18 nt, Human
uuacaaaccaggucacca

SEQ ID NO: 37688 - RNA, 21 nt, Human
ucuuauaaaugaaagauuauu

SEQ ID NO: 37689 - RNA, 26 nt, Human
cgcccaggcugguaugcagucauguu

SEQ ID NO: 37690 - RNA, 20 nt, Human
gccaggcagugucuuagaug

SEQ ID NO: 37691 - RNA, 23 nt, Human
cauugcuugcccugggccuaucc

SEQ ID NO: 37692 - RNA, 28 nt, Human
gcagagcucuggccagcugccucuucuu

SEQ ID NO: 37693 - RNA, 22 nt, Human
ggcuuuggguuuccugacccau

SEQ ID NO: 37694 - RNA, 24 nt, Human
uggagggagaacaggcacauuagc

SEQ ID NO: 37695 - RNA, 22 nt, Human
gcugggagcauggaggacagcu

SEQ ID NO: 37696 - RNA, 22 nt, Human
gaacccagaaggcagagguugc

SEQ ID NO: 37697 - RNA, 27 nt, Human
ggcaguuugaaagacuuguuuuacaga

SEQ ID NO: 37698 - RNA, 28 nt, Human
gcacacacauuuuucuacccuucuucug

SEQ ID NO: 37699 - RNA, 27 nt, Human
ucugcccaggagguggcguccagcagu

SEQ ID NO: 37700 - RNA, 22 nt, Human
gaacuccuggacucaagcaauc

SEQ ID NO: 37701 - RNA, 21 nt, Human
gguggcccaaucgcuguuacu

SEQ ID NO: 37702 - RNA, 20 nt, Human
cuguaaaaacuaacggcuuc

SEQ ID NO: 37703 - RNA, 21 nt, Human
cccucauuccucccaggaauu

SEQ ID NO: 37704 - RNA, 25 nt, Human
uugaagccauagucgugccuguuug

SEQ ID NO: 37705 - RNA, 25 nt, Human
ggcgaaccaucucuguggucuuguu

SEQ ID NO: 37706 - RNA, 26 nt, Human
uugcauacuuaccuagugaaacuuuu

SEQ ID NO: 37707 - RNA, 20 nt, Human
acuuccugaaggggagggag

SEQ ID NO: 37708 - RNA, 21 nt, Human
aguguggcugaggccacccag

SEQ ID NO: 37709 - RNA, 24 nt, Human
uaccaauagccugaauuugaggag

SEQ ID NO: 37710 - RNA, 24 nt, Human
cagaagagacaggagaucagagac

SEQ ID NO: 37711 - RNA, 21 nt, Human
augugcgcucuguaaagugau

SEQ ID NO: 37712 - RNA, 27 nt, Human
gucacccaggcgggaguggugcaaugg

SEQ ID NO: 37713 - RNA, 21 nt, Human
ccaauagacccaggacgagua

SEQ ID NO: 37714 - RNA, 19 nt, Human
uggaagccgccccucucug

SEQ ID NO: 37715 - RNA, 22 nt, Human
cuuuuaaacuguguacauaacu

SEQ ID NO: 37716 - RNA, 20 nt, Human
aaagacugagcagaacugaa

SEQ ID NO: 37717 - RNA, 21 nt, Human
gccacauucagcacauauaua

SEQ ID NO: 37718 - RNA, 25 nt, Human
ucuaaaacauguuugcacuugucuu

SEQ ID NO: 37719 - RNA, 24 nt, Human
ccugggcccugcucaaugccaccu

SEQ ID NO: 37720 - RNA, 28 nt, Human
cccuccaaacccucccaggauucaaagc

SEQ ID NO: 37721 - RNA, 19 nt, Human
gucauucuucccuaaucuu

SEQ ID NO: 37722 - RNA, 22 nt, Human
ugccucccgaguucaagugauu

SEQ ID NO: 37723 - RNA, 21 nt, Human
aucuucuuuuugaaaucagca

SEQ ID NO: 37724 - RNA, 26 nt, Human
cuacuaaaaauagaaaaauuagccag

SEQ ID NO: 37725 - RNA, 24 nt, Human
ccuauuuggaccuaaacugugcca

SEQ ID NO: 37726 - RNA, 20 nt, Human
caggcuggagugcaguagca

SEQ ID NO: 37727 - RNA, 22 nt, Human
uugugcuugggauuacaguugu

SEQ ID NO: 37728 - RNA, 22 nt, Human
gucagcaagguugcgcgugccc

SEQ ID NO: 37729 - RNA, 20 nt, Human
ucuaccuucccuuucacuga

SEQ ID NO: 37730 - RNA, 24 nt, Human
ggcuuccugggguucccuucuugg

SEQ ID NO: 37731 - RNA, 22 nt, Human
accuguuucagcugcuacuuca

SEQ ID NO: 37732 - RNA, 16 nt, Human
ggccuggacagcacug

SEQ ID NO: 37733 - RNA, 28 nt, Human
cugacuucuguuccagagcaaaggucau

SEQ ID NO: 37734 - RNA, 27 nt, Human
uugcccaggcuggugucaaacuccugg

SEQ ID NO: 37735 - RNA, 20 nt, Human
agaucuacacccaucccccu

SEQ ID NO: 37736 - RNA, 22 nt, Human
ugggacuacaagcggcugccac

SEQ ID NO: 37737 - RNA, 27 nt, Human
ccagcagcugcuuuuggagcagggguc

SEQ ID NO: 37738 - RNA, 27 nt, Human
auucagucugucuggaaucccggaacc

SEQ ID NO: 37739 - RNA, 23 nt, Human
agaaguaaacagauggcacuuug

SEQ ID NO: 37740 - RNA, 23 nt, Human
ggcagaggaguauaggacugggg

SEQ ID NO: 37741 - RNA, 23 nt, Human
cucaggaggcggaggcugcaguc

SEQ ID NO: 37742 - RNA, 20 nt, Human
gcccugagagggcuaguucu

SEQ ID NO: 37743 - RNA, 21 nt, Human
auaaagguuuugaagugaaua

SEQ ID NO: 37744 - RNA, 21 nt, Human
uccucacuuagcuauauucug

SEQ ID NO: 37745 - RNA, 15 nt, Human
cuucccuucuggucg

SEQ ID NO: 37746 - RNA, 23 nt, Human
uccagcucuccccugcgcaggcc

SEQ ID NO: 37747 - RNA, 21 nt, Human
cuagauucucaccugccuuca

SEQ ID NO: 37748 - RNA, 26 nt, Human
gccacugcacccggcccuugccucau

SEQ ID NO: 37749 - RNA, 21 nt, Human
gccaucgugggccagccuugc

SEQ ID NO: 37750 - RNA, 21 nt, Human
ggccccggacgggugaggaga

SEQ ID NO: 37751 - RNA, 27 nt, Human
aaacucauauugaaacuucaucuaguc

SEQ ID NO: 37752 - RNA, 20 nt, Human
gcuuguggcucccuccugcc

SEQ ID NO: 37753 - RNA, 24 nt, Human
aaagggauguucacuguaugccuc

SEQ ID NO: 37754 - RNA, 21 nt, Human
augugggaaauggcuugggga

SEQ ID NO: 37755 - RNA, 23 nt, Human
agcagacaccagcuucagaugcu

SEQ ID NO: 37756 - RNA, 21 nt, Human
uguaguuacacuuguguuuca

SEQ ID NO: 37757 - RNA, 27 nt, Human
gaguccccagaugagcuggcauuugag

SEQ ID NO: 37758 - RNA, 22 nt, Human
uuucuucccagcuccuggccuc

SEQ ID NO: 37759 - RNA, 23 nt, Human
uugccaccaaaaaguaaaugcau

SEQ ID NO: 37760 - RNA, 27 nt, Human
guggcaaaaauagaaaacaaucuucau

SEQ ID NO: 37761 - RNA, 26 nt, Human
cuaccucccucaagccugggaaguca

SEQ ID NO: 37762 - RNA, 23 nt, Human
cugcccucucuggugccugugga

SEQ ID NO: 37763 - RNA, 24 nt, Human
ggcuucagcuugguuuguuaaauu

SEQ ID NO: 37764 - RNA, 31 nt, Human
agccacauuuuccugaauuaugauggucugc

SEQ ID NO: 37765 - RNA, 22 nt, Human
gccaggcucucccucucugcac

SEQ ID NO: 37766 - RNA, 24 nt, Human
ucuauacaaaugaaguauggaggu

SEQ ID NO: 37767 - RNA, 26 nt, Human
ccucacaaccuguccuucaccuaguc

SEQ ID NO: 37768 - RNA, 21 nt, Human
cugcugcugcugcuaaucuuc

SEQ ID NO: 37769 - RNA, 22 nt, Human
ccgacccaaagccaccagcguc

SEQ ID NO: 37770 - RNA, 26 nt, Human
gaggccagggaaagcaucucuggcuc

SEQ ID NO: 37771 - RNA, 21 nt, Human
ucuugauugugauacuguggu

SEQ ID NO: 37772 - RNA, 21 nt, Human
ccugcucuuuccucccccacc

SEQ ID NO: 37773 - RNA, 26 nt, Human
ugcacugcuaccugguacugcuuuca

SEQ ID NO: 37774 - RNA, 19 nt, Human
aacacuaaacuacugugaa

SEQ ID NO: 37775 - RNA, 22 nt, Human
gucucgaacuccugaccuuagg

SEQ ID NO: 37776 - RNA, 22 nt, Human
guuucgaacuccugaccucagg

SEQ ID NO: 37777 - RNA, 21 nt, Human
caucuggaaaauugauaaaga

SEQ ID NO: 37778 - RNA, 20 nt, Human
cugagaaggacagaacuguc

SEQ ID NO: 37779 - RNA, 22 nt, Human
uuuuuauacugagugugccuag

SEQ ID NO: 37780 - RNA, 20 nt, Human
gcugaacuuucucucauagg

SEQ ID NO: 37781 - RNA, 29 nt, Human
cuuaaauaaaacacaccucucugcugugg

SEQ ID NO: 37782 - RNA, 25 nt, Human
cuuuguaauuauuuucuccccaaca

SEQ ID NO: 37783 - RNA, 18 nt, Human
gaugcuucuuaccuguca

SEQ ID NO: 37784 - RNA, 22 nt, Human
aucacuugaacucgggaggcag

SEQ ID NO: 37785 - RNA, 26 nt, Human
gauacuugggcaugucauuucuguuu

SEQ ID NO: 37786 - RNA, 26 nt, Human
uccccgucagcagugucugugugucu

SEQ ID NO: 37787 - RNA, 25 nt, Human
aggguguguaacuucagcucugcag

SEQ ID NO: 37788 - RNA, 23 nt, Human
uggcauaaaaaacagugugguua

SEQ ID NO: 37789 - RNA, 21 nt, Human
ggaggcuggugaaggagggca

SEQ ID NO: 37790 - RNA, 23 nt, Human
ucugggagcccagugucaagucu

SEQ ID NO: 37791 - RNA, 22 nt, Human
acauauacauguacacauacac

SEQ ID NO: 37792 - RNA, 22 nt, Human
auuuuucuuaaggcuaugcuuc

SEQ ID NO: 37793 - RNA, 23 nt, Human
cugugucccuacacuaccuggcu

SEQ ID NO: 37794 - RNA, 22 nt, Human
gaugggguuucaccauguuggc

SEQ ID NO: 37795 - RNA, 27 nt, Human
ccuuaaguaaacaaacaagaaaugucu

SEQ ID NO: 37796 - RNA, 28 nt, Human
gcaguagcuguguguccgaggucagugu

SEQ ID NO: 37797 - RNA, 17 nt, Human
auuauaaaaaugucauu

SEQ ID NO: 37798 - RNA, 24 nt, Human
ccuccugcggauacucuuggagag

SEQ ID NO: 37799 - RNA, 27 nt, Human
ucugucugggacucaggaguccuaagg

SEQ ID NO: 37800 - RNA, 19 nt, Human
agggagccaccagggggug

SEQ ID NO: 37801 - RNA, 27 nt, Human
ggcugugggaucuauuacagcugcagg

SEQ ID NO: 37802 - RNA, 21 nt, Human
gguccugauuuuguuccagca

SEQ ID NO: 37803 - RNA, 19 nt, Human
ccacagcucccacagcccu

SEQ ID NO: 37804 - RNA, 18 nt, Human
uguggacuuccucuuaga

SEQ ID NO: 37805 - RNA, 22 nt, Human
gcuccgcugggcgaaugugaca

SEQ ID NO: 37806 - RNA, 22 nt, Human
guggcccaggcugagagcagca

SEQ ID NO: 37807 - RNA, 20 nt, Human
ucugagcuugguggccuguu

SEQ ID NO: 37808 - RNA, 27 nt, Human
uccuccucuuccucucaaaggcugaag

SEQ ID NO: 37809 - RNA, 26 nt, Human
aaugcccccuuugcaaggccugcugc

SEQ ID NO: 37810 - RNA, 20 nt, Human
acuccccccagcuccuaguu

SEQ ID NO: 37811 - RNA, 23 nt, Human
cuuuaguuagugauuauauuuca

SEQ ID NO: 37812 - RNA, 21 nt, Human
gcuucaaguugaaaguggcca

SEQ ID NO: 37813 - RNA, 22 nt, Human
ucuuccuccuccccugccaggc

SEQ ID NO: 37814 - RNA, 26 nt, Human
cagagcgagaaggugucaggagcagc

SEQ ID NO: 37815 - RNA, 20 nt, Human
acucuauucauuccuugcca

SEQ ID NO: 37816 - RNA, 21 nt, Human
guuauucuccccuaugccuuc

SEQ ID NO: 37817 - RNA, 24 nt, Human
ucuuagcacaccuacaccucuuga

SEQ ID NO: 37818 - RNA, 25 nt, Human
ggcaacauggugaaauccugucuuu

SEQ ID NO: 37819 - RNA, 18 nt, Human
cauaucaagacucuuugg

SEQ ID NO: 37820 - RNA, 21 nt, Human
cccccggggacgcacugagau

SEQ ID NO: 37821 - RNA, 22 nt, Human
gccgacugucuccucugccuuu

SEQ ID NO: 37822 - RNA, 22 nt, Human
ugccccagaggaaggagcugua

SEQ ID NO: 37823 - RNA, 20 nt, Human
aacgugccucaggaggcacc

SEQ ID NO: 37824 - RNA, 22 nt, Human
cugcaaccugugccucccggcu

SEQ ID NO: 37825 - RNA, 24 nt, Human
cugccucugggccuuugcuuugug

SEQ ID NO: 37826 - RNA, 25 nt, Human
aacuugcauaggacuuucugucuuu

SEQ ID NO: 37827 - RNA, 22 nt, Human
uaaccagcucagagcugaacau

SEQ ID NO: 37828 - RNA, 23 nt, Human
agugaaauauuacucugccuguc

SEQ ID NO: 37829 - RNA, 23 nt, Human
cacugcacccccuccugcugcag

SEQ ID NO: 37830 - RNA, 27 nt, Human
cgcugcugccgugggccuggaccaagg

SEQ ID NO: 37831 - RNA, 22 nt, Human
ggaaguuggcuuagcucggcua

SEQ ID NO: 37832 - RNA, 17 nt, Human
caucucagcaucucuua

SEQ ID NO: 37833 - RNA, 19 nt, Human
uacagcaggcugggcccag

SEQ ID NO: 37834 - RNA, 22 nt, Human
gccucucuguggucuccauccu

SEQ ID NO: 37835 - RNA, 28 nt, Human
aagaggaaguuuauuuguugaauagcac

SEQ ID NO: 37836 - RNA, 16 nt, Human
agaacagaauugcucc

SEQ ID NO: 37837 - RNA, 27 nt, Human
ccuuugucuuaaaaauacucagcuuuc

SEQ ID NO: 37838 - RNA, 23 nt, Human
acccaucuccagaugccaaagga

SEQ ID NO: 37839 - RNA, 26 nt, Human
ucuuacacaugugacccccacccaga

SEQ ID NO: 37840 - RNA, 25 nt, Human
acaaaagggguaauugcauucuucu

SEQ ID NO: 37841 - RNA, 24 nt, Human
ugccucuccagacuucugccagaa

SEQ ID NO: 37842 - RNA, 21 nt, Human
agcaacaaaacauacacuuug

SEQ ID NO: 37843 - RNA, 21 nt, Human
gaaacugccauuucauucaca

SEQ ID NO: 37844 - RNA, 22 nt, Human
cgccuguaauccaagcacuugg

SEQ ID NO: 37845 - RNA, 17 nt, Human
uccuguauucuacagca

SEQ ID NO: 37846 - RNA, 24 nt, Human
uucccuccguuuguuuucuuuuca

SEQ ID NO: 37847 - RNA, 22 nt, Human
gaacucgggaggcagagguugu

SEQ ID NO: 37848 - RNA, 22 nt, Human
gaaccugggagguagagguugc

SEQ ID NO: 37849 - RNA, 21 nt, Human
ccagcaugcauccccaaaaaa

SEQ ID NO: 37850 - RNA, 24 nt, Human
aggcuggagugcaguagugcaguc

SEQ ID NO: 37851 - RNA, 22 nt, Human
uuggaucuuggcaugcacccac

SEQ ID NO: 37852 - RNA, 22 nt, Human
gaaugacagaacaaucaucuua

SEQ ID NO: 37853 - RNA, 26 nt, Human
aaaugagauuuuuguuuuccacugug

SEQ ID NO: 37854 - RNA, 27 nt, Human
aagccacccuucccugccuccagcugu

SEQ ID NO: 37855 - RNA, 25 nt, Human
ugcaguccacagcauucacauucuc

SEQ ID NO: 37856 - RNA, 23 nt, Human
gccaagccccagccucagccugc

SEQ ID NO: 37857 - RNA, 21 nt, Human
gcucagggccaccugagacug

SEQ ID NO: 37858 - RNA, 22 nt, Human
uugcccagucuucagcggagca

SEQ ID NO: 37859 - RNA, 23 nt, Human
ccuuugauaaccaaauucuguca

SEQ ID NO: 37860 - RNA, 21 nt, Human
cugccucucccucccuguuug

SEQ ID NO: 37861 - RNA, 20 nt, Human
uuaaaaacaugaccacucuu

SEQ ID NO: 37862 - RNA, 20 nt, Human
gucuggagaggauauggaaa

SEQ ID NO: 37863 - RNA, 22 nt, Human
gagcauauuuaaaacaaagaag

SEQ ID NO: 37864 - RNA, 23 nt, Human
ccagcaaugugaguauuauuugg

SEQ ID NO: 37865 - RNA, 19 nt, Human
aucccaguucaaagaaaca

SEQ ID NO: 37866 - RNA, 26 nt, Human
caccauguuccccugagccuccaagg

SEQ ID NO: 37867 - RNA, 21 nt, Human
agcucccucguccugggaugc

SEQ ID NO: 37868 - RNA, 26 nt, Human
gagcuagcccggaaggaggagcaaga

SEQ ID NO: 37869 - RNA, 24 nt, Human
ucacagcuggggguccccgauucc

SEQ ID NO: 37870 - RNA, 27 nt, Human
gcagagcagggagccacuugccagggu

SEQ ID NO: 37871 - RNA, 22 nt, Human
ucauggucucuaaccacuugac

SEQ ID NO: 37872 - RNA, 27 nt, Human
ucccagccaugggcgaggugacagcag

SEQ ID NO: 37873 - RNA, 22 nt, Human
aggccggcagccccagccugcu

SEQ ID NO: 37874 - RNA, 21 nt, Human
cccuagcgacccucaggcuuc

SEQ ID NO: 37875 - RNA, 24 nt, Human
ucauucucugcauagcccucuggg

SEQ ID NO: 37876 - RNA, 22 nt, Human
gacacagaagaugaugagggag

SEQ ID NO: 37877 - RNA, 27 nt, Human
acugagucuaugaggaaauaguuccug

SEQ ID NO: 37878 - RNA, 22 nt, Human
ucaaauucugccuaccacaggc

SEQ ID NO: 37879 - RNA, 21 nt, Human
agaaauucuuagauuaaauca

SEQ ID NO: 37880 - RNA, 21 nt, Human
aaaugagauuuuguacaugga

SEQ ID NO: 37881 - RNA, 23 nt, Human
aaacauccucucacuugcauucu

SEQ ID NO: 37882 - RNA, 27 nt, Human
cuccaucuggugacagugggaugggug

SEQ ID NO: 37883 - RNA, 22 nt, Human
cuuugggccuggcuggguggga

SEQ ID NO: 37884 - RNA, 22 nt, Human
cgaccucgcaaccacugcuuug

SEQ ID NO: 37885 - RNA, 25 nt, Human
guuggccaggcuggucucaaacugc

SEQ ID NO: 37886 - RNA, 22 nt, Human
accccugcccaggcagucuuug

SEQ ID NO: 37887 - RNA, 25 nt, Human
ugugaggcgcucagccagggccaag

SEQ ID NO: 37888 - RNA, 26 nt, Human
acucacaaacauguucuugguguauu

SEQ ID NO: 37889 - RNA, 24 nt, Human
gaggccuuggucuaggucucucca

SEQ ID NO: 37890 - RNA, 21 nt, Human
uguucgugugugaaauguagg

SEQ ID NO: 37891 - RNA, 22 nt, Human
gagagagacccugucucaaaaa

SEQ ID NO: 37892 - RNA, 27 nt, Human
ccaggaggccagggauugcgggaaaag

SEQ ID NO: 37893 - RNA, 23 nt, Human
auguuguuaaggaagcugucauu

SEQ ID NO: 37894 - RNA, 26 nt, Human
cagaaaugucaucaaauauuaccaaa

SEQ ID NO: 37895 - RNA, 22 nt, Human
agagugagacccugucucaaac

SEQ ID NO: 37896 - RNA, 27 nt, Human
cagaguguuuccuguuucuggaauucc

SEQ ID NO: 37897 - RNA, 26 nt, Human
guggacaccuguaaucccagcuacuc

SEQ ID NO: 37898 - RNA, 24 nt, Human
cuugggaaauaugaaugcccccag

SEQ ID NO: 37899 - RNA, 24 nt, Human
ggacuuaggaggggcaauggagcc

SEQ ID NO: 37900 - RNA, 21 nt, Human
uaauccauaaccaccaaaaau

SEQ ID NO: 37901 - RNA, 27 nt, Human
ugguggaggcugcgagggugcacggcc

SEQ ID NO: 37902 - RNA, 25 nt, Human
ggcaggcaggagguggaguugcagc

SEQ ID NO: 37903 - RNA, 17 nt, Human
uacuaucacugcaccug

SEQ ID NO: 37904 - RNA, 25 nt, Human
ucacucucuaaaagcaacagcaugu

SEQ ID NO: 37905 - RNA, 27 nt, Human
cugggaaagacugauguugauuuggaa

SEQ ID NO: 37906 - RNA, 22 nt, Human
cccagcuccucuccccaaaaca

SEQ ID NO: 37907 - RNA, 18 nt, Human
uuugggagcugccagucu

SEQ ID NO: 37908 - RNA, 22 nt, Human
gauucuccagccucagccuccu

SEQ ID NO: 37909 - RNA, 26 nt, Human
ugcccaggcccaggggcaggcucuug

SEQ ID NO: 37910 - RNA, 23 nt, Human
ccucuacuguaaacuuucugguc

SEQ ID NO: 37911 - RNA, 25 nt, Human
ccuaaaacaugaaaauuaucucccu

SEQ ID NO: 37912 - RNA, 23 nt, Human
uuaaggaaucauaaucauuugua

SEQ ID NO: 37913 - RNA, 20 nt, Human
agagauuggugaauugaaug

SEQ ID NO: 37914 - RNA, 22 nt, Human
cgcucaggcuggagugccaugg

SEQ ID NO: 37915 - RNA, 23 nt, Human
ugcuuccagaaacuaaagggaaa

SEQ ID NO: 37916 - RNA, 23 nt, Human
cuuuaauuagaagcuuagccuug

SEQ ID NO: 37917 - RNA, 23 nt, Human
gccagcuggagcgccacagccgc

SEQ ID NO: 37918 - RNA, 21 nt, Human
uuucuacugcuuuugagggcc

SEQ ID NO: 37919 - RNA, 22 nt, Human
uucugagccugccuuuaucccc

SEQ ID NO: 37920 - RNA, 23 nt, Human
acugcagcugccagcacuugguc

SEQ ID NO: 37921 - RNA, 17 nt, Human
caguguccucagcuuca

SEQ ID NO: 37922 - RNA, 20 nt, Human
aguaaggaguucauuuuaug

SEQ ID NO: 37923 - RNA, 20 nt, Human
ugauaauuuauauaaaauag

SEQ ID NO: 37924 - RNA, 27 nt, Human
gccucaagccugaguggaagcaccuga

SEQ ID NO: 37925 - RNA, 23 nt, Human
ucugcuuucaaaacgaaagcuga

SEQ ID NO: 37926 - RNA, 24 nt, Human
accuuuagagccuaauuacuccaa

SEQ ID NO: 37927 - RNA, 23 nt, Human
aaggagcugcccagagcaucaca

SEQ ID NO: 37928 - RNA, 22 nt, Human
aauuuccuuccuucccuccaca

SEQ ID NO: 37929 - RNA, 26 nt, Human
gagucuuccuguuuuuccuguaccgg

SEQ ID NO: 37930 - RNA, 31 nt, Human
gacugccccugcugccuucugcccaguggga

SEQ ID NO: 37931 - RNA, 25 nt, Human
gagggaagaggagagaaaagacagg

SEQ ID NO: 37932 - RNA, 16 nt, Human
gauccagaaaauauca

SEQ ID NO: 37933 - RNA, 21 nt, Human
ugaugcuuugaaaguacucug

SEQ ID NO: 37934 - RNA, 20 nt, Human
cagaugcaaaaauucaccuc

SEQ ID NO: 37935 - RNA, 27 nt, Human
cuacagugaaaguugcuacaggaucuc

SEQ ID NO: 37936 - RNA, 21 nt, Human
uuaaagucaucuuuacuuucc

SEQ ID NO: 37937 - RNA, 21 nt, Human
aacaacaaagcagaagacucc

SEQ ID NO: 37938 - RNA, 21 nt, Human
ccugagcuccagggcccagcc

SEQ ID NO: 37939 - RNA, 22 nt, Human
caggcuggaguucagcggugca

SEQ ID NO: 37940 - RNA, 25 nt, Human
acucgcuguaugaaaggagagagca

SEQ ID NO: 37941 - RNA, 27 nt, Human
cuccaucuuuauagaaggaauuuguac

SEQ ID NO: 37942 - RNA, 24 nt, Human
ucugacaugauccauagugaaauu

SEQ ID NO: 37943 - RNA, 25 nt, Human
ccugucacccugcuuucccugccuc

SEQ ID NO: 37944 - RNA, 22 nt, Human
acugcaagcuccgccuccuggg

SEQ ID NO: 37945 - RNA, 22 nt, Human
accgcaagcuccgccucccggg

SEQ ID NO: 37946 - RNA, 27 nt, Human
gucccugccaaugcuccagcugucguc

SEQ ID NO: 37947 - RNA, 22 nt, Human
auuuuucuccccgugcuccccc

SEQ ID NO: 37948 - RNA, 21 nt, Human
cccacucuaccuccuuagcuu

SEQ ID NO: 37949 - RNA, 25 nt, Human
ccuacgcucacuguucccugaucau

SEQ ID NO: 37950 - RNA, 27 nt, Human
cggauccaaagacccaggaaugacagg

SEQ ID NO: 37951 - RNA, 27 nt, Human
gaguaagagcugggcauuuagaaagau

SEQ ID NO: 37952 - RNA, 25 nt, Human
uuccuuuaggccgccugcccgccuc

SEQ ID NO: 37953 - RNA, 26 nt, Human
uugagacagagucuggcucugucacc

SEQ ID NO: 37954 - RNA, 21 nt, Human
ggcagggccugcaggagggga

SEQ ID NO: 37955 - RNA, 23 nt, Human
ugagucuccacacacacuccuca

SEQ ID NO: 37956 - RNA, 24 nt, Human
ggcguggacucccuggugcuagaa

SEQ ID NO: 37957 - RNA, 22 nt, Human
ucaggaugacaaucaccaggaa

SEQ ID NO: 37958 - RNA, 31 nt, Human
cagggcuucugcugcaucugcagccaugucg

SEQ ID NO: 37959 - RNA, 23 nt, Human
cuguuuucaucuccuuuuccauc

SEQ ID NO: 37960 - RNA, 26 nt, Human
ggccucaaguaauccuccugccucag

SEQ ID NO: 37961 - RNA, 21 nt, Human
cuuucucucacugucuauuua

SEQ ID NO: 37962 - RNA, 20 nt, Human
uauuauauacagguugagua

SEQ ID NO: 37963 - RNA, 22 nt, Human
cugaggcaugagaauugcuuga

SEQ ID NO: 37964 - RNA, 18 nt, Human
ggugggcauggggugggg

SEQ ID NO: 37965 - RNA, 25 nt, Human
cauccccaguccaggaaaccaucuc

SEQ ID NO: 37966 - RNA, 25 nt, Human
gccacugugcccagccuguucuaug

SEQ ID NO: 37967 - RNA, 27 nt, Human
uggaggaguccaggccauggaggcaga

SEQ ID NO: 37968 - RNA, 22 nt, Human
acucccgccagccccugccucg

SEQ ID NO: 37969 - RNA, 27 nt, Human
uguugguuugaggaugaaggggcucca

SEQ ID NO: 37970 - RNA, 21 nt, Human
gcaccuugcagccccuuccug

SEQ ID NO: 37971 - RNA, 26 nt, Human
ccccuacugcugugaacccuggggcc

SEQ ID NO: 37972 - RNA, 25 nt, Human
ucugccuggcguccccucccucugu

SEQ ID NO: 37973 - RNA, 19 nt, Human
ggagggagggauuagaagc

SEQ ID NO: 37974 - RNA, 20 nt, Human
ucucaugacuccuacuuuuc

SEQ ID NO: 37975 - RNA, 26 nt, Human
agagugugcgggggacggagguaagc

SEQ ID NO: 37976 - RNA, 22 nt, Human
cugagaggcaggcauagaggcu

SEQ ID NO: 37977 - RNA, 22 nt, Human
gaggacucaguucacaaaaugc

SEQ ID NO: 37978 - RNA, 24 nt, Human
ggauagugagguuccugccuucac

SEQ ID NO: 37979 - RNA, 23 nt, Human
acauuuaagcacacauuuuauuc

SEQ ID NO: 37980 - RNA, 24 nt, Human
uucugauuuggaaucucuccaucu

SEQ ID NO: 37981 - RNA, 21 nt, Human
uucauuuaagggaaagaaaau

SEQ ID NO: 37982 - RNA, 22 nt, Human
gagguugcgccacuacacucca

SEQ ID NO: 37983 - RNA, 26 nt, Human
ugacagcagaggcuuugcugcuguga

SEQ ID NO: 37984 - RNA, 23 nt, Human
caacagcaaacccugaugugaca

SEQ ID NO: 37985 - RNA, 19 nt, Human
gcuuugggagacagucuag

SEQ ID NO: 37986 - RNA, 23 nt, Human
guucaaaacauugaaacacucuu

SEQ ID NO: 37987 - RNA, 24 nt, Human
agggaaagcggaagguagaaggcu

SEQ ID NO: 37988 - RNA, 22 nt, Human
ggaacaaaagucuagugauuag

SEQ ID NO: 37989 - RNA, 26 nt, Human
cagaccaaugagccuagggagaugcu

SEQ ID NO: 37990 - RNA, 23 nt, Human
gagcgagacucugucucaacaac

SEQ ID NO: 37991 - RNA, 22 nt, Human
cucucugaguaggugacaucug

SEQ ID NO: 37992 - RNA, 23 nt, Human
ugagucuuagaguccagacacaa

SEQ ID NO: 37993 - RNA, 18 nt, Human
gcuauacaggauguaaua

SEQ ID NO: 37994 - RNA, 27 nt, Human
uggaauaaaguccucaaaauugaaaug

SEQ ID NO: 37995 - RNA, 21 nt, Human
acaauuccacacuauucucug

SEQ ID NO: 37996 - RNA, 23 nt, Human
auuucuccaggcacucccuggag

SEQ ID NO: 37997 - RNA, 21 nt, Human
gccuguaaucccagcccuuug

SEQ ID NO: 37998 - RNA, 27 nt, Human
acggcacaaguagagagaaacuaccua

SEQ ID NO: 37999 - RNA, 22 nt, Human
ggcugagaaacuucagcagcag

SEQ ID NO: 38000 - RNA, 28 nt, Human
gccaggaggugccacuggagugugcgug

SEQ ID NO: 38001 - RNA, 21 nt, Human
gccucaucuuguauuguucca

SEQ ID NO: 38002 - RNA, 22 nt, Human
ucuccugccucagccugaaguc

SEQ ID NO: 38003 - RNA, 21 nt, Human
aaagaauguuuuggcaagagc

SEQ ID NO: 38004 - RNA, 27 nt, Human
guuaaucugaguaacuuauugccuagc

SEQ ID NO: 38005 - RNA, 26 nt, Human
ccuucacuggagugcaccugccucua

SEQ ID NO: 38006 - RNA, 23 nt, Human
ggcaguaaguccccagcagugag

SEQ ID NO: 38007 - RNA, 22 nt, Human
agcuuggaaaacuggaguuucu

SEQ ID NO: 38008 - RNA, 27 nt, Human
gcggacagguuauggacauucaugccc

SEQ ID NO: 38009 - RNA, 21 nt, Human
aaauaaaacacauuuacucca

SEQ ID NO: 38010 - RNA, 27 nt, Human
gggcggggaccgagcuagcggagccag

SEQ ID NO: 38011 - RNA, 22 nt, Human
gcugggauguuucugucacauc

SEQ ID NO: 38012 - RNA, 22 nt, Human
caacauuuuagcuuuugcccau

SEQ ID NO: 38013 - RNA, 20 nt, Human
gagaccagagaggcccugug

SEQ ID NO: 38014 - RNA, 26 nt, Human
aggaggcggagguugcaguaagccaa

SEQ ID NO: 38015 - RNA, 20 nt, Human
ucuccaauuucacaucuuga

SEQ ID NO: 38016 - RNA, 24 nt, Human
ggaggcagggagaguaagacaugc

SEQ ID NO: 38017 - RNA, 23 nt, Human
ucucaaacuccugaccucaggcg

SEQ ID NO: 38018 - RNA, 21 nt, Human
cacucuccacuuucucucaca

SEQ ID NO: 38019 - RNA, 24 nt, Human
uccacugaggacauucagccuggg

SEQ ID NO: 38020 - RNA, 23 nt, Human
gcauccucaaccuccuggguuca

SEQ ID NO: 38021 - RNA, 20 nt, Human
acucaccagccuccuggucu

SEQ ID NO: 38022 - RNA, 22 nt, Human
cgccagccaaguuucgucauag

SEQ ID NO: 38023 - RNA, 24 nt, Human
acuccuccuuuuguaucauucagc

SEQ ID NO: 38024 - RNA, 27 nt, Human
aggagguuuaaggcaaguagacaacau

SEQ ID NO: 38025 - RNA, 22 nt, Human
gcugccuggccuuguccucagc

SEQ ID NO: 38026 - RNA, 21 nt, Human
aagacaccuauccugcucugu

SEQ ID NO: 38027 - RNA, 25 nt, Human
augagccggagggagggaagucugg

SEQ ID NO: 38028 - RNA, 22 nt, Human
agaccagccuggucaauauagc

SEQ ID NO: 38029 - RNA, 18 nt, Human
cuccucuucuccccacca

SEQ ID NO: 38030 - RNA, 22 nt, Human
gcuugcguuagaaugaggagga

SEQ ID NO: 38031 - RNA, 21 nt, Human
gguuucuaugagucugcucca

SEQ ID NO: 38032 - RNA, 24 nt, Human
gccaccccaaagcccuccuccucc

SEQ ID NO: 38033 - RNA, 22 nt, Human
gcaaaacaaucuaucccagguu

SEQ ID NO: 38034 - RNA, 23 nt, Human
aucgcccaggcuggagcuggccc

SEQ ID NO: 38035 - RNA, 22 nt, Human
uauguaaacuauaauuauuuug

SEQ ID NO: 38036 - RNA, 21 nt, Human
ccagacucacagagaacugcu

SEQ ID NO: 38037 - RNA, 26 nt, Human
acagaugugaaaauauacuugacucu

SEQ ID NO: 38038 - RNA, 22 nt, Human
gagcccugagugcugugcugcu

SEQ ID NO: 38039 - RNA, 19 nt, Human
cccagggauuaggagcagc

SEQ ID NO: 38040 - RNA, 26 nt, Human
guuuuuaaaagaauuucauagauauu

SEQ ID NO: 38041 - RNA, 22 nt, Human
uuguguggcugaucugaaguca

SEQ ID NO: 38042 - RNA, 22 nt, Human
caugccuguaaacccagggcuu

SEQ ID NO: 38043 - RNA, 26 nt, Human
ucuguuguguuucucacuggaggcug

SEQ ID NO: 38044 - RNA, 23 nt, Human
ccgaaguagcugggauuacaggc

SEQ ID NO: 38045 - RNA, 27 nt, Human
acaugccacaauccuaugcucuugccu

SEQ ID NO: 38046 - RNA, 20 nt, Human
ggcaaagccccucacacugc

SEQ ID NO: 38047 - RNA, 13 nt, Human
uccaguuaccuca

SEQ ID NO: 38048 - RNA, 24 nt, Human
ccccucaccugggcaccuggggag

SEQ ID NO: 38049 - RNA, 20 nt, Human
aaacauuugcuuuuacucuc

SEQ ID NO: 38050 - RNA, 21 nt, Human
gaguaaucagaguacuuucgg

SEQ ID NO: 38051 - RNA, 22 nt, Human
aauucuugaagguuacauuaaa

SEQ ID NO: 38052 - RNA, 25 nt, Human
aguuuuugcuuguguccuccucagu

SEQ ID NO: 38053 - RNA, 22 nt, Human
agaaugaagaaaauuagaguag

SEQ ID NO: 38054 - RNA, 23 nt, Human
uuuccccaggcaggaguuggggu

SEQ ID NO: 38055 - RNA, 21 nt, Human
gccucucuccuuccccaucag

SEQ ID NO: 38056 - RNA, 28 nt, Human
aaaugugucuucagcuggcagcauuuau

SEQ ID NO: 38057 - RNA, 20 nt, Human
guaguuacacuuguguuuca

SEQ ID NO: 38058 - RNA, 22 nt, Human
cauaccuguuauaccagcacuu

SEQ ID NO: 38059 - RNA, 23 nt, Human
cuuuccuaucauggagugacggu

SEQ ID NO: 38060 - RNA, 22 nt, Human
agggaaagacuggcaagaaaag

SEQ ID NO: 38061 - RNA, 21 nt, Human
cuucccucuuucuaguuggaa

SEQ ID NO: 38062 - RNA, 22 nt, Human
agagaaaccccggacugggauc

SEQ ID NO: 38063 - RNA, 21 nt, Human
cguaugucuguuaccauguca

SEQ ID NO: 38064 - RNA, 21 nt, Human
cuccacccuccccgugcugcu

SEQ ID NO: 38065 - RNA, 22 nt, Human
ggaaaggggaauggcugcuuuu

SEQ ID NO: 38066 - RNA, 26 nt, Human
ccuccaucucuccgaaccuggcuucg

SEQ ID NO: 38067 - RNA, 23 nt, Human
ccgagcuagcuggggacaagggc

SEQ ID NO: 38068 - RNA, 15 nt, Human
ggcaguuuuucugua

SEQ ID NO: 38069 - RNA, 26 nt, Human
gcagagaaccaauucuggagaacagc

SEQ ID NO: 38070 - RNA, 15 nt, Human
auacauacuauuucu

SEQ ID NO: 38071 - RNA, 22 nt, Human
aucgcuugaacccaggagacgg

SEQ ID NO: 38072 - RNA, 23 nt, Human
acaaagugccuucuguuucacag

SEQ ID NO: 38073 - RNA, 21 nt, Human
cgaacauggugagacccaucu

SEQ ID NO: 38074 - RNA, 22 nt, Human
accagcacacggcucuucuucc

SEQ ID NO: 38075 - RNA, 21 nt, Human
uggagagaacaggagggccag

SEQ ID NO: 38076 - RNA, 22 nt, Human
uccagccugggcaacaagagca

SEQ ID NO: 38077 - RNA, 21 nt, Human
gccccuggggagggaggagag

SEQ ID NO: 38078 - RNA, 21 nt, Human
uucagcuguacauacucagua

SEQ ID NO: 38079 - RNA, 24 nt, Human
cacgagccccuccagccucuccaa

SEQ ID NO: 38080 - RNA, 23 nt, Human
aaauauaaugaucagcaaaaaga

SEQ ID NO: 38081 - RNA, 23 nt, Human
aggcugaguagguccacaaauaa

SEQ ID NO: 38082 - RNA, 22 nt, Human
ugcagugagccaugaucaugcc

SEQ ID NO: 38083 - RNA, 23 nt, Human
ggccucucggggcuucugacgcc

SEQ ID NO: 38084 - RNA, 21 nt, Human
ggagguuguggcugcagugag

SEQ ID NO: 38085 - RNA, 23 nt, Human
uaucacugcuuuuuccuuagcuu

SEQ ID NO: 38086 - RNA, 19 nt, Human
uugcugucugccccuuguc

SEQ ID NO: 38087 - RNA, 24 nt, Human
uuagcaauaugacaauaauccucu

SEQ ID NO: 38088 - RNA, 22 nt, Human
gccucccaaguagcugagacug

SEQ ID NO: 38089 - RNA, 23 nt, Human
acuauuaagggacgacugccuuc

SEQ ID NO: 38090 - RNA, 23 nt, Human
uaggaaacauccucauugauccu

SEQ ID NO: 38091 - RNA, 27 nt, Human
ggcggcgggcaguugcaguggugcaga

SEQ ID NO: 38092 - RNA, 26 nt, Human
ugcacccuuagcagccacugccaccu

SEQ ID NO: 38093 - RNA, 19 nt, Human
uaucucagucaugcauaaa

SEQ ID NO: 38094 - RNA, 21 nt, Human
guggguaguaugauggguguu

SEQ ID NO: 38095 - RNA, 20 nt, Human
ugcuucuugccuaccacuug

SEQ ID NO: 38096 - RNA, 24 nt, Human
ugacauuuggauuaaucuccagcu

SEQ ID NO: 38097 - RNA, 22 nt, Human
caggaggucaaggcugcaguga

SEQ ID NO: 38098 - RNA, 25 nt, Human
uccccuaccagccucauucuucucc

SEQ ID NO: 38099 - RNA, 21 nt, Human
uucagcuauucuuacugacau

SEQ ID NO: 38100 - RNA, 26 nt, Human
aagggggugggacagggacucggggc

SEQ ID NO: 38101 - RNA, 24 nt, Human
gagagaaguacaaagguugcagug

SEQ ID NO: 38102 - RNA, 22 nt, Human
ucuguuuuauuauccaggauuu

SEQ ID NO: 38103 - RNA, 22 nt, Human
gaggaaauagaguuugcuuacu

SEQ ID NO: 38104 - RNA, 24 nt, Human
caccuuacuggccagucugcaucc

SEQ ID NO: 38105 - RNA, 21 nt, Human
accugacagaugcacggccca

SEQ ID NO: 38106 - RNA, 20 nt, Human
ucuccaccccuuucuagacc

SEQ ID NO: 38107 - RNA, 21 nt, Human
caaaacugaaacccucuuucc

SEQ ID NO: 38108 - RNA, 23 nt, Human
gccagcagccuuuaauucuuggg

SEQ ID NO: 38109 - RNA, 20 nt, Human
agagagaaguucguaccuug

SEQ ID NO: 38110 - RNA, 21 nt, Human
ccauaaggcacacucucuaag

SEQ ID NO: 38111 - RNA, 27 nt, Human
uccagaagagugaaagagagggagggg

SEQ ID NO: 38112 - RNA, 21 nt, Human
cucccaccucggacaccaucu

SEQ ID NO: 38113 - RNA, 23 nt, Human
gccccuggcugagaaggggagga

SEQ ID NO: 38114 - RNA, 21 nt, Human
ugcuuucaaaaauaaaccaga

SEQ ID NO: 38115 - RNA, 22 nt, Human
ucuucuuuccuccccucccaug

SEQ ID NO: 38116 - RNA, 20 nt, Human
gggugaggcugggugucugg

SEQ ID NO: 38117 - RNA, 25 nt, Human
ugguggcgggcgccuaaaaucccag

SEQ ID NO: 38118 - RNA, 19 nt, Human
cacccaggucgggcggugg

SEQ ID NO: 38119 - RNA, 21 nt, Human
ccaagcacgaagccaccaguc

SEQ ID NO: 38120 - RNA, 23 nt, Human
gccccuguacuccagccugggug

SEQ ID NO: 38121 - RNA, 22 nt, Human
aaaguuccucucucuuuuguaa

SEQ ID NO: 38122 - RNA, 27 nt, Human
acacucaaccucccucugaccucauaa

SEQ ID NO: 38123 - RNA, 27 nt, Human
cauuccccuccuauguaugauucauuu

SEQ ID NO: 38124 - RNA, 22 nt, Human
cacuacacuccagccuggcgac

SEQ ID NO: 38125 - RNA, 24 nt, Human
caguucugagcgggucauggggca

SEQ ID NO: 38126 - RNA, 22 nt, Human
gcccguaaucccagggcuuugg

SEQ ID NO: 38127 - RNA, 21 nt, Human
cuggggaggggcagggggaga

SEQ ID NO: 38128 - RNA, 23 nt, Human
uccuagccagccgcacagucuag

SEQ ID NO: 38129 - RNA, 23 nt, Human
aggagucugugcugugcacccug

SEQ ID NO: 38130 - RNA, 23 nt, Human
gagcaagcccuacucggaugggg

SEQ ID NO: 38131 - RNA, 26 nt, Human
cgcggcugggacagacacuucgggaa

SEQ ID NO: 38132 - RNA, 21 nt, Human
guuuuucaagaaaacuggaaa

SEQ ID NO: 38133 - RNA, 21 nt, Human
cacaggcggagguugcggugg

SEQ ID NO: 38134 - RNA, 23 nt, Human
ucaggacugagcacacaggugaa

SEQ ID NO: 38135 - RNA, 27 nt, Human
gggcugaagucggcuuggggagccaga

SEQ ID NO: 38136 - RNA, 26 nt, Human
gggaagagaagagggcccagcccaga

SEQ ID NO: 38137 - RNA, 25 nt, Human
cgcugccaaucuaagccagucucac

SEQ ID NO: 38138 - RNA, 19 nt, Human
augccuuccuucucugccc

SEQ ID NO: 38139 - RNA, 20 nt, Human
ccuguucucugagaguacca

SEQ ID NO: 38140 - RNA, 20 nt, Human
gcugagggcaucucugagug

SEQ ID NO: 38141 - RNA, 24 nt, Human
ccuuucucagccuccagcugggcu

SEQ ID NO: 38142 - RNA, 20 nt, Human
uuucucucauggcguucuag

SEQ ID NO: 38143 - RNA, 22 nt, Human
ugccucccggguucaagugauu

SEQ ID NO: 38144 - RNA, 20 nt, Human
ucuuuuuuguuuuccucuca

SEQ ID NO: 38145 - RNA, 21 nt, Human
gacauaaaaugaauuaaugga

SEQ ID NO: 38146 - RNA, 29 nt, Human
ccaaccgcugccauuucacacucacccuc

SEQ ID NO: 38147 - RNA, 27 nt, Human
uuuccaaugcaucuuccaugaugcauu

SEQ ID NO: 38148 - RNA, 20 nt, Human
agcaggagcagggcccgccc

SEQ ID NO: 38149 - RNA, 24 nt, Human
cugcagcugauccauaggacuacc

SEQ ID NO: 38150 - RNA, 21 nt, Human
ucuuuggaggaacagcucccu

SEQ ID NO: 38151 - RNA, 20 nt, Human
ggcuucugcugagauggcca

SEQ ID NO: 38152 - RNA, 23 nt, Human
ugggaguaacggacuuaaccuca

SEQ ID NO: 38153 - RNA, 32 nt, Human
caaugggaagaagagagaucucugugaucauc

SEQ ID NO: 38154 - RNA, 22 nt, Human
uauuaccaauccaguucaauua

SEQ ID NO: 38155 - RNA, 23 nt, Human
ccuucauuucccccuccuuugcu

SEQ ID NO: 38156 - RNA, 20 nt, Human
ggggagggagacgggauagu

SEQ ID NO: 38157 - RNA, 28 nt, Human
gcaggcauacuuuuccacacaucuuugg

SEQ ID NO: 38158 - RNA, 26 nt, Human
ucagguaccuccucccuuucaucuca

SEQ ID NO: 38159 - RNA, 26 nt, Human
uguguucuuaccgccuccuuuuuccu

SEQ ID NO: 38160 - RNA, 20 nt, Human
cuuugugagggcuggagcau

SEQ ID NO: 38161 - RNA, 27 nt, Human
gcauucaccugcccugucuccaaacag

SEQ ID NO: 38162 - RNA, 27 nt, Human
caguuuuguuaacucucuuugggaauu

SEQ ID NO: 38163 - RNA, 23 nt, Human
ucauuuuguuuucauaagacaau

SEQ ID NO: 38164 - RNA, 28 nt, Human
uacaaucacgucacaggucucuuggccu

SEQ ID NO: 38165 - RNA, 26 nt, Human
cccacugucucuaaccacuccugggc

SEQ ID NO: 38166 - RNA, 18 nt, Human
acaccugcacgcauagga

SEQ ID NO: 38167 - RNA, 23 nt, Human
acagagcaggccacgcucaggcc

SEQ ID NO: 38168 - RNA, 18 nt, Human
gucucucccuggccgccc

SEQ ID NO: 38169 - RNA, 25 nt, Human
gaacagccacaaaauacacaccccu

SEQ ID NO: 38170 - RNA, 18 nt, Human
ggagaggggcuacgcagc

SEQ ID NO: 38171 - RNA, 26 nt, Human
aacuggcaacuuacuacugaaucucu

SEQ ID NO: 38172 - RNA, 20 nt, Human
gugauuuuucuucagguaac

SEQ ID NO: 38173 - RNA, 23 nt, Human
ugcuucucugcugggaucucgcu

SEQ ID NO: 38174 - RNA, 21 nt, Human
uuaaaaguuuggauguauaga

SEQ ID NO: 38175 - RNA, 27 nt, Human
gcuuugcucagcacacucuccugggcc

SEQ ID NO: 38176 - RNA, 19 nt, Human
cuucccuuugcaccagccc

SEQ ID NO: 38177 - RNA, 24 nt, Human
gaugaauuugaaguucuacuagaa

SEQ ID NO: 38178 - RNA, 22 nt, Human
uacaccgcugagcugggcagag

SEQ ID NO: 38179 - RNA, 22 nt, Human
aggguccaugugaucacacuga

SEQ ID NO: 38180 - RNA, 23 nt, Human
agcacucagcccgggaggcaggc

SEQ ID NO: 38181 - RNA, 23 nt, Human
cguuuucggugccaucagugccc

SEQ ID NO: 38182 - RNA, 20 nt, Human
uccaaagaacaagaaauugu

SEQ ID NO: 38183 - RNA, 21 nt, Human
ucucagcuugagaccauuuca

SEQ ID NO: 38184 - RNA, 27 nt, Human
ccuggagcagcucucgagaacuaccug

SEQ ID NO: 38185 - RNA, 25 nt, Human
ugagaggagucugcucaggagccag

SEQ ID NO: 38186 - RNA, 18 nt, Human
uuaaaaaauccggaaaaa

SEQ ID NO: 38187 - RNA, 20 nt, Human
ccaggcuccacuccugggcu

SEQ ID NO: 38188 - RNA, 20 nt, Human
ccucuuucucugcuggagcu

SEQ ID NO: 38189 - RNA, 25 nt, Human
ucacccugcggcaggcacaacagau

SEQ ID NO: 38190 - RNA, 22 nt, Human
cccugaaccccacaguccgccu

SEQ ID NO: 38191 - RNA, 24 nt, Human
ggacuaaaucauuuugcuacuuua

SEQ ID NO: 38192 - RNA, 24 nt, Human
ucaguauucuuccuggcaagauac

SEQ ID NO: 38193 - RNA, 25 nt, Human
uccugacccuacccuugugagaguc

SEQ ID NO: 38194 - RNA, 19 nt, Human
caaaaggaaaccacaaaaa

SEQ ID NO: 38195 - RNA, 27 nt, Human
gaguagcugagauuacaggugcgcgcc

SEQ ID NO: 38196 - RNA, 21 nt, Human
caggcacaaaaggccacauag

SEQ ID NO: 38197 - RNA, 20 nt, Human
guccuuccacugugcaccug

SEQ ID NO: 38198 - RNA, 18 nt, Human
gccuguaacaauguaaua

SEQ ID NO: 38199 - RNA, 32 nt, Human
guuagagauuaugcauuuuccacauagggaaa

SEQ ID NO: 38200 - RNA, 22 nt, Human
ucuaacugccugagcccaggga

SEQ ID NO: 38201 - RNA, 22 nt, Human
ccccaagaccucagcccaggca

SEQ ID NO: 38202 - RNA, 31 nt, Human
gcccuucucuugcugccuccugggcagggcc

SEQ ID NO: 38203 - RNA, 22 nt, Human
gaugugaagacaccugcagccu

SEQ ID NO: 38204 - RNA, 22 nt, Human
caccacugcacuucagcuuggg

SEQ ID NO: 38205 - RNA, 27 nt, Human
accagccucggcaacaugccaagaccc

SEQ ID NO: 38206 - RNA, 20 nt, Human
acucucugcuacauucaguu

SEQ ID NO: 38207 - RNA, 24 nt, Human
cuguuggccaggcuggagugcagu

SEQ ID NO: 38208 - RNA, 26 nt, Human
uggaugcuuguuucaaaggguuuccu

SEQ ID NO: 38209 - RNA, 22 nt, Human
aaccaagauuaugugacuugca

SEQ ID NO: 38210 - RNA, 22 nt, Human
cggcggaguauauuagagccgg

SEQ ID NO: 38211 - RNA, 24 nt, Human
ccucaauccugggcucaagugauc

SEQ ID NO: 38212 - RNA, 19 nt, Human
ugguuuuuauuccuggcau

SEQ ID NO: 38213 - RNA, 27 nt, Human
uggucucagacuugggaaaacugccua

SEQ ID NO: 38214 - RNA, 22 nt, Human
cuccaggcugggcagcaagagc

SEQ ID NO: 38215 - RNA, 21 nt, Human
auucaaauuguaugcuuucug

SEQ ID NO: 38216 - RNA, 19 nt, Human
gccucuucucagcaugcug

SEQ ID NO: 38217 - RNA, 28 nt, Human
gggaggccuggaaggaguucacuguaga

SEQ ID NO: 38218 - RNA, 22 nt, Human
ccaggaaagauaagaggaccaa

SEQ ID NO: 38219 - RNA, 22 nt, Human
gcauagccauaggugaggacuu

SEQ ID NO: 38220 - RNA, 27 nt, Human
cucagugucagaccagccuucuccuca

SEQ ID NO: 38221 - RNA, 25 nt, Human
cacuacacucuggaugguguaugac

SEQ ID NO: 38222 - RNA, 23 nt, Human
uucuuugggggugauugucucgc

SEQ ID NO: 38223 - RNA, 22 nt, Human
gggucugggcccugcucccugu

SEQ ID NO: 38224 - RNA, 24 nt, Human
gcugcaaccucccccuccuggguu

SEQ ID NO: 38225 - RNA, 22 nt, Human
gcuguugccaugaggcgaggcu

SEQ ID NO: 38226 - RNA, 22 nt, Human
aaagugcugggauuacaggcau

SEQ ID NO: 38227 - RNA, 27 nt, Human
uuauggccacauuucucuuucugcugu

SEQ ID NO: 38228 - RNA, 20 nt, Human
accugcucuggacacuugcu

SEQ ID NO: 38229 - RNA, 23 nt, Human
guuucugcuuucaguuucuuggc

SEQ ID NO: 38230 - RNA, 20 nt, Human
aacaaccaugaaagacuggg

SEQ ID NO: 38231 - RNA, 24 nt, Human
gccucucugugcacuugcugucug

SEQ ID NO: 38232 - RNA, 22 nt, Human
ugcaaccacugccuccaggguu

SEQ ID NO: 38233 - RNA, 20 nt, Human
gcaaagcauuccuaguuaac

SEQ ID NO: 38234 - RNA, 27 nt, Human
cugggcaggggacagagagacacaggc

SEQ ID NO: 38235 - RNA, 23 nt, Human
acuguucuuuugcauuuugccgc

SEQ ID NO: 38236 - RNA, 20 nt, Human
cacccaggcuggaguacacu

SEQ ID NO: 38237 - RNA, 23 nt, Human
cuaaauguaagaaaaaucugcua

SEQ ID NO: 38238 - RNA, 27 nt, Human
aggugcuucaggauaccauauacagcu

SEQ ID NO: 38239 - RNA, 21 nt, Human
auuuguacugcuuuaugguca

SEQ ID NO: 38240 - RNA, 15 nt, Human
cucuccucgccugcc

SEQ ID NO: 38241 - RNA, 30 nt, Human
gacuccagcucugacuucugcucuggacca

SEQ ID NO: 38242 - RNA, 23 nt, Human
cacggugacacaggucagggcuc

SEQ ID NO: 38243 - RNA, 20 nt, Human
uggacccccugagauccagc

SEQ ID NO: 38244 - RNA, 19 nt, Human
uuuuguuucuuuuuucggc

SEQ ID NO: 38245 - RNA, 24 nt, Human
ucuagaaucauacuuaacauuuca

SEQ ID NO: 38246 - RNA, 20 nt, Human
agguaggauucuguuuuaua

SEQ ID NO: 38247 - RNA, 27 nt, Human
cacagccgccagacccgccugcugagc

SEQ ID NO: 38248 - RNA, 21 nt, Human
cucagcuuucugaggcccuga

SEQ ID NO: 38249 - RNA, 25 nt, Human
ggucagccuagcaugcaaccagugg

SEQ ID NO: 38250 - RNA, 27 nt, Human
agaccacugccaucuauccaccugccc

SEQ ID NO: 38251 - RNA, 19 nt, Human
aucaacaacaaggaagucu

SEQ ID NO: 38252 - RNA, 21 nt, Human
ggcaucugaaccccugccucu

SEQ ID NO: 38253 - RNA, 21 nt, Human
uaggcagcaguuccuuaguuu

SEQ ID NO: 38254 - RNA, 21 nt, Human
cgaggcagguggaucgcuuga

SEQ ID NO: 38255 - RNA, 25 nt, Human
aaagcagcagaaggugaagcaggaa

SEQ ID NO: 38256 - RNA, 23 nt, Human
cgggacgcagcaggaggccaggc

SEQ ID NO: 38257 - RNA, 26 nt, Human
ucagucagacuggggugcaggaccug

SEQ ID NO: 38258 - RNA, 22 nt, Human
agaagcugcauguuaagugcca

SEQ ID NO: 38259 - RNA, 22 nt, Human
gacucauuucuggucuuggggc

SEQ ID NO: 38260 - RNA, 21 nt, Human
acaaucuggcucacugcagcc

SEQ ID NO: 38261 - RNA, 23 nt, Human
ccuccugccgaucgcccggggcu

SEQ ID NO: 38262 - RNA, 23 nt, Human
agaacagagucuuuuucuucuuc

SEQ ID NO: 38263 - RNA, 21 nt, Human
gguuucuguagccggaagauc

SEQ ID NO: 38264 - RNA, 27 nt, Human
aguuuucuuuauuccuggcagugucag

SEQ ID NO: 38265 - RNA, 21 nt, Human
uucaggagggagcggagcagc

SEQ ID NO: 38266 - RNA, 19 nt, Human
gccccuccccagcauccca

SEQ ID NO: 38267 - RNA, 26 nt, Human
gcccucuccccucucccgagggcugg

SEQ ID NO: 38268 - RNA, 22 nt, Human
aauuccucaguaaccuccaucu

SEQ ID NO: 38269 - RNA, 24 nt, Human
ggaacuugccugccuuuccaucca

SEQ ID NO: 38270 - RNA, 25 nt, Human
ugugugccguguauugacccgcuuc

SEQ ID NO: 38271 - RNA, 23 nt, Human
aguugcccaggcugaucuugaac

SEQ ID NO: 38272 - RNA, 30 nt, Human
ugcaagcauuagcuaucacagcaaaggauu

SEQ ID NO: 38273 - RNA, 20 nt, Human
aucuuuuaauuguguauuua

SEQ ID NO: 38274 - RNA, 21 nt, Human
agccuccucucccuaguguag

SEQ ID NO: 38275 - RNA, 22 nt, Human
gggggcugucacccugcucugg

SEQ ID NO: 38276 - RNA, 21 nt, Human
cacaugaaagaaaaaugggua

SEQ ID NO: 38277 - RNA, 20 nt, Human
caguucugugaauacugccc

SEQ ID NO: 38278 - RNA, 21 nt, Human
cugcagcucaccauguaugcc

SEQ ID NO: 38279 - RNA, 28 nt, Human
gcuugggaucuucaaugaacugugcuuu

SEQ ID NO: 38280 - RNA, 21 nt, Human
acaaacccuuuucauccuggc

SEQ ID NO: 38281 - RNA, 22 nt, Human
caguagugguuaguccacugag

SEQ ID NO: 38282 - RNA, 22 nt, Human
uucaaaaguucuuaaaggcaag

SEQ ID NO: 38283 - RNA, 24 nt, Human
caagugauccucuugucucagucc

SEQ ID NO: 38284 - RNA, 21 nt, Human
cccauggagaagcaggccuua

SEQ ID NO: 38285 - RNA, 20 nt, Human
ugcuuuguugauauucaaag

SEQ ID NO: 38286 - RNA, 27 nt, Human
ccuuuucucccugugccguuuucuugc

SEQ ID NO: 38287 - RNA, 22 nt, Human
gcuaauaaaauggugacuuuaa

SEQ ID NO: 38288 - RNA, 30 nt, Human
cugcggggccgcgggggucgaauguucgug

SEQ ID NO: 38289 - RNA, 26 nt, Human
ucccaggucauugugucuguuuccga

SEQ ID NO: 38290 - RNA, 21 nt, Human
aacugauucagaaacugacuu

SEQ ID NO: 38291 - RNA, 21 nt, Human
cuuucuuuuuccuuguggucu

SEQ ID NO: 38292 - RNA, 31 nt, Human
aggggacucugagaauggaagggagcucuca

SEQ ID NO: 38293 - RNA, 23 nt, Human
ucacugguuuacaaauauagguu

SEQ ID NO: 38294 - RNA, 21 nt, Human
cuacuugaauaacucaguuaa

SEQ ID NO: 38295 - RNA, 18 nt, Human
uccuauggaaacuauuug

SEQ ID NO: 38296 - RNA, 26 nt, Human
cacccaggcuugauuuggauccacag

SEQ ID NO: 38297 - RNA, 23 nt, Human
cucccucaucucaaaggguccuc

SEQ ID NO: 38298 - RNA, 25 nt, Human
ccaggauaagagaccacuuagccuu

SEQ ID NO: 38299 - RNA, 24 nt, Human
agagucauauuaucauacuuauca

SEQ ID NO: 38300 - RNA, 27 nt, Human
aggcugugucagaaacugaagcuguuc

SEQ ID NO: 38301 - RNA, 22 nt, Human
caaacuccugaccucaggcgau

SEQ ID NO: 38302 - RNA, 21 nt, Human
cuccaucucaaaacaaaaaca

SEQ ID NO: 38303 - RNA, 27 nt, Human
ggcuguaggaaaucuaguuauuuacag

SEQ ID NO: 38304 - RNA, 21 nt, Human
ccgggaaauuccuccaggcaa

SEQ ID NO: 38305 - RNA, 20 nt, Human
gcacagucaucugacuucug

SEQ ID NO: 38306 - RNA, 21 nt, Human
aaaccacacagacuugggcag

SEQ ID NO: 38307 - RNA, 27 nt, Human
ccuucauuccucuccaugcugcaauca

SEQ ID NO: 38308 - RNA, 20 nt, Human
gaaaauggaaaauauacaag

SEQ ID NO: 38309 - RNA, 24 nt, Human
uguuuucuucaaaaaagcuguaag

SEQ ID NO: 38310 - RNA, 28 nt, Human
uugggucugguuuuguuuuggauuggua

SEQ ID NO: 38311 - RNA, 22 nt, Human
cauggacugggguguucccugg

SEQ ID NO: 38312 - RNA, 22 nt, Human
gccucugcagagaacacugccu

SEQ ID NO: 38313 - RNA, 20 nt, Human
uuaaccugcaugcagcaaca

SEQ ID NO: 38314 - RNA, 26 nt, Human
ggcccaggcucggugaggaggcaagg

SEQ ID NO: 38315 - RNA, 25 nt, Human
ggccucucugccuguggccuuccgg

SEQ ID NO: 38316 - RNA, 20 nt, Human
ccuggcgcuuccagcugaga

SEQ ID NO: 38317 - RNA, 23 nt, Human
gucugugggcaccagcacuucau

SEQ ID NO: 38318 - RNA, 27 nt, Human
ugaacaaaugacaucaaacuugugagg

SEQ ID NO: 38319 - RNA, 25 nt, Human
guggcagcaggggucagggaagugg

SEQ ID NO: 38320 - RNA, 25 nt, Human
cucgggcauuguuugcauuguguuu

SEQ ID NO: 38321 - RNA, 23 nt, Human
augugucucucauucuuucuucu

SEQ ID NO: 38322 - RNA, 27 nt, Human
ucaugccaccauggccagccaacuuuu

SEQ ID NO: 38323 - RNA, 23 nt, Human
ccaggaaguggcaguugcaguga

SEQ ID NO: 38324 - RNA, 28 nt, Human
gugcaugauucgcaggucagcuauuucc

SEQ ID NO: 38325 - RNA, 23 nt, Human
guugccggccaggaaucccagug

SEQ ID NO: 38326 - RNA, 21 nt, Human
cucugguggcuaugcauuuau

SEQ ID NO: 38327 - RNA, 24 nt, Human
gaugguccucacaagccucuucug

SEQ ID NO: 38328 - RNA, 22 nt, Human
gccacacacuugcuguaaggcu

SEQ ID NO: 38329 - RNA, 21 nt, Human
agugcucagcuguggcuggag

SEQ ID NO: 38330 - RNA, 21 nt, Human
gggugggaaaucuaugguuuu

SEQ ID NO: 38331 - RNA, 27 nt, Human
uucucaaggaaugcuuuccucuaacug

SEQ ID NO: 38332 - RNA, 22 nt, Human
ucucagccaccuuccucaggcu

SEQ ID NO: 38333 - RNA, 21 nt, Human
cuaaaauauuuucacaaccag

SEQ ID NO: 38334 - RNA, 25 nt, Human
gccugucaggaacuccucacuguuu

SEQ ID NO: 38335 - RNA, 21 nt, Human
aacaaauuuugggggcaggag

SEQ ID NO: 38336 - RNA, 18 nt, Human
agccucucuuccucuguc

SEQ ID NO: 38337 - RNA, 24 nt, Human
uuacuucguucccuggaucaaauu

SEQ ID NO: 38338 - RNA, 23 nt, Human
cuccaaaacacacaugccucuuu

SEQ ID NO: 38339 - RNA, 20 nt, Human
uuugcagccucuccuagcca

SEQ ID NO: 38340 - RNA, 25 nt, Human
uugucgcccuggaauaggguccugc

SEQ ID NO: 38341 - RNA, 20 nt, Human
aagaggccacacccugcccu

SEQ ID NO: 38342 - RNA, 24 nt, Human
acucauagcaaagucacuucuguu

SEQ ID NO: 38343 - RNA, 22 nt, Human
acucaccucugucgcuuggguu

SEQ ID NO: 38344 - RNA, 22 nt, Human
uuccuuugguuugaauaacucc

SEQ ID NO: 38345 - RNA, 22 nt, Human
cgucucucacccaugcgacucg

SEQ ID NO: 38346 - RNA, 21 nt, Human
uucuuaggcuggagugcagug

SEQ ID NO: 38347 - RNA, 22 nt, Human
agcacagaaaucaauguuagca

SEQ ID NO: 38348 - RNA, 24 nt, Human
gcuguucuuuuuuguacuuuucug

SEQ ID NO: 38349 - RNA, 25 nt, Human
ggagggaggggcacagugaagaagg

SEQ ID NO: 38350 - RNA, 27 nt, Human
gccagugcugaccagggacuucugacc

SEQ ID NO: 38351 - RNA, 27 nt, Human
acuagcaccuaucauaauggucuuagu

SEQ ID NO: 38352 - RNA, 24 nt, Human
auauauuguguuugcugacaauca

SEQ ID NO: 38353 - RNA, 23 nt, Human
uuguggcuucucuuuacagcuuu

SEQ ID NO: 38354 - RNA, 26 nt, Human
gugcagggggagaugggugaugaggu

SEQ ID NO: 38355 - RNA, 20 nt, Human
ugcccggugcugucugagua

SEQ ID NO: 38356 - RNA, 22 nt, Human
agggggcagagucuucccuacc

SEQ ID NO: 38357 - RNA, 22 nt, Human
gccuguaauuccaucauuuugg

SEQ ID NO: 38358 - RNA, 22 nt, Human
auauccaacaugugcucaggga

SEQ ID NO: 38359 - RNA, 21 nt, Human
ccaaagugcugggauuaaagc

SEQ ID NO: 38360 - RNA, 22 nt, Human
gucucuccacugcucucagccu

SEQ ID NO: 38361 - RNA, 31 nt, Human
uauuaucaacugcugcuucaccagacuuuuc

SEQ ID NO: 38362 - RNA, 23 nt, Human
agccccaucacacuguguuugug

SEQ ID NO: 38363 - RNA, 20 nt, Human
aacucugcugcuucccaagg

SEQ ID NO: 38364 - RNA, 19 nt, Human
gcucaggcuggagugcagu

SEQ ID NO: 38365 - RNA, 29 nt, Human
gauugcaacaggcugggcuucaguggcag

SEQ ID NO: 38366 - RNA, 28 nt, Human
gaaugaguugaggccacuguguuccuuc

SEQ ID NO: 38367 - RNA, 22 nt, Human
ugcaaaaucugccucccggguu

SEQ ID NO: 38368 - RNA, 19 nt, Human
cagccaggcugggcagagc

SEQ ID NO: 38369 - RNA, 22 nt, Human
cggcggcgggcaguugcagugg

SEQ ID NO: 38370 - RNA, 22 nt, Human
aaggauuagcaguguguggaaa

SEQ ID NO: 38371 - RNA, 21 nt, Human
gcccagccacauuucagccga

SEQ ID NO: 38372 - RNA, 28 nt, Human
ccaggaagcagagcgucaugcaggucuu

SEQ ID NO: 38373 - RNA, 26 nt, Human
gaaaacagcuguggucgggcacggug

SEQ ID NO: 38374 - RNA, 22 nt, Human
uggggcagugagggcuuaggac

SEQ ID NO: 38375 - RNA, 22 nt, Human
ccugcugcugccccauuugauc

SEQ ID NO: 38376 - RNA, 22 nt, Human
ugaggugggcuccuggaacugc

SEQ ID NO: 38377 - RNA, 25 nt, Human
uccuccugcccccaccccaggcugg

SEQ ID NO: 38378 - RNA, 20 nt, Human
gagagugagauagucacaga

SEQ ID NO: 38379 - RNA, 20 nt, Human
gcuggucgggucaagagucg

SEQ ID NO: 38380 - RNA, 27 nt, Human
gcucucuggacacuugcgacaccucaa

SEQ ID NO: 38381 - RNA, 29 nt, Human
ccggugugcagcuggagagcgagcggcca

SEQ ID NO: 38382 - RNA, 21 nt, Human
cuuauaagagauucacucaga

SEQ ID NO: 38383 - RNA, 21 nt, Human
auucucuuucuucagucuuuu

SEQ ID NO: 38384 - RNA, 22 nt, Human
aggugauucuggccucuguggu

SEQ ID NO: 38385 - RNA, 22 nt, Human
cuuacacuuucucuccaucacc

SEQ ID NO: 38386 - RNA, 19 nt, Human
uccagcagaaggaaacaug

SEQ ID NO: 38387 - RNA, 26 nt, Human
ucucuagcuugcggccugugucuaug

SEQ ID NO: 38388 - RNA, 22 nt, Human
ucgaucuugccauaacuuuaca

SEQ ID NO: 38389 - RNA, 20 nt, Human
auuagccuggcgugguagcg

SEQ ID NO: 38390 - RNA, 26 nt, Human
ccagccuggcccuggcaaggggcggg

SEQ ID NO: 38391 - RNA, 22 nt, Human
uucuagaguuccuaccauggag

SEQ ID NO: 38392 - RNA, 22 nt, Human
guucuuccuguaaucuuguuga

SEQ ID NO: 38393 - RNA, 22 nt, Human
cggcgggaggcaguggcugggg

SEQ ID NO: 38394 - RNA, 20 nt, Human
aauccaagcaccauucuuua

SEQ ID NO: 38395 - RNA, 26 nt, Human
agggaggcagaggcuuggguaaacuc

SEQ ID NO: 38396 - RNA, 20 nt, Human
uucucucuuaauuaauaaca

SEQ ID NO: 38397 - RNA, 20 nt, Human
ucuuccuagccuuucuaaac

SEQ ID NO: 38398 - RNA, 24 nt, Human
ccaacagacaccuuccacucugag

SEQ ID NO: 38399 - RNA, 26 nt, Human
aggaauagagggaggaguguaauuuu

SEQ ID NO: 38400 - RNA, 21 nt, Human
ucaauaaauauaauuucucua

SEQ ID NO: 38401 - RNA, 21 nt, Human
cccuccagcugccugggcugg

SEQ ID NO: 38402 - RNA, 21 nt, Human
uccugcuccagggcaguaaac

SEQ ID NO: 38403 - RNA, 27 nt, Human
ugccuguagaguuaguauuucuauuuu

SEQ ID NO: 38404 - RNA, 26 nt, Human
cacaaaacaucaaguuccacacacgc

SEQ ID NO: 38405 - RNA, 20 nt, Human
caacauagcagaucuguuuu

SEQ ID NO: 38406 - RNA, 18 nt, Human
cucucugcugcuggaccc

SEQ ID NO: 38407 - RNA, 21 nt, Human
caauaaauaugaugaccuuga

SEQ ID NO: 38408 - RNA, 23 nt, Human
guuacuuaggguuuuuguuuucu

SEQ ID NO: 38409 - RNA, 24 nt, Human
ggagagcgggacguggcagaggag

SEQ ID NO: 38410 - RNA, 25 nt, Human
aggcuguuuccuuuugcaucuggaa

SEQ ID NO: 38411 - RNA, 21 nt, Human
gaccccugcuccagggccacu

SEQ ID NO: 38412 - RNA, 26 nt, Human
gauggccauguaaauaagaugauuua

SEQ ID NO: 38413 - RNA, 22 nt, Human
gagcccagucccacagccuucc

SEQ ID NO: 38414 - RNA, 22 nt, Human
gcccucggugcuggaguggacg

SEQ ID NO: 38415 - RNA, 26 nt, Human
cuggcacacuuaguguucuucuuuca

SEQ ID NO: 38416 - RNA, 21 nt, Human
gaucagcucagacauauuuca

SEQ ID NO: 38417 - RNA, 22 nt, Human
cuggaagcacugcuguguccgc

SEQ ID NO: 38418 - RNA, 20 nt, Human
cugccccacauggacaaaac

SEQ ID NO: 38419 - RNA, 21 nt, Human
auuuuucugucucccaaccuc

SEQ ID NO: 38420 - RNA, 23 nt, Human
gucugcucuguacaauugucccu

SEQ ID NO: 38421 - RNA, 22 nt, Human
caacuauucuguuccacaccca

SEQ ID NO: 38422 - RNA, 27 nt, Human
cacuguacuccagcccggcacuccagc

SEQ ID NO: 38423 - RNA, 23 nt, Human
uguuaaaaagacuguuauuucac

SEQ ID NO: 38424 - RNA, 23 nt, Human
ggaagagggagggauggacaagu

SEQ ID NO: 38425 - RNA, 28 nt, Human
ucaugugccugaaggcuauccacuacau

SEQ ID NO: 38426 - RNA, 21 nt, Human
uaauaaaaugaggcuuuuuua

SEQ ID NO: 38427 - RNA, 19 nt, Human
gcuccccuccacagcugca

SEQ ID NO: 38428 - RNA, 23 nt, Human
caggacagagacaaaaaugagga

SEQ ID NO: 38429 - RNA, 27 nt, Human
uugcaguauucuccccugauuggaaug

SEQ ID NO: 38430 - RNA, 22 nt, Human
agaaacuuaagcaaaggggaca

SEQ ID NO: 38431 - RNA, 22 nt, Human
ccgcccccuggguucaagcaau

SEQ ID NO: 38432 - RNA, 24 nt, Human
agaugcuuaagacauuuuguuuca

SEQ ID NO: 38433 - RNA, 20 nt, Human
ggggguccacccagcaaaga

SEQ ID NO: 38434 - RNA, 22 nt, Human
cucucuccacuuccccuugucc

SEQ ID NO: 38435 - RNA, 21 nt, Human
cacccagacuggcgugcagug

SEQ ID NO: 38436 - RNA, 24 nt, Human
ucucucugcucuccauuaagugca

SEQ ID NO: 38437 - RNA, 23 nt, Human
gagcgucaaguccugcuuucuca

SEQ ID NO: 38438 - RNA, 27 nt, Human
ccugccugugcccgcaugugugccugg

SEQ ID NO: 38439 - RNA, 22 nt, Human
agagaugggguuucacuguguu

SEQ ID NO: 38440 - RNA, 24 nt, Human
uucuuagccuaguacaauuccuuc

SEQ ID NO: 38441 - RNA, 22 nt, Human
agcucacuguguuucuuuucuu

SEQ ID NO: 38442 - RNA, 18 nt, Human
ggaaguggaaggcaguga

SEQ ID NO: 38443 - RNA, 22 nt, Human
uuucacuagccccaaacuuuuu

SEQ ID NO: 38444 - RNA, 27 nt, Human
cacgucuggcuaauuauuauuuuuugu

SEQ ID NO: 38445 - RNA, 27 nt, Human
gcugcuggcacuucaggcucugccucu

SEQ ID NO: 38446 - RNA, 20 nt, Human
aucacccaccauagggcaug

SEQ ID NO: 38447 - RNA, 21 nt, Human
acacaggaauguacacuggug

SEQ ID NO: 38448 - RNA, 20 nt, Human
gguuaucacuuuuccuccag

SEQ ID NO: 38449 - RNA, 22 nt, Human
gggaggugggugggucagguga

SEQ ID NO: 38450 - RNA, 23 nt, Human
ugccuccugugggaggcugagga

SEQ ID NO: 38451 - RNA, 22 nt, Human
ugaucauucaggguucaucuca

SEQ ID NO: 38452 - RNA, 21 nt, Human
gaagucacuuccuggguauau

SEQ ID NO: 38453 - RNA, 23 nt, Human
ccggaguagcugggaccacaggu

SEQ ID NO: 38454 - RNA, 21 nt, Human
uuuugucuugaaugaauuuua

SEQ ID NO: 38455 - RNA, 22 nt, Human
gcaccugccuuacauggcuugu

SEQ ID NO: 38456 - RNA, 27 nt, Human
gcuucaaacucuugggcucaagccauc

SEQ ID NO: 38457 - RNA, 20 nt, Human
auacaggaagaaagagcuug

SEQ ID NO: 38458 - RNA, 24 nt, Human
uuuaggauguauauacaaagacga

SEQ ID NO: 38459 - RNA, 23 nt, Human
cuccugccucagccuccugagca

SEQ ID NO: 38460 - RNA, 23 nt, Human
cuggcucucugguccuuguugcu

SEQ ID NO: 38461 - RNA, 24 nt, Human
gugauccgggucgggacacugccu

SEQ ID NO: 38462 - RNA, 21 nt, Human
accccacccucuuccuguguc

SEQ ID NO: 38463 - RNA, 24 nt, Human
uuucaccaagccuuuucauaauca

SEQ ID NO: 38464 - RNA, 19 nt, Human
gaaucagcuauuuacugcc

SEQ ID NO: 38465 - RNA, 21 nt, Human
uccauuucaagagguggcccc

SEQ ID NO: 38466 - RNA, 27 nt, Human
auacuauaaaugugcuaaguuauuuga

SEQ ID NO: 38467 - RNA, 20 nt, Human
cacucagaucccuuuuuuaa

SEQ ID NO: 38468 - RNA, 27 nt, Human
ggaucaccugaauucucucagcuguca

SEQ ID NO: 38469 - RNA, 21 nt, Human
ccauacauuuauuucuguaaa

SEQ ID NO: 38470 - RNA, 21 nt, Human
ucgaaugugagaaugccuuca

SEQ ID NO: 38471 - RNA, 26 nt, Human
cuccccagaggugaccacuuucaacu

SEQ ID NO: 38472 - RNA, 22 nt, Human
uggaagggcuagaaccuguaga

SEQ ID NO: 38473 - RNA, 25 nt, Human
agcucacuggagagccuacauuccu

SEQ ID NO: 38474 - RNA, 27 nt, Human
cucggcucucccacaggugggcacccc

SEQ ID NO: 38475 - RNA, 24 nt, Human
aaacagccacgaggugguagcucu

SEQ ID NO: 38476 - RNA, 20 nt, Human
cugagucuagcauguuucua

SEQ ID NO: 38477 - RNA, 27 nt, Human
uuccaacaacuaugaugaacuauguuc

SEQ ID NO: 38478 - RNA, 26 nt, Human
gcucuaggaagacauuuuuccguuug

SEQ ID NO: 38479 - RNA, 23 nt, Human
gaugcuuugaguuuaaacccacc

SEQ ID NO: 38480 - RNA, 23 nt, Human
ccgggggacgaguccggagcagc

SEQ ID NO: 38481 - RNA, 24 nt, Human
guacuggagcacguggucaggguc

SEQ ID NO: 38482 - RNA, 21 nt, Human
ccugucggugaaggaucaugu

SEQ ID NO: 38483 - RNA, 22 nt, Human
aggagaggaaaggacaugggua

SEQ ID NO: 38484 - RNA, 21 nt, Human
auuuuuaauuaaaaacuagua

SEQ ID NO: 38485 - RNA, 21 nt, Human
caagcgacucuccugccucag

SEQ ID NO: 38486 - RNA, 22 nt, Human
ugagugggagacaggcggcagg

SEQ ID NO: 38487 - RNA, 22 nt, Human
cccugcucucuuagaaagagcc

SEQ ID NO: 38488 - RNA, 23 nt, Human
gccagccacagguacagagccca

SEQ ID NO: 38489 - RNA, 20 nt, Human
gcaggggccuccuaagccag

SEQ ID NO: 38490 - RNA, 24 nt, Human
ucuccugccagcugaacuguaguu

SEQ ID NO: 38491 - RNA, 23 nt, Human
ggcgcaggugcugauucugucaa

SEQ ID NO: 38492 - RNA, 22 nt, Human
accauuuuuaauaagcacaauc

SEQ ID NO: 38493 - RNA, 27 nt, Human
agagucaccuccagacaacaucugcuc

SEQ ID NO: 38494 - RNA, 21 nt, Human
gcuagagguaaacguucugcu

SEQ ID NO: 38495 - RNA, 28 nt, Human
uuucucucuuugcacuuccuuccuaauc

SEQ ID NO: 38496 - RNA, 27 nt, Human
cgcaaaacgggacaugaugugacaauc

SEQ ID NO: 38497 - RNA, 21 nt, Human
caaagauguugucccugggga

SEQ ID NO: 38498 - RNA, 22 nt, Human
cccaaagugcuuggauuacagg

SEQ ID NO: 38499 - RNA, 21 nt, Human
uuagaaaaccagucacuucuu

SEQ ID NO: 38500 - RNA, 25 nt, Human
acugucugcuaacaugguacacugc

SEQ ID NO: 38501 - RNA, 29 nt, Human
cucuccaggacugccaggcugcuggagga

SEQ ID NO: 38502 - RNA, 24 nt, Human
aaguugugguuuggggaggucugu

SEQ ID NO: 38503 - RNA, 27 nt, Human
guuucauguacuucucucucugacucu

SEQ ID NO: 38504 - RNA, 19 nt, Human
ugcuacuuaacaagguggu

SEQ ID NO: 38505 - RNA, 22 nt, Human
gugugcccuggggagccucaga

SEQ ID NO: 38506 - RNA, 25 nt, Human
ggcgggcagaggagagggaggccgc

SEQ ID NO: 38507 - RNA, 29 nt, Human
agccuuggcaagaaaacuugcugcauaau

SEQ ID NO: 38508 - RNA, 25 nt, Human
gggcucccagccccucucuccuuuu

SEQ ID NO: 38509 - RNA, 23 nt, Human
ggcucagaugacuguaaaaugaa

SEQ ID NO: 38510 - RNA, 26 nt, Human
ccaguuuaaaagaguuugaaggagca

SEQ ID NO: 38511 - RNA, 23 nt, Human
aauggugagaccaaaacaauaac

SEQ ID NO: 38512 - RNA, 25 nt, Human
uugucgcucagccuggagugcagug

SEQ ID NO: 38513 - RNA, 22 nt, Human
auacggacguccuuuggugcug

SEQ ID NO: 38514 - RNA, 20 nt, Human
guggacacauuaguaauggu

SEQ ID NO: 38515 - RNA, 23 nt, Human
cacucuccuaggcauucuggacc

SEQ ID NO: 38516 - RNA, 27 nt, Human
acuggcuguucagccuaggcugcacac

SEQ ID NO: 38517 - RNA, 20 nt, Human
ccaaagacacaagcaaccaa

SEQ ID NO: 38518 - RNA, 24 nt, Human
gugaagauggaaggcuggagagaa

SEQ ID NO: 38519 - RNA, 17 nt, Human
cacauacuucuacuuuu

SEQ ID NO: 38520 - RNA, 21 nt, Human
gcccccaggagacacuacccu

SEQ ID NO: 38521 - RNA, 23 nt, Human
cccaggaguucaaagcuguagug

SEQ ID NO: 38522 - RNA, 22 nt, Human
ggagcuaguggagagggagagg

SEQ ID NO: 38523 - RNA, 22 nt, Human
uagauuucucaguucuucuuua

SEQ ID NO: 38524 - RNA, 20 nt, Human
gcgucuccccuuuaaagacu

SEQ ID NO: 38525 - RNA, 24 nt, Human
acccagggguaguggaggacugca

SEQ ID NO: 38526 - RNA, 25 nt, Human
cugccucugugugccccuuugcguc

SEQ ID NO: 38527 - RNA, 25 nt, Human
gccugggcgucaccaugccacagcu

SEQ ID NO: 38528 - RNA, 20 nt, Human
caccauuaagugaucuuuau

SEQ ID NO: 38529 - RNA, 21 nt, Human
accguugggaccaaugccuua

SEQ ID NO: 38530 - RNA, 17 nt, Human
ugauggaggcuugguga

SEQ ID NO: 38531 - RNA, 22 nt, Human
caggacuccggcacuaugagcg

SEQ ID NO: 38532 - RNA, 23 nt, Human
ucuugugccuucugcucucucag

SEQ ID NO: 38533 - RNA, 19 nt, Human
uccucuccuccccuugccc

SEQ ID NO: 38534 - RNA, 22 nt, Human
acacagggcaagacacauacag

SEQ ID NO: 38535 - RNA, 22 nt, Human
uaugguuacuucuucucuuaga

SEQ ID NO: 38536 - RNA, 27 nt, Human
gaguagcugggauuacaggcgcguauc

SEQ ID NO: 38537 - RNA, 23 nt, Human
agccaucacuuaccuugcacuga

SEQ ID NO: 38538 - RNA, 21 nt, Human
uccucaagaucagccaucuug

SEQ ID NO: 38539 - RNA, 26 nt, Human
ucuccggccgggcgccccugccucca

SEQ ID NO: 38540 - RNA, 24 nt, Human
uggaggcagacagggugggcuggg

SEQ ID NO: 38541 - RNA, 21 nt, Human
agcagcauucagcacacccca

SEQ ID NO: 38542 - RNA, 23 nt, Human
uacagaaauucauuaugcugcua

SEQ ID NO: 38543 - RNA, 26 nt, Human
ucccagaucuugaagaaaaucauaua

SEQ ID NO: 38544 - RNA, 22 nt, Human
agguaugccucaccaauuugcc

SEQ ID NO: 38545 - RNA, 23 nt, Human
aacagcaagcagcuucuuuucag

SEQ ID NO: 38546 - RNA, 27 nt, Human
ccauaagcuugcugaauaguguaccgg

SEQ ID NO: 38547 - RNA, 25 nt, Human
uccagaugauuuuuacucccaagga

SEQ ID NO: 38548 - RNA, 26 nt, Human
gagcauggaaaucacuuucauuuccg

SEQ ID NO: 38549 - RNA, 22 nt, Human
cugcuguguucccacagacaga

SEQ ID NO: 38550 - RNA, 26 nt, Human
ggagggcagggagagcaaggggcaag

SEQ ID NO: 38551 - RNA, 27 nt, Human
ugcagcucggguuuccgagcuucugcc

SEQ ID NO: 38552 - RNA, 25 nt, Human
guggaaaaggaagcgacccagaaau

SEQ ID NO: 38553 - RNA, 23 nt, Human
ucccuaggguggggugugagaug

SEQ ID NO: 38554 - RNA, 20 nt, Human
gcucagaaaacagaaauacu

SEQ ID NO: 38555 - RNA, 21 nt, Human
cuccuuccuugggccugccuc

SEQ ID NO: 38556 - RNA, 22 nt, Human
agguugugaugauagcacuggu

SEQ ID NO: 38557 - RNA, 21 nt, Human
ccuguaaucccagcacuuggg

SEQ ID NO: 38558 - RNA, 23 nt, Human
cacugccuagucgggacuuguaa

SEQ ID NO: 38559 - RNA, 22 nt, Human
acaauccagaggaauauuuuua

SEQ ID NO: 38560 - RNA, 22 nt, Human
cagccuaugucuuuauauuguc

SEQ ID NO: 38561 - RNA, 25 nt, Human
gccuugagucuggccaaggagguga

SEQ ID NO: 38562 - RNA, 19 nt, Human
agucuuccuucauccuugc

SEQ ID NO: 38563 - RNA, 23 nt, Human
uucuuuacaaggaguauuguaaa

SEQ ID NO: 38564 - RNA, 22 nt, Human
aaagugcugggauuacggacgu

SEQ ID NO: 38565 - RNA, 21 nt, Human
ucaguaaaugugauucaccuc

SEQ ID NO: 38566 - RNA, 23 nt, Human
ggcucagaaaccgugagagagcc

SEQ ID NO: 38567 - RNA, 27 nt, Human
ucugucacccaggcuggagugaucuca

SEQ ID NO: 38568 - RNA, 25 nt, Human
gugaauuugucccauucccucucug

SEQ ID NO: 38569 - RNA, 24 nt, Human
cugcuuccuccaagcugcugccuc

SEQ ID NO: 38570 - RNA, 27 nt, Human
agggaaagguucaacaaacagggagaa

SEQ ID NO: 38571 - RNA, 19 nt, Human
gcccaggcuggagugcagu

SEQ ID NO: 38572 - RNA, 27 nt, Human
uuugccucccuuaucccacccucgagg

SEQ ID NO: 38573 - RNA, 19 nt, Human
acccaggcuggagugcggu

SEQ ID NO: 38574 - RNA, 23 nt, Human
cucacccaggcuggaaugcagug

SEQ ID NO: 38575 - RNA, 21 nt, Human
gggagaggggagccagagccg

SEQ ID NO: 38576 - RNA, 21 nt, Human
caccucccugguucaagcgau

SEQ ID NO: 38577 - RNA, 26 nt, Human
gguacccgugcugcagucgggcacgc

SEQ ID NO: 38578 - RNA, 30 nt, Human
ugaucacuuuguuaaaaauauuuucugaau

SEQ ID NO: 38579 - RNA, 22 nt, Human
aggcugaggcaggagaauugau

SEQ ID NO: 38580 - RNA, 25 nt, Human
gguggcucacgccuguggucucagc

SEQ ID NO: 38581 - RNA, 27 nt, Human
ggaggcugaggugggaggauggcuugc

SEQ ID NO: 38582 - RNA, 27 nt, Human
auugccucugccucgcuuuaugauguc

SEQ ID NO: 38583 - RNA, 24 nt, Human
gguucucucagcuuguucuugccu

SEQ ID NO: 38584 - RNA, 27 nt, Human
cccuucagacuaucuuucagccuucug

SEQ ID NO: 38585 - RNA, 21 nt, Human
ugucacccccuccucccugau

SEQ ID NO: 38586 - RNA, 24 nt, Human
cccgcgagguggcccccaggcugg

SEQ ID NO: 38587 - RNA, 23 nt, Human
ucucaauguucuuuuccaacaca

SEQ ID NO: 38588 - RNA, 24 nt, Human
ggauccugcacucuuccucccuca

SEQ ID NO: 38589 - RNA, 21 nt, Human
ucccgggaggucuggagcagc

SEQ ID NO: 38590 - RNA, 22 nt, Human
acccaggguggagugcaguggu

SEQ ID NO: 38591 - RNA, 21 nt, Human
uaauucaucuuuaugaagauu

SEQ ID NO: 38592 - RNA, 28 nt, Human
cucuuauuuggggcaguaccaguccaua

SEQ ID NO: 38593 - RNA, 24 nt, Human
gcuccuaauggcucucugaaagug

SEQ ID NO: 38594 - RNA, 21 nt, Human
acuccagccuggugacagagu

SEQ ID NO: 38595 - RNA, 22 nt, Human
uucuuccuagauuuuguuguuu

SEQ ID NO: 38596 - RNA, 22 nt, Human
gaaaccaaggggaaguaauaag

SEQ ID NO: 38597 - RNA, 22 nt, Human
cccaaaauacugggauuacagg

SEQ ID NO: 38598 - RNA, 24 nt, Human
gacagcaucugcagcaguugcuga

SEQ ID NO: 38599 - RNA, 21 nt, Human
ggagagaacaacaggggcugg

SEQ ID NO: 38600 - RNA, 26 nt, Human
aaauguauaccuuugagaacagugcc

SEQ ID NO: 38601 - RNA, 27 nt, Human
ccugcugcugaccuccccuugaggacc

SEQ ID NO: 38602 - RNA, 20 nt, Human
aaauccagaaccaccugccu

SEQ ID NO: 38603 - RNA, 21 nt, Human
gccacucccugcugugugacu

SEQ ID NO: 38604 - RNA, 23 nt, Human
uggagauguaggaaccgaucugc

SEQ ID NO: 38605 - RNA, 22 nt, Human
ccuuuguaagacacacagccuu

SEQ ID NO: 38606 - RNA, 23 nt, Human
ugcuagaaaaauguucuuuaaag

SEQ ID NO: 38607 - RNA, 19 nt, Human
uagaggaacugaauccaaa

SEQ ID NO: 38608 - RNA, 27 nt, Human
ccuucccccugcuucaggcugcugagc

SEQ ID NO: 38609 - RNA, 24 nt, Human
aucuaaucccuucaaggaagugau

SEQ ID NO: 38610 - RNA, 24 nt, Human
aaauggcaaccacuagugugcuca

SEQ ID NO: 38611 - RNA, 21 nt, Human
uuccuccugucuccucuguca

SEQ ID NO: 38612 - RNA, 24 nt, Human
ccagcagcugcugccuuccauucc

SEQ ID NO: 38613 - RNA, 21 nt, Human
ccguccuccucuaccucucuc

SEQ ID NO: 38614 - RNA, 21 nt, Human
ucuuagccuggggccugggga

SEQ ID NO: 38615 - RNA, 22 nt, Human
ugggcagcaguggacuaagugc

SEQ ID NO: 38616 - RNA, 24 nt, Human
gcaccaucucuccuccuuuucaca

SEQ ID NO: 38617 - RNA, 24 nt, Human
cagcuucuccccugggggccugag

SEQ ID NO: 38618 - RNA, 22 nt, Human
cauggaggcagauguggggcug

SEQ ID NO: 38619 - RNA, 23 nt, Human
gcuuugugaaauuuaaaaaauuu

SEQ ID NO: 38620 - RNA, 21 nt, Human
cgguggcggaggcugaggaga

SEQ ID NO: 38621 - RNA, 18 nt, Human
gggaggucucaagagaua

SEQ ID NO: 38622 - RNA, 21 nt, Human
uguaguauuugaauacuguca

SEQ ID NO: 38623 - RNA, 22 nt, Human
cuaaggugggagaauugcuuga

SEQ ID NO: 38624 - RNA, 22 nt, Human
uguuugccccucagucuuuaua

SEQ ID NO: 38625 - RNA, 20 nt, Human
agggaguggaggugcagcga

SEQ ID NO: 38626 - RNA, 22 nt, Human
cugaggcaggaggauuacuuga

SEQ ID NO: 38627 - RNA, 23 nt, Human
aguggaugacuguugaugaagua

SEQ ID NO: 38628 - RNA, 22 nt, Human
ucugagcuggcucacacgugcc

SEQ ID NO: 38629 - RNA, 26 nt, Human
cugucccgcuagugccugcuaggugc

SEQ ID NO: 38630 - RNA, 27 nt, Human
cucuggccccggacucugcuuacccug

SEQ ID NO: 38631 - RNA, 27 nt, Human
aggguucccgggaaagacuggagcagc

SEQ ID NO: 38632 - RNA, 22 nt, Human
cuugccuguaaucccagcacuu

SEQ ID NO: 38633 - RNA, 22 nt, Human
ccaugcauccaucgcugaaggg

SEQ ID NO: 38634 - RNA, 27 nt, Human
gcucugaagaaagugcugucuggcucc

SEQ ID NO: 38635 - RNA, 24 nt, Human
ucugcauaaacccuccuguccugg

SEQ ID NO: 38636 - RNA, 22 nt, Human
gggaagguagccagugccugag

SEQ ID NO: 38637 - RNA, 25 nt, Human
uggguguucauucauuuuguuugac

SEQ ID NO: 38638 - RNA, 26 nt, Human
cuuugggccucaguugcccuggcaga

SEQ ID NO: 38639 - RNA, 25 nt, Human
gccccaggaagaaaaugaugcagcu

SEQ ID NO: 38640 - RNA, 18 nt, Human
gauuuuuagcuguauuug

SEQ ID NO: 38641 - RNA, 21 nt, Human
gcagugagccaagauugugcc

SEQ ID NO: 38642 - RNA, 21 nt, Human
uggaggcggagguugcaguga

SEQ ID NO: 38643 - RNA, 21 nt, Human
guuuagcuucaguacugugac

SEQ ID NO: 38644 - RNA, 22 nt, Human
cccacaucucuacccauccugc

SEQ ID NO: 38645 - RNA, 27 nt, Human
cccuugccucugccugguacccacaug

SEQ ID NO: 38646 - RNA, 17 nt, Human
acgagggagagcgcagc

SEQ ID NO: 38647 - RNA, 23 nt, Human
aacagauaaaaaauguaucugca

SEQ ID NO: 38648 - RNA, 26 nt, Human
caaucaggcccauccaucccaugccu

SEQ ID NO: 38649 - RNA, 21 nt, Human
augcuucacaugguuaaaaac

SEQ ID NO: 38650 - RNA, 23 nt, Human
gaacauauccccaguggauaagg

SEQ ID NO: 38651 - RNA, 23 nt, Human
caucugguuuggccauuccuccu

SEQ ID NO: 38652 - RNA, 21 nt, Human
ggcuggcgcccguaaucccag

SEQ ID NO: 38653 - RNA, 21 nt, Human
cacacuugaaagacgguguuu

SEQ ID NO: 38654 - RNA, 29 nt, Human
ccugggagacugaggagagcauuggcuga

SEQ ID NO: 38655 - RNA, 21 nt, Human
ucugggagccuaaaccaggcu

SEQ ID NO: 38656 - RNA, 20 nt, Human
aaacgcuuugucaugcuucu

SEQ ID NO: 38657 - RNA, 22 nt, Human
gcaucaccuccaccauacucca

SEQ ID NO: 38658 - RNA, 22 nt, Human
uaccaaauacacauuucacauu

SEQ ID NO: 38659 - RNA, 21 nt, Human
aucugaaagaaauaaccaucu

SEQ ID NO: 38660 - RNA, 23 nt, Human
ggcuuuuucucccuccccauguc

SEQ ID NO: 38661 - RNA, 28 nt, Human
gcugcaccccagcgccugggcccgcccc

SEQ ID NO: 38662 - RNA, 22 nt, Human
gcacuucucucccugacugccg

SEQ ID NO: 38663 - RNA, 22 nt, Human
accagcuacgggaagagcuuug

SEQ ID NO: 38664 - RNA, 19 nt, Human
ucuggacugaagccugcag

SEQ ID NO: 38665 - RNA, 23 nt, Human
uagguauuauauuuuggccuuac

SEQ ID NO: 38666 - RNA, 27 nt, Human
gcccagccugccugccgcaccccugug

SEQ ID NO: 38667 - RNA, 22 nt, Human
caaacucaaacuccaaaccuca

SEQ ID NO: 38668 - RNA, 20 nt, Human
ccagccgccccuucgccaag

SEQ ID NO: 38669 - RNA, 21 nt, Human
gucuugcuauguugcccaggc

SEQ ID NO: 38670 - RNA, 21 nt, Human
ccugggcagccccaccuccgc

SEQ ID NO: 38671 - RNA, 23 nt, Human
cccaaaauucuaagagcagcagc

SEQ ID NO: 38672 - RNA, 23 nt, Human
guucaagcgagucuccugccuca

SEQ ID NO: 38673 - RNA, 21 nt, Human
cauccagcagcagcacuuaga

SEQ ID NO: 38674 - RNA, 19 nt, Human
uucuagcauuaaacaaaua

SEQ ID NO: 38675 - RNA, 27 nt, Human
ggagaggggaggggacgggcagggucu

SEQ ID NO: 38676 - RNA, 21 nt, Human
ccugucccugccccaccccau

SEQ ID NO: 38677 - RNA, 21 nt, Human
uccagucuucaaggugcucca

SEQ ID NO: 38678 - RNA, 23 nt, Human
acucugcauccucugucauuuua

SEQ ID NO: 38679 - RNA, 22 nt, Human
aacaaccagagacuacacagga

SEQ ID NO: 38680 - RNA, 26 nt, Human
gacuccgucuccaaaaacaaacaaac

SEQ ID NO: 38681 - RNA, 21 nt, Human
uuccauccagccaaguuuaug

SEQ ID NO: 38682 - RNA, 20 nt, Human
ccagacauuccugcuccgug

SEQ ID NO: 38683 - RNA, 22 nt, Human
aauugaguuuuuccgugaacuu

SEQ ID NO: 38684 - RNA, 29 nt, Human
cugcaugcccugucugugccaugaguguc

SEQ ID NO: 38685 - RNA, 26 nt, Human
cgcggguaaccaugccuagcaaaacc

SEQ ID NO: 38686 - RNA, 19 nt, Human
uuuugcacuugcuuagaag

SEQ ID NO: 38687 - RNA, 22 nt, Human
guuguauuuuggaagacagguu

SEQ ID NO: 38688 - RNA, 28 nt, Human
gggaaaagaauuuucagcaaaguaccaa

SEQ ID NO: 38689 - RNA, 22 nt, Human
ggcguccccacacugaaggucc

SEQ ID NO: 38690 - RNA, 22 nt, Human
ugauggauuuggacaugcuucu

SEQ ID NO: 38691 - RNA, 18 nt, Human
acauugaauggaucaaua

SEQ ID NO: 38692 - RNA, 20 nt, Human
ccccgagcuggcccagcaca

SEQ ID NO: 38693 - RNA, 21 nt, Human
cuagguuuaggcccuuguaca

SEQ ID NO: 38694 - RNA, 22 nt, Human
ugcaacacuuugaggacauuua

SEQ ID NO: 38695 - RNA, 26 nt, Human
cccaaagugcugggauugugggcaug

SEQ ID NO: 38696 - RNA, 20 nt, Human
gccagugcuuucaguaggaa

SEQ ID NO: 38697 - RNA, 22 nt, Human
cagacuggagugcaguggcacg

SEQ ID NO: 38698 - RNA, 22 nt, Human
caggcuggagugcaguggcgcg

SEQ ID NO: 38699 - RNA, 22 nt, Human
cagguuggagugcaguggcgug

SEQ ID NO: 38700 - RNA, 22 nt, Human
caggcuggagugcgguggcgca

SEQ ID NO: 38701 - RNA, 20 nt, Human
gccacccuugucaagggagu

SEQ ID NO: 38702 - RNA, 20 nt, Human
aagaauugguuauuuggggg

SEQ ID NO: 38703 - RNA, 27 nt, Human
gagcugcggaagcccacucaggaggag

SEQ ID NO: 38704 - RNA, 21 nt, Human
uuuccauucccuucacugugg

SEQ ID NO: 38705 - RNA, 25 nt, Human
agauacugugagcuuacauugaaaa

SEQ ID NO: 38706 - RNA, 21 nt, Human
auauuugcuuauuuauauuca

SEQ ID NO: 38707 - RNA, 21 nt, Human
aguaggcuaagagaagacaag

SEQ ID NO: 38708 - RNA, 23 nt, Human
caccauguucccagcucagugcc

SEQ ID NO: 38709 - RNA, 21 nt, Human
auuucuccacauuuuggguac

SEQ ID NO: 38710 - RNA, 30 nt, Human
cagaauauuaaaacauggaauauuuuugcu

SEQ ID NO: 38711 - RNA, 27 nt, Human
uuaccucuucaguguuuucucaugcaa

SEQ ID NO: 38712 - RNA, 26 nt, Human
ccuguucaucugcugacuucugucua

SEQ ID NO: 38713 - RNA, 22 nt, Human
ucucauuuguuuuucucacucc

SEQ ID NO: 38714 - RNA, 32 nt, Human
gcaauccucccaccucagccuccugaguagcu

SEQ ID NO: 38715 - RNA, 26 nt, Human
aagaauuuuuguuuggacuguuuuca

SEQ ID NO: 38716 - RNA, 27 nt, Human
ccuucauuucauaucugacugcaagcu

SEQ ID NO: 38717 - RNA, 21 nt, Human
ccuuggaccaccuucauguua

SEQ ID NO: 38718 - RNA, 24 nt, Human
acugauacuacaacuuuuguuuuc

SEQ ID NO: 38719 - RNA, 23 nt, Human
cuguacauuucacaaaaaggcau

SEQ ID NO: 38720 - RNA, 31 nt, Human
ugcucaccagugccauguucauccacuguga

SEQ ID NO: 38721 - RNA, 24 nt, Human
uuagacuaauugguacaaggaagg

SEQ ID NO: 38722 - RNA, 22 nt, Human
aaagugcugggauuacagaugu

SEQ ID NO: 38723 - RNA, 22 nt, Human
agggugcugagauuacaggugu

SEQ ID NO: 38724 - RNA, 22 nt, Human
aggagcugagggagggagccau

SEQ ID NO: 38725 - RNA, 22 nt, Human
cuccccgcagacgaugccaccu

SEQ ID NO: 38726 - RNA, 21 nt, Human
acuguucaagacacuagaaca

SEQ ID NO: 38727 - RNA, 22 nt, Human
ucaggcuggaguacaguggcau

SEQ ID NO: 38728 - RNA, 22 nt, Human
aacuucucuugcuuucuaugcu

SEQ ID NO: 38729 - RNA, 21 nt, Human
uuuguaaucccagcacuuugg

SEQ ID NO: 38730 - RNA, 22 nt, Human
ccccccagcccucagggagcuc

SEQ ID NO: 38731 - RNA, 23 nt, Human
cccucugcccuguuuuguauacc

SEQ ID NO: 38732 - RNA, 20 nt, Human
agcuuugguguauguguugg

SEQ ID NO: 38733 - RNA, 26 nt, Human
agcuccacgacaaacuuucugccuuc

SEQ ID NO: 38734 - RNA, 22 nt, Human
cccgacugugaccacuugcuca

SEQ ID NO: 38735 - RNA, 21 nt, Human
gagcaaacauaccucccuugu

SEQ ID NO: 38736 - RNA, 22 nt, Human
uugccuccccacugcagccugc

SEQ ID NO: 38737 - RNA, 23 nt, Human
uuuaagggauucuccugccucag

SEQ ID NO: 38738 - RNA, 22 nt, Human
aauagaaaaaugugguuuacaa

SEQ ID NO: 38739 - RNA, 20 nt, Human
uucagugagccaagauugca

SEQ ID NO: 38740 - RNA, 20 nt, Human
gugggaugggacagggaggc

SEQ ID NO: 38741 - RNA, 26 nt, Human
ugacaccucgccccugcucccuccca

SEQ ID NO: 38742 - RNA, 21 nt, Human
ccuuucucucccugcuuugcu

SEQ ID NO: 38743 - RNA, 23 nt, Human
aagacgagcugugcuugaaggaa

SEQ ID NO: 38744 - RNA, 26 nt, Human
guguggcagggaucguugcacuggac

SEQ ID NO: 38745 - RNA, 25 nt, Human
ugguggcacaugccuguaaucccag

SEQ ID NO: 38746 - RNA, 23 nt, Human
ccuaggguaggggcacugcugca

SEQ ID NO: 38747 - RNA, 27 nt, Human
ggcaguuucugguacuccuaugcaaua

SEQ ID NO: 38748 - RNA, 22 nt, Human
uaugucccuuaccugggauuuc

SEQ ID NO: 38749 - RNA, 26 nt, Human
ccuggcaacagagcaagacuccgucu

SEQ ID NO: 38750 - RNA, 27 nt, Human
ucaugccacuccccacuguggccauag

SEQ ID NO: 38751 - RNA, 24 nt, Human
cugccaggaaccucauuuuccugg

SEQ ID NO: 38752 - RNA, 22 nt, Human
cagagcacaggaagagcagugu

SEQ ID NO: 38753 - RNA, 22 nt, Human
uggcgcacaccuguagucccag

SEQ ID NO: 38754 - RNA, 22 nt, Human
uggugcacaccuguaguccuag

SEQ ID NO: 38755 - RNA, 22 nt, Human
ggaggcugagaugagaggauca

SEQ ID NO: 38756 - RNA, 25 nt, Human
ggggcugagaaacaggcugcgguga

SEQ ID NO: 38757 - RNA, 25 nt, Human
cggcgggcagaggugaugucuggga

SEQ ID NO: 38758 - RNA, 26 nt, Human
ccuccacucacugcugugagugcgcc

SEQ ID NO: 38759 - RNA, 21 nt, Human
ggccacacccaccccauuccu

SEQ ID NO: 38760 - RNA, 27 nt, Human
acugccucuacugggcgugcugccaag

SEQ ID NO: 38761 - RNA, 22 nt, Human
ucauuuugacagcaucuuccuc

SEQ ID NO: 38762 - RNA, 26 nt, Human
gaggagggagagaacuaggggcccgc

SEQ ID NO: 38763 - RNA, 22 nt, Human
ccagccaaggacagacuguaga

SEQ ID NO: 38764 - RNA, 21 nt, Human
gcuaaccuuguagcaugugaa

SEQ ID NO: 38765 - RNA, 20 nt, Human
cccaagauucuucagucugg

SEQ ID NO: 38766 - RNA, 24 nt, Human
aggguucaucaucccucccugccu

SEQ ID NO: 38767 - RNA, 26 nt, Human
agaucagugucagauauuguugaggg

SEQ ID NO: 38768 - RNA, 28 nt, Human
ucuguuuuguuuuucccuuuuuucucca

SEQ ID NO: 38769 - RNA, 21 nt, Human
ggaggugggaggagggaguga

SEQ ID NO: 38770 - RNA, 21 nt, Human
acuggggggagggugggcagg

SEQ ID NO: 38771 - RNA, 21 nt, Human
cgaacugcauguauugugcca

SEQ ID NO: 38772 - RNA, 26 nt, Human
uuacuucuaaaaggcauuagccaggc

SEQ ID NO: 38773 - RNA, 22 nt, Human
cacccgaacagaggacaacccu

SEQ ID NO: 38774 - RNA, 26 nt, Human
accaaaacaaauggagaagaaacauc

SEQ ID NO: 38775 - RNA, 17 nt, Human
ugcagugauugguuguc

SEQ ID NO: 38776 - RNA, 24 nt, Human
cuccucgggcugggaaacaggaag

SEQ ID NO: 38777 - RNA, 23 nt, Human
ucugaggucacagggccugggga

SEQ ID NO: 38778 - RNA, 22 nt, Human
cucuuggugugcuucccgugac

SEQ ID NO: 38779 - RNA, 25 nt, Human
auacauacaaccuauguaauuuuua

SEQ ID NO: 38780 - RNA, 23 nt, Human
gggaaauugaugacuuccucaug

SEQ ID NO: 38781 - RNA, 24 nt, Human
ggggaaagauaguggcaacaggca

SEQ ID NO: 38782 - RNA, 28 nt, Human
uguaccuccccugccuugcuguugguca

SEQ ID NO: 38783 - RNA, 27 nt, Human
ggacuugugugaccugcuuugaaaugu

SEQ ID NO: 38784 - RNA, 26 nt, Human
uugucuuuacuuuuaaaaguaauacu

SEQ ID NO: 38785 - RNA, 22 nt, Human
gugguuuagggcucagagcucc

SEQ ID NO: 38786 - RNA, 20 nt, Human
ugaccaggagcuacuuugag

SEQ ID NO: 38787 - RNA, 27 nt, Human
gacuucucaauaaucaaugaaguagcu

SEQ ID NO: 38788 - RNA, 22 nt, Human
gcagguggaucgccugagguca

SEQ ID NO: 38789 - RNA, 17 nt, Human
uuucccugcugaaugcc

SEQ ID NO: 38790 - RNA, 21 nt, Human
gcccaccaaccaaguguuaca

SEQ ID NO: 38791 - RNA, 22 nt, Human
guugagaacauccauucauucu

SEQ ID NO: 38792 - RNA, 21 nt, Human
uacugcuccaggcauuuuauu

SEQ ID NO: 38793 - RNA, 21 nt, Human
ccaaguaccugccgguuugcu

SEQ ID NO: 38794 - RNA, 27 nt, Human
gaggcccagagucuaagacugcaguga

SEQ ID NO: 38795 - RNA, 23 nt, Human
uuccacugggcaguugagguggc

SEQ ID NO: 38796 - RNA, 22 nt, Human
aaacuccugaccucaggugauc

SEQ ID NO: 38797 - RNA, 25 nt, Human
ugcugcaucccaccagccugagcaa

SEQ ID NO: 38798 - RNA, 27 nt, Human
ugguggcacaggcacugaacaggcugg

SEQ ID NO: 38799 - RNA, 24 nt, Human
ucuuggcugugugucugcggaucu

SEQ ID NO: 38800 - RNA, 25 nt, Human
ucccacauacccagaggagagcaua

SEQ ID NO: 38801 - RNA, 26 nt, Human
ggaggcaccuggaacccguggcaagc

SEQ ID NO: 38802 - RNA, 19 nt, Human
aggagaggacauggagggg

SEQ ID NO: 38803 - RNA, 26 nt, Human
uugggucccugagagcugugagaagg

SEQ ID NO: 38804 - RNA, 25 nt, Human
gccccugcaaggcgcucaaugggaa

SEQ ID NO: 38805 - RNA, 23 nt, Human
ucuguacaaaugugcagcgaaau

SEQ ID NO: 38806 - RNA, 22 nt, Human
caaaaaguuaaaaaucagcugg

SEQ ID NO: 38807 - RNA, 22 nt, Human
uagcuuuguucauugcauuuau

SEQ ID NO: 38808 - RNA, 21 nt, Human
ccugcuguuugccccucaguc

SEQ ID NO: 38809 - RNA, 24 nt, Human
gccacucucagagacucccaggag

SEQ ID NO: 38810 - RNA, 22 nt, Human
ucucccacucuacugaaacccg

SEQ ID NO: 38811 - RNA, 21 nt, Human
cgguuguuucuuucuuucuua

SEQ ID NO: 38812 - RNA, 21 nt, Human
ucaccgaggcuggagugcagu

SEQ ID NO: 38813 - RNA, 22 nt, Human
ucacuagugccuaaauguagua

SEQ ID NO: 38814 - RNA, 21 nt, Human
aauucugagcuauggcugcuu

SEQ ID NO: 38815 - RNA, 24 nt, Human
ggacuuuagaaucuggcacacaac

SEQ ID NO: 38816 - RNA, 23 nt, Human
ggguuuuaccaccgucugucuca

SEQ ID NO: 38817 - RNA, 23 nt, Human
agguuccacagaggacacagaga

SEQ ID NO: 38818 - RNA, 23 nt, Human
ggagauggaaaaggaguucgagc

SEQ ID NO: 38819 - RNA, 24 nt, Human
auccuguuucuugcucugagugcu

SEQ ID NO: 38820 - RNA, 22 nt, Human
uggaucgcaccuguaaucccag

SEQ ID NO: 38821 - RNA, 22 nt, Human
ggggugagaaguacagggcaga

SEQ ID NO: 38822 - RNA, 22 nt, Human
aggcuggagugcaauggcguaa

SEQ ID NO: 38823 - RNA, 22 nt, Human
ccacugcacucuagccggagug

SEQ ID NO: 38824 - RNA, 25 nt, Human
ggaccugguggggagggagggcuuu

SEQ ID NO: 38825 - RNA, 27 nt, Human
cugcccucucuggugccuguggagaug

SEQ ID NO: 38826 - RNA, 27 nt, Human
cgucauggcgcuccuccgcagccuggg

SEQ ID NO: 38827 - RNA, 23 nt, Human
cuggucauagaggaagagcuaga

SEQ ID NO: 38828 - RNA, 23 nt, Human
ucucacaaguuauuucauucaua

SEQ ID NO: 38829 - RNA, 22 nt, Human
accuguaagcccagcauuugag

SEQ ID NO: 38830 - RNA, 26 nt, Human
uuacugagauuucucaguuguaaaac

SEQ ID NO: 38831 - RNA, 25 nt, Human
uugagccucagugauccuguggccg

SEQ ID NO: 38832 - RNA, 22 nt, Human
uaagugcugggauugcaggcgu

SEQ ID NO: 38833 - RNA, 27 nt, Human
ucaucccucgugcacauccuguugugu

SEQ ID NO: 38834 - RNA, 21 nt, Human
acaauucccugcugucgucuu

SEQ ID NO: 38835 - RNA, 22 nt, Human
cagagugggguagguugggaga

SEQ ID NO: 38836 - RNA, 22 nt, Human
cacugcacuccggccugaugac

SEQ ID NO: 38837 - RNA, 24 nt, Human
gacuuugccucuucuccugccuca

SEQ ID NO: 38838 - RNA, 22 nt, Human
aaugaagcugguugaguguggg

SEQ ID NO: 38839 - RNA, 21 nt, Human
cgguccucggacucacuaugg

SEQ ID NO: 38840 - RNA, 22 nt, Human
auccauucaacaaguauuugcu

SEQ ID NO: 38841 - RNA, 22 nt, Human
cagcaccaccauuuaauuucau

SEQ ID NO: 38842 - RNA, 20 nt, Human
auggaaaucauauacauuag

SEQ ID NO: 38843 - RNA, 25 nt, Human
ugagcauuugacuucccuuacucuu

SEQ ID NO: 38844 - RNA, 22 nt, Human
ggcucacugcaaccucugcccc

SEQ ID NO: 38845 - RNA, 22 nt, Human
ggcucacugcaaucucugccuc

SEQ ID NO: 38846 - RNA, 19 nt, Human
gguugcagugagccaggau

SEQ ID NO: 38847 - RNA, 27 nt, Human
ccugcucccaguaccucugcuccaggg

SEQ ID NO: 38848 - RNA, 19 nt, Human
ucagcucuuguaauacuca

SEQ ID NO: 38849 - RNA, 26 nt, Human
uuccugccauagacuuccugccuugg

SEQ ID NO: 38850 - RNA, 26 nt, Human
ugugagccaccgcugccagcacagag

SEQ ID NO: 38851 - RNA, 22 nt, Human
gggcccaggaguuugaggcugc

SEQ ID NO: 38852 - RNA, 21 nt, Human
accaugccagugcagauucaa

SEQ ID NO: 38853 - RNA, 22 nt, Human
gucucuauuuaugagaucacug

SEQ ID NO: 38854 - RNA, 27 nt, Human
uggaaauugaucauuuucaguuguuca

SEQ ID NO: 38855 - RNA, 23 nt, Human
ucucacuuugacacccaggcugg

SEQ ID NO: 38856 - RNA, 23 nt, Human
gccuuggccgcauaggcccagcc

SEQ ID NO: 38857 - RNA, 22 nt, Human
ccccacagcccugcucauuccu

SEQ ID NO: 38858 - RNA, 23 nt, Human
cuggcacaagcucagcacaugcc

SEQ ID NO: 38859 - RNA, 18 nt, Human
uugcccaggcuggggugc

SEQ ID NO: 38860 - RNA, 27 nt, Human
gacacaaaagcaaguuugauuuuugca

SEQ ID NO: 38861 - RNA, 27 nt, Human
cagauccaaugaaccagcagcuggaau

SEQ ID NO: 38862 - RNA, 22 nt, Human
gucuuuuggauggguugggaga

SEQ ID NO: 38863 - RNA, 22 nt, Human
gcuugggugaauuucaggggaa

SEQ ID NO: 38864 - RNA, 19 nt, Human
cagaggggaaaccagugua

SEQ ID NO: 38865 - RNA, 23 nt, Human
gaguuucuuuaagaaacuucauc

SEQ ID NO: 38866 - RNA, 24 nt, Human
cgggaggcggcagcggcugcagcg

SEQ ID NO: 38867 - RNA, 22 nt, Human
auugcuugaacccaggaggugg

SEQ ID NO: 38868 - RNA, 21 nt, Human
aagccgccaccgugcccagcu

SEQ ID NO: 38869 - RNA, 24 nt, Human
uccacccgauccuggagagcugug

SEQ ID NO: 38870 - RNA, 19 nt, Human
ugcaucuguaacccagcua

SEQ ID NO: 38871 - RNA, 25 nt, Human
acacauuuaacgacagaagguugcc

SEQ ID NO: 38872 - RNA, 31 nt, Human
ucacauuacaucagacaucucuuuaugcaug

SEQ ID NO: 38873 - RNA, 27 nt, Human
gcucggccugugagccccguuccuacc

SEQ ID NO: 38874 - RNA, 21 nt, Human
caucuggagaguccaggagag

SEQ ID NO: 38875 - RNA, 21 nt, Human
gcccugugcugaacuugcugu

SEQ ID NO: 38876 - RNA, 24 nt, Human
gggugccuguaaucccagcuacug

SEQ ID NO: 38877 - RNA, 21 nt, Human
gccagcuuacuagcacuuuga

SEQ ID NO: 38878 - RNA, 27 nt, Human
aggcagggagcagccgccccaucugcc

SEQ ID NO: 38879 - RNA, 25 nt, Human
cccucucuggcguccccggcugcuu

SEQ ID NO: 38880 - RNA, 26 nt, Human
uccccauuccuugccugucaggacca

SEQ ID NO: 38881 - RNA, 27 nt, Human
uauucagcauuaaagaugaaucucaga

SEQ ID NO: 38882 - RNA, 24 nt, Human
aaccuucaugaugaauuacuucuu

SEQ ID NO: 38883 - RNA, 19 nt, Human
ggagagggauuggaguacc

SEQ ID NO: 38884 - RNA, 23 nt, Human
agagcaagaggucaagagcugug

SEQ ID NO: 38885 - RNA, 15 nt, Human
aguccuaggaaauua

SEQ ID NO: 38886 - RNA, 22 nt, Human
uggggccucuuccuggaugugc

SEQ ID NO: 38887 - RNA, 26 nt, Human
agaguguuuuuucugucauuucuacu

SEQ ID NO: 38888 - RNA, 22 nt, Human
cagugcaggcucuggagccaga

SEQ ID NO: 38889 - RNA, 27 nt, Human
cugagucuaccauuuucuugcucuccc

SEQ ID NO: 38890 - RNA, 27 nt, Human
uugcugcauaucagcaguuggauguuc

SEQ ID NO: 38891 - RNA, 23 nt, Human
uacuccagagcaaccaagcaauu

SEQ ID NO: 38892 - RNA, 27 nt, Human
auaaagugccucggacaguccgcaguu

SEQ ID NO: 38893 - RNA, 22 nt, Human
acaaucauagcucgcugcagcc

SEQ ID NO: 38894 - RNA, 22 nt, Human
agcuguacugaguucucaucca

SEQ ID NO: 38895 - RNA, 28 nt, Human
ucaucccaggcuugcugcaggguuauga

SEQ ID NO: 38896 - RNA, 25 nt, Human
ucaacuguuuucauuuaagggaaag

SEQ ID NO: 38897 - RNA, 19 nt, Human
cagccugacuuucucucca

SEQ ID NO: 38898 - RNA, 26 nt, Human
accuacucuaucagagaaaaacagga

SEQ ID NO: 38899 - RNA, 23 nt, Human
cuggggugcagaggaggcccaga

SEQ ID NO: 38900 - RNA, 27 nt, Human
uccccccucaguuucugaaaugauucu

SEQ ID NO: 38901 - RNA, 23 nt, Human
agaccuacaggcugacguuccgg

SEQ ID NO: 38902 - RNA, 22 nt, Human
aaacuauuuuaaagcugacuuu

SEQ ID NO: 38903 - RNA, 27 nt, Human
cccugcucuuccucagcuguguggguc

SEQ ID NO: 38904 - RNA, 28 nt, Human
uucaugcccauuaugucuuagaggugcu

SEQ ID NO: 38905 - RNA, 23 nt, Human
cuucucgugccuccccaccacca

SEQ ID NO: 38906 - RNA, 19 nt, Human
ccuugggccucaccuccuc

SEQ ID NO: 38907 - RNA, 22 nt, Human
cccugcccuguugcucgugggu

SEQ ID NO: 38908 - RNA, 24 nt, Human
cccuauuaaagaaaccacaggguu

SEQ ID NO: 38909 - RNA, 24 nt, Human
ugggagccgcggcggccuggggaa

SEQ ID NO: 38910 - RNA, 26 nt, Human
gucugucacccuccuuuccugcuccc

SEQ ID NO: 38911 - RNA, 20 nt, Human
uugcuguacauguacuccaa

SEQ ID NO: 38912 - RNA, 30 nt, Human
ggcuggauuuugguucccuuguaaagacag

SEQ ID NO: 38913 - RNA, 22 nt, Human
agccuccucaacuaugaccuca

SEQ ID NO: 38914 - RNA, 23 nt, Human
cagaugcacaaauugugcaguga

SEQ ID NO: 38915 - RNA, 24 nt, Human
ccaagaaagaaaccagacccugua

SEQ ID NO: 38916 - RNA, 22 nt, Human
cagcacuuugggaggcugagau

SEQ ID NO: 38917 - RNA, 26 nt, Human
gugaagccacaggagccccaccccca

SEQ ID NO: 38918 - RNA, 21 nt, Human
uuuggagauacuugagcugag

SEQ ID NO: 38919 - RNA, 21 nt, Human
ggaggcagagggcaagggagg

SEQ ID NO: 38920 - RNA, 20 nt, Human
cugaaucucccaguguucag

SEQ ID NO: 38921 - RNA, 21 nt, Human
caccuguagucccagcacuuu

SEQ ID NO: 38922 - RNA, 21 nt, Human
gggaauuguccucuguggaag

SEQ ID NO: 38923 - RNA, 23 nt, Human
ucccugccacuucaacccccagc

SEQ ID NO: 38924 - RNA, 21 nt, Human
ccccgcucuggauccugcacu

SEQ ID NO: 38925 - RNA, 23 nt, Human
aucgcgccacugcacuccagccu

SEQ ID NO: 38926 - RNA, 26 nt, Human
cugagggcuuuguucaucuggucauc

SEQ ID NO: 38927 - RNA, 22 nt, Human
ugugccuccagacuaugcagcu

SEQ ID NO: 38928 - RNA, 24 nt, Human
cacaaacaccccaccuuccacucg

SEQ ID NO: 38929 - RNA, 25 nt, Human
ccacaaacgagcucccagacaugua

SEQ ID NO: 38930 - RNA, 22 nt, Human
caggaguuugagccuucaguga

SEQ ID NO: 38931 - RNA, 24 nt, Human
cuacacagaagcuucaaauuccuc

SEQ ID NO: 38932 - RNA, 22 nt, Human
gccagccuggccaacauggcga

SEQ ID NO: 38933 - RNA, 22 nt, Human
ucgcccaggcucaagugauucu

SEQ ID NO: 38934 - RNA, 27 nt, Human
gggccccaccucagaucaaagcagcuc

SEQ ID NO: 38935 - RNA, 21 nt, Human
ccagggagguggcccaggaag

SEQ ID NO: 38936 - RNA, 23 nt, Human
gcuaggcugcaacuuuaucucau

SEQ ID NO: 38937 - RNA, 26 nt, Human
acaggcuggggccuggauucugaggc

SEQ ID NO: 38938 - RNA, 22 nt, Human
gaacccaggagcaguugggagu

SEQ ID NO: 38939 - RNA, 25 nt, Human
ggggccggcccugugugcagguucc

SEQ ID NO: 38940 - RNA, 25 nt, Human
cgaaguccugaagcugggcggcagu

SEQ ID NO: 38941 - RNA, 23 nt, Human
caaaaaguuuaaaaaugcauaaa

SEQ ID NO: 38942 - RNA, 20 nt, Human
uaaaagcauaauuuaauagc

SEQ ID NO: 38943 - RNA, 29 nt, Human
ggcucgggguggagcuagggugggggcug

SEQ ID NO: 38944 - RNA, 20 nt, Human
ucggcucugcccucugugac

SEQ ID NO: 38945 - RNA, 21 nt, Human
caugaucugaaagguguggaa

SEQ ID NO: 38946 - RNA, 22 nt, Human
ucccucuggcuccagagcucag

SEQ ID NO: 38947 - RNA, 21 nt, Human
ugggaaagcuuucauuagaaa

SEQ ID NO: 38948 - RNA, 22 nt, Human
uccaccccacucacucgcuccu

SEQ ID NO: 38949 - RNA, 21 nt, Human
cuuugagcgaucucucacaug

SEQ ID NO: 38950 - RNA, 21 nt, Human
agcuaauuuuuuauuuuguag

SEQ ID NO: 38951 - RNA, 24 nt, Human
caaccaaagaugcuuaaaaaccuu

SEQ ID NO: 38952 - RNA, 27 nt, Human
uucuggcuuuucagcuguucuuuguag

SEQ ID NO: 38953 - RNA, 25 nt, Human
cuccugaauuuuuaaugcagaaguu

SEQ ID NO: 38954 - RNA, 24 nt, Human
aaggaugaaggacaguuuuuuccu

SEQ ID NO: 38955 - RNA, 22 nt, Human
ccauuaguggcagcaucaugua

SEQ ID NO: 38956 - RNA, 22 nt, Human
uacaaaauguugaccucagguc

SEQ ID NO: 38957 - RNA, 27 nt, Human
accagccucgguugacguggaugcgcg

SEQ ID NO: 38958 - RNA, 20 nt, Human
ccagggcuggccaggguugu

SEQ ID NO: 38959 - RNA, 21 nt, Human
aaucugguauccaagcuuaaa

SEQ ID NO: 38960 - RNA, 21 nt, Human
ucauucuauaggaucauguga

SEQ ID NO: 38961 - RNA, 24 nt, Human
ggcauggucaaaggcucaaaccuu

SEQ ID NO: 38962 - RNA, 22 nt, Human
uaagagcccugagcccagaaaa

SEQ ID NO: 38963 - RNA, 21 nt, Human
cucccugcacuaaccagcuuu

SEQ ID NO: 38964 - RNA, 21 nt, Human
aacagcuuugucuccaaagaa

SEQ ID NO: 38965 - RNA, 22 nt, Human
auucaggcuggagugcaguggu

SEQ ID NO: 38966 - RNA, 20 nt, Human
gcacuuuuccaggcuuuuua

SEQ ID NO: 38967 - RNA, 20 nt, Human
augugagccaggauggucuc

SEQ ID NO: 38968 - RNA, 22 nt, Human
aucacuugaacccgggcagcgg

SEQ ID NO: 38969 - RNA, 23 nt, Human
ccaaauugcugggauuuacaggc

SEQ ID NO: 38970 - RNA, 23 nt, Human
ccucgguuucccuguccuugccc

SEQ ID NO: 38971 - RNA, 25 nt, Human
guuuucuccccuucuccggaaggcu

SEQ ID NO: 38972 - RNA, 22 nt, Human
ugggcuccuggggcucagccua

SEQ ID NO: 38973 - RNA, 22 nt, Human
ggagaaggagaggaacgggcag

SEQ ID NO: 38974 - RNA, 22 nt, Human
agcagcaucuccaccugccauc

SEQ ID NO: 38975 - RNA, 26 nt, Human
ggauggaagaaagaagccauugaaaa

SEQ ID NO: 38976 - RNA, 22 nt, Human
uguuacaaacaauaaugcguca

SEQ ID NO: 38977 - RNA, 22 nt, Human
cccugggccucaguuuccccau

SEQ ID NO: 38978 - RNA, 26 nt, Human
ccugccugucucuaguuucucucaca

SEQ ID NO: 38979 - RNA, 22 nt, Human
gagguggcaagagaagggcuga

SEQ ID NO: 38980 - RNA, 23 nt, Human
uuaacucccuaguuacccacccu

SEQ ID NO: 38981 - RNA, 27 nt, Human
gcuccaaaacucugggcucagcugcuc

SEQ ID NO: 38982 - RNA, 20 nt, Human
uccaacuggugggaacugga

SEQ ID NO: 38983 - RNA, 22 nt, Human
ggagagaaggggcccucccagc

SEQ ID NO: 38984 - RNA, 23 nt, Human
aaucuuuuuuauuauccuucaca

SEQ ID NO: 38985 - RNA, 22 nt, Human
cuucccuucacucaagcuuggc

SEQ ID NO: 38986 - RNA, 23 nt, Human
ggcuucuguuugucagucucaua

SEQ ID NO: 38987 - RNA, 22 nt, Human
cccaaaggcaucccagccuggg

SEQ ID NO: 38988 - RNA, 25 nt, Human
cugggugcauaucauccaggauaau

SEQ ID NO: 38989 - RNA, 27 nt, Human
cugguaugaauauauaacucagcuggc

SEQ ID NO: 38990 - RNA, 25 nt, Human
gccgaagacaaaugacaggauuaug

SEQ ID NO: 38991 - RNA, 24 nt, Human
uggagggagagcagaggccuuugc

SEQ ID NO: 38992 - RNA, 21 nt, Human
uuuucucuucaacaguaacug

SEQ ID NO: 38993 - RNA, 20 nt, Human
ggaggaaggccagaggaaca

SEQ ID NO: 38994 - RNA, 20 nt, Human
gggaaaggaaagaaguugua

SEQ ID NO: 38995 - RNA, 26 nt, Human
ccugccugccucccucccccugcuag

SEQ ID NO: 38996 - RNA, 20 nt, Human
aaagugcuggcugcaggauu

SEQ ID NO: 38997 - RNA, 21 nt, Human
gguggagagguuugucucagc

SEQ ID NO: 38998 - RNA, 25 nt, Human
ccugcuguaugaaaagcuucuuggc

SEQ ID NO: 38999 - RNA, 26 nt, Human
uguuuuucuucaguugugccucuucc

SEQ ID NO: 39000 - RNA, 27 nt, Human
gcccaggaugcugaaagcagauuucuu

SEQ ID NO: 39001 - RNA, 21 nt, Human
uaauuaguuccaguuucuccu

SEQ ID NO: 39002 - RNA, 26 nt, Human
caaugccauuucaguggcuucccagc

SEQ ID NO: 39003 - RNA, 20 nt, Human
auaacauccugcuccauucc

SEQ ID NO: 39004 - RNA, 19 nt, Human
cccaacugaaacaccagaa

SEQ ID NO: 39005 - RNA, 18 nt, Human
ccccucucccugccaccc

SEQ ID NO: 39006 - RNA, 24 nt, Human
gauuuauaaagcaaauuacuccaa

SEQ ID NO: 39007 - RNA, 18 nt, Human
uugcccaggcuggaguuc

SEQ ID NO: 39008 - RNA, 18 nt, Human
gugcccaggcuggagugc

SEQ ID NO: 39009 - RNA, 27 nt, Human
ugaagaacguggcgaaaccccguaucu

SEQ ID NO: 39010 - RNA, 19 nt, Human
gaagugcuggguugggaag

SEQ ID NO: 39011 - RNA, 25 nt, Human
cugccuugugccuggcacucugccg

SEQ ID NO: 39012 - RNA, 20 nt, Human
gaaaucccuccugauuguag

SEQ ID NO: 39013 - RNA, 26 nt, Human
gccgcccgccugucacugcagcugcc

SEQ ID NO: 39014 - RNA, 22 nt, Human
augauuuuggcucacugcagcc

SEQ ID NO: 39015 - RNA, 26 nt, Human
aaaauuacaaaaauuagccgagcaug

SEQ ID NO: 39016 - RNA, 23 nt, Human
ccuucacuuagcaccugccucag

SEQ ID NO: 39017 - RNA, 24 nt, Human
ccccuccucccuuuuuccuugucc

SEQ ID NO: 39018 - RNA, 21 nt, Human
gagaaagaguggauuucagcc

SEQ ID NO: 39019 - RNA, 23 nt, Human
gcgccagccgcagccacagccgc

SEQ ID NO: 39020 - RNA, 22 nt, Human
ccuacucucacacugguucuca

SEQ ID NO: 39021 - RNA, 17 nt, Human
cccgcaaggcaggcugg

SEQ ID NO: 39022 - RNA, 22 nt, Human
auuuuuccaacagcuaaacuac

SEQ ID NO: 39023 - RNA, 24 nt, Human
uucacaccacugccauuuccuccu

SEQ ID NO: 39024 - RNA, 22 nt, Human
ccucacugcaacgccugccucu

SEQ ID NO: 39025 - RNA, 20 nt, Human
ucagaguaacaugccagcuu

SEQ ID NO: 39026 - RNA, 26 nt, Human
uggaaagaggcucuggacagcagaag

SEQ ID NO: 39027 - RNA, 19 nt, Human
uucugcugcucucguggcc

SEQ ID NO: 39028 - RNA, 20 nt, Human
uaguauuuguaucacuguac

SEQ ID NO: 39029 - RNA, 23 nt, Human
ucacucgaacccgggaggcagag

SEQ ID NO: 39030 - RNA, 22 nt, Human
cuguuucugaauaauagaaauc

SEQ ID NO: 39031 - RNA, 22 nt, Human
uuucaagucuccucagucauca

SEQ ID NO: 39032 - RNA, 27 nt, Human
ggugugaggacaagaaugcaaauggcu

SEQ ID NO: 39033 - RNA, 23 nt, Human
guggcccggaccgcagugcccca

SEQ ID NO: 39034 - RNA, 25 nt, Human
cgcuggagugcaccagucuugggga

SEQ ID NO: 39035 - RNA, 23 nt, Human
ucuuggccagagcugaguggcag

SEQ ID NO: 39036 - RNA, 23 nt, Human
acaaucuuuuucuaguuaagugu

SEQ ID NO: 39037 - RNA, 27 nt, Human
uucuaaccuugauagaagaaccuuggg

SEQ ID NO: 39038 - RNA, 21 nt, Human
guugugggcugccuuuguuug

SEQ ID NO: 39039 - RNA, 22 nt, Human
guacucaguaagacagugcagu

SEQ ID NO: 39040 - RNA, 24 nt, Human
cgucuccaggacccagagcuguuc

SEQ ID NO: 39041 - RNA, 20 nt, Human
gauuggaauccgcacuggau

SEQ ID NO: 39042 - RNA, 21 nt, Human
guucucuggguagguguugaa

SEQ ID NO: 39043 - RNA, 26 nt, Human
guguugcagugaaccaagaucacacc

SEQ ID NO: 39044 - RNA, 21 nt, Human
gccgaugugcauaucaacauu

SEQ ID NO: 39045 - RNA, 26 nt, Human
gccagcacgccuggcuaauuuuuugu

SEQ ID NO: 39046 - RNA, 21 nt, Human
guacauacauauuuuuaaacc

SEQ ID NO: 39047 - RNA, 20 nt, Human
uuucuaugcugaagucuuuu

SEQ ID NO: 39048 - RNA, 30 nt, Human
cuugcugucuuuugugccucugcaagcuac

SEQ ID NO: 39049 - RNA, 22 nt, Human
cggaggggagcaggaaugcugc

SEQ ID NO: 39050 - RNA, 19 nt, Human
gccuccaaggaaccugaca

SEQ ID NO: 39051 - RNA, 22 nt, Human
ggcacaugcuuccacuccaucc

SEQ ID NO: 39052 - RNA, 21 nt, Human
agaaauuuaugauuugccaga

SEQ ID NO: 39053 - RNA, 24 nt, Human
uggaucccaggggcuuaucucuuc

SEQ ID NO: 39054 - RNA, 23 nt, Human
cggcagaggcagagaugggagug

SEQ ID NO: 39055 - RNA, 22 nt, Human
uccaccagcuggggagcuagag

SEQ ID NO: 39056 - RNA, 21 nt, Human
gcaguuuuucucuugaaggau

SEQ ID NO: 39057 - RNA, 23 nt, Human
uaucugucuuuuaauugguguuu

SEQ ID NO: 39058 - RNA, 27 nt, Human
cccugcaggagcuucccaagcugguca

SEQ ID NO: 39059 - RNA, 23 nt, Human
ucucgagcuccugaccucaggug

SEQ ID NO: 39060 - RNA, 21 nt, Human
guauguacuuagcuguacuau

SEQ ID NO: 39061 - RNA, 27 nt, Human
ccaggaggaccaggggugcagacagaa

SEQ ID NO: 39062 - RNA, 21 nt, Human
gccauugacuucuucccaaga

SEQ ID NO: 39063 - RNA, 24 nt, Human
uccaggccccugaugcuccaaccu

SEQ ID NO: 39064 - RNA, 25 nt, Human
ucguuuaucauuucagaaauugcug

SEQ ID NO: 39065 - RNA, 22 nt, Human
uauugcuucuuuuuggagagug

SEQ ID NO: 39066 - RNA, 28 nt, Human
cuguccucuggaucacagacacugcaca

SEQ ID NO: 39067 - RNA, 22 nt, Human
gagcucuugaucucaagcgauc

SEQ ID NO: 39068 - RNA, 20 nt, Human
ugaccucagugaauucugug

SEQ ID NO: 39069 - RNA, 20 nt, Human
ggcacacacaccuccauuca

SEQ ID NO: 39070 - RNA, 24 nt, Human
ccuccuggaaggcagccaggcugg

SEQ ID NO: 39071 - RNA, 20 nt, Human
ucccuacggcuuccuccgca

SEQ ID NO: 39072 - RNA, 27 nt, Human
ccaagccccucagggcccagaccuucc

SEQ ID NO: 39073 - RNA, 21 nt, Human
ggaaacaaagcccaaauguuu

SEQ ID NO: 39074 - RNA, 23 nt, Human
caccucucggugggacagagcag

SEQ ID NO: 39075 - RNA, 26 nt, Human
cccagccaucuacaagaucugaauuc

SEQ ID NO: 39076 - RNA, 21 nt, Human
auuauuuagaaacaauguguc

SEQ ID NO: 39077 - RNA, 22 nt, Human
gcaaaagccucucucagcccac

SEQ ID NO: 39078 - RNA, 25 nt, Human
guuguuuaccaggcacuguguguag

SEQ ID NO: 39079 - RNA, 24 nt, Human
agucuccgguguguaccucagacu

SEQ ID NO: 39080 - RNA, 23 nt, Human
cuuaauaaaaaacagucgauugg

SEQ ID NO: 39081 - RNA, 22 nt, Human
ugcagcuccaggggcucgacuu

SEQ ID NO: 39082 - RNA, 23 nt, Human
aaugggaggcuguggagccggcg

SEQ ID NO: 39083 - RNA, 24 nt, Human
ugcccuguccuccagcuuccccuc

SEQ ID NO: 39084 - RNA, 19 nt, Human
ggcagcugucucaaaccuc

SEQ ID NO: 39085 - RNA, 27 nt, Human
cccagcaccugcuacagugagcugcca

SEQ ID NO: 39086 - RNA, 19 nt, Human
ucccaugagagugcauacc

SEQ ID NO: 39087 - RNA, 17 nt, Human
agcuaaaugaccaucca

SEQ ID NO: 39088 - RNA, 20 nt, Human
cacagccgcucacuccccgu

SEQ ID NO: 39089 - RNA, 22 nt, Human
auguggcaaccuguucuuccua

SEQ ID NO: 39090 - RNA, 24 nt, Human
caugauuaauuuaaaaaguauuua

SEQ ID NO: 39091 - RNA, 26 nt, Human
uucauuucuuaagcuuuuaaaauuca

SEQ ID NO: 39092 - RNA, 26 nt, Human
gcugacgggacccagcuguagugagg

SEQ ID NO: 39093 - RNA, 21 nt, Human
agccagugucuaggcacugag

SEQ ID NO: 39094 - RNA, 25 nt, Human
gaagcugaagauaaccuugaugauu

SEQ ID NO: 39095 - RNA, 21 nt, Human
gagagcuucagccaucacgag

SEQ ID NO: 39096 - RNA, 23 nt, Human
cuuccaaacuccugggccuccga

SEQ ID NO: 39097 - RNA, 23 nt, Human
agcaccccacacuggagccaucu

SEQ ID NO: 39098 - RNA, 22 nt, Human
caggccaggauggagcccaggg

SEQ ID NO: 39099 - RNA, 19 nt, Human
agaaaacaaggauaugcuu

SEQ ID NO: 39100 - RNA, 20 nt, Human
uugcccagccugggggagug

SEQ ID NO: 39101 - RNA, 21 nt, Human
cauaccaucacuuggcaauuu

SEQ ID NO: 39102 - RNA, 21 nt, Human
uggaggugggguugggauugg

SEQ ID NO: 39103 - RNA, 25 nt, Human
aucccuugccuauuuucaucuugcu

SEQ ID NO: 39104 - RNA, 26 nt, Human
caugccacuaaccacaagcaagcugg

SEQ ID NO: 39105 - RNA, 25 nt, Human
gagguuagaugggaggaugaauugu

SEQ ID NO: 39106 - RNA, 27 nt, Human
ugucauuguuuuaucagugcuaaugug

SEQ ID NO: 39107 - RNA, 25 nt, Human
cccuuccucccccucauugaggacu

SEQ ID NO: 39108 - RNA, 22 nt, Human
ccacaaaccuaguacgacuuca

SEQ ID NO: 39109 - RNA, 22 nt, Human
uuuccaaaaauaugaaaacuug

SEQ ID NO: 39110 - RNA, 24 nt, Human
cagggcugaaagcuuuuauucuuu

SEQ ID NO: 39111 - RNA, 23 nt, Human
cgccuguaaucucagcuacucag

SEQ ID NO: 39112 - RNA, 23 nt, Human
cauucccuagauagagauacuuu

SEQ ID NO: 39113 - RNA, 26 nt, Human
ggucuuacuccagcccuuccugggug

SEQ ID NO: 39114 - RNA, 23 nt, Human
uguagaucccaagaugacugggg

SEQ ID NO: 39115 - RNA, 19 nt, Human
aauauccgcuacacagguu

SEQ ID NO: 39116 - RNA, 27 nt, Human
uucaagcuaacuacuuacccuuuaaac

SEQ ID NO: 39117 - RNA, 23 nt, Human
ccugugcauggucugaccccagg

SEQ ID NO: 39118 - RNA, 28 nt, Human
uccuggagaagaggagauuuucucuuuu

SEQ ID NO: 39119 - RNA, 21 nt, Human
cucuuaaaaaggaggagcugg

SEQ ID NO: 39120 - RNA, 24 nt, Human
gcuuaacuguguagaggugugugg

SEQ ID NO: 39121 - RNA, 25 nt, Human
ucaggccccuaggcugggggguugu

SEQ ID NO: 39122 - RNA, 18 nt, Human
caguuaacuguccuggcc

SEQ ID NO: 39123 - RNA, 24 nt, Human
ugacagccaccgcuuucacacccu

SEQ ID NO: 39124 - RNA, 27 nt, Human
ucucugaugcucuucuucugugucucu

SEQ ID NO: 39125 - RNA, 21 nt, Human
cagagaagggaaagcagucug

SEQ ID NO: 39126 - RNA, 26 nt, Human
gccaacugggaaacaugguauaucau

SEQ ID NO: 39127 - RNA, 21 nt, Human
cugccuaacuuauccaucuuu

SEQ ID NO: 39128 - RNA, 25 nt, Human
uucugcuauccuuagucauaacucu

SEQ ID NO: 39129 - RNA, 22 nt, Human
ggcuucuccuuuggaagugagg

SEQ ID NO: 39130 - RNA, 22 nt, Human
gugguggcaguacuguggccca

SEQ ID NO: 39131 - RNA, 22 nt, Human
ggagcaccuucuaaaucuaaga

SEQ ID NO: 39132 - RNA, 27 nt, Human
uuuuuggggggcaaaagaaagcaacgu

SEQ ID NO: 39133 - RNA, 23 nt, Human
uccuggagcccccaguucaaauc

SEQ ID NO: 39134 - RNA, 19 nt, Human
aacuauagucacuacuuuu

SEQ ID NO: 39135 - RNA, 23 nt, Human
gacgggguuucauuguguuagcc

SEQ ID NO: 39136 - RNA, 23 nt, Human
aucacgccacugcauuccagccu

SEQ ID NO: 39137 - RNA, 26 nt, Human
gagaauugggggcuuagggucggaac

SEQ ID NO: 39138 - RNA, 27 nt, Human
cccgguuucacuccuucucagccuggg

SEQ ID NO: 39139 - RNA, 21 nt, Human
gccagccagccacauuucccu

SEQ ID NO: 39140 - RNA, 23 nt, Human
uguggguggaagggcuggguguc

SEQ ID NO: 39141 - RNA, 22 nt, Human
cugcagccgcggagcagugggc

SEQ ID NO: 39142 - RNA, 24 nt, Human
gccucucuggaacucugcagacca

SEQ ID NO: 39143 - RNA, 20 nt, Human
cucagcuucauuuccgugaa

SEQ ID NO: 39144 - RNA, 21 nt, Human
cucacauccgauuucuccucc

SEQ ID NO: 39145 - RNA, 21 nt, Human
agcucagugccuuucugcacc

SEQ ID NO: 39146 - RNA, 21 nt, Human
gaacauccuuccuucccaccc

SEQ ID NO: 39147 - RNA, 27 nt, Human
ggggagggagaguucggagccaaauua

SEQ ID NO: 39148 - RNA, 20 nt, Human
gccuccuccugggcuccaga

SEQ ID NO: 39149 - RNA, 21 nt, Human
uuggcugcugaaauagccccu

SEQ ID NO: 39150 - RNA, 25 nt, Human
cuuuguguugaccucaucccuggcu

SEQ ID NO: 39151 - RNA, 21 nt, Human
guggggguugcuguugauuga

SEQ ID NO: 39152 - RNA, 21 nt, Human
ggucugucucuucccaccuuc

SEQ ID NO: 39153 - RNA, 25 nt, Human
cugcucacuuuccacccucucucca

SEQ ID NO: 39154 - RNA, 21 nt, Human
ucuauaaucccagcacuuugg

SEQ ID NO: 39155 - RNA, 21 nt, Human
gccacaacaaccacugucuuu

SEQ ID NO: 39156 - RNA, 22 nt, Human
gauuauacuacuacuaauuuuu

SEQ ID NO: 39157 - RNA, 23 nt, Human
gaacccacaguuguaucaauggu

SEQ ID NO: 39158 - RNA, 26 nt, Human
agccuagaaacuaacacagccaucaa

SEQ ID NO: 39159 - RNA, 21 nt, Human
uugugguauuccaucucgggu

SEQ ID NO: 39160 - RNA, 23 nt, Human
uaucauuaucgacuugggagaaa

SEQ ID NO: 39161 - RNA, 18 nt, Human
accuggucagcuccucac

SEQ ID NO: 39162 - RNA, 23 nt, Human
augggaggggcugggacuggagc

SEQ ID NO: 39163 - RNA, 25 nt, Human
ugguagcgcauggcuguaauccugg

SEQ ID NO: 39164 - RNA, 21 nt, Human
agcugcacucuggcuggggaa

SEQ ID NO: 39165 - RNA, 26 nt, Human
acuguacugcccucugcugggaaggg

SEQ ID NO: 39166 - RNA, 18 nt, Human
cugaguauguaacuugca

SEQ ID NO: 39167 - RNA, 23 nt, Human
cagcgcccugggagacagcaccg

SEQ ID NO: 39168 - RNA, 26 nt, Human
ccacagaaaacacacagcuuccacaa

SEQ ID NO: 39169 - RNA, 17 nt, Human
ccaaccaccaccaccac

SEQ ID NO: 39170 - RNA, 24 nt, Human
cacagccacuacugacugcagcca

SEQ ID NO: 39171 - RNA, 20 nt, Human
agcuuugguagcucuguugg

SEQ ID NO: 39172 - RNA, 25 nt, Human
cugcaguacuguacauauuuuucuu

SEQ ID NO: 39173 - RNA, 22 nt, Human
aucacccaggcuggaguggagu

SEQ ID NO: 39174 - RNA, 27 nt, Human
gagcccaagcucuccuccacaggugaa

SEQ ID NO: 39175 - RNA, 19 nt, Human
aaaagaggggaccagaagc

SEQ ID NO: 39176 - RNA, 21 nt, Human
ccuucauuucaucacaaucug

SEQ ID NO: 39177 - RNA, 19 nt, Human
gccagcccugacgggacag

SEQ ID NO: 39178 - RNA, 22 nt, Human
ggggauguuacccuugcguuca

SEQ ID NO: 39179 - RNA, 26 nt, Human
cucucaucccccuucuucccacaacc

SEQ ID NO: 39180 - RNA, 19 nt, Human
aggaggucagaaagagaua

SEQ ID NO: 39181 - RNA, 27 nt, Human
cgggcaagaagcugcuucugcccacac

SEQ ID NO: 39182 - RNA, 23 nt, Human
acaggaaaguugggaagcggggg

SEQ ID NO: 39183 - RNA, 22 nt, Human
gccuuggcuuucucccucaccc

SEQ ID NO: 39184 - RNA, 22 nt, Human
ugagacuacaggcaugagccac

SEQ ID NO: 39185 - RNA, 20 nt, Human
ccaauuucauuucucuuccg

SEQ ID NO: 39186 - RNA, 24 nt, Human
ugaggugggggcgggugggcaggg

SEQ ID NO: 39187 - RNA, 23 nt, Human
auuauugcuguuacucuggauga

SEQ ID NO: 39188 - RNA, 28 nt, Human
ucuggcuccccucauccucauggucacu

SEQ ID NO: 39189 - RNA, 22 nt, Human
ccuccuugugccccucucagcu

SEQ ID NO: 39190 - RNA, 24 nt, Human
auggacucuacacugugaacuugg

SEQ ID NO: 39191 - RNA, 22 nt, Human
guuuccggaggauugucaucuc

SEQ ID NO: 39192 - RNA, 19 nt, Human
uuuuccuuugccauugauu

SEQ ID NO: 39193 - RNA, 24 nt, Human
guuuuuauuuguuuauguuauuua

SEQ ID NO: 39194 - RNA, 27 nt, Human
ggucucgaacuccuggcaucaagcgau

SEQ ID NO: 39195 - RNA, 27 nt, Human
ggucucaaacuccuaggaucaagccau

SEQ ID NO: 39196 - RNA, 20 nt, Human
agaucacugcaaaccugccu

SEQ ID NO: 39197 - RNA, 27 nt, Human
cuccucaucacguuucucucauuuucu

SEQ ID NO: 39198 - RNA, 27 nt, Human
gccuugagccugcuuccucacuccagg

SEQ ID NO: 39199 - RNA, 21 nt, Human
ggcugggaucucguguccuca

SEQ ID NO: 39200 - RNA, 22 nt, Human
ggcuagaagaaaguaaaaagaa

SEQ ID NO: 39201 - RNA, 23 nt, Human
cuugcuuguuuugacucaggcag

SEQ ID NO: 39202 - RNA, 25 nt, Human
agaaacccucacucucuacagguuu

SEQ ID NO: 39203 - RNA, 22 nt, Human
uuggugcaugauaguaggccuu

SEQ ID NO: 39204 - RNA, 19 nt, Human
ccuccaccuccuggguuca

SEQ ID NO: 39205 - RNA, 22 nt, Human
cuugacucugcugaaagcugcu

SEQ ID NO: 39206 - RNA, 22 nt, Human
ucuaccacaauccuccuccucc

SEQ ID NO: 39207 - RNA, 19 nt, Human
auauuuuuauauuuccuuu

SEQ ID NO: 39208 - RNA, 21 nt, Human
cuuuguagacuguuccuguuu

SEQ ID NO: 39209 - RNA, 24 nt, Human
gaaucaccugggaaaauaccagaa

SEQ ID NO: 39210 - RNA, 19 nt, Human
accacauucccugcacaug

SEQ ID NO: 39211 - RNA, 22 nt, Human
cacccaggcugaagugcagugg

SEQ ID NO: 39212 - RNA, 25 nt, Human
cggggcuggagugugaggguccugc

SEQ ID NO: 39213 - RNA, 22 nt, Human
guggguggaucaccugugguca

SEQ ID NO: 39214 - RNA, 26 nt, Human
uuucugaugacaguguuaucccaaga

SEQ ID NO: 39215 - RNA, 21 nt, Human
aaggggaauggagcacuuuaa

SEQ ID NO: 39216 - RNA, 27 nt, Human
ugccagucugaccagcacaguccuggg

SEQ ID NO: 39217 - RNA, 21 nt, Human
cuaucuggggagcuccuggcc

SEQ ID NO: 39218 - RNA, 27 nt, Human
gcuuuugcccaugcauucaauauugau

SEQ ID NO: 39219 - RNA, 24 nt, Human
uuccugagccucucccagcuccac

SEQ ID NO: 39220 - RNA, 25 nt, Human
uggauuuauucugccaaaccugugu

SEQ ID NO: 39221 - RNA, 17 nt, Human
ccauauaaacaaaaaga

SEQ ID NO: 39222 - RNA, 26 nt, Human
ugggaagcagcuuccugggagauuag

SEQ ID NO: 39223 - RNA, 22 nt, Human
acccaggcuagagugcaguggc

SEQ ID NO: 39224 - RNA, 22 nt, Human
acccaggcuggagugcaauggc

SEQ ID NO: 39225 - RNA, 22 nt, Human
guuuuucuaaaacuuuguguuu

SEQ ID NO: 39226 - RNA, 24 nt, Human
guguuauccuucuuaucccacucc

SEQ ID NO: 39227 - RNA, 17 nt, Human
acggcacuugagauaug

SEQ ID NO: 39228 - RNA, 24 nt, Human
gagauggacucuguccucagcaac

SEQ ID NO: 39229 - RNA, 27 nt, Human
cuuucucugccucucccacacucuccc

SEQ ID NO: 39230 - RNA, 20 nt, Human
cgccucucggggccugugcc

SEQ ID NO: 39231 - RNA, 25 nt, Human
ucuguauagugugacuaacccacag

SEQ ID NO: 39232 - RNA, 23 nt, Human
uccagcccugacuaaacuaccac

SEQ ID NO: 39233 - RNA, 22 nt, Human
cuccucugggcucuggccucag

SEQ ID NO: 39234 - RNA, 23 nt, Human
cuuaggaacuagcauauaauucu

SEQ ID NO: 39235 - RNA, 25 nt, Human
gcuuaguuaagucauccacagccca

SEQ ID NO: 39236 - RNA, 24 nt, Human
uuuucaugcuaucaaauuaucuuc

SEQ ID NO: 39237 - RNA, 22 nt, Human
agaccagccuggccaauauggu

SEQ ID NO: 39238 - RNA, 21 nt, Human
ggccucggcugggaccguuca

SEQ ID NO: 39239 - RNA, 21 nt, Human
gcuccugagcauaccagggga

SEQ ID NO: 39240 - RNA, 22 nt, Human
guacagucaucccgcuggucug

SEQ ID NO: 39241 - RNA, 23 nt, Human
ccuccaggaugucucccgguuuc

SEQ ID NO: 39242 - RNA, 27 nt, Human
auugcuugaggccagguguuugaggcc

SEQ ID NO: 39243 - RNA, 19 nt, Human
uggaagcuuucaacagagc

SEQ ID NO: 39244 - RNA, 25 nt, Human
auuauuuuaaagauuagauuuaguc

SEQ ID NO: 39245 - RNA, 21 nt, Human
ucuccccugaccugugagccc

SEQ ID NO: 39246 - RNA, 22 nt, Human
cagcucaggugacuggagcccg

SEQ ID NO: 39247 - RNA, 25 nt, Human
uacaugguauuguauaucaguggag

SEQ ID NO: 39248 - RNA, 19 nt, Human
cccacccccaacgccaucu

SEQ ID NO: 39249 - RNA, 22 nt, Human
aguggcacgaucucagcucacu

SEQ ID NO: 39250 - RNA, 22 nt, Human
aguggcgcgaucucggcucacu

SEQ ID NO: 39251 - RNA, 22 nt, Human
aguggugcgaucuuggcucacu

SEQ ID NO: 39252 - RNA, 21 nt, Human
ugccuguaagcccagcacuuu

SEQ ID NO: 39253 - RNA, 21 nt, Human
uuccuguaaucccagcacuuu

SEQ ID NO: 39254 - RNA, 18 nt, Human
ggagaccuuccacaaagg

SEQ ID NO: 39255 - RNA, 25 nt, Human
aaagggagaauuuguuaacgaguac

SEQ ID NO: 39256 - RNA, 22 nt, Human
aaauguuccuuuaaaugcagca

SEQ ID NO: 39257 - RNA, 21 nt, Human
aaaaugugggauuauggguca

SEQ ID NO: 39258 - RNA, 22 nt, Human
ccuucauuccucauagguacug

SEQ ID NO: 39259 - RNA, 22 nt, Human
acucaaacuccugaccuuguga

SEQ ID NO: 39260 - RNA, 22 nt, Human
ugcuuuuucacuaaaggucagu

SEQ ID NO: 39261 - RNA, 21 nt, Human
gucagcagauggucagcaggu

SEQ ID NO: 39262 - RNA, 21 nt, Human
cuuccugguuuucugccuuug

SEQ ID NO: 39263 - RNA, 21 nt, Human
caggccaagugugguggugca

SEQ ID NO: 39264 - RNA, 19 nt, Human
gugacuuuugcccaaggaa

SEQ ID NO: 39265 - RNA, 18 nt, Human
aaguuuucaugugcucag

SEQ ID NO: 39266 - RNA, 22 nt, Human
gagaagccuggugguacauucc

SEQ ID NO: 39267 - RNA, 25 nt, Human
ccagccuuuaccagcagcguacggc

SEQ ID NO: 39268 - RNA, 21 nt, Human
cuucugucugucucacugucu

SEQ ID NO: 39269 - RNA, 20 nt, Human
aggcuauacuccagcuggcc

SEQ ID NO: 39270 - RNA, 21 nt, Human
gcaagcagagugcacagcccu

SEQ ID NO: 39271 - RNA, 21 nt, Human
uccagcagaauuuguguagug

SEQ ID NO: 39272 - RNA, 23 nt, Human
caggaugaaguaacuaguguuac

SEQ ID NO: 39273 - RNA, 25 nt, Human
ucugccaggcugggguguuuucggu

SEQ ID NO: 39274 - RNA, 22 nt, Human
gcgugagccacugcaccuggcc

SEQ ID NO: 39275 - RNA, 22 nt, Human
gugugagccacugcacccggcc

SEQ ID NO: 39276 - RNA, 22 nt, Human
gcucaggcuggagugcagugau

SEQ ID NO: 39277 - RNA, 20 nt, Human
agaguacaaccugcagagaa

SEQ ID NO: 39278 - RNA, 23 nt, Human
gaacuccugacccucaagugauc

SEQ ID NO: 39279 - RNA, 31 nt, Human
aggguccagcugaaggugaggggauggagua

SEQ ID NO: 39280 - RNA, 22 nt, Human
ggcaggcaccuguagucccagc

SEQ ID NO: 39281 - RNA, 28 nt, Human
aagucuaaaccaccagcccauccugagg

SEQ ID NO: 39282 - RNA, 20 nt, Human
ccucuugagcuccuggaaau

SEQ ID NO: 39283 - RNA, 26 nt, Human
aacagcuucuccacaguguagacuga

SEQ ID NO: 39284 - RNA, 21 nt, Human
cagcuuuguacaggucuuuuc

SEQ ID NO: 39285 - RNA, 26 nt, Human
uuagucuacucuuaagccaucuuggu

SEQ ID NO: 39286 - RNA, 21 nt, Human
ugugggucaaauuggggggag

SEQ ID NO: 39287 - RNA, 22 nt, Human
cuguaagcuaauccacaaccug

SEQ ID NO: 39288 - RNA, 25 nt, Human
aggcugucugucugcuucacauguc

SEQ ID NO: 39289 - RNA, 21 nt, Human
gaaugucccucucuugggacu

SEQ ID NO: 39290 - RNA, 20 nt, Human
aggguguggcagaauucagc

SEQ ID NO: 39291 - RNA, 20 nt, Human
gacugucaacguuguccuca

SEQ ID NO: 39292 - RNA, 25 nt, Human
uacucagaguugcaaccucagccuc

SEQ ID NO: 39293 - RNA, 24 nt, Human
ucccagcccagagcagccaucagg

SEQ ID NO: 39294 - RNA, 19 nt, Human
ccuacuuaaacaaaaacuu

SEQ ID NO: 39295 - RNA, 24 nt, Human
gaggaaggcugaggaaugacuugg

SEQ ID NO: 39296 - RNA, 18 nt, Human
gaaagagaggguaugugc

SEQ ID NO: 39297 - RNA, 27 nt, Human
aucuccucuccacaccugccuggcacc

SEQ ID NO: 39298 - RNA, 22 nt, Human
auccaaauccuacuaggaagag

SEQ ID NO: 39299 - RNA, 22 nt, Human
gagcgagacccugucucaauaa

SEQ ID NO: 39300 - RNA, 26 nt, Human
agucucucauuucuuucaagacagcc

SEQ ID NO: 39301 - RNA, 22 nt, Human
guaguucccugaaaacccagag

SEQ ID NO: 39302 - RNA, 24 nt, Human
ccccaaaucuuuguauuguccaca

SEQ ID NO: 39303 - RNA, 22 nt, Human
aucacuugaacgugggaggcag

SEQ ID NO: 39304 - RNA, 22 nt, Human
cacugcacccuggguugggugc

SEQ ID NO: 39305 - RNA, 22 nt, Human
aaggccaggaaagguugggguc

SEQ ID NO: 39306 - RNA, 24 nt, Human
ucgggugugggcuggagaggcaga

SEQ ID NO: 39307 - RNA, 27 nt, Human
ccucaacaacacaacuucacccaccgc

SEQ ID NO: 39308 - RNA, 22 nt, Human
aacuuccugaguagcugggauu

SEQ ID NO: 39309 - RNA, 24 nt, Human
ccuccaucgccuucccugccucuc

SEQ ID NO: 39310 - RNA, 25 nt, Human
gucauuuggcaaaggagaugacuua

SEQ ID NO: 39311 - RNA, 24 nt, Human
cugagaagaaaccuaaaaacugug

SEQ ID NO: 39312 - RNA, 22 nt, Human
gguggucacucucugguaccga

SEQ ID NO: 39313 - RNA, 23 nt, Human
ucuucuucuuuauuauucuuugc

SEQ ID NO: 39314 - RNA, 23 nt, Human
gucgugccacugcacuccagccu

SEQ ID NO: 39315 - RNA, 23 nt, Human
aaagugcugggauuacaagggug

SEQ ID NO: 39316 - RNA, 22 nt, Human
uccaaugcugaaugccuguuag

SEQ ID NO: 39317 - RNA, 19 nt, Human
ggcccgacugccagaggga

SEQ ID NO: 39318 - RNA, 20 nt, Human
gucaaauuauguauuggugg

SEQ ID NO: 39319 - RNA, 26 nt, Human
ugagugagaggguuugagucaaaagc

SEQ ID NO: 39320 - RNA, 26 nt, Human
gcuugugguuucagaugugggcggcc

SEQ ID NO: 39321 - RNA, 22 nt, Human
acugcaacguccgccucccggg

SEQ ID NO: 39322 - RNA, 22 nt, Human
ugacccuuuugcaucauauggg

SEQ ID NO: 39323 - RNA, 24 nt, Human
cuucccugcuucugagacuucaau

SEQ ID NO: 39324 - RNA, 19 nt, Human
cauuugcaagaugugugua

SEQ ID NO: 39325 - RNA, 22 nt, Human
ugggucugggccacaagggagg

SEQ ID NO: 39326 - RNA, 27 nt, Human
cccugcucccugcccuccugggcagcc

SEQ ID NO: 39327 - RNA, 26 nt, Human
ccuuucucuuccgguucuaggcgcuu

SEQ ID NO: 39328 - RNA, 23 nt, Human
ugaaccacugcacccaccuacuu

SEQ ID NO: 39329 - RNA, 28 nt, Human
uugugagccaguggcuugagugaauguu

SEQ ID NO: 39330 - RNA, 22 nt, Human
uucauuuccugugucuuuuuuc

SEQ ID NO: 39331 - RNA, 26 nt, Human
cucugccacccggguucaagcaauuc

SEQ ID NO: 39332 - RNA, 22 nt, Human
ucugauuuguuuuccucuuaac

SEQ ID NO: 39333 - RNA, 22 nt, Human
ugaacuccuggcuucaagcagu

SEQ ID NO: 39334 - RNA, 25 nt, Human
cacaggcugcaagcugcagggaauu

SEQ ID NO: 39335 - RNA, 21 nt, Human
gaaaauucaaacuggagagaa

SEQ ID NO: 39336 - RNA, 26 nt, Human
ccaccucuuccuucccacugccaaag

SEQ ID NO: 39337 - RNA, 20 nt, Human
aacaguacuuuuaacuuuuu

SEQ ID NO: 39338 - RNA, 20 nt, Human
ugcgucuggggaggaauaaa

SEQ ID NO: 39339 - RNA, 24 nt, Human
gacucgcuuuucugcuugcaaaua

SEQ ID NO: 39340 - RNA, 21 nt, Human
uuugagacuguccugugccug

SEQ ID NO: 39341 - RNA, 25 nt, Human
uaagucuacaggggcuggugaccuc

SEQ ID NO: 39342 - RNA, 21 nt, Human
acuguucuuuucaaauucuac

SEQ ID NO: 39343 - RNA, 21 nt, Human
uggaugcccaggaaucuguau

SEQ ID NO: 39344 - RNA, 22 nt, Human
aaaucaguuacucuucaguuaa

SEQ ID NO: 39345 - RNA, 22 nt, Human
guggccuuuguguccccuggag

SEQ ID NO: 39346 - RNA, 22 nt, Human
cagccuauuaccuuuacguugu

SEQ ID NO: 39347 - RNA, 22 nt, Human
acacauuuaaagauucauucau

SEQ ID NO: 39348 - RNA, 22 nt, Human
ugccucaguagauacuaaagca

SEQ ID NO: 39349 - RNA, 20 nt, Human
gcagagcaggaaacaugacu

SEQ ID NO: 39350 - RNA, 20 nt, Human
gguccccauccccaccagcu

SEQ ID NO: 39351 - RNA, 26 nt, Human
uucauaaggaagcacuguuggagcua

SEQ ID NO: 39352 - RNA, 22 nt, Human
gcucacugcaaccuccaccuuc

SEQ ID NO: 39353 - RNA, 24 nt, Human
ucucugucugucucucucuguguc

SEQ ID NO: 39354 - RNA, 20 nt, Human
ggcccgagaacauggccuaa

SEQ ID NO: 39355 - RNA, 23 nt, Human
ggagagggggacgugccggccgc

SEQ ID NO: 39356 - RNA, 27 nt, Human
uugcccagugugggaguugguuuaaau

SEQ ID NO: 39357 - RNA, 24 nt, Human
accuugugauuugcccgccucagc

SEQ ID NO: 39358 - RNA, 13 nt, Human
ugcccccaccuca

SEQ ID NO: 39359 - RNA, 20 nt, Human
uauuuauugaacaauguagu

SEQ ID NO: 39360 - RNA, 21 nt, Human
ccuuucucauucuccaagccu

SEQ ID NO: 39361 - RNA, 21 nt, Human
gugucuucucccaguguugac

SEQ ID NO: 39362 - RNA, 22 nt, Human
gcucaucucccuuuauucguuu

SEQ ID NO: 39363 - RNA, 20 nt, Human
gcuggguuugcagucagaua

SEQ ID NO: 39364 - RNA, 25 nt, Human
cgcugcagccuccagcccgcggcaa

SEQ ID NO: 39365 - RNA, 22 nt, Human
gaggggaggggcagggggcggu

SEQ ID NO: 39366 - RNA, 23 nt, Human
caggagccuggcacugcuuccuc

SEQ ID NO: 39367 - RNA, 25 nt, Human
cccagguugcacaggagugggaugg

SEQ ID NO: 39368 - RNA, 18 nt, Human
uugcuguccucucuuguc

SEQ ID NO: 39369 - RNA, 27 nt, Human
ucuccacccucaucucucugcguauuu

SEQ ID NO: 39370 - RNA, 22 nt, Human
cacagcccugagcucuuuacgg

SEQ ID NO: 39371 - RNA, 21 nt, Human
uugcuccuggggaaaacacgc

SEQ ID NO: 39372 - RNA, 25 nt, Human
agggaaagacaugugaacagaguua

SEQ ID NO: 39373 - RNA, 22 nt, Human
gucccggccaccgcugccucag

SEQ ID NO: 39374 - RNA, 19 nt, Human
aucaggauaucucaggagg

SEQ ID NO: 39375 - RNA, 23 nt, Human
ucccuuaagaaucaaaagcagaa

SEQ ID NO: 39376 - RNA, 19 nt, Human
uaugaugguggaucaagac

SEQ ID NO: 39377 - RNA, 26 nt, Human
guccccagccucugggcuccuguuuc

SEQ ID NO: 39378 - RNA, 20 nt, Human
caggcgagcauguuguggua

SEQ ID NO: 39379 - RNA, 22 nt, Human
aucucuugaacccgggaggcgg

SEQ ID NO: 39380 - RNA, 24 nt, Human
uccuucacuggcgccuucucggag

SEQ ID NO: 39381 - RNA, 23 nt, Human
ggcucccuccccuccuguugcag

SEQ ID NO: 39382 - RNA, 27 nt, Human
gacuauguauauauugccaauuuuagu

SEQ ID NO: 39383 - RNA, 25 nt, Human
ccuucaccugccuuggucauggcuc

SEQ ID NO: 39384 - RNA, 20 nt, Human
agacccaugccccccucccc

SEQ ID NO: 39385 - RNA, 23 nt, Human
ugucuacccagacccuugugcgg

SEQ ID NO: 39386 - RNA, 21 nt, Human
ggcgggggaggggagguagga

SEQ ID NO: 39387 - RNA, 23 nt, Human
cucucccccgcccaaggcugcag

SEQ ID NO: 39388 - RNA, 22 nt, Human
gcagagcuggacgcuguggaaa

SEQ ID NO: 39389 - RNA, 27 nt, Human
cuccagccccuggaccccugggguggc

SEQ ID NO: 39390 - RNA, 29 nt, Human
gccuguccgucccugucccgggcugggga

SEQ ID NO: 39391 - RNA, 24 nt, Human
ucugucucuggucuuucucuuuga

SEQ ID NO: 39392 - RNA, 26 nt, Human
uaguugcuugcuaauauuuccagaag

SEQ ID NO: 39393 - RNA, 22 nt, Human
ccgaguagcugggaucgcaggc

SEQ ID NO: 39394 - RNA, 23 nt, Human
gagaaaggaguaggagccuagca

SEQ ID NO: 39395 - RNA, 22 nt, Human
ugcacugucuucugauccuguu

SEQ ID NO: 39396 - RNA, 23 nt, Human
ggccuuuggaggggaaaugggga

SEQ ID NO: 39397 - RNA, 20 nt, Human
uuguccucuggcuuauugcc

SEQ ID NO: 39398 - RNA, 20 nt, Human
uaagugggaguggaggcagg

SEQ ID NO: 39399 - RNA, 17 nt, Human
uguuuuuaaguaaccua

SEQ ID NO: 39400 - RNA, 21 nt, Human
gaugggaucuccugugcuugg

SEQ ID NO: 39401 - RNA, 19 nt, Human
ccugccucuauccuaagga

SEQ ID NO: 39402 - RNA, 21 nt, Human
gagagaaauauaaauauuuac

SEQ ID NO: 39403 - RNA, 22 nt, Human
cagacuuaacagcccagcacuu

SEQ ID NO: 39404 - RNA, 21 nt, Human
cccugcucccauccaguggcc

SEQ ID NO: 39405 - RNA, 28 nt, Human
gcuagaguugcaacuacagcuggguuau

SEQ ID NO: 39406 - RNA, 25 nt, Human
ggcuuacagauuuaaagcaucaucu

SEQ ID NO: 39407 - RNA, 22 nt, Human
cagauguugacuucucaucccc

SEQ ID NO: 39408 - RNA, 22 nt, Human
agaaagcuucauccacagccuu

SEQ ID NO: 39409 - RNA, 18 nt, Human
gccuuuuuugcacuuugg

SEQ ID NO: 39410 - RNA, 32 nt, Human
gagaccggacccgagagcagagcugcuguuuc

SEQ ID NO: 39411 - RNA, 23 nt, Human
ugaaaacaccaugucauggagug

SEQ ID NO: 39412 - RNA, 18 nt, Human
aggccccccagggccgcg

SEQ ID NO: 39413 - RNA, 23 nt, Human
ccaaguaguugggagguguuggc

SEQ ID NO: 39414 - RNA, 20 nt, Human
uggagccacaguugaggaca

SEQ ID NO: 39415 - RNA, 21 nt, Human
ugagugugagugacagauaca

SEQ ID NO: 39416 - RNA, 27 nt, Human
ccuccacuccggcaucagcagccaguc

SEQ ID NO: 39417 - RNA, 21 nt, Human
uucuucaguccuuugucuuuc

SEQ ID NO: 39418 - RNA, 27 nt, Human
gccuccagccacugcccgggucugcgg

SEQ ID NO: 39419 - RNA, 26 nt, Human
uuccacccuuucacacaauucauguc

SEQ ID NO: 39420 - RNA, 21 nt, Human
cggucugauaaaaggguccuu

SEQ ID NO: 39421 - RNA, 24 nt, Human
gugacaucacagggccucaguuuc

SEQ ID NO: 39422 - RNA, 24 nt, Human
agcucauuacugccuucccuccca

SEQ ID NO: 39423 - RNA, 25 nt, Human
cugggcugggacggacaggagaggc

SEQ ID NO: 39424 - RNA, 21 nt, Human
cagguucuacagggaggcugc

SEQ ID NO: 39425 - RNA, 21 nt, Human
uuugauagcacacauggggcc

SEQ ID NO: 39426 - RNA, 29 nt, Human
acucaauuaaggauucuguccucuccuca

SEQ ID NO: 39427 - RNA, 22 nt, Human
ccaacauggugagacccugucu

SEQ ID NO: 39428 - RNA, 25 nt, Human
cccagugacggcccccucuuugcag

SEQ ID NO: 39429 - RNA, 21 nt, Human
uguaacuuggagagggacgaa

SEQ ID NO: 39430 - RNA, 22 nt, Human
cccugacccuccugcugccuuc

SEQ ID NO: 39431 - RNA, 26 nt, Human
aggaggagacugcaagagaucauuug

SEQ ID NO: 39432 - RNA, 23 nt, Human
gcugggaggcugagagaggcuuu

SEQ ID NO: 39433 - RNA, 19 nt, Human
gaaguuucaguuguccuua

SEQ ID NO: 39434 - RNA, 23 nt, Human
uuuccuaaauacuccaucuguuu

SEQ ID NO: 39435 - RNA, 20 nt, Human
ccugcugggacucccugacu

SEQ ID NO: 39436 - RNA, 27 nt, Human
uggaauguggaucaguguuuuuugccu

SEQ ID NO: 39437 - RNA, 22 nt, Human
agcuuuggaaguccaaaaagaa

SEQ ID NO: 39438 - RNA, 22 nt, Human
caggaagagaaggagcagagca

SEQ ID NO: 39439 - RNA, 22 nt, Human
cgucuguaaucccagcacuuug

SEQ ID NO: 39440 - RNA, 22 nt, Human
cgccuguaauuccagcacuuug

SEQ ID NO: 39441 - RNA, 19 nt, Human
cuucugcuguccuuuugca

SEQ ID NO: 39442 - RNA, 22 nt, Human
uucaagagauucuccugccuca

SEQ ID NO: 39443 - RNA, 25 nt, Human
ccugauuuaggcagagguggcauuu

SEQ ID NO: 39444 - RNA, 20 nt, Human
ggccccaaccugccaccuca

SEQ ID NO: 39445 - RNA, 27 nt, Human
uggcucacgccuguaaucccaacacuu

SEQ ID NO: 39446 - RNA, 27 nt, Human
gugugagagcuagaaugagaaaaagag

SEQ ID NO: 39447 - RNA, 26 nt, Human
aacaacaaaaagguacauauggguuc

SEQ ID NO: 39448 - RNA, 21 nt, Human
cuccaaggcuggagugcagug

SEQ ID NO: 39449 - RNA, 22 nt, Human
uguuuacaauauagaugacauu

SEQ ID NO: 39450 - RNA, 27 nt, Human
guugcaagccuuugucuuacucuuuca

SEQ ID NO: 39451 - RNA, 23 nt, Human
cagagacaaccuuucugucuuca

SEQ ID NO: 39452 - RNA, 27 nt, Human
aacuuuauacuuagcaaguuacuccau

SEQ ID NO: 39453 - RNA, 20 nt, Human
gcuguauggaaacuacuuuc

SEQ ID NO: 39454 - RNA, 19 nt, Human
guacucuccaagcuccugu

SEQ ID NO: 39455 - RNA, 23 nt, Human
ugcccccagaaucugggcuucuu

SEQ ID NO: 39456 - RNA, 17 nt, Human
ccugcucucuguagacu

SEQ ID NO: 39457 - RNA, 19 nt, Human
uccuguagugagcacuuug

SEQ ID NO: 39458 - RNA, 20 nt, Human
acccaaauaaaaaugcacuc

SEQ ID NO: 39459 - RNA, 23 nt, Human
acuaugucuguuuucuuuuuugu

SEQ ID NO: 39460 - RNA, 25 nt, Human
gucugccuuuuuaaggcaguuccgu

SEQ ID NO: 39461 - RNA, 19 nt, Human
ucucuacucccuccagagg

SEQ ID NO: 39462 - RNA, 22 nt, Human
cucauacccuguaauuuugucc

SEQ ID NO: 39463 - RNA, 20 nt, Human
ccuuagccuuuggagcuaga

SEQ ID NO: 39464 - RNA, 22 nt, Human
gcugcaggaggcggccuagcug

SEQ ID NO: 39465 - RNA, 23 nt, Human
ugucgcucaggcuggagugccau

SEQ ID NO: 39466 - RNA, 20 nt, Human
acuccagaacaucaccaaga

SEQ ID NO: 39467 - RNA, 23 nt, Human
ccuccacucacacauguagacaa

SEQ ID NO: 39468 - RNA, 25 nt, Human
aggagcagcagcggagcgugcuucg

SEQ ID NO: 39469 - RNA, 21 nt, Human
gaucuucuguuaauacacauu

SEQ ID NO: 39470 - RNA, 20 nt, Human
cauucuuguugccacagcug

SEQ ID NO: 39471 - RNA, 22 nt, Human
acacugaagaacauguccuaca

SEQ ID NO: 39472 - RNA, 21 nt, Human
ccauucuacuugcucuggacc

SEQ ID NO: 39473 - RNA, 21 nt, Human
gcuuccucucgugcuuggucc

SEQ ID NO: 39474 - RNA, 28 nt, Human
uuaagauggaagacuuccuucuugacaa

SEQ ID NO: 39475 - RNA, 21 nt, Human
guaccugaaguaggcucaaua

SEQ ID NO: 39476 - RNA, 21 nt, Human
ggaacgaagagaggcacacag

SEQ ID NO: 39477 - RNA, 22 nt, Human
gccaucucacuagaauaggaua

SEQ ID NO: 39478 - RNA, 23 nt, Human
agcccccaauucccacagcuuuu

SEQ ID NO: 39479 - RNA, 22 nt, Human
cuggggagcacagggaggcaga

SEQ ID NO: 39480 - RNA, 21 nt, Human
aauaguuacagauacagugug

SEQ ID NO: 39481 - RNA, 26 nt, Human
agcacuuuguaaacacccucuugcuu

SEQ ID NO: 39482 - RNA, 23 nt, Human
gugcugguucacucugcccagcc

SEQ ID NO: 39483 - RNA, 18 nt, Human
ggaaacacaaucgcugaa

SEQ ID NO: 39484 - RNA, 22 nt, Human
ccuccugcugcuuuggugccuc

SEQ ID NO: 39485 - RNA, 22 nt, Human
guguuugaaauuuuugcauuuu

SEQ ID NO: 39486 - RNA, 23 nt, Human
ccuuacccagaguggcccacagg

SEQ ID NO: 39487 - RNA, 21 nt, Human
caguuucagauccugaucuua

SEQ ID NO: 39488 - RNA, 20 nt, Human
aauucucccugccucagccu

SEQ ID NO: 39489 - RNA, 22 nt, Human
guuuuuucuucugugcauugac

SEQ ID NO: 39490 - RNA, 24 nt, Human
ccugcucucuuuuucuccaggguc

SEQ ID NO: 39491 - RNA, 21 nt, Human
cugggcuuuggugaggcguga

SEQ ID NO: 39492 - RNA, 27 nt, Human
uugaagcugagaaggcacagggcaagg

SEQ ID NO: 39493 - RNA, 26 nt, Human
ggcaaagccuuuaaccaguuuucaac

SEQ ID NO: 39494 - RNA, 22 nt, Human
uagaacauuuuuccucauuuua

SEQ ID NO: 39495 - RNA, 23 nt, Human
uaaagaagacuguggaaucuguu

SEQ ID NO: 39496 - RNA, 19 nt, Human
uauucuccaagauuaucuc

SEQ ID NO: 39497 - RNA, 25 nt, Human
uggugcucaaaccagaucgaaguuu

SEQ ID NO: 39498 - RNA, 23 nt, Human
uccagccucucucugaacuguga

SEQ ID NO: 39499 - RNA, 23 nt, Human
caugccacaacauggaugagccu

SEQ ID NO: 39500 - RNA, 26 nt, Human
ugcccaggcuagggggcuauagaaac

SEQ ID NO: 39501 - RNA, 22 nt, Human
cugugugaugucccguuaguga

SEQ ID NO: 39502 - RNA, 21 nt, Human
cucccaugggcugagugggga

SEQ ID NO: 39503 - RNA, 21 nt, Human
cuuacugcuagcucugcuuuu

SEQ ID NO: 39504 - RNA, 24 nt, Human
gaauuuaggcaacacucaauuuac

SEQ ID NO: 39505 - RNA, 27 nt, Human
uuuuaaacuuuggccugaacaguuuuu

SEQ ID NO: 39506 - RNA, 22 nt, Human
cacuugaagaagagggucuuga

SEQ ID NO: 39507 - RNA, 22 nt, Human
ccaacuggguacagccugggug

SEQ ID NO: 39508 - RNA, 22 nt, Human
acccaggcccaccccagagacc

SEQ ID NO: 39509 - RNA, 23 nt, Human
uuccuggggcuggaaugcugggu

SEQ ID NO: 39510 - RNA, 23 nt, Human
aggacacucuuggcucguuuggg

SEQ ID NO: 39511 - RNA, 23 nt, Human
ccuccggcgcgaugccaaaaaga

SEQ ID NO: 39512 - RNA, 25 nt, Human
ucugucucccaggcuggagugcaau

SEQ ID NO: 39513 - RNA, 24 nt, Human
gcaucuguaguguccaucagcagg

SEQ ID NO: 39514 - RNA, 29 nt, Human
uucaguuggcucaucagccagcauuggug

SEQ ID NO: 39515 - RNA, 20 nt, Human
cgccgcccuggcggggacgg

SEQ ID NO: 39516 - RNA, 23 nt, Human
uucacuuuucaaaauauuguaga

SEQ ID NO: 39517 - RNA, 25 nt, Human
gcccaggcuggagugcaguggcucg

SEQ ID NO: 39518 - RNA, 21 nt, Human
gcuguauauguugggugcaaa

SEQ ID NO: 39519 - RNA, 24 nt, Human
gcucacaugcucugcucucacgug

SEQ ID NO: 39520 - RNA, 19 nt, Human
gggugaaugggcagaggga

SEQ ID NO: 39521 - RNA, 26 nt, Human
uguuucuguuccugauaaacacuuug

SEQ ID NO: 39522 - RNA, 25 nt, Human
caucccucagcaaacgcagcucuuc

SEQ ID NO: 39523 - RNA, 24 nt, Human
ucucucuggccugcugcucucuca

SEQ ID NO: 39524 - RNA, 21 nt, Human
uguaauaaaacuguggcaccu

SEQ ID NO: 39525 - RNA, 22 nt, Human
gauacuucuuuuuaucucuuua

SEQ ID NO: 39526 - RNA, 20 nt, Human
ccaagacugaagacugcaca

SEQ ID NO: 39527 - RNA, 20 nt, Human
gaggaagaaagcauuuugca

SEQ ID NO: 39528 - RNA, 24 nt, Human
cccaacgugucuaggagagcuuuc

SEQ ID NO: 39529 - RNA, 24 nt, Human
cugccuguuuucaaggggaguaag

SEQ ID NO: 39530 - RNA, 15 nt, Human
ucugaaccucuuaga

SEQ ID NO: 39531 - RNA, 23 nt, Human
aucuccagggacucucaggcuaa

SEQ ID NO: 39532 - RNA, 21 nt, Human
gagcagcggagccgccuagca

SEQ ID NO: 39533 - RNA, 22 nt, Human
ucugucugguuuccucuuugga

SEQ ID NO: 39534 - RNA, 23 nt, Human
gccagaaguuuuuccacagccuu

SEQ ID NO: 39535 - RNA, 19 nt, Human
cucuggggagaaggugcca

SEQ ID NO: 39536 - RNA, 27 nt, Human
ccaugcccaguuuuuacccaucaugca

SEQ ID NO: 39537 - RNA, 19 nt, Human
uuauguuuguuuuaagaca

SEQ ID NO: 39538 - RNA, 20 nt, Human
agggagaccugcugugugga

SEQ ID NO: 39539 - RNA, 22 nt, Human
aggcugaggugggcggauugcu

SEQ ID NO: 39540 - RNA, 20 nt, Human
aggaguucguucagagacca

SEQ ID NO: 39541 - RNA, 27 nt, Human
cuguggcugggacaggaguugugugua

SEQ ID NO: 39542 - RNA, 26 nt, Human
ccugggacaguguccacaaauaccgu

SEQ ID NO: 39543 - RNA, 19 nt, Human
acaagucauucuaccucuu

SEQ ID NO: 39544 - RNA, 24 nt, Human
ggucagcucugcaucagguguuuu

SEQ ID NO: 39545 - RNA, 21 nt, Human
accccuuccuuugaucauuuc

SEQ ID NO: 39546 - RNA, 27 nt, Human
gaggaagauaagaaugauuccugcgcg

SEQ ID NO: 39547 - RNA, 23 nt, Human
gcggugccuggggagauccgagg

SEQ ID NO: 39548 - RNA, 23 nt, Human
ggucuguagguugcacacuuugg

SEQ ID NO: 39549 - RNA, 20 nt, Human
ucgguggcugucgugaaauu

SEQ ID NO: 39550 - RNA, 22 nt, Human
aaggaugaggugauguauugac

SEQ ID NO: 39551 - RNA, 24 nt, Human
ccacacacccccuuccuccuacca

SEQ ID NO: 39552 - RNA, 23 nt, Human
cuugugaacugacuccuugcacu

SEQ ID NO: 39553 - RNA, 22 nt, Human
gauuacaggcgugagcaaucgu

SEQ ID NO: 39554 - RNA, 21 nt, Human
gagcaucuccgggaccugccu

SEQ ID NO: 39555 - RNA, 20 nt, Human
gggauccagggcaaugugaa

SEQ ID NO: 39556 - RNA, 23 nt, Human
acuguccuggaguggcaccggcc

SEQ ID NO: 39557 - RNA, 23 nt, Human
ucccugagagagaucaaccuccc

SEQ ID NO: 39558 - RNA, 23 nt, Human
ccacagccaugauacagggcucu

SEQ ID NO: 39559 - RNA, 24 nt, Human
uacaguuagaaaugauacuuccuu

SEQ ID NO: 39560 - RNA, 20 nt, Human
guuugaccccacgcccagcc

SEQ ID NO: 39561 - RNA, 25 nt, Human
guagcacaggcuucacagugauuuu

SEQ ID NO: 39562 - RNA, 22 nt, Human
gauauuaaagauuucuuuucau

SEQ ID NO: 39563 - RNA, 20 nt, Human
gcaguguaggugguuagcag

SEQ ID NO: 39564 - RNA, 22 nt, Human
uguuguuuuuaucaucaugugc

SEQ ID NO: 39565 - RNA, 27 nt, Human
gcugggaggcaggaggcagcggccugu

SEQ ID NO: 39566 - RNA, 21 nt, Human
aaccacagcacauacuucuuu

SEQ ID NO: 39567 - RNA, 26 nt, Human
ccgccucggggugugcagccggcucg

SEQ ID NO: 39568 - RNA, 24 nt, Human
ugcaaccuccgccuucccagauuc

SEQ ID NO: 39569 - RNA, 25 nt, Human
cugagccuugagaggaaugugguca

SEQ ID NO: 39570 - RNA, 25 nt, Human
uucuaauuugaucaaaacauugagg

SEQ ID NO: 39571 - RNA, 15 nt, Human
aggaagagcuuggua

SEQ ID NO: 39572 - RNA, 20 nt, Human
gcaugcaccaaacacugcuu

SEQ ID NO: 39573 - RNA, 26 nt, Human
aggaaggaggaauggcuugcugggga

SEQ ID NO: 39574 - RNA, 17 nt, Human
agacuugcuuggguggu

SEQ ID NO: 39575 - RNA, 19 nt, Human
guuaaaaucaggauuuuag

SEQ ID NO: 39576 - RNA, 20 nt, Human
uguaaaaagaaaaauauggg

SEQ ID NO: 39577 - RNA, 21 nt, Human
auuccagcaagaaagaaaaga

SEQ ID NO: 39578 - RNA, 23 nt, Human
gcuuuucuguucacccuccugcc

SEQ ID NO: 39579 - RNA, 28 nt, Human
guuauaucagacuggagcaccagagaga

SEQ ID NO: 39580 - RNA, 27 nt, Human
uacaguaggcccugagccgacugugaa

SEQ ID NO: 39581 - RNA, 26 nt, Human
gcaggcugagccccuugguucacagu

SEQ ID NO: 39582 - RNA, 21 nt, Human
gaggaggcggcggcggcggug

SEQ ID NO: 39583 - RNA, 23 nt, Human
augccuugguuuuuacugcucug

SEQ ID NO: 39584 - RNA, 21 nt, Human
ggccuggcccaaagcaguguu

SEQ ID NO: 39585 - RNA, 21 nt, Human
guuagcuucccuucuggacca

SEQ ID NO: 39586 - RNA, 23 nt, Human
uacucuguaucucuuuguacucu

SEQ ID NO: 39587 - RNA, 22 nt, Human
cacauccaggugcagcuggagc

SEQ ID NO: 39588 - RNA, 21 nt, Human
ggaagcggagguuguggugag

SEQ ID NO: 39589 - RNA, 21 nt, Human
gcugcucagugccugccucug

SEQ ID NO: 39590 - RNA, 24 nt, Human
guaacaucccuaauaacaaccuuc

SEQ ID NO: 39591 - RNA, 21 nt, Human
agcauggaccuccugcccugg

SEQ ID NO: 39592 - RNA, 23 nt, Human
accgagaaggggaccucaucuag

SEQ ID NO: 39593 - RNA, 25 nt, Human
ccugaccuggcccccucaguguugu

SEQ ID NO: 39594 - RNA, 25 nt, Human
gaugccucagaucugauccgcaucu

SEQ ID NO: 39595 - RNA, 22 nt, Human
caggcagccaaggaaacacuga

SEQ ID NO: 39596 - RNA, 24 nt, Human
uuuuguagaaugaaccacugcccc

SEQ ID NO: 39597 - RNA, 25 nt, Human
caagaacaacaaaacagguguuaug

SEQ ID NO: 39598 - RNA, 27 nt, Human
agacacagacacccacagacccugucc

SEQ ID NO: 39599 - RNA, 28 nt, Human
aaggguacgggccucucugguacacgag

SEQ ID NO: 39600 - RNA, 18 nt, Human
augacccucuuccucaug

SEQ ID NO: 39601 - RNA, 20 nt, Human
gcagauaccuggugagcuca

SEQ ID NO: 39602 - RNA, 23 nt, Human
gggagagagugagagagagugag

SEQ ID NO: 39603 - RNA, 19 nt, Human
acuggcuuuuuguucuucu

SEQ ID NO: 39604 - RNA, 19 nt, Human
gacaacaaaagaaaucucc

SEQ ID NO: 39605 - RNA, 22 nt, Human
uuccugagccuucagcacuaac

SEQ ID NO: 39606 - RNA, 19 nt, Human
ucaccaucauccucaggga

SEQ ID NO: 39607 - RNA, 25 nt, Human
aggaaauggacaaaaaugagaauga

SEQ ID NO: 39608 - RNA, 23 nt, Human
uucuggaacuccuguccccuuag

SEQ ID NO: 39609 - RNA, 27 nt, Human
gcugcaaccccucuccggcuccucugc

SEQ ID NO: 39610 - RNA, 27 nt, Human
cccaggcaacagagcgugacuccgucu

SEQ ID NO: 39611 - RNA, 30 nt, Human
uuguccuagaugcuggagugagauuauaua

SEQ ID NO: 39612 - RNA, 25 nt, Human
cuuugcccaucagugaauggaaugg

SEQ ID NO: 39613 - RNA, 23 nt, Human
ccaccucucuaaaagacacagga

SEQ ID NO: 39614 - RNA, 26 nt, Human
agcugugccaauacugccuacugugc

SEQ ID NO: 39615 - RNA, 26 nt, Human
uggucugagccccacgaaggccuugg

SEQ ID NO: 39616 - RNA, 23 nt, Human
acuguucuucauuuuauuaauau

SEQ ID NO: 39617 - RNA, 20 nt, Human
ggagccugagaagaggcaga

SEQ ID NO: 39618 - RNA, 27 nt, Human
cucaaagcuucuuugauuaagugcuag

SEQ ID NO: 39619 - RNA, 25 nt, Human
gaacaaugauaccguuuuauuuacu

SEQ ID NO: 39620 - RNA, 24 nt, Human
uuuuucugucauuucuacuuuuug

SEQ ID NO: 39621 - RNA, 23 nt, Human
gggcucgaaggguuagagaagaa

SEQ ID NO: 39622 - RNA, 23 nt, Human
ggagguggggacucuggaaaagc

SEQ ID NO: 39623 - RNA, 20 nt, Human
ccugcccuguuccccguccu

SEQ ID NO: 39624 - RNA, 21 nt, Human
ggggaguugcgagggagcgag

SEQ ID NO: 39625 - RNA, 20 nt, Human
caguauccuucuagcucucc

SEQ ID NO: 39626 - RNA, 22 nt, Human
gcccccaggaaacgcucuccuc

SEQ ID NO: 39627 - RNA, 27 nt, Human
uuuuccccuuggaagacacuauugauc

SEQ ID NO: 39628 - RNA, 22 nt, Human
gagcuacacucccacuucuuca

SEQ ID NO: 39629 - RNA, 18 nt, Human
caguugucuuuucuugaa

SEQ ID NO: 39630 - RNA, 22 nt, Human
ugagucaggggagcucagucuc

SEQ ID NO: 39631 - RNA, 20 nt, Human
guaccugaaacugccgccac

SEQ ID NO: 39632 - RNA, 24 nt, Human
cccccugcccccuccuggaaggcu

SEQ ID NO: 39633 - RNA, 21 nt, Human
cccagaaacuccccuuguacc

SEQ ID NO: 39634 - RNA, 23 nt, Human
gacggcuucucacgcuuuguuua

SEQ ID NO: 39635 - RNA, 22 nt, Human
uuauaauaaaacugaaaauacu

SEQ ID NO: 39636 - RNA, 22 nt, Human
augaucacagcucacugcaggu

SEQ ID NO: 39637 - RNA, 27 nt, Human
ccagaaagaaagagcaauaauaauuaa

SEQ ID NO: 39638 - RNA, 25 nt, Human
acagcuagaaauuuuccucugugau

SEQ ID NO: 39639 - RNA, 24 nt, Human
agccauggaagagaauauggaaga

SEQ ID NO: 39640 - RNA, 21 nt, Human
cuccaacacucugucuugaau

SEQ ID NO: 39641 - RNA, 19 nt, Human
cucuccucaucaucauucc

SEQ ID NO: 39642 - RNA, 25 nt, Human
ccucuucucccccaccucccggguc

SEQ ID NO: 39643 - RNA, 25 nt, Human
ccuugcugugccucaguuuccuauc

SEQ ID NO: 39644 - RNA, 24 nt, Human
aggugaucuuaauuacuuucagaa

SEQ ID NO: 39645 - RNA, 22 nt, Human
aaaguggugggauuacaggugu

SEQ ID NO: 39646 - RNA, 21 nt, Human
uauguauucuucacuacugag

SEQ ID NO: 39647 - RNA, 20 nt, Human
cauauugaaaagcacagagg

SEQ ID NO: 39648 - RNA, 21 nt, Human
aaacccuucccugaagagaga

SEQ ID NO: 39649 - RNA, 21 nt, Human
uauccaguuagaacauugauu

SEQ ID NO: 39650 - RNA, 21 nt, Human
aagucccugcuccuccucuuc

SEQ ID NO: 39651 - RNA, 21 nt, Human
gagguagcagugggcacuuuu

SEQ ID NO: 39652 - RNA, 19 nt, Human
agcgcucuggcugggacag

SEQ ID NO: 39653 - RNA, 23 nt, Human
accaugcccggcuaauuuuuugc

SEQ ID NO: 39654 - RNA, 23 nt, Human
accaugccuggcuaaucuuuugc

SEQ ID NO: 39655 - RNA, 22 nt, Human
accaaaacccaacaauguggcc

SEQ ID NO: 39656 - RNA, 22 nt, Human
cccaaguagcugggauaacagg

SEQ ID NO: 39657 - RNA, 21 nt, Human
ccgcucucccuuugcgcagcc

SEQ ID NO: 39658 - RNA, 25 nt, Human
ucccuguggagucaaggauucuucu

SEQ ID NO: 39659 - RNA, 19 nt, Human
uuguuuucuuuucucuggc

SEQ ID NO: 39660 - RNA, 19 nt, Human
ggcucccccaucugcucca

SEQ ID NO: 39661 - RNA, 21 nt, Human
ggugcccaggauagauguaau

SEQ ID NO: 39662 - RNA, 28 nt, Human
caugguuuugugccaucuguagcuauaa

SEQ ID NO: 39663 - RNA, 22 nt, Human
gaccagccugggcaagauggug

SEQ ID NO: 39664 - RNA, 19 nt, Human
ucuccacugccaugccuuu

SEQ ID NO: 39665 - RNA, 22 nt, Human
gggucucuuccucuccaggccu

SEQ ID NO: 39666 - RNA, 21 nt, Human
gcaaacccaacuaagccagga

SEQ ID NO: 39667 - RNA, 19 nt, Human
gcagccuggcagggcacag

SEQ ID NO: 39668 - RNA, 17 nt, Human
uggaggccugggccaag

SEQ ID NO: 39669 - RNA, 20 nt, Human
gaccacaggcuuguuaccac

SEQ ID NO: 39670 - RNA, 21 nt, Human
cacucaggcuggaguacagug

SEQ ID NO: 39671 - RNA, 23 nt, Human
uauuuuuucuuuuguaauugugu

SEQ ID NO: 39672 - RNA, 20 nt, Human
ccugcagggagcaggcgcug

SEQ ID NO: 39673 - RNA, 21 nt, Human
cugagcauuggugacaggguc

SEQ ID NO: 39674 - RNA, 20 nt, Human
uugcaggcccugcuuguggu

SEQ ID NO: 39675 - RNA, 25 nt, Human
auccuugugacauuaaaaacacaua

SEQ ID NO: 39676 - RNA, 21 nt, Human
uuuguagauggggcagaggaa

SEQ ID NO: 39677 - RNA, 26 nt, Human
uguccucagaagugccggggauucug

SEQ ID NO: 39678 - RNA, 21 nt, Human
cacccuggugcugugcagccu

SEQ ID NO: 39679 - RNA, 21 nt, Human
uacuaccucacuacuacaucu

SEQ ID NO: 39680 - RNA, 20 nt, Human
gucccgucacaugucucaag

SEQ ID NO: 39681 - RNA, 22 nt, Human
ccagaacugagaccuccagaaa

SEQ ID NO: 39682 - RNA, 27 nt, Human
agcauuuuauacauacccucgcugcca

SEQ ID NO: 39683 - RNA, 21 nt, Human
gggaaaaagggcaauguugau

SEQ ID NO: 39684 - RNA, 22 nt, Human
ccuaaugccuucuccugccuuu

SEQ ID NO: 39685 - RNA, 22 nt, Human
ugaaauucugaguuguuggggc

SEQ ID NO: 39686 - RNA, 21 nt, Human
guagggagaugacaguggugc

SEQ ID NO: 39687 - RNA, 23 nt, Human
guuauuuaaacuuugggaaaugu

SEQ ID NO: 39688 - RNA, 25 nt, Human
caggacuccuuguucugcucuggca

SEQ ID NO: 39689 - RNA, 23 nt, Human
uguuaagucuuuugugacuggga

SEQ ID NO: 39690 - RNA, 22 nt, Human
auuauccugaauuacuuuggag

SEQ ID NO: 39691 - RNA, 23 nt, Human
gcugaggcaggagaaucacugga

SEQ ID NO: 39692 - RNA, 29 nt, Human
uucucacugccacugcucuugccucuugu

SEQ ID NO: 39693 - RNA, 23 nt, Human
ucuucaaggagaaugaauacugg

SEQ ID NO: 39694 - RNA, 23 nt, Human
uagcuuuagucuuucuguuccca

SEQ ID NO: 39695 - RNA, 21 nt, Human
uccccugcacuggaguccagu

SEQ ID NO: 39696 - RNA, 19 nt, Human
ggagcgggcggaggaggaa

SEQ ID NO: 39697 - RNA, 21 nt, Human
uauguacauucuugcucugca

SEQ ID NO: 39698 - RNA, 22 nt, Human
gcaacauggugaaagcccgucu

SEQ ID NO: 39699 - RNA, 21 nt, Human
ugucugcagccuugaacucug

SEQ ID NO: 39700 - RNA, 22 nt, Human
ggguugcuccuuugauuagaga

SEQ ID NO: 39701 - RNA, 26 nt, Human
auuucaucuagaaguggcagcaucuc

SEQ ID NO: 39702 - RNA, 26 nt, Human
ugauucucacuuugaguuuucuuccu

SEQ ID NO: 39703 - RNA, 23 nt, Human
uugggguuuggcugcaguggcag

SEQ ID NO: 39704 - RNA, 27 nt, Human
acugguucaagcuuccgccucggcggg

SEQ ID NO: 39705 - RNA, 22 nt, Human
ccuauguguccauuucugcaca

SEQ ID NO: 39706 - RNA, 22 nt, Human
ugcggacuugcugcugcugcug

SEQ ID NO: 39707 - RNA, 21 nt, Human
uucuccucugacccaucagcu

SEQ ID NO: 39708 - RNA, 21 nt, Human
uggggacauuccaauuugcac

SEQ ID NO: 39709 - RNA, 21 nt, Human
acccccaccccccaggccgcc

SEQ ID NO: 39710 - RNA, 17 nt, Human
cuucaucccaaaggaca

SEQ ID NO: 39711 - RNA, 28 nt, Human
gcggcggcugugugcgcagggcccggca

SEQ ID NO: 39712 - RNA, 27 nt, Human
agagacacaauaaugaaacucccagaa

SEQ ID NO: 39713 - RNA, 24 nt, Human
cuuauccugucccuccuccaggua

SEQ ID NO: 39714 - RNA, 26 nt, Human
ccugcacucuagugacccugggugcc

SEQ ID NO: 39715 - RNA, 22 nt, Human
ucuuucaccuguuccauccugu

SEQ ID NO: 39716 - RNA, 27 nt, Human
gagcggcuucagcacugcagccacgac

SEQ ID NO: 39717 - RNA, 24 nt, Human
ggagcaggugugcaggagcgcagc

SEQ ID NO: 39718 - RNA, 23 nt, Human
ugcuguagugccuucugcgccag

SEQ ID NO: 39719 - RNA, 23 nt, Human
gcggcuucaggaacccacggccu

SEQ ID NO: 39720 - RNA, 19 nt, Human
uucaaacuuagugcugcug

SEQ ID NO: 39721 - RNA, 21 nt, Human
ccugaccucugcuuugggguu

SEQ ID NO: 39722 - RNA, 21 nt, Human
ggaaggcaauguguugccaua

SEQ ID NO: 39723 - RNA, 23 nt, Human
ccuugcucuccaggcuguuaacc

SEQ ID NO: 39724 - RNA, 20 nt, Human
ucacggcuucucacugggac

SEQ ID NO: 39725 - RNA, 22 nt, Human
aauuguaccugacccugucuuu

SEQ ID NO: 39726 - RNA, 25 nt, Human
ugaagauuaacuuuuccuaacauug

SEQ ID NO: 39727 - RNA, 23 nt, Human
ggcaggagaaucgcuugaaccug

SEQ ID NO: 39728 - RNA, 23 nt, Human
ggcaggagaauugcuugaaucug

SEQ ID NO: 39729 - RNA, 20 nt, Human
uuuguugaaaauacaguaga

SEQ ID NO: 39730 - RNA, 25 nt, Human
uccuaacuacacacagggaggaggg

SEQ ID NO: 39731 - RNA, 23 nt, Human
agacauaggaacauguaguuuua

SEQ ID NO: 39732 - RNA, 26 nt, Human
gucuguuuuguucauuacuuuguuca

SEQ ID NO: 39733 - RNA, 16 nt, Human
guucccaggcugcagu

SEQ ID NO: 39734 - RNA, 19 nt, Human
agcccaggcgggagcggug

SEQ ID NO: 39735 - RNA, 23 nt, Human
cccgucugcccaguaaaagccuu

SEQ ID NO: 39736 - RNA, 27 nt, Human
gucacccaggcuggacugcaaugacgc

SEQ ID NO: 39737 - RNA, 29 nt, Human
caugcgaaacuccagccuaggcuuucaaa

SEQ ID NO: 39738 - RNA, 21 nt, Human
ccuaccucugcucuuggagga

SEQ ID NO: 39739 - RNA, 26 nt, Human
agagugagaggggagguggcaggaca

SEQ ID NO: 39740 - RNA, 24 nt, Human
cugccggcaccgcccuccugcugc

SEQ ID NO: 39741 - RNA, 22 nt, Human
ccagccuggcgaaaccccaucu

SEQ ID NO: 39742 - RNA, 27 nt, Human
gcucagggcacccugaggcggagguuu

SEQ ID NO: 39743 - RNA, 25 nt, Human
aggaagacggaaaagacugccugcc

SEQ ID NO: 39744 - RNA, 22 nt, Human
ccaacauggugaaaccuugucu

SEQ ID NO: 39745 - RNA, 21 nt, Human
agucuccucccuaugaugcca

SEQ ID NO: 39746 - RNA, 27 nt, Human
cccaaagugcugggauuaaagcuguga

SEQ ID NO: 39747 - RNA, 22 nt, Human
agcucagagagagaaagaucug

SEQ ID NO: 39748 - RNA, 22 nt, Human
gcggugguggcggugcaagaga

SEQ ID NO: 39749 - RNA, 22 nt, Human
ccuggaccaguggucucacaug

SEQ ID NO: 39750 - RNA, 25 nt, Human
ccaggaaugugucagagucaccucc

SEQ ID NO: 39751 - RNA, 21 nt, Human
gucgcccagggcuuggcuacu

SEQ ID NO: 39752 - RNA, 27 nt, Human
ggaggugggggccuucgggaggaggag

SEQ ID NO: 39753 - RNA, 21 nt, Human
uuggcaucugcuuuuaaugga

SEQ ID NO: 39754 - RNA, 23 nt, Human
ggggaggugguaggcugcaugug

SEQ ID NO: 39755 - RNA, 22 nt, Human
cugaucucucuggguaggugcc

SEQ ID NO: 39756 - RNA, 22 nt, Human
gaaauaaaauuauuuugcugaa

SEQ ID NO: 39757 - RNA, 24 nt, Human
aagggccuucucuccaagcuggga

SEQ ID NO: 39758 - RNA, 23 nt, Human
cuuuuuuauuuuuauuuuuugcc

SEQ ID NO: 39759 - RNA, 22 nt, Human
ggcuggugggugggguuuucaa

SEQ ID NO: 39760 - RNA, 26 nt, Human
uuccacauagaggccuucccauccag

SEQ ID NO: 39761 - RNA, 24 nt, Human
gaagcuugaguucugacucacuga

SEQ ID NO: 39762 - RNA, 22 nt, Human
caagccccacagccccucaaag

SEQ ID NO: 39763 - RNA, 27 nt, Human
ucacugcacccuggauuugcauacauu

SEQ ID NO: 39764 - RNA, 19 nt, Human
cuaaaugcauuucuccaca

SEQ ID NO: 39765 - RNA, 22 nt, Human
ccugcugagcugccccugcugc

SEQ ID NO: 39766 - RNA, 18 nt, Human
gagcacuggagugcaggg

SEQ ID NO: 39767 - RNA, 22 nt, Human
ccagaaagagaccuggguuguc

SEQ ID NO: 39768 - RNA, 21 nt, Human
uguuggucaggcuggucucaa

SEQ ID NO: 39769 - RNA, 27 nt, Human
ucacagaccacacacccagcccuccug

SEQ ID NO: 39770 - RNA, 22 nt, Human
agacugggaaacauacacauac

SEQ ID NO: 39771 - RNA, 21 nt, Human
ggcaggcaggcagggcauagc

SEQ ID NO: 39772 - RNA, 27 nt, Human
agcugggaucaaccacaauuaauagga

SEQ ID NO: 39773 - RNA, 22 nt, Human
aaauguucaaagaguagcacua

SEQ ID NO: 39774 - RNA, 21 nt, Human
uucuccuucuucagccucccg

SEQ ID NO: 39775 - RNA, 22 nt, Human
ucugcgugcucucacucucucu

SEQ ID NO: 39776 - RNA, 26 nt, Human
ugggcagaucaugggucaagagaucg

SEQ ID NO: 39777 - RNA, 21 nt, Human
ugagggugacuuuuccugcug

SEQ ID NO: 39778 - RNA, 21 nt, Human
cucccagugaggugguugcuc

SEQ ID NO: 39779 - RNA, 22 nt, Human
agaguucucgaagaaaauaaau

SEQ ID NO: 39780 - RNA, 25 nt, Human
aacaaggggucugaggaugcauucg

SEQ ID NO: 39781 - RNA, 20 nt, Human
gggagggagggagggaaagc

SEQ ID NO: 39782 - RNA, 20 nt, Human
gggaggcagagcggcaagga

SEQ ID NO: 39783 - RNA, 24 nt, Human
acuuuucuaugccauuugccucca

SEQ ID NO: 39784 - RNA, 23 nt, Human
ugucagaguuccguacucgggag

SEQ ID NO: 39785 - RNA, 24 nt, Human
gagagugagcuguaggugugcggg

SEQ ID NO: 39786 - RNA, 17 nt, Human
cugggagcuuggccucu

SEQ ID NO: 39787 - RNA, 26 nt, Human
cuggaucuccugcugccuuuucugga

SEQ ID NO: 39788 - RNA, 22 nt, Human
ugcaaccucugcuucccagguu

SEQ ID NO: 39789 - RNA, 24 nt, Human
cacaccuguaaccccaucuucucu

SEQ ID NO: 39790 - RNA, 22 nt, Human
ggcaaugguuucacaugguuac

SEQ ID NO: 39791 - RNA, 21 nt, Human
gguucacugcagucuugaccu

SEQ ID NO: 39792 - RNA, 27 nt, Human
ucauauuaaaaggacuauuucucuaaa

SEQ ID NO: 39793 - RNA, 20 nt, Human
gggcccaggaaaauuagaag

SEQ ID NO: 39794 - RNA, 29 nt, Human
uaucuauguuggguccaagaaggaauuuc

SEQ ID NO: 39795 - RNA, 26 nt, Human
ugccacacacccccuuccuccuacca

SEQ ID NO: 39796 - RNA, 22 nt, Human
acgcuggugcugagacaggggc

SEQ ID NO: 39797 - RNA, 24 nt, Human
cuaugucacccaaugcauauccaa

SEQ ID NO: 39798 - RNA, 21 nt, Human
uucaggaaacacagauucuuu

SEQ ID NO: 39799 - RNA, 26 nt, Human
cguaugagaaaccuauauuucaauac

SEQ ID NO: 39800 - RNA, 26 nt, Human
cagaagccugccucugauuuacccua

SEQ ID NO: 39801 - RNA, 21 nt, Human
gcucaagaccagccuggcuaa

SEQ ID NO: 39802 - RNA, 29 nt, Human
agcacccccuuguaagcucagggcuacug

SEQ ID NO: 39803 - RNA, 22 nt, Human
cuaucggccucuugggagccag

SEQ ID NO: 39804 - RNA, 21 nt, Human
uuuucuuuucuuguggaauau

SEQ ID NO: 39805 - RNA, 23 nt, Human
uuugacuuauacaacauagucag

SEQ ID NO: 39806 - RNA, 21 nt, Human
gcaaaaugcugggauuacagg

SEQ ID NO: 39807 - RNA, 21 nt, Human
caagauucuucagucuggacu

SEQ ID NO: 39808 - RNA, 23 nt, Human
auguucuucuucauugaauuuca

SEQ ID NO: 39809 - RNA, 26 nt, Human
uuuggcaaccuguguccuggcugagg

SEQ ID NO: 39810 - RNA, 24 nt, Human
gcguaaucucggcucacugcaacg

SEQ ID NO: 39811 - RNA, 23 nt, Human
ugggagagagaaaagaaaccaga

SEQ ID NO: 39812 - RNA, 22 nt, Human
acuggucuuccucugauucagc

SEQ ID NO: 39813 - RNA, 27 nt, Human
guccaggcuggucuugaauuccugggc

SEQ ID NO: 39814 - RNA, 25 nt, Human
ccacauuuugcuuuauaauuucuac

SEQ ID NO: 39815 - RNA, 19 nt, Human
acacauggacaccauuuca

SEQ ID NO: 39816 - RNA, 26 nt, Human
cuguaaccccaucuucucugaguaca

SEQ ID NO: 39817 - RNA, 19 nt, Human
cacaggcuggcaguuggua

SEQ ID NO: 39818 - RNA, 21 nt, Human
uguuacugcuacuacacuuug

SEQ ID NO: 39819 - RNA, 22 nt, Human
ucagcaaguggagguuucaaug

SEQ ID NO: 39820 - RNA, 18 nt, Human
gacuguacuuauuuucca

SEQ ID NO: 39821 - RNA, 24 nt, Human
ccacucauuuaaauaauacaauca

SEQ ID NO: 39822 - RNA, 22 nt, Human
ucuuucucugggaccugggguc

SEQ ID NO: 39823 - RNA, 23 nt, Human
ccuacugcucaguagucaucucu

SEQ ID NO: 39824 - RNA, 26 nt, Human
ucacacacaaacaggcuuuccacccc

SEQ ID NO: 39825 - RNA, 22 nt, Human
ugugagccacugugucuggcca

SEQ ID NO: 39826 - RNA, 25 nt, Human
ccacuucucagcgaggauggcacuu

SEQ ID NO: 39827 - RNA, 20 nt, Human
gggaggcaagaucucaggga

SEQ ID NO: 39828 - RNA, 22 nt, Human
ucuguggguuucuaagugacac

SEQ ID NO: 39829 - RNA, 21 nt, Human
cgucuggaaugggcuuggggg

SEQ ID NO: 39830 - RNA, 21 nt, Human
guuauuggaaaauacuaccua

SEQ ID NO: 39831 - RNA, 29 nt, Human
gcuggccuuugccagcauguucaacagcu

SEQ ID NO: 39832 - RNA, 19 nt, Human
gccuuagagagccacagga

SEQ ID NO: 39833 - RNA, 22 nt, Human
cgccuccaggcugggccuggcc

SEQ ID NO: 39834 - RNA, 23 nt, Human
cucuggacuggggacacagggau

SEQ ID NO: 39835 - RNA, 25 nt, Human
cagcaucagcaacugggcacagaaa

SEQ ID NO: 39836 - RNA, 26 nt, Human
cgugccucccccugcugcccugggcu

SEQ ID NO: 39837 - RNA, 26 nt, Human
aaauggugcaguauuugcauauaacc

SEQ ID NO: 39838 - RNA, 18 nt, Human
gcuguccuuuggagggug

SEQ ID NO: 39839 - RNA, 22 nt, Human
gacuccugccuguuuuagucca

SEQ ID NO: 39840 - RNA, 22 nt, Human
ucgugccacugcaguccagccu

SEQ ID NO: 39841 - RNA, 22 nt, Human
gaucccucagccaacucugaag

SEQ ID NO: 39842 - RNA, 23 nt, Human
agagggggagagcaggcagcggg

SEQ ID NO: 39843 - RNA, 24 nt, Human
uuuugcucacagggacucuccaua

SEQ ID NO: 39844 - RNA, 22 nt, Human
ucuuucuccaccaccucgggcc

SEQ ID NO: 39845 - RNA, 21 nt, Human
cuccagaauuacccuuccuca

SEQ ID NO: 39846 - RNA, 22 nt, Human
cacacaccuccgagacagucca

SEQ ID NO: 39847 - RNA, 21 nt, Human
ccucacugcugcccugagucc

SEQ ID NO: 39848 - RNA, 26 nt, Human
gcagggauagucacuggcuggacucc

SEQ ID NO: 39849 - RNA, 21 nt, Human
ggaaggcccucucgccaacac

SEQ ID NO: 39850 - RNA, 25 nt, Human
aguauuuuuauaaauauaagccuuu

SEQ ID NO: 39851 - RNA, 23 nt, Human
aaagaaccacacuagggucucca

SEQ ID NO: 39852 - RNA, 20 nt, Human
gaggacagacacaggcucca

SEQ ID NO: 39853 - RNA, 24 nt, Human
cuuacugucugcaccagccggccu

SEQ ID NO: 39854 - RNA, 24 nt, Human
aggguccaggcaggguguagggga

SEQ ID NO: 39855 - RNA, 26 nt, Human
acccaaagguaggaaggucaagguca

SEQ ID NO: 39856 - RNA, 26 nt, Human
ucuuucuuuuuuaauguugccaaaac

SEQ ID NO: 39857 - RNA, 23 nt, Human
guuucguagaugccccucucugg

SEQ ID NO: 39858 - RNA, 26 nt, Human
gugcccaggcuggagugcaauagcuc

SEQ ID NO: 39859 - RNA, 27 nt, Human
gaccagccugaccaacauggagauauc

SEQ ID NO: 39860 - RNA, 21 nt, Human
cagacugcauuuaucuuguca

SEQ ID NO: 39861 - RNA, 16 nt, Human
cuucccuuucuaccca

SEQ ID NO: 39862 - RNA, 18 nt, Human
auuugaaauucuccaugu

SEQ ID NO: 39863 - RNA, 22 nt, Human
cugcaaccuucaccuaccgagu

SEQ ID NO: 39864 - RNA, 24 nt, Human
ccacccuggcccgccccucgcugc

SEQ ID NO: 39865 - RNA, 23 nt, Human
uguugccuaggcuggaggacagu

SEQ ID NO: 39866 - RNA, 21 nt, Human
uucuccucuccuucccauggc

SEQ ID NO: 39867 - RNA, 24 nt, Human
auagacacuaaccuugauagugau

SEQ ID NO: 39868 - RNA, 23 nt, Human
cuggugcgcugcacccacuaaug

SEQ ID NO: 39869 - RNA, 21 nt, Human
ccuucauucagccuugcugac

SEQ ID NO: 39870 - RNA, 21 nt, Human
cuguuugagauuuuuaucucu

SEQ ID NO: 39871 - RNA, 21 nt, Human
ugucccuaacaguccacaggc

SEQ ID NO: 39872 - RNA, 23 nt, Human
ugggcgguggagcaggagcuggc

SEQ ID NO: 39873 - RNA, 22 nt, Human
guuuuuaaaauaugcuacucug

SEQ ID NO: 39874 - RNA, 29 nt, Human
uaaccgcaaacuaucaacaacccccaacc

SEQ ID NO: 39875 - RNA, 20 nt, Human
aguaggggaaggcccaggga

SEQ ID NO: 39876 - RNA, 25 nt, Human
uccggcauaagagagacacuugcuu

SEQ ID NO: 39877 - RNA, 26 nt, Human
cgaguccaggauggaauuucacagga

SEQ ID NO: 39878 - RNA, 23 nt, Human
gauuauccugcugccaucauguc

SEQ ID NO: 39879 - RNA, 25 nt, Human
ccugcugcugaggcuguaccuccuu

SEQ ID NO: 39880 - RNA, 21 nt, Human
ugggcaauuggcaccaucuuu

SEQ ID NO: 39881 - RNA, 26 nt, Human
acaagcugggacgucagggaaaugaa

SEQ ID NO: 39882 - RNA, 26 nt, Human
cuggacggcaggcucacugccaggcc

SEQ ID NO: 39883 - RNA, 25 nt, Human
cauguucugauugguuuucugggaa

SEQ ID NO: 39884 - RNA, 24 nt, Human
agacauccccuuagaugaucugaa

SEQ ID NO: 39885 - RNA, 26 nt, Human
gggcggaaggggacuucgggagccag

SEQ ID NO: 39886 - RNA, 20 nt, Human
cgccuguaucccagcacuuu

SEQ ID NO: 39887 - RNA, 24 nt, Human
cucauagccagcucuacacagagg

SEQ ID NO: 39888 - RNA, 22 nt, Human
uacagaagaguaaacuggugag

SEQ ID NO: 39889 - RNA, 19 nt, Human
aaguccagagccugccacu

SEQ ID NO: 39890 - RNA, 27 nt, Human
acuugugguucuucaacagcugugcag

SEQ ID NO: 39891 - RNA, 25 nt, Human
uggcuucucccaggccucuucuacu

SEQ ID NO: 39892 - RNA, 22 nt, Human
guggcuuugcccagccugcugc

SEQ ID NO: 39893 - RNA, 30 nt, Human
ugcggucagccucuucacacccaccuggcu

SEQ ID NO: 39894 - RNA, 21 nt, Human
cucgauccugcaccuuccucu

SEQ ID NO: 39895 - RNA, 23 nt, Human
cagggagaccugggguccugugg

SEQ ID NO: 39896 - RNA, 27 nt, Human
gaucaaauugugcaguacuuugugcau

SEQ ID NO: 39897 - RNA, 26 nt, Human
ugcagagucccugagcccaccuccca

SEQ ID NO: 39898 - RNA, 21 nt, Human
ugucuugggccucuuuuguca

SEQ ID NO: 39899 - RNA, 23 nt, Human
ucuguuacuccugauggugccau

SEQ ID NO: 39900 - RNA, 22 nt, Human
cuugcccaggcuggagugcaau

SEQ ID NO: 39901 - RNA, 20 nt, Human
ccccuuagcucacagugccu

SEQ ID NO: 39902 - RNA, 22 nt, Human
cccaucaucuugggaggugggg

SEQ ID NO: 39903 - RNA, 22 nt, Human
gaacuccugggcucaagcaauc

SEQ ID NO: 39904 - RNA, 23 nt, Human
ucacuauacagagagucugaacc

SEQ ID NO: 39905 - RNA, 22 nt, Human
ucauuccacuacaaagucaccu

SEQ ID NO: 39906 - RNA, 21 nt, Human
uugagcaauagucaguggcac

SEQ ID NO: 39907 - RNA, 21 nt, Human
gaucccuggccacugaaaagc

SEQ ID NO: 39908 - RNA, 24 nt, Human
ugagcaauaaacaacacauuuuua

SEQ ID NO: 39909 - RNA, 22 nt, Human
uuuguaaauacauuguuugcag

SEQ ID NO: 39910 - RNA, 27 nt, Human
ucucccacuguuuguacucucaccuuc

SEQ ID NO: 39911 - RNA, 21 nt, Human
uguugucccuucuaggguuau

SEQ ID NO: 39912 - RNA, 26 nt, Human
uuacuacagcaaggcuuugguuucca

SEQ ID NO: 39913 - RNA, 27 nt, Human
aaucuauacugugaugauuugacucaa

SEQ ID NO: 39914 - RNA, 26 nt, Human
gggagggggcccugcccggcccuccc

SEQ ID NO: 39915 - RNA, 25 nt, Human
cagcucaggcuggagcagguauaug

SEQ ID NO: 39916 - RNA, 21 nt, Human
aucugucacaaaaagccaggu

SEQ ID NO: 39917 - RNA, 23 nt, Human
ggugagagggccgggcagagggg

SEQ ID NO: 39918 - RNA, 21 nt, Human
uuguuugguuauagugcaaua

SEQ ID NO: 39919 - RNA, 21 nt, Human
ugauuccacugaaaccucugu

SEQ ID NO: 39920 - RNA, 22 nt, Human
aggaacacuacacugcacagga

SEQ ID NO: 39921 - RNA, 26 nt, Human
caugaucuuagcucacugcaaccucc

SEQ ID NO: 39922 - RNA, 17 nt, Human
aggguggagugcagugg

SEQ ID NO: 39923 - RNA, 22 nt, Human
uucuccaaacugaagcagccuc

SEQ ID NO: 39924 - RNA, 23 nt, Human
aggcuggagugcaggccgcgauc

SEQ ID NO: 39925 - RNA, 29 nt, Human
cuuugagcuucuccucugcuccaacagac

SEQ ID NO: 39926 - RNA, 26 nt, Human
gcagcaggcccaggccagcgggcgcc

SEQ ID NO: 39927 - RNA, 19 nt, Human
ccagaguuuaucuuuucua

SEQ ID NO: 39928 - RNA, 24 nt, Human
ccugagccugcuucugccugcuuu

SEQ ID NO: 39929 - RNA, 22 nt, Human
gcacugaagaagaccugccugu

SEQ ID NO: 39930 - RNA, 20 nt, Human
aacacagccaucuaacucau

SEQ ID NO: 39931 - RNA, 29 nt, Human
auuguauuaucuucuucuuuguuuucagu

SEQ ID NO: 39932 - RNA, 22 nt, Human
gcaugagccacuguguccgguc

SEQ ID NO: 39933 - RNA, 26 nt, Human
uucuaaaauggcagcuucaguucuag

SEQ ID NO: 39934 - RNA, 26 nt, Human
gcuugggcuggagugggcucucugga

SEQ ID NO: 39935 - RNA, 25 nt, Human
gccuucuccaccugcccucccacuc

SEQ ID NO: 39936 - RNA, 19 nt, Human
ccuccaucuaccccuucca

SEQ ID NO: 39937 - RNA, 20 nt, Human
uucucuucucucuggacuuc

SEQ ID NO: 39938 - RNA, 24 nt, Human
cucucccaggcaggcagcugcagg

SEQ ID NO: 39939 - RNA, 22 nt, Human
caucucugaaaagacuggggga

SEQ ID NO: 39940 - RNA, 25 nt, Human
ggacuugccuuuccuucucuucucc

SEQ ID NO: 39941 - RNA, 20 nt, Human
uaggaagagagugggcugca

SEQ ID NO: 39942 - RNA, 22 nt, Human
gggagagaggggaggcaaagcu

SEQ ID NO: 39943 - RNA, 23 nt, Human
cugucccuggacccuggcuggca

SEQ ID NO: 39944 - RNA, 24 nt, Human
gucauuuuauaugacuaguuuaca

SEQ ID NO: 39945 - RNA, 22 nt, Human
cgccccugcacuccagccuggg

SEQ ID NO: 39946 - RNA, 22 nt, Human
ugccccuguacuccagccuggg

SEQ ID NO: 39947 - RNA, 26 nt, Human
ucuaccaggucaaaauagugccacua

SEQ ID NO: 39948 - RNA, 26 nt, Human
ccugguguggcucuaaggguaaauca

SEQ ID NO: 39949 - RNA, 21 nt, Human
ucccaaacccucaggauggcg

SEQ ID NO: 39950 - RNA, 22 nt, Human
acggaggggcugggccugggga

SEQ ID NO: 39951 - RNA, 23 nt, Human
auguaaacucgggggugcugggg

SEQ ID NO: 39952 - RNA, 19 nt, Human
guccagaguucucgaagaa

SEQ ID NO: 39953 - RNA, 23 nt, Human
cugcugagagacagagcuauucu

SEQ ID NO: 39954 - RNA, 27 nt, Human
ccuaacggauagcauuuguaaauacuc

SEQ ID NO: 39955 - RNA, 26 nt, Human
gcugccucuuuggcaccuccucccaa

SEQ ID NO: 39956 - RNA, 23 nt, Human
guguguccccucuugacacucac

SEQ ID NO: 39957 - RNA, 22 nt, Human
ggcguugggguuaguaucucuc

SEQ ID NO: 39958 - RNA, 16 nt, Human
uucuacugccucagcc

SEQ ID NO: 39959 - RNA, 27 nt, Human
acuagcacgacuuacauagcucaaaua

SEQ ID NO: 39960 - RNA, 22 nt, Human
ugaggggacuaaguguucucag

SEQ ID NO: 39961 - RNA, 15 nt, Human
ggucuaccucuguca

SEQ ID NO: 39962 - RNA, 26 nt, Human
uggagugcuggugcugagcuguuuga

SEQ ID NO: 39963 - RNA, 23 nt, Human
cagagauacccagacaacaggau

SEQ ID NO: 39964 - RNA, 19 nt, Human
agucucccccuuccugcau

SEQ ID NO: 39965 - RNA, 18 nt, Human
aagggcguggcucugggu

SEQ ID NO: 39966 - RNA, 22 nt, Human
accaaaacaccccaacuuggca

SEQ ID NO: 39967 - RNA, 27 nt, Human
uuacucagaauucucuaguuugauuaa

SEQ ID NO: 39968 - RNA, 21 nt, Human
caagcgagucuccugccucag

SEQ ID NO: 39969 - RNA, 21 nt, Human
ucuucucacagucaaaaggaa

SEQ ID NO: 39970 - RNA, 20 nt, Human
uucaugcagccauccauuug

SEQ ID NO: 39971 - RNA, 19 nt, Human
guuacggucccaucucuuc

SEQ ID NO: 39972 - RNA, 26 nt, Human
cagggaggggugggagagggaauuua

SEQ ID NO: 39973 - RNA, 21 nt, Human
acugcucuacacugcaugucu

SEQ ID NO: 39974 - RNA, 19 nt, Human
uauuuacacugaauuccaa

SEQ ID NO: 39975 - RNA, 19 nt, Human
ccacuaaggaggaggaguc

SEQ ID NO: 39976 - RNA, 22 nt, Human
uguuccaagugugugugcaaug

SEQ ID NO: 39977 - RNA, 32 nt, Human
gggauuccuaaucacucagagcagucugugac

SEQ ID NO: 39978 - RNA, 27 nt, Human
uguguaugauucauuaccauuuugagg

SEQ ID NO: 39979 - RNA, 21 nt, Human
cccaaauugauuuucuucuuu

SEQ ID NO: 39980 - RNA, 18 nt, Human
gguuauacaacuugccuc

SEQ ID NO: 39981 - RNA, 22 nt, Human
uugcccgggcaaccagcuuugc

SEQ ID NO: 39982 - RNA, 23 nt, Human
ccaucucuacaaaaaccaaaaag

SEQ ID NO: 39983 - RNA, 21 nt, Human
ccugcagcugccuuuucugcc

SEQ ID NO: 39984 - RNA, 21 nt, Human
ucgucacgccuguaaucccag

SEQ ID NO: 39985 - RNA, 21 nt, Human
gccagugacugucccucccag

SEQ ID NO: 39986 - RNA, 27 nt, Human
ccaacuugugacugcucacuuaugacg

SEQ ID NO: 39987 - RNA, 19 nt, Human
aaauacugcuuagcauuuu

SEQ ID NO: 39988 - RNA, 25 nt, Human
gcucugcacauucaccgcagcugcc

SEQ ID NO: 39989 - RNA, 22 nt, Human
ccagagagaggccaaggcugau

SEQ ID NO: 39990 - RNA, 21 nt, Human
agcuugacaaauaauuagugu

SEQ ID NO: 39991 - RNA, 23 nt, Human
agggaggucuccugggcugccag

SEQ ID NO: 39992 - RNA, 21 nt, Human
auuuccuuugagcaucaugcc

SEQ ID NO: 39993 - RNA, 24 nt, Human
cggcagcagcggcgguggcagugg

SEQ ID NO: 39994 - RNA, 27 nt, Human
auuaaaaucagcagauugaguuuucaa

SEQ ID NO: 39995 - RNA, 23 nt, Human
gggaauggcacagcccaaagaag

SEQ ID NO: 39996 - RNA, 22 nt, Human
ugagugagaggggaggccaaga

SEQ ID NO: 39997 - RNA, 32 nt, Human
uagaaaaugcagaaacuccccaaugccuuagc

SEQ ID NO: 39998 - RNA, 26 nt, Human
cucucuagguccccaggggggccggg

SEQ ID NO: 39999 - RNA, 27 nt, Human
uucccuggaaggucccauucuuucuca

SEQ ID NO: 40000 - RNA, 26 nt, Human
cgccucagccucccaaagugcuggga

SEQ ID NO: 40001 - RNA, 20 nt, Human
aggcaccuuaucagcagagc

SEQ ID NO: 40002 - RNA, 23 nt, Human
agguagaggguuggggguuggug

SEQ ID NO: 40003 - RNA, 25 nt, Human
aggccuggccugaucuggccucugc

SEQ ID NO: 40004 - RNA, 19 nt, Human
cugucaaucccaucugcag

SEQ ID NO: 40005 - RNA, 21 nt, Human
acugacugaaacaugagccag

SEQ ID NO: 40006 - RNA, 22 nt, Human
guuggagagcacaguugccccg

SEQ ID NO: 40007 - RNA, 23 nt, Human
cacucuccaggcuggagugcagu

SEQ ID NO: 40008 - RNA, 26 nt, Human
gggugaggaaauccagaguugccaug

SEQ ID NO: 40009 - RNA, 22 nt, Human
aggagaaagcugauggagccag

SEQ ID NO: 40010 - RNA, 26 nt, Human
cgcccaggcuggagugcagucgugcc

SEQ ID NO: 40011 - RNA, 23 nt, Human
ucucaaacuccugaccucaggca

SEQ ID NO: 40012 - RNA, 26 nt, Human
cucacuaaaaaggaaacuucaguuga

SEQ ID NO: 40013 - RNA, 20 nt, Human
cuucucuuuucccucccaac

SEQ ID NO: 40014 - RNA, 22 nt, Human
ggggaggggguaagggagccag

SEQ ID NO: 40015 - RNA, 20 nt, Human
ucggaagcagugccuuccau

SEQ ID NO: 40016 - RNA, 25 nt, Human
aaggaaaugcaguguguugcagugg

SEQ ID NO: 40017 - RNA, 27 nt, Human
uugggauggaauggccucugaaagacu

SEQ ID NO: 40018 - RNA, 27 nt, Human
ccugcagcguucacgaagugacauuga

SEQ ID NO: 40019 - RNA, 21 nt, Human
uuacucuuauuuucagaaaga

SEQ ID NO: 40020 - RNA, 23 nt, Human
cgccuccuggguucaagcaaguc

SEQ ID NO: 40021 - RNA, 18 nt, Human
ccagaucucaucugggga

SEQ ID NO: 40022 - RNA, 24 nt, Human
guccccucccucacaggccugcag

SEQ ID NO: 40023 - RNA, 21 nt, Human
gagcuccccuggggcucugga

SEQ ID NO: 40024 - RNA, 22 nt, Human
cuggcauuuguuuccucaucuu

SEQ ID NO: 40025 - RNA, 22 nt, Human
aacucugcccuggcuucucugg

SEQ ID NO: 40026 - RNA, 27 nt, Human
gaccuaggucuuuugaacucaagucca

SEQ ID NO: 40027 - RNA, 24 nt, Human
ggaagaagaaaacucaacucagug

SEQ ID NO: 40028 - RNA, 21 nt, Human
gauccucucuggggcuguguu

SEQ ID NO: 40029 - RNA, 20 nt, Human
uuuuaccuucuuuaaaauag

SEQ ID NO: 40030 - RNA, 27 nt, Human
ccccugccuugccccugagcacuucug

SEQ ID NO: 40031 - RNA, 22 nt, Human
ccaaguagauuuggguagagga

SEQ ID NO: 40032 - RNA, 26 nt, Human
agccccggaggcggcggucgagaccc

SEQ ID NO: 40033 - RNA, 22 nt, Human
ugcaauccgggagguguuuccu

SEQ ID NO: 40034 - RNA, 26 nt, Human
acuggguggaugaaaggccgagggau

SEQ ID NO: 40035 - RNA, 22 nt, Human
gggcacugacugauagcuuaca

SEQ ID NO: 40036 - RNA, 20 nt, Human
uuauuuucacacaguccaca

SEQ ID NO: 40037 - RNA, 23 nt, Human
gcgacucugugucccaggcacag

SEQ ID NO: 40038 - RNA, 22 nt, Human
ucucgggguggggugacuggga

SEQ ID NO: 40039 - RNA, 22 nt, Human
cuguuacacuauuaaaggcuua

SEQ ID NO: 40040 - RNA, 18 nt, Human
uuaagacuuacaccccag

SEQ ID NO: 40041 - RNA, 24 nt, Human
acuuuugcuuucuaccugacugcc

SEQ ID NO: 40042 - RNA, 23 nt, Human
uugcugacucacguugcugcccu

SEQ ID NO: 40043 - RNA, 18 nt, Human
gguauuuucacugccuca

SEQ ID NO: 40044 - RNA, 22 nt, Human
agcuaccaauuuuagaauauua

SEQ ID NO: 40045 - RNA, 27 nt, Human
uuggaaaacauguucuagaacuaguua

SEQ ID NO: 40046 - RNA, 22 nt, Human
accgggcagccagaaaaaucau

SEQ ID NO: 40047 - RNA, 21 nt, Human
ugcuggggcccagucugcccc

SEQ ID NO: 40048 - RNA, 26 nt, Human
aacuucugugugguggcaguacugug

SEQ ID NO: 40049 - RNA, 24 nt, Human
acgggaguggacaggaguggaugc

SEQ ID NO: 40050 - RNA, 18 nt, Human
aguucacauccaccugcu

SEQ ID NO: 40051 - RNA, 23 nt, Human
gcagagaaauaaacagcauuucu

SEQ ID NO: 40052 - RNA, 23 nt, Human
gggccuggccucuguaagccugu

SEQ ID NO: 40053 - RNA, 27 nt, Human
accacacagccaagcugagacuguggc

SEQ ID NO: 40054 - RNA, 23 nt, Human
cgcgcgccgccgccuccagggug

SEQ ID NO: 40055 - RNA, 21 nt, Human
acaaggucaguaaugcugcag

SEQ ID NO: 40056 - RNA, 22 nt, Human
aguaauacagccugguuuucaa

SEQ ID NO: 40057 - RNA, 23 nt, Human
agcccguccuccccugccugccu

SEQ ID NO: 40058 - RNA, 22 nt, Human
uacacuagcuuucugcauuuaa

SEQ ID NO: 40059 - RNA, 22 nt, Human
agucagacagagacagcaagac

SEQ ID NO: 40060 - RNA, 26 nt, Human
ccugcuguuugcuuuugguaauguga

SEQ ID NO: 40061 - RNA, 20 nt, Human
acccaugccaucucaaccuc

SEQ ID NO: 40062 - RNA, 25 nt, Human
uuaugcauuuaucucuuuuguggac

SEQ ID NO: 40063 - RNA, 21 nt, Human
uuucuaccucagcagcaguug

SEQ ID NO: 40064 - RNA, 19 nt, Human
uccuuuaagacuuaccuca

SEQ ID NO: 40065 - RNA, 19 nt, Human
ucuggcagagccucagcug

SEQ ID NO: 40066 - RNA, 21 nt, Human
cucuguguugccaugugugcu

SEQ ID NO: 40067 - RNA, 17 nt, Human
gacuucuuugugcucaa

SEQ ID NO: 40068 - RNA, 30 nt, Human
cuggccuuucuguuccuuggacaugccugg

SEQ ID NO: 40069 - RNA, 25 nt, Human
gaguacagaguggcccucaccgagg

SEQ ID NO: 40070 - RNA, 21 nt, Human
gcaucccucuccaaaagguca

SEQ ID NO: 40071 - RNA, 22 nt, Human
ugaagucuaggauauuuuucag

SEQ ID NO: 40072 - RNA, 26 nt, Human
ccacaguugaggcucacacacagguc

SEQ ID NO: 40073 - RNA, 22 nt, Human
acugccuuccuccuuauccuac

SEQ ID NO: 40074 - RNA, 26 nt, Human
ggauucagggccggagguucuggugg

SEQ ID NO: 40075 - RNA, 20 nt, Human
cuauuuaguagcaugcagga

SEQ ID NO: 40076 - RNA, 27 nt, Human
aucaaagggcugaguugagaacacugu

SEQ ID NO: 40077 - RNA, 21 nt, Human
acaggcuggccacagcugggc

SEQ ID NO: 40078 - RNA, 30 nt, Human
acaugcugcugcuacugcuaacagccaauu

SEQ ID NO: 40079 - RNA, 21 nt, Human
cugccucuggcugccugcguc

SEQ ID NO: 40080 - RNA, 28 nt, Human
cacaugcuauguucugucuucccaaacc

SEQ ID NO: 40081 - RNA, 17 nt, Human
gccucaagcucuggcug

SEQ ID NO: 40082 - RNA, 22 nt, Human
uugcccagggcucagccuggug

SEQ ID NO: 40083 - RNA, 27 nt, Human
uuccuaaguucaucagaaugaagggga

SEQ ID NO: 40084 - RNA, 23 nt, Human
ccuggcucccugucccugggcuc

SEQ ID NO: 40085 - RNA, 24 nt, Human
ccugccucuguggcucugccugug

SEQ ID NO: 40086 - RNA, 23 nt, Human
cucgguaccuguuacugcugcua

SEQ ID NO: 40087 - RNA, 28 nt, Human
ucagcuuccugugccucugugggagagg

SEQ ID NO: 40088 - RNA, 22 nt, Human
aggcugccgcuggguggcagaa

SEQ ID NO: 40089 - RNA, 19 nt, Human
gagggaggggcaggagagc

SEQ ID NO: 40090 - RNA, 28 nt, Human
gaguguacugugcuugaagcagagcacu

SEQ ID NO: 40091 - RNA, 26 nt, Human
uugcucugucauccaggcuggagugc

SEQ ID NO: 40092 - RNA, 25 nt, Human
agaaguuaaagagacuucucuguaa

SEQ ID NO: 40093 - RNA, 23 nt, Human
cagcgcugggcuggugugcagug

SEQ ID NO: 40094 - RNA, 21 nt, Human
uaugcccacgcuggagugcag

SEQ ID NO: 40095 - RNA, 21 nt, Human
ugagaagcuggaaauauuucu

SEQ ID NO: 40096 - RNA, 22 nt, Human
cauauccugggacauaaaaaua

SEQ ID NO: 40097 - RNA, 25 nt, Human
gcuguuagcaugaugucuuaccuca

SEQ ID NO: 40098 - RNA, 22 nt, Human
acaacugcugagagaucaaaga

SEQ ID NO: 40099 - RNA, 21 nt, Human
uuugccuuguguccucuuguu

SEQ ID NO: 40100 - RNA, 20 nt, Human
gggggccgggggaggacuga

SEQ ID NO: 40101 - RNA, 22 nt, Human
uauuaaaaauauggaacuucua

SEQ ID NO: 40102 - RNA, 28 nt, Human
uccuggaucucccugagaugggcuuccc

SEQ ID NO: 40103 - RNA, 25 nt, Human
gccucccucccuccugccccggcau

SEQ ID NO: 40104 - RNA, 24 nt, Human
agaguuguugcugagaauuaagaa

SEQ ID NO: 40105 - RNA, 24 nt, Human
ucagaggcuggagagcagagcacc

SEQ ID NO: 40106 - RNA, 22 nt, Human
gaucacugcaaccucugccucc

SEQ ID NO: 40107 - RNA, 27 nt, Human
ggaggcugaggugggagaauugcuuga

SEQ ID NO: 40108 - RNA, 26 nt, Human
cuacccagagccuucuccugccuaca

SEQ ID NO: 40109 - RNA, 26 nt, Human
gcaaagcaugcccuucugcacaggag

SEQ ID NO: 40110 - RNA, 19 nt, Human
uucucuuccuccuccaccg

SEQ ID NO: 40111 - RNA, 19 nt, Human
aucccuugcugcgggcccg

SEQ ID NO: 40112 - RNA, 23 nt, Human
gcucccagccagcgagucaggag

SEQ ID NO: 40113 - RNA, 24 nt, Human
gugggugcggaggggcgugugugc

SEQ ID NO: 40114 - RNA, 25 nt, Human
acuaagcugacccugcuucaagcaa

SEQ ID NO: 40115 - RNA, 18 nt, Human
cugucugaccugguucuc

SEQ ID NO: 40116 - RNA, 22 nt, Human
uuuguggguuuugaaugcaucu

SEQ ID NO: 40117 - RNA, 21 nt, Human
gugaagcccuauaggucucag

SEQ ID NO: 40118 - RNA, 22 nt, Human
agccccacucacccacccuccu

SEQ ID NO: 40119 - RNA, 21 nt, Human
ccaaagcucucuggcacccag

SEQ ID NO: 40120 - RNA, 21 nt, Human
gccaaaacauagagccagcuu

SEQ ID NO: 40121 - RNA, 23 nt, Human
ccucuucgugaacaccagcagau

SEQ ID NO: 40122 - RNA, 19 nt, Human
ucaguccugcuucuuccag

SEQ ID NO: 40123 - RNA, 26 nt, Human
gcuccuggaacuugcucaggcuccgg

SEQ ID NO: 40124 - RNA, 22 nt, Human
ccacugcacuccaggcugggug

SEQ ID NO: 40125 - RNA, 25 nt, Human
agucccuggcuauaagaucuggauu

SEQ ID NO: 40126 - RNA, 24 nt, Human
uagaucauagcuugaacugaagcc

SEQ ID NO: 40127 - RNA, 22 nt, Human
aggcugagaugagaggaucacu

SEQ ID NO: 40128 - RNA, 24 nt, Human
ggaugagaccggugcgacucauga

SEQ ID NO: 40129 - RNA, 22 nt, Human
cucagucucccaaguagcuggg

SEQ ID NO: 40130 - RNA, 19 nt, Human
ccaggaggucgaggcugca

SEQ ID NO: 40131 - RNA, 28 nt, Human
gcugcuuuguuguucugccuguccuagu

SEQ ID NO: 40132 - RNA, 20 nt, Human
gcugagucucugaaaagucu

SEQ ID NO: 40133 - RNA, 21 nt, Human
caaaaguaaucuaccucugaa

SEQ ID NO: 40134 - RNA, 22 nt, Human
uagacugccccacuuaaacucu

SEQ ID NO: 40135 - RNA, 21 nt, Human
cuccaucugaucaaagugaca

SEQ ID NO: 40136 - RNA, 24 nt, Human
agcagagaaggcacuugcauccua

SEQ ID NO: 40137 - RNA, 21 nt, Human
ggcuuggaaugaauucucucu

SEQ ID NO: 40138 - RNA, 23 nt, Human
acgcaaacaacaacaaaugcugc

SEQ ID NO: 40139 - RNA, 22 nt, Human
cuuuuuuaaaugcaacagcugu

SEQ ID NO: 40140 - RNA, 21 nt, Human
gccucggggacacuagugaca

SEQ ID NO: 40141 - RNA, 26 nt, Human
ggccaccuggccuuucaguuacuuga

SEQ ID NO: 40142 - RNA, 22 nt, Human
gguguggguucccugggccaag

SEQ ID NO: 40143 - RNA, 27 nt, Human
ucugaucuauuucaccaaccaccccau

SEQ ID NO: 40144 - RNA, 21 nt, Human
ugggagccaggcagggccagg

SEQ ID NO: 40145 - RNA, 26 nt, Human
acucggucucaaaaacaaaacaaaac

SEQ ID NO: 40146 - RNA, 20 nt, Human
gggcagcugcggagcauguc

SEQ ID NO: 40147 - RNA, 20 nt, Human
gugcaauggcuucaaaaauc

SEQ ID NO: 40148 - RNA, 20 nt, Human
aaaauacaaaaauuaguggg

SEQ ID NO: 40149 - RNA, 21 nt, Human
gaccauggugugaauguagag

SEQ ID NO: 40150 - RNA, 21 nt, Human
ccccagucccagccgugugcu

SEQ ID NO: 40151 - RNA, 22 nt, Human
cugccuaagcuguggguucucu

SEQ ID NO: 40152 - RNA, 19 nt, Human
uauuugagaguucuaaauu

SEQ ID NO: 40153 - RNA, 23 nt, Human
cuuugcagcaggccugccgccuu

SEQ ID NO: 40154 - RNA, 21 nt, Human
ucuagaaacuuccuguaugga

SEQ ID NO: 40155 - RNA, 21 nt, Human
gcucacuggugaacagugucu

SEQ ID NO: 40156 - RNA, 25 nt, Human
aaugcucucagagcaccucugacgc

SEQ ID NO: 40157 - RNA, 29 nt, Human
uccagcaccauucuucacugacccauccc

SEQ ID NO: 40158 - RNA, 20 nt, Human
gaaccagcucaccuggccag

SEQ ID NO: 40159 - RNA, 21 nt, Human
ggaccagccuccugggacugu

SEQ ID NO: 40160 - RNA, 22 nt, Human
ucaggaaugaagauuugugaag

SEQ ID NO: 40161 - RNA, 22 nt, Human
cccgaguaccugggauuacagg

SEQ ID NO: 40162 - RNA, 26 nt, Human
uccuucugcucaaggcugauguuugu

SEQ ID NO: 40163 - RNA, 20 nt, Human
gggacucccuccugggaagc

SEQ ID NO: 40164 - RNA, 18 nt, Human
ccaacagcacccucucca

SEQ ID NO: 40165 - RNA, 22 nt, Human
gcccccagccuaugagcauccu

SEQ ID NO: 40166 - RNA, 22 nt, Human
uuuuugggcaaaacuacucauu

SEQ ID NO: 40167 - RNA, 23 nt, Human
uacaagaucugaauucuacugaa

SEQ ID NO: 40168 - RNA, 22 nt, Human
uccgacaucgugaaccuguucu

SEQ ID NO: 40169 - RNA, 25 nt, Human
gcucuucagcagauccaaacccccu

SEQ ID NO: 40170 - RNA, 19 nt, Human
cccaguucaucaucaucuc

SEQ ID NO: 40171 - RNA, 23 nt, Human
guuacccaggcuggagugcaaug

SEQ ID NO: 40172 - RNA, 23 nt, Human
uaggcaggacugccaugcaguga

SEQ ID NO: 40173 - RNA, 19 nt, Human
cugaggcagagcugcuuga

SEQ ID NO: 40174 - RNA, 22 nt, Human
caggcuggagugcaguggcucc

SEQ ID NO: 40175 - RNA, 22 nt, Human
ccagcucuaaccagucuuucau

SEQ ID NO: 40176 - RNA, 26 nt, Human
uucauucuacucauacuacacaccca

SEQ ID NO: 40177 - RNA, 22 nt, Human
agccacagcuauuggauuuccc

SEQ ID NO: 40178 - RNA, 27 nt, Human
uccuccagggggccugcaggccccagc

SEQ ID NO: 40179 - RNA, 23 nt, Human
guauacgcacgcacccacacccu

SEQ ID NO: 40180 - RNA, 22 nt, Human
cuuccuggcaucaugccuucug

SEQ ID NO: 40181 - RNA, 20 nt, Human
aagaaacuaucaagagagua

SEQ ID NO: 40182 - RNA, 21 nt, Human
ucagccaggcuggagugcagu

SEQ ID NO: 40183 - RNA, 24 nt, Human
gcaucaguauuuauagcaaaaaga

SEQ ID NO: 40184 - RNA, 27 nt, Human
aaaaugcugggauuacaggccugagcc

SEQ ID NO: 40185 - RNA, 24 nt, Human
caggaggugcagcguguggaguga

SEQ ID NO: 40186 - RNA, 21 nt, Human
aaagaucuguauuuacacucc

SEQ ID NO: 40187 - RNA, 20 nt, Human
uauuugagaggaagccuucu

SEQ ID NO: 40188 - RNA, 25 nt, Human
ggucuucccuuucuggcuucuagga

SEQ ID NO: 40189 - RNA, 23 nt, Human
ggcaccauccagcaccuccguca

SEQ ID NO: 40190 - RNA, 25 nt, Human
aggcugccacuggaaugucuucuca

SEQ ID NO: 40191 - RNA, 23 nt, Human
auagaucauaucauugcuacuuu

SEQ ID NO: 40192 - RNA, 19 nt, Human
gcaaagcuaacauccugcc

SEQ ID NO: 40193 - RNA, 21 nt, Human
gccaccucccucugccagucg

SEQ ID NO: 40194 - RNA, 26 nt, Human
aucuugaacuccugggcucaagccau

SEQ ID NO: 40195 - RNA, 22 nt, Human
gacuacaggcgugagccaccau

SEQ ID NO: 40196 - RNA, 21 nt, Human
ggagucgggaucugcgcugca

SEQ ID NO: 40197 - RNA, 23 nt, Human
cuaguucaucccuucucuuccag

SEQ ID NO: 40198 - RNA, 21 nt, Human
gcaucugaccucuaccuucau

SEQ ID NO: 40199 - RNA, 21 nt, Human
uaagagaaggggauuaccuug

SEQ ID NO: 40200 - RNA, 26 nt, Human
cauuugaaaggagugggaggaauaca

SEQ ID NO: 40201 - RNA, 21 nt, Human
agcguuuuuaaccuguuuugu

SEQ ID NO: 40202 - RNA, 25 nt, Human
gggauuacaggcaugcgccaccacg

SEQ ID NO: 40203 - RNA, 20 nt, Human
uuuugccauguugcccagac

SEQ ID NO: 40204 - RNA, 24 nt, Human
cagcccagcuccacgaggacugaa

SEQ ID NO: 40205 - RNA, 20 nt, Human
ccugccugccugcccugggc

SEQ ID NO: 40206 - RNA, 22 nt, Human
gugcagcugugagcgcguggcc

SEQ ID NO: 40207 - RNA, 28 nt, Human
ccuggggucugugaggcagcggagcugg

SEQ ID NO: 40208 - RNA, 21 nt, Human
gugaggggcaggagcuggggc

SEQ ID NO: 40209 - RNA, 25 nt, Human
caugauaucacuucuucuagaguaa

SEQ ID NO: 40210 - RNA, 26 nt, Human
gauggccauggaaggguugaggggcc

SEQ ID NO: 40211 - RNA, 21 nt, Human
ugccagggugagauguuuccu

SEQ ID NO: 40212 - RNA, 22 nt, Human
aaaucacuguuaguguggccaa

SEQ ID NO: 40213 - RNA, 21 nt, Human
gucgccaaguuggagugcaau

SEQ ID NO: 40214 - RNA, 21 nt, Human
cucuccucuauugauucaguu

SEQ ID NO: 40215 - RNA, 21 nt, Human
guuggcagacuagaguacagu

SEQ ID NO: 40216 - RNA, 23 nt, Human
aauggaaacuuaaaaauauccau

SEQ ID NO: 40217 - RNA, 21 nt, Human
ggcuccucuguggugucugcc

SEQ ID NO: 40218 - RNA, 21 nt, Human
cccuccacagucuuccuugcc

SEQ ID NO: 40219 - RNA, 22 nt, Human
ccaaguagcugggaccacaggc

SEQ ID NO: 40220 - RNA, 26 nt, Human
gaggaagaaagcaaacccggggagca

SEQ ID NO: 40221 - RNA, 23 nt, Human
gaccagcacucagccucauucag

SEQ ID NO: 40222 - RNA, 23 nt, Human
guggggcagauggcagggcugag

SEQ ID NO: 40223 - RNA, 22 nt, Human
ccgagaucgagccacugcacuc

SEQ ID NO: 40224 - RNA, 23 nt, Human
cuguguagucuuccuuuucucca

SEQ ID NO: 40225 - RNA, 23 nt, Human
uuucucacucucuauauccauuu

SEQ ID NO: 40226 - RNA, 21 nt, Human
ugcuauggugcucugucuacu

SEQ ID NO: 40227 - RNA, 26 nt, Human
aagcacucucaucagauaucugacau

SEQ ID NO: 40228 - RNA, 22 nt, Human
ggcuccaccugcgccgccgauc

SEQ ID NO: 40229 - RNA, 22 nt, Human
uaggcaagagugcaauggcaca

SEQ ID NO: 40230 - RNA, 21 nt, Human
uuuuuugggcugggugcagug

SEQ ID NO: 40231 - RNA, 22 nt, Human
gaaaauucagauauuuucuuag

SEQ ID NO: 40232 - RNA, 24 nt, Human
caguuagcauucugacauucuaaa

SEQ ID NO: 40233 - RNA, 21 nt, Human
accaacuauccaaguguuaua

SEQ ID NO: 40234 - RNA, 20 nt, Human
cccagaagccugggcuuagg

SEQ ID NO: 40235 - RNA, 22 nt, Human
gugaacaagaacaccccugccg

SEQ ID NO: 40236 - RNA, 21 nt, Human
gagugugggcuggcuguugug

SEQ ID NO: 40237 - RNA, 20 nt, Human
aaaggaucccugcggagggu

SEQ ID NO: 40238 - RNA, 22 nt, Human
ugucgcccaggcuagaguggau

SEQ ID NO: 40239 - RNA, 22 nt, Human
ggaacuccugggcucaagggau

SEQ ID NO: 40240 - RNA, 24 nt, Human
gagccuccccuggguuaacaaaug

SEQ ID NO: 40241 - RNA, 27 nt, Human
agcucacugcuggugcugguguaggca

SEQ ID NO: 40242 - RNA, 22 nt, Human
ugcggcgcgcguggauccugcu

SEQ ID NO: 40243 - RNA, 24 nt, Human
ccugcucccugcccuccugggcag

SEQ ID NO: 40244 - RNA, 22 nt, Human
uuuaagcugccaauuguagcac

SEQ ID NO: 40245 - RNA, 20 nt, Human
ccaaaaggaaaagcuuggca

SEQ ID NO: 40246 - RNA, 22 nt, Human
aauaaggccaugcaagugugcg

SEQ ID NO: 40247 - RNA, 19 nt, Human
gggcgacaccuuccuccca

SEQ ID NO: 40248 - RNA, 20 nt, Human
cauaagcagaggcugcagga

SEQ ID NO: 40249 - RNA, 21 nt, Human
ggugaccucauguaauuagcu

SEQ ID NO: 40250 - RNA, 24 nt, Human
gcaggugccggugccuguccccgg

SEQ ID NO: 40251 - RNA, 21 nt, Human
guuggccaggcuggucucaaa

SEQ ID NO: 40252 - RNA, 22 nt, Human
ugaacuccugggcucaagcagu

SEQ ID NO: 40253 - RNA, 23 nt, Human
uuguuguuguauccuuuucuccu

SEQ ID NO: 40254 - RNA, 20 nt, Human
uucugcgcuuuaauuguggg

SEQ ID NO: 40255 - RNA, 27 nt, Human
uggcaggcgggggaggcugcaggcuca

SEQ ID NO: 40256 - RNA, 26 nt, Human
uuccagccucaggaauuuauggucgc

SEQ ID NO: 40257 - RNA, 22 nt, Human
uucucucucugcauaugccugg

SEQ ID NO: 40258 - RNA, 23 nt, Human
uuuuucugggugcgguggcucau

SEQ ID NO: 40259 - RNA, 22 nt, Human
guugcccagguacaaggccagg

SEQ ID NO: 40260 - RNA, 27 nt, Human
gaagccaguccagaagagggguccgcu

SEQ ID NO: 40261 - RNA, 26 nt, Human
cugccucuuggguuucagugauuuuu

SEQ ID NO: 40262 - RNA, 27 nt, Human
acacacacagccucucugcccaccucu

SEQ ID NO: 40263 - RNA, 21 nt, Human
ucuggcuggggagagacuaaa

SEQ ID NO: 40264 - RNA, 21 nt, Human
agugucccggaagcccuccuu

SEQ ID NO: 40265 - RNA, 26 nt, Human
cagagcuguguacaggauguaauauu

SEQ ID NO: 40266 - RNA, 21 nt, Human
gccagugaccuccuuuugaag

SEQ ID NO: 40267 - RNA, 21 nt, Human
ugccagccugaaaauuccaaa

SEQ ID NO: 40268 - RNA, 22 nt, Human
ccaugcuaggcuugccugggug

SEQ ID NO: 40269 - RNA, 24 nt, Human
cagggccuucuggaggaguggcac

SEQ ID NO: 40270 - RNA, 20 nt, Human
gccgagccaccaugcuugcc

SEQ ID NO: 40271 - RNA, 24 nt, Human
ccuggcagaaggggcacggggcag

SEQ ID NO: 40272 - RNA, 18 nt, Human
agagugagcucuggugga

SEQ ID NO: 40273 - RNA, 22 nt, Human
uccuugucacugguagaccaaa

SEQ ID NO: 40274 - RNA, 23 nt, Human
cugacaggguggcaggugacuuu

SEQ ID NO: 40275 - RNA, 27 nt, Human
ccugggcaacagagugacacucugucu

SEQ ID NO: 40276 - RNA, 21 nt, Human
ccucuugcccacccugacuga

SEQ ID NO: 40277 - RNA, 22 nt, Human
gagccuucuacgcagagguuga

SEQ ID NO: 40278 - RNA, 22 nt, Human
auuuaaaauauuccugcaaaag

SEQ ID NO: 40279 - RNA, 22 nt, Human
ucuucuuucuuggacuauggau

SEQ ID NO: 40280 - RNA, 22 nt, Human
aacaggacugugguacuagggg

SEQ ID NO: 40281 - RNA, 21 nt, Human
ccuugcauagucucucuuguc

SEQ ID NO: 40282 - RNA, 24 nt, Human
cgcggccgccuccccccggcccuc

SEQ ID NO: 40283 - RNA, 23 nt, Human
cuccacccucuucugggauggcu

SEQ ID NO: 40284 - RNA, 22 nt, Human
agcccuaggggugguaugaccc

SEQ ID NO: 40285 - RNA, 14 nt, Human
cagcccugcagccu

SEQ ID NO: 40286 - RNA, 20 nt, Human
gccuucagacaaacaggaaa

SEQ ID NO: 40287 - RNA, 23 nt, Human
agauaggaagaagaaugauggau

SEQ ID NO: 40288 - RNA, 25 nt, Human
cuguauccauucuaccuguccuccg

SEQ ID NO: 40289 - RNA, 21 nt, Human
cccuccacaggaaauugccuc

SEQ ID NO: 40290 - RNA, 24 nt, Human
ccaaauagcuggggcuaccauggu

SEQ ID NO: 40291 - RNA, 21 nt, Human
ccuuucuccuccgaggugguu

SEQ ID NO: 40292 - RNA, 22 nt, Human
uuaucugaaugcauacaaggag

SEQ ID NO: 40293 - RNA, 24 nt, Human
acaguccugcccauccacgcggag

SEQ ID NO: 40294 - RNA, 19 nt, Human
uuguguuuuucaaagugau

SEQ ID NO: 40295 - RNA, 22 nt, Human
gaaugauuuaugaugaaucuug

SEQ ID NO: 40296 - RNA, 20 nt, Human
cauuuaggaucuccaugaga

SEQ ID NO: 40297 - RNA, 26 nt, Human
cuuucauagcauuuuucacucuuggc

SEQ ID NO: 40298 - RNA, 19 nt, Human
uuguggaaugaguccuccu

SEQ ID NO: 40299 - RNA, 22 nt, Human
agcuaauuuuuauguuuuuagu

SEQ ID NO: 40300 - RNA, 24 nt, Human
ugcgcuucuuuucucucaucauca

SEQ ID NO: 40301 - RNA, 24 nt, Human
ccugccugccacccugccccuugc

SEQ ID NO: 40302 - RNA, 22 nt, Human
cuaccuuuugugggccuguccg

SEQ ID NO: 40303 - RNA, 27 nt, Human
gcacaccucacacgggaccacagccgc

SEQ ID NO: 40304 - RNA, 23 nt, Human
ccugucauccaguucccugccuc

SEQ ID NO: 40305 - RNA, 22 nt, Human
uuuccaaauaaaguaaaauuug

SEQ ID NO: 40306 - RNA, 22 nt, Human
aguucccucuguuccuuccucu

SEQ ID NO: 40307 - RNA, 21 nt, Human
cuuuauuuucuucccgucugc

SEQ ID NO: 40308 - RNA, 20 nt, Human
augcagccucuuaugcacca

SEQ ID NO: 40309 - RNA, 26 nt, Human
acugggugacaagggugaggaugaga

SEQ ID NO: 40310 - RNA, 21 nt, Human
ucuguucucuccucuguccca

SEQ ID NO: 40311 - RNA, 27 nt, Human
uccuagcccuucaguaagaccuugcca

SEQ ID NO: 40312 - RNA, 21 nt, Human
guccuuuccauucucaaaucc

SEQ ID NO: 40313 - RNA, 28 nt, Human
gccauggagugagacccaggagccggac

SEQ ID NO: 40314 - RNA, 19 nt, Human
augcaguucuguggugcug

SEQ ID NO: 40315 - RNA, 25 nt, Human
ccaaaaucacauggauuccccaagu

SEQ ID NO: 40316 - RNA, 25 nt, Human
gccucucaucccccuucuucccaca

SEQ ID NO: 40317 - RNA, 27 nt, Human
uggccagaagcuucucuggugaaguuu

SEQ ID NO: 40318 - RNA, 22 nt, Human
uaggccuguaauuuugguucuu

SEQ ID NO: 40319 - RNA, 23 nt, Human
acugcuggcccugacucugcagc

SEQ ID NO: 40320 - RNA, 20 nt, Human
cgucugucugucuagugucu

SEQ ID NO: 40321 - RNA, 22 nt, Human
gggagacagagguugcagugag

SEQ ID NO: 40322 - RNA, 19 nt, Human
uauuauggugauacuccaa

SEQ ID NO: 40323 - RNA, 23 nt, Human
cugucucugucccuuuuaggccc

SEQ ID NO: 40324 - RNA, 26 nt, Human
cuaccugcagauccaggggcugcugu

SEQ ID NO: 40325 - RNA, 19 nt, Human
cucugugacucgcuuagcu

SEQ ID NO: 40326 - RNA, 21 nt, Human
gcucuggggcuggaggcuagu

SEQ ID NO: 40327 - RNA, 17 nt, Human
uuugccucuccgucugu

SEQ ID NO: 40328 - RNA, 21 nt, Human
ucagaaauuuuagauugugaa

SEQ ID NO: 40329 - RNA, 29 nt, Human
auagaaauagucccugagagcacacugug

SEQ ID NO: 40330 - RNA, 22 nt, Human
uuccucuaccuucuuuaucuuu

SEQ ID NO: 40331 - RNA, 28 nt, Human
uggggggaaguccaugccucccuggccu

SEQ ID NO: 40332 - RNA, 23 nt, Human
ugcgaaagggcgggaaaggcagu

SEQ ID NO: 40333 - RNA, 24 nt, Human
aagugcaaugauacaacaaaaaga

SEQ ID NO: 40334 - RNA, 21 nt, Human
cacagcccagucuggggacag

SEQ ID NO: 40335 - RNA, 24 nt, Human
acuccucugcuuccucuguuggcc

SEQ ID NO: 40336 - RNA, 26 nt, Human
gccuguaaucccagcuacuccgggag

SEQ ID NO: 40337 - RNA, 26 nt, Human
agggacagcccugacacuccuuucag

SEQ ID NO: 40338 - RNA, 21 nt, Human
cuguauuuucuuucacuuuau

SEQ ID NO: 40339 - RNA, 19 nt, Human
cacugacggcaucuuccca

SEQ ID NO: 40340 - RNA, 22 nt, Human
ggacuccugucuaggugccccu

SEQ ID NO: 40341 - RNA, 26 nt, Human
ggacccagaagcaccuccuuuguaga

SEQ ID NO: 40342 - RNA, 25 nt, Human
cgcaugcacucagagcacagagccg

SEQ ID NO: 40343 - RNA, 32 nt, Human
agaaggcagccagcagcagcugcacuggaaca

SEQ ID NO: 40344 - RNA, 22 nt, Human
aggagcugggggagaggacucu

SEQ ID NO: 40345 - RNA, 22 nt, Human
cgacagagcaagacuccaucuc

SEQ ID NO: 40346 - RNA, 22 nt, Human
caacagagcgagacuccaucuc

SEQ ID NO: 40347 - RNA, 28 nt, Human
guuuuacuaaaaaauuuuuccauugaaa

SEQ ID NO: 40348 - RNA, 24 nt, Human
ccauuuauucauaccuacucugaa

SEQ ID NO: 40349 - RNA, 20 nt, Human
gugccugcgugggugugugc

SEQ ID NO: 40350 - RNA, 27 nt, Human
gccuugaacuccuggccucaagggauc

SEQ ID NO: 40351 - RNA, 23 nt, Human
gcccucagccuguugcccugccu

SEQ ID NO: 40352 - RNA, 21 nt, Human
cuugugagcccugggcuuagg

SEQ ID NO: 40353 - RNA, 19 nt, Human
cuccaucucugcaaauaca

SEQ ID NO: 40354 - RNA, 21 nt, Human
cagcagcccuggauugcuuuc

SEQ ID NO: 40355 - RNA, 24 nt, Human
aagucaaacacgaacucaaagagg

SEQ ID NO: 40356 - RNA, 21 nt, Human
uagggaccugcucugugcuca

SEQ ID NO: 40357 - RNA, 16 nt, Human
ccggcuggugaauuca

SEQ ID NO: 40358 - RNA, 21 nt, Human
ucuuuacuggaaaugagccca

SEQ ID NO: 40359 - RNA, 21 nt, Human
uccccccaccaguugugccuu

SEQ ID NO: 40360 - RNA, 27 nt, Human
cacaaauguuauaauuuauauagugug

SEQ ID NO: 40361 - RNA, 27 nt, Human
aacaaauuuucaggagggacgugcaau

SEQ ID NO: 40362 - RNA, 18 nt, Human
cuuauaaaaaugaaauua

SEQ ID NO: 40363 - RNA, 23 nt, Human
ucagaucaaaaccauucuguaaa

SEQ ID NO: 40364 - RNA, 20 nt, Human
uucuaugagauuuacuccaa

SEQ ID NO: 40365 - RNA, 25 nt, Human
ggagcucacccugcccgcucccaac

SEQ ID NO: 40366 - RNA, 21 nt, Human
agacauucagcacacugugaa

SEQ ID NO: 40367 - RNA, 21 nt, Human
agccaaggaacaggauuuccc

SEQ ID NO: 40368 - RNA, 21 nt, Human
gcagguuuuaaaguggagauu

SEQ ID NO: 40369 - RNA, 23 nt, Human
gguugucaauaaaccugcccucg

SEQ ID NO: 40370 - RNA, 23 nt, Human
ucucacugccacugcucuugccu

SEQ ID NO: 40371 - RNA, 26 nt, Human
ugcgucuccccucgggcuggaagcgu

SEQ ID NO: 40372 - RNA, 20 nt, Human
cguccaagcaaaaacaaaug

SEQ ID NO: 40373 - RNA, 23 nt, Human
uuuaccucguugcacugcugaga

SEQ ID NO: 40374 - RNA, 23 nt, Human
uuucacguguaccugugucaucu

SEQ ID NO: 40375 - RNA, 22 nt, Human
uugauguuucuuauucuuuuua

SEQ ID NO: 40376 - RNA, 28 nt, Human
acuuauuucacuaucuucuucaaauaca

SEQ ID NO: 40377 - RNA, 22 nt, Human
cuuuucucauguugaagccacu

SEQ ID NO: 40378 - RNA, 27 nt, Human
cccuccuggugcugcccaccuucccug

SEQ ID NO: 40379 - RNA, 26 nt, Human
ggaguggaagccgaagcaggaguugu

SEQ ID NO: 40380 - RNA, 19 nt, Human
ggguuagaaucagcucuuu

SEQ ID NO: 40381 - RNA, 22 nt, Human
cgagggagaagacuauauugua

SEQ ID NO: 40382 - RNA, 23 nt, Human
cacuaaauuuguuuguuguuguu

SEQ ID NO: 40383 - RNA, 21 nt, Human
agugaacauucugauuuuaca

SEQ ID NO: 40384 - RNA, 21 nt, Human
gggggccgcgcgcugcucugu

SEQ ID NO: 40385 - RNA, 22 nt, Human
cugcucuggcccuuccccaggc

SEQ ID NO: 40386 - RNA, 23 nt, Human
ggccuggagcuuggggugaggaa

SEQ ID NO: 40387 - RNA, 21 nt, Human
cggagaacuccuuccccaaau

SEQ ID NO: 40388 - RNA, 19 nt, Human
ccaggagguguugcaguga

SEQ ID NO: 40389 - RNA, 21 nt, Human
ggagguuuggcuuucuguggg

SEQ ID NO: 40390 - RNA, 23 nt, Human
ccuucccauugcucacaaagguc

SEQ ID NO: 40391 - RNA, 20 nt, Human
ggaggucagggcugcaguga

SEQ ID NO: 40392 - RNA, 22 nt, Human
ugugaccucccaaggggguggg

SEQ ID NO: 40393 - RNA, 24 nt, Human
aggaagggaagggagggaggucug

SEQ ID NO: 40394 - RNA, 25 nt, Human
acuguucucagaagagucacaguuu

SEQ ID NO: 40395 - RNA, 22 nt, Human
gcucugucgccgaggcugcagu

SEQ ID NO: 40396 - RNA, 22 nt, Human
ucuccaauggcucaguuuugcu

SEQ ID NO: 40397 - RNA, 25 nt, Human
ccuccaauugcaguggauuccucgg

SEQ ID NO: 40398 - RNA, 19 nt, Human
ccucucugccccagaucug

SEQ ID NO: 40399 - RNA, 22 nt, Human
agaauuucuucauaccuuuucc

SEQ ID NO: 40400 - RNA, 27 nt, Human
ucucagauuccaccaucuuuuugugcu

SEQ ID NO: 40401 - RNA, 19 nt, Human
cuguuuaagucuugagugu

SEQ ID NO: 40402 - RNA, 21 nt, Human
ucuggcuuuugagaugacuua

SEQ ID NO: 40403 - RNA, 22 nt, Human
cagagccuucucucuccugugc

SEQ ID NO: 40404 - RNA, 21 nt, Human
agucaugugagcagauuuuuu

SEQ ID NO: 40405 - RNA, 22 nt, Human
gggccuucuuggagccgugugu

SEQ ID NO: 40406 - RNA, 23 nt, Human
ugagguggggagaacggaaugac

SEQ ID NO: 40407 - RNA, 26 nt, Human
ggaaaauggcuccaaagguuaaauga

SEQ ID NO: 40408 - RNA, 24 nt, Human
uccucaagugaguucuuaguauuu

SEQ ID NO: 40409 - RNA, 21 nt, Human
auaguuccugugguuuuucac

SEQ ID NO: 40410 - RNA, 25 nt, Human
gagaaggaaagaagccuggagcagc

SEQ ID NO: 40411 - RNA, 27 nt, Human
aacaguuacagcaauaaagaauaguua

SEQ ID NO: 40412 - RNA, 20 nt, Human
agcuuugggguuccuuuuau

SEQ ID NO: 40413 - RNA, 21 nt, Human
cuuuucucccuugucauugcc

SEQ ID NO: 40414 - RNA, 28 nt, Human
cugccucucggacucgggcugcggcguc

SEQ ID NO: 40415 - RNA, 27 nt, Human
gggcuggcugagagccgcaggagcagc

SEQ ID NO: 40416 - RNA, 22 nt, Human
ucacugcaaccucugccuccug

SEQ ID NO: 40417 - RNA, 30 nt, Human
ugccucuguguaucucagcauuuuuauucc

SEQ ID NO: 40418 - RNA, 26 nt, Human
gcacaggccagggcucgggcaugugg

SEQ ID NO: 40419 - RNA, 26 nt, Human
ucuguaaccccagcacuuugggaggc

SEQ ID NO: 40420 - RNA, 21 nt, Human
uggguuagagauggaguuugc

SEQ ID NO: 40421 - RNA, 27 nt, Human
accauuuuccuuguacucuucucucca

SEQ ID NO: 40422 - RNA, 22 nt, Human
ugcuuucuuccagccccuaggc

SEQ ID NO: 40423 - RNA, 22 nt, Human
uggcgcgugccuguaaucccag

SEQ ID NO: 40424 - RNA, 19 nt, Human
gagggagggcgcaggcggc

SEQ ID NO: 40425 - RNA, 27 nt, Human
ccacugcacuccagccugggagacaga

SEQ ID NO: 40426 - RNA, 21 nt, Human
ugguucugguuaaacagcugu

SEQ ID NO: 40427 - RNA, 27 nt, Human
cacugcacuccaaccugggcagcagag

SEQ ID NO: 40428 - RNA, 24 nt, Human
guccucuguugcuuuuugguucca

SEQ ID NO: 40429 - RNA, 22 nt, Human
acauagacauuucaaaauuaau

SEQ ID NO: 40430 - RNA, 27 nt, Human
ugggaggucaaguuaagagucaaaaau

SEQ ID NO: 40431 - RNA, 20 nt, Human
ggccuuacucauauauugcc

SEQ ID NO: 40432 - RNA, 31 nt, Human
agagccuccuucaagaugcugcugguccugc

SEQ ID NO: 40433 - RNA, 21 nt, Human
gggacccccucacacaccacc

SEQ ID NO: 40434 - RNA, 23 nt, Human
cggacuguguugccugggugcuc

SEQ ID NO: 40435 - RNA, 26 nt, Human
acucuacauccuacugcuuuggccuc

SEQ ID NO: 40436 - RNA, 22 nt, Human
caaguuaauguacuuucauucc

SEQ ID NO: 40437 - RNA, 19 nt, Human
acugcagcuuucuuccgcc

SEQ ID NO: 40438 - RNA, 22 nt, Human
aaaccuuugagacuauugagau

SEQ ID NO: 40439 - RNA, 26 nt, Human
cacccccuuucaagucccaaacacug

SEQ ID NO: 40440 - RNA, 28 nt, Human
ucgcucaccucccuccuuggcaccauga

SEQ ID NO: 40441 - RNA, 22 nt, Human
ccugcaugugccccugccucua

SEQ ID NO: 40442 - RNA, 21 nt, Human
ggugaaauccuaucucuacca

SEQ ID NO: 40443 - RNA, 28 nt, Human
ucuuaacaucaagagaacugucaggagc

SEQ ID NO: 40444 - RNA, 21 nt, Human
cuucaaaauauauugaaguaa

SEQ ID NO: 40445 - RNA, 25 nt, Human
guguuugaggccacccugaggaucg

SEQ ID NO: 40446 - RNA, 26 nt, Human
auuuuucugguucacaacagcacaaa

SEQ ID NO: 40447 - RNA, 23 nt, Human
ggagaguucuguggugaaauagu

SEQ ID NO: 40448 - RNA, 21 nt, Human
ccugcugccccucccugccuc

SEQ ID NO: 40449 - RNA, 24 nt, Human
ucagggagguccgaucuggaacac

SEQ ID NO: 40450 - RNA, 22 nt, Human
guugcuuugauucuuccucaaa

SEQ ID NO: 40451 - RNA, 23 nt, Human
uugaaauaguucaaacugcagcu

SEQ ID NO: 40452 - RNA, 21 nt, Human
ucaguucauucccagaagucc

SEQ ID NO: 40453 - RNA, 25 nt, Human
uuuuccucucaugucuuugcugcag

SEQ ID NO: 40454 - RNA, 27 nt, Human
ggcucugaccuccuuccuguucaccuu

SEQ ID NO: 40455 - RNA, 18 nt, Human
ugguuagaggaaggcuga

SEQ ID NO: 40456 - RNA, 22 nt, Human
gguuaaauuggcaaacauucau

SEQ ID NO: 40457 - RNA, 18 nt, Human
cuugcugucuucucuguc

SEQ ID NO: 40458 - RNA, 21 nt, Human
ucacagaugaagacagcagau

SEQ ID NO: 40459 - RNA, 21 nt, Human
agaacgggcaacuacagcucu

SEQ ID NO: 40460 - RNA, 26 nt, Human
ucagcacuuugggaggcugaaguggg

SEQ ID NO: 40461 - RNA, 26 nt, Human
cuuccugcuccugcugcacagcugcc

SEQ ID NO: 40462 - RNA, 17 nt, Human
ugaagcaaaaaggguga

SEQ ID NO: 40463 - RNA, 22 nt, Human
cccaacaacaugaaacugccua

SEQ ID NO: 40464 - RNA, 19 nt, Human
cuguccccuccccucuguu

SEQ ID NO: 40465 - RNA, 21 nt, Human
uugaagccuuguuccgaucua

SEQ ID NO: 40466 - RNA, 25 nt, Human
ugggugaagagaaaggaaguacaga

SEQ ID NO: 40467 - RNA, 23 nt, Human
cccauuuccagcuccuaguagcu

SEQ ID NO: 40468 - RNA, 27 nt, Human
uugcaaccuccgccuccugcguucggg

SEQ ID NO: 40469 - RNA, 22 nt, Human
cacaccacugcaggcaggugga

SEQ ID NO: 40470 - RNA, 20 nt, Human
uaaagagacaacgaauguga

SEQ ID NO: 40471 - RNA, 27 nt, Human
cggccccuacaggcuggcccugcaaug

SEQ ID NO: 40472 - RNA, 22 nt, Human
aucuucccagguagcugggauu

SEQ ID NO: 40473 - RNA, 19 nt, Human
cacauacuuuuuaaaucca

SEQ ID NO: 40474 - RNA, 24 nt, Human
ggucucgagccuccuguaccuucc

SEQ ID NO: 40475 - RNA, 22 nt, Human
cuggcucucuggcuccugugca

SEQ ID NO: 40476 - RNA, 20 nt, Human
uaaaucucccauuuuuguaa

SEQ ID NO: 40477 - RNA, 21 nt, Human
gggucaggaacaguggcuggg

SEQ ID NO: 40478 - RNA, 26 nt, Human
ccugccugcccugccuccgucccaac

SEQ ID NO: 40479 - RNA, 20 nt, Human
uguagaguguagacuguggc

SEQ ID NO: 40480 - RNA, 27 nt, Human
ccuguucccaguucccugggccucugg

SEQ ID NO: 40481 - RNA, 22 nt, Human
agccucccgauaagcugagauu

SEQ ID NO: 40482 - RNA, 30 nt, Human
gcgcgccgccuccccgcccucucucacucc

SEQ ID NO: 40483 - RNA, 26 nt, Human
gauacuccaaaaccaucaccauguac

SEQ ID NO: 40484 - RNA, 21 nt, Human
accaggcucuaugugcugcug

SEQ ID NO: 40485 - RNA, 23 nt, Human
uuaagaaaaaccacagggaccaa

SEQ ID NO: 40486 - RNA, 30 nt, Human
ggaagcuuccugccuuuuucuuugguugcu

SEQ ID NO: 40487 - RNA, 22 nt, Human
aucagccuggccaucuggauuu

SEQ ID NO: 40488 - RNA, 23 nt, Human
uuugagacagaauuuugcucuug

SEQ ID NO: 40489 - RNA, 21 nt, Human
ucaggaguuugaggccagccu

SEQ ID NO: 40490 - RNA, 20 nt, Human
ugucucugugggcuugggau

SEQ ID NO: 40491 - RNA, 21 nt, Human
uagaaaacggguucucugccu

SEQ ID NO: 40492 - RNA, 22 nt, Human
cuuccaggucaggaugcacauu

SEQ ID NO: 40493 - RNA, 22 nt, Human
cucagccaggugggaaugacgg

SEQ ID NO: 40494 - RNA, 22 nt, Human
ggcucacugcaaccuccaacuc

SEQ ID NO: 40495 - RNA, 26 nt, Human
aacucauauaauacagaaagaguuuu

SEQ ID NO: 40496 - RNA, 22 nt, Human
gggcaggugggggaauggaggc

SEQ ID NO: 40497 - RNA, 27 nt, Human
ggccagccugggaacauggaguggcag

SEQ ID NO: 40498 - RNA, 22 nt, Human
ccucccagccaccgccccccuc

SEQ ID NO: 40499 - RNA, 20 nt, Human
cccaauaaacuucauuucuc

SEQ ID NO: 40500 - RNA, 22 nt, Human
gccugcucuggccuaauggauc

SEQ ID NO: 40501 - RNA, 22 nt, Human
cugcugccggagagaaggggag

SEQ ID NO: 40502 - RNA, 26 nt, Human
gcccauagaaacaugacacugaccuu

SEQ ID NO: 40503 - RNA, 20 nt, Human
ggcucagugggcucccucag

SEQ ID NO: 40504 - RNA, 20 nt, Human
cgccucggguccccgcacca

SEQ ID NO: 40505 - RNA, 24 nt, Human
ccccaagagggagcugauaucaug

SEQ ID NO: 40506 - RNA, 24 nt, Human
gucggagcgccgacucccuucucg

SEQ ID NO: 40507 - RNA, 22 nt, Human
gggcgucggagccaccuccugg

SEQ ID NO: 40508 - RNA, 22 nt, Human
gcucuuuuguugaaccuguauu

SEQ ID NO: 40509 - RNA, 27 nt, Human
gccccucuuuaaugguggaacaaaugu

SEQ ID NO: 40510 - RNA, 18 nt, Human
aggcuagaauagcauuuu

SEQ ID NO: 40511 - RNA, 21 nt, Human
ggggcagccuuccugguuuau

SEQ ID NO: 40512 - RNA, 21 nt, Human
agaaucaagagugagccaugg

SEQ ID NO: 40513 - RNA, 24 nt, Human
ccucuuccuguccuuuagaccuga

SEQ ID NO: 40514 - RNA, 21 nt, Human
gcauauauacauguaucugua

SEQ ID NO: 40515 - RNA, 13 nt, Human
ggugcaaugugau

SEQ ID NO: 40516 - RNA, 21 nt, Human
aucucccacaucaaccaauga

SEQ ID NO: 40517 - RNA, 21 nt, Human
aguaaagccuuaaguggcaga

SEQ ID NO: 40518 - RNA, 27 nt, Human
ggccagguaagggggugcagcagugag

SEQ ID NO: 40519 - RNA, 22 nt, Human
gccucaagguuuuagguucuaa

SEQ ID NO: 40520 - RNA, 24 nt, Human
ccugggccuggcucccucacucuc

SEQ ID NO: 40521 - RNA, 20 nt, Human
ccucgggagauccuggagcu

SEQ ID NO: 40522 - RNA, 21 nt, Human
uccuagaguguuuggucgggu

SEQ ID NO: 40523 - RNA, 23 nt, Human
agggcauggcacugacaucugcc

SEQ ID NO: 40524 - RNA, 17 nt, Human
gcugggggcugggcagg

SEQ ID NO: 40525 - RNA, 20 nt, Human
ucacaucuucggagaugagg

SEQ ID NO: 40526 - RNA, 22 nt, Human
uaugaauucaguagauaucuua

SEQ ID NO: 40527 - RNA, 18 nt, Human
ugcacuucucccucaagg

SEQ ID NO: 40528 - RNA, 31 nt, Human
cugaucuuacgaugcccugccuuuuacuagc

SEQ ID NO: 40529 - RNA, 22 nt, Human
gggaaggugguggaaugucuau

SEQ ID NO: 40530 - RNA, 22 nt, Human
aggguucugcuguccugugcca

SEQ ID NO: 40531 - RNA, 22 nt, Human
gugugagccacuguggccgacc

SEQ ID NO: 40532 - RNA, 26 nt, Human
cauuucagaagaguuacagccgugaa

SEQ ID NO: 40533 - RNA, 22 nt, Human
uacuauaugaaacuuuacaaca

SEQ ID NO: 40534 - RNA, 23 nt, Human
cucuaagcaccgucccugcccag

SEQ ID NO: 40535 - RNA, 21 nt, Human
ccaggagcugcugaauuugug

SEQ ID NO: 40536 - RNA, 24 nt, Human
ggaaucuuccugaagacauggccc

SEQ ID NO: 40537 - RNA, 23 nt, Human
uagacuuugggcccacguguuuu

SEQ ID NO: 40538 - RNA, 27 nt, Human
gcuggaggaagugccaucugcauggcc

SEQ ID NO: 40539 - RNA, 26 nt, Human
ggcugagagccgcaggagcagcaggc

SEQ ID NO: 40540 - RNA, 30 nt, Human
uagaauuucacuuuuggaggggacccuuga

SEQ ID NO: 40541 - RNA, 24 nt, Human
cugucacccaggcuggagugcagu

SEQ ID NO: 40542 - RNA, 21 nt, Human
gacuacauacugcagcagaac

SEQ ID NO: 40543 - RNA, 26 nt, Human
aucagccuaggcaacauaguaagacc

SEQ ID NO: 40544 - RNA, 26 nt, Human
caggaguucugaagcugacagcacua

SEQ ID NO: 40545 - RNA, 18 nt, Human
cgugggugggcgggugcu

SEQ ID NO: 40546 - RNA, 19 nt, Human
gacuuguaauaaugagcua

SEQ ID NO: 40547 - RNA, 22 nt, Human
acccaggcugaagugcagugga

SEQ ID NO: 40548 - RNA, 23 nt, Human
accaugccuggcuaauuuuuugc

SEQ ID NO: 40549 - RNA, 23 nt, Human
accaugucuggcuaauuuuuugu

SEQ ID NO: 40550 - RNA, 22 nt, Human
augccucccuucucccagcuca

SEQ ID NO: 40551 - RNA, 21 nt, Human
aguauaaaauacaacaaagga

SEQ ID NO: 40552 - RNA, 25 nt, Human
cauuuuaugcagaagcauauuuugc

SEQ ID NO: 40553 - RNA, 22 nt, Human
cucucggguucucucuuuuuua

SEQ ID NO: 40554 - RNA, 19 nt, Human
gugccucagcugcugucac

SEQ ID NO: 40555 - RNA, 22 nt, Human
ucacugaacuccggccugggug

SEQ ID NO: 40556 - RNA, 19 nt, Human
cccaugagacagucccaga

SEQ ID NO: 40557 - RNA, 20 nt, Human
uuugucaauaaacugccuuu

SEQ ID NO: 40558 - RNA, 27 nt, Human
ggucucgaacuccugaccucgugaucc

SEQ ID NO: 40559 - RNA, 25 nt, Human
auaggaaccaacugccuugccuuca

SEQ ID NO: 40560 - RNA, 20 nt, Human
gcugggcuucaguggcagcu

SEQ ID NO: 40561 - RNA, 30 nt, Human
cgcagggauccggggaagcugcggcaggga

SEQ ID NO: 40562 - RNA, 24 nt, Human
ggaagccgcugaauccaccugcuu

SEQ ID NO: 40563 - RNA, 22 nt, Human
cugguagggggaaaauguguau

SEQ ID NO: 40564 - RNA, 23 nt, Human
uggaaacauuccaaaaacgugaa

SEQ ID NO: 40565 - RNA, 23 nt, Human
auugucaugauuguccuuaguac

SEQ ID NO: 40566 - RNA, 24 nt, Human
cccagccccagccucagcccugcc

SEQ ID NO: 40567 - RNA, 18 nt, Human
ggaaagaugguggaagac

SEQ ID NO: 40568 - RNA, 23 nt, Human
cgacagccacugagaccggcuuu

SEQ ID NO: 40569 - RNA, 25 nt, Human
ggcacaaaaugauggacccaaugca

SEQ ID NO: 40570 - RNA, 26 nt, Human
guggguggguggguauauuccucagg

SEQ ID NO: 40571 - RNA, 20 nt, Human
caacagaagcauuuguauuu

SEQ ID NO: 40572 - RNA, 27 nt, Human
acuaccugcuaauucuugccgcauuuc

SEQ ID NO: 40573 - RNA, 21 nt, Human
cccagcaccacccuccuuccc

SEQ ID NO: 40574 - RNA, 23 nt, Human
gaucuuugggcauggccagggga

SEQ ID NO: 40575 - RNA, 19 nt, Human
aaagaacaauaaugauucc

SEQ ID NO: 40576 - RNA, 24 nt, Human
ccaacuugucacuugccagucacu

SEQ ID NO: 40577 - RNA, 25 nt, Human
uugcugaagacuacaggcagccaaa

SEQ ID NO: 40578 - RNA, 20 nt, Human
ucaauaaacagccaucugcc

SEQ ID NO: 40579 - RNA, 28 nt, Human
cgggcacagggaaggcagcugggccguu

SEQ ID NO: 40580 - RNA, 24 nt, Human
aggcagggacaggcccugggggug

SEQ ID NO: 40581 - RNA, 21 nt, Human
uccaucucuccccucuugacc

SEQ ID NO: 40582 - RNA, 21 nt, Human
cucugaccucugcugagugcu

SEQ ID NO: 40583 - RNA, 17 nt, Human
ugagaacacuguggaag

SEQ ID NO: 40584 - RNA, 20 nt, Human
ccaacuugucuucucucccu

SEQ ID NO: 40585 - RNA, 23 nt, Human
ggccucucucugccugaaauguu

SEQ ID NO: 40586 - RNA, 26 nt, Human
aacugugcuugaaaaacacugucucu

SEQ ID NO: 40587 - RNA, 21 nt, Human
acuguccugugaggacagcug

SEQ ID NO: 40588 - RNA, 23 nt, Human
ggcucacuguaaccucugccucc

SEQ ID NO: 40589 - RNA, 21 nt, Human
uaaugugaagacauuuuuugc

SEQ ID NO: 40590 - RNA, 27 nt, Human
ugggacugagaugcaggauuucuucac

SEQ ID NO: 40591 - RNA, 20 nt, Human
augccguauuucugagugcu

SEQ ID NO: 40592 - RNA, 26 nt, Human
uacagcauaaagcacauugcugagcc

SEQ ID NO: 40593 - RNA, 18 nt, Human
ccauuucuucccugcuca

SEQ ID NO: 40594 - RNA, 16 nt, Human
accugaaaaacaaaua

SEQ ID NO: 40595 - RNA, 21 nt, Human
caugugaaauaaaacucagua

SEQ ID NO: 40596 - RNA, 22 nt, Human
ugaacaaaaagauaaaucuuca

SEQ ID NO: 40597 - RNA, 24 nt, Human
cacugcugcuuucccuccugggcu

SEQ ID NO: 40598 - RNA, 20 nt, Human
uuuuggggcuuucuuuucag

SEQ ID NO: 40599 - RNA, 23 nt, Human
ggcaggagacucgcuugaaccug

SEQ ID NO: 40600 - RNA, 21 nt, Human
acuuuuagccaccagguacuc

SEQ ID NO: 40601 - RNA, 22 nt, Human
caggcuggagugcagugccaug

SEQ ID NO: 40602 - RNA, 21 nt, Human
ugguaucauuuggaaaucagc

SEQ ID NO: 40603 - RNA, 20 nt, Human
ccccacugcugagcuggccc

SEQ ID NO: 40604 - RNA, 22 nt, Human
aacuuuuuauuguauuguguua

SEQ ID NO: 40605 - RNA, 21 nt, Human
cuggccagaccaggugaccuu

SEQ ID NO: 40606 - RNA, 21 nt, Human
gcuggcucgcgccuccucucc

SEQ ID NO: 40607 - RNA, 20 nt, Human
aaguaaucccagaacaaugg

SEQ ID NO: 40608 - RNA, 21 nt, Human
uggauuaaauguuaaagcuuu

SEQ ID NO: 40609 - RNA, 20 nt, Human
cagcgcuugggcugaaggaa

SEQ ID NO: 40610 - RNA, 22 nt, Human
ugccuguaaucccagcuauuug

SEQ ID NO: 40611 - RNA, 27 nt, Human
aggcugagaaucagacugacaguuuac

SEQ ID NO: 40612 - RNA, 20 nt, Human
aggagguugaggcugcagug

SEQ ID NO: 40613 - RNA, 27 nt, Human
ucuugugucuguugagacuuuaaggga

SEQ ID NO: 40614 - RNA, 21 nt, Human
ugcguguccaucaucagcuga

SEQ ID NO: 40615 - RNA, 32 nt, Human
agcugagaccagggucuuaucucucugggacc

SEQ ID NO: 40616 - RNA, 21 nt, Human
gauacuugagccuccucuuua

SEQ ID NO: 40617 - RNA, 22 nt, Human
ccuguucugggggucugucucu

SEQ ID NO: 40618 - RNA, 27 nt, Human
aaauauucugaacauuuuucuauucau

SEQ ID NO: 40619 - RNA, 22 nt, Human
uucuuacccuguguuuucugca

SEQ ID NO: 40620 - RNA, 20 nt, Human
gugguuuguuugugugcaaa

SEQ ID NO: 40621 - RNA, 26 nt, Human
uucugaucuccuccuucccuucugug

SEQ ID NO: 40622 - RNA, 21 nt, Human
ucuuuucagcacuuaauuuua

SEQ ID NO: 40623 - RNA, 25 nt, Human
gaccgaaaaugaauuguaauuuucu

SEQ ID NO: 40624 - RNA, 23 nt, Human
uucugcaggaagcacucaccccc

SEQ ID NO: 40625 - RNA, 23 nt, Human
ccucccucucucaugaggcacag

SEQ ID NO: 40626 - RNA, 27 nt, Human
cccuccaggucccuggugcuagagcuu

SEQ ID NO: 40627 - RNA, 22 nt, Human
cugcugaaaugugugguuuuua

SEQ ID NO: 40628 - RNA, 23 nt, Human
aacacgagcaaaacuuccucuca

SEQ ID NO: 40629 - RNA, 23 nt, Human
accucauucagccucuugggcuc

SEQ ID NO: 40630 - RNA, 29 nt, Human
cucacuagaauauuccuuauguugacaug

SEQ ID NO: 40631 - RNA, 23 nt, Human
ugggugacugaguaacugaaaug

SEQ ID NO: 40632 - RNA, 20 nt, Human
gcauuuucagcagauccuca

SEQ ID NO: 40633 - RNA, 21 nt, Human
ucuggguggccggagccggag

SEQ ID NO: 40634 - RNA, 19 nt, Human
augcaugcauauucaagag

SEQ ID NO: 40635 - RNA, 22 nt, Human
cacgccucuaaucccaggacuu

SEQ ID NO: 40636 - RNA, 25 nt, Human
ccgcgucuucagcuguuucgcaucc

SEQ ID NO: 40637 - RNA, 22 nt, Human
gccacugcgaggggggcugggc

SEQ ID NO: 40638 - RNA, 26 nt, Human
ugguccuuuuuaaacuacuaguuuua

SEQ ID NO: 40639 - RNA, 23 nt, Human
uuggcugagccacaucucucaca

SEQ ID NO: 40640 - RNA, 19 nt, Human
uacuauaugaugaauagca

SEQ ID NO: 40641 - RNA, 24 nt, Human
aacuugugccuagaaacuacagca

SEQ ID NO: 40642 - RNA, 22 nt, Human
acacagccagcaccaccgcccc

SEQ ID NO: 40643 - RNA, 20 nt, Human
ccacugggccaagugcagug

SEQ ID NO: 40644 - RNA, 25 nt, Human
aaccacacccuggcccagacugcca

SEQ ID NO: 40645 - RNA, 26 nt, Human
accagcacaauccugccucacuggcc

SEQ ID NO: 40646 - RNA, 19 nt, Human
cuccagcaagucucaggcc

SEQ ID NO: 40647 - RNA, 23 nt, Human
ccugcgggcugccccgcuuugcg

SEQ ID NO: 40648 - RNA, 24 nt, Human
gcuggggcugagagagaccacagc

SEQ ID NO: 40649 - RNA, 27 nt, Human
ccuugcccugcuuugccuuaaagccuc

SEQ ID NO: 40650 - RNA, 25 nt, Human
agauauacagaguucucagacccca

SEQ ID NO: 40651 - RNA, 23 nt, Human
gaccagccagggcaacaugauga

SEQ ID NO: 40652 - RNA, 22 nt, Human
auuuggcucuuguucuuugguu

SEQ ID NO: 40653 - RNA, 23 nt, Human
ggguucucuucuccugugaucau

SEQ ID NO: 40654 - RNA, 21 nt, Human
caacaagccaacacaaaaaua

SEQ ID NO: 40655 - RNA, 21 nt, Human
gaucucaaagcucugcuugua

SEQ ID NO: 40656 - RNA, 22 nt, Human
ccugggcagggagagaggcugg

SEQ ID NO: 40657 - RNA, 23 nt, Human
uuucaaaauuacaaugcauuuau

SEQ ID NO: 40658 - RNA, 22 nt, Human
ucccugagagaaguagcacuca

SEQ ID NO: 40659 - RNA, 21 nt, Human
cucagccucugccacugugaa

SEQ ID NO: 40660 - RNA, 20 nt, Human
cuuucuggaaaaacaggaua

SEQ ID NO: 40661 - RNA, 20 nt, Human
aggacuggggaaacagcugu

SEQ ID NO: 40662 - RNA, 22 nt, Human
caggcuggacugcaaugacgcg

SEQ ID NO: 40663 - RNA, 19 nt, Human
gcugcucuccgccgcggcc

SEQ ID NO: 40664 - RNA, 24 nt, Human
agguggggaaaggaagucuuccug

SEQ ID NO: 40665 - RNA, 19 nt, Human
ccuacuucucccuugcucc

SEQ ID NO: 40666 - RNA, 23 nt, Human
cccaggaggcagcuguugcagug

SEQ ID NO: 40667 - RNA, 24 nt, Human
cccggggcugcagccuccucuuuc

SEQ ID NO: 40668 - RNA, 23 nt, Human
gaagcccagauuggcaagaggag

SEQ ID NO: 40669 - RNA, 29 nt, Human
ggaaggcaggccaaccagcaaaauccuga

SEQ ID NO: 40670 - RNA, 20 nt, Human
gguguuguuggguggcagcu

SEQ ID NO: 40671 - RNA, 22 nt, Human
gccuggccuucagcaguucuuu

SEQ ID NO: 40672 - RNA, 22 nt, Human
gugcccaggcucaggugcagcc

SEQ ID NO: 40673 - RNA, 27 nt, Human
ucagaaacacacuuaagagaaaaggau

SEQ ID NO: 40674 - RNA, 22 nt, Human
ucucucgcccaggcuggagugc

SEQ ID NO: 40675 - RNA, 22 nt, Human
agcagcccuccagaccugggug

SEQ ID NO: 40676 - RNA, 19 nt, Human
aaugccugcuuuguguaca

SEQ ID NO: 40677 - RNA, 19 nt, Human
gaaauaaaccugcacugaa

SEQ ID NO: 40678 - RNA, 28 nt, Human
cagaaguggggaaauggaacucuuaaca

SEQ ID NO: 40679 - RNA, 27 nt, Human
gccagcacuccugccaucacagggccc

SEQ ID NO: 40680 - RNA, 28 nt, Human
gggcuccccgcugucacugccagucacc

SEQ ID NO: 40681 - RNA, 29 nt, Human
gucacaggacgauuucacugacacugcga

SEQ ID NO: 40682 - RNA, 19 nt, Human
ucaggccaugagcugcagu

SEQ ID NO: 40683 - RNA, 20 nt, Human
uuucaggcuggcauggagag

SEQ ID NO: 40684 - RNA, 23 nt, Human
acaucaucccuggcuguggauag

SEQ ID NO: 40685 - RNA, 25 nt, Human
gucugaaaaccauuuuaaaccaucu

SEQ ID NO: 40686 - RNA, 26 nt, Human
aaccugacaaccauguguacaccagg

SEQ ID NO: 40687 - RNA, 19 nt, Human
ccccacccccgucguggug

SEQ ID NO: 40688 - RNA, 24 nt, Human
ccuuuuuuccuguucacaagcuga

SEQ ID NO: 40689 - RNA, 22 nt, Human
gcuuaugccuguaaucccggua

SEQ ID NO: 40690 - RNA, 21 nt, Human
ccggaaaagaggagaagagca

SEQ ID NO: 40691 - RNA, 20 nt, Human
cugcgccccgccucucgggc

SEQ ID NO: 40692 - RNA, 21 nt, Human
agcuacuucuguauuuuuagu

SEQ ID NO: 40693 - RNA, 23 nt, Human
gugccuggcuucuaccugggugc

SEQ ID NO: 40694 - RNA, 22 nt, Human
ggcugacugcaaccacugccuc

SEQ ID NO: 40695 - RNA, 27 nt, Human
ccaacagcagugaucucagggcagaca

SEQ ID NO: 40696 - RNA, 21 nt, Human
gcagaacucuccacuucccca

SEQ ID NO: 40697 - RNA, 21 nt, Human
uguccaccccggcucggcggc

SEQ ID NO: 40698 - RNA, 22 nt, Human
cccuuuccccagccucuccucc

SEQ ID NO: 40699 - RNA, 22 nt, Human
gacccugcaguagcgcaaaggc

SEQ ID NO: 40700 - RNA, 23 nt, Human
cagagcccagacucuuggagcag

SEQ ID NO: 40701 - RNA, 22 nt, Human
uggauggagaagagguugcuga

SEQ ID NO: 40702 - RNA, 20 nt, Human
uucuguugcgcuacugacuc

SEQ ID NO: 40703 - RNA, 32 nt, Human
acguucugucaacugugcugugcucuucuuua

SEQ ID NO: 40704 - RNA, 21 nt, Human
gaugggcuucugggcccagcc

SEQ ID NO: 40705 - RNA, 24 nt, Human
uugcagggcaguaggagugcagac

SEQ ID NO: 40706 - RNA, 22 nt, Human
ugucaucaccuccaguuuguug

SEQ ID NO: 40707 - RNA, 27 nt, Human
ucuucaccuaagucucugugaauugaa

SEQ ID NO: 40708 - RNA, 21 nt, Human
gggagguggugguugcaguga

SEQ ID NO: 40709 - RNA, 20 nt, Human
gguuucuauggccuugcugu

SEQ ID NO: 40710 - RNA, 23 nt, Human
ccccgccgccucacugcagccag

SEQ ID NO: 40711 - RNA, 27 nt, Human
uucauucuggaauaauccuaaacauau

SEQ ID NO: 40712 - RNA, 25 nt, Human
gcucugaagguccaaagaguuucug

SEQ ID NO: 40713 - RNA, 26 nt, Human
agguagggaaagguaagcccucagaa

SEQ ID NO: 40714 - RNA, 22 nt, Human
ccuggucuuccuccaacaucac

SEQ ID NO: 40715 - RNA, 25 nt, Human
cccaggaggaguuacagaugcagcc

SEQ ID NO: 40716 - RNA, 17 nt, Human
uguuugcacuauacuuu

SEQ ID NO: 40717 - RNA, 23 nt, Human
aacaccaccaaguuccuccagca

SEQ ID NO: 40718 - RNA, 23 nt, Human
gcaauauuucccccuuacuacuu

SEQ ID NO: 40719 - RNA, 22 nt, Human
agccaucaggcuggaggugacg

SEQ ID NO: 40720 - RNA, 23 nt, Human
uccuccaggagcuucuuguuucc

SEQ ID NO: 40721 - RNA, 19 nt, Human
uaguuugccuggaauuguu

SEQ ID NO: 40722 - RNA, 26 nt, Human
ugcugcuggggaggcuggaagcauau

SEQ ID NO: 40723 - RNA, 22 nt, Human
gugggugaaucaccugagguca

SEQ ID NO: 40724 - RNA, 22 nt, Human
gccugcccugucuccugggauc

SEQ ID NO: 40725 - RNA, 22 nt, Human
uaacugcaagaauuaaaucuuc

SEQ ID NO: 40726 - RNA, 25 nt, Human
uuccauuccaacuuuaguuucugca

SEQ ID NO: 40727 - RNA, 23 nt, Human
accgcuguucccagacacacuua

SEQ ID NO: 40728 - RNA, 25 nt, Human
ugauuuggcugcacuugaacacuga

SEQ ID NO: 40729 - RNA, 22 nt, Human
ucuuucacauuguuugcugcua

SEQ ID NO: 40730 - RNA, 22 nt, Human
gcccaggcuggaguacaauggc

SEQ ID NO: 40731 - RNA, 27 nt, Human
ucauaaugugcccuguaucuauuggca

SEQ ID NO: 40732 - RNA, 21 nt, Human
aggguccagaaggagacaggc

SEQ ID NO: 40733 - RNA, 24 nt, Human
uaauguuuaguucugugacacugu

SEQ ID NO: 40734 - RNA, 18 nt, Human
aucacccaggcuggcaga

SEQ ID NO: 40735 - RNA, 22 nt, Human
uccuccauuucaacuccagaag

SEQ ID NO: 40736 - RNA, 23 nt, Human
gacucacugacauaccuaccuuc

SEQ ID NO: 40737 - RNA, 21 nt, Human
ccccaacacgagaggaaagcu

SEQ ID NO: 40738 - RNA, 22 nt, Human
agucacugauccauaacuuucc

SEQ ID NO: 40739 - RNA, 27 nt, Human
uuuaaaccauuguuguugaguguaaga

SEQ ID NO: 40740 - RNA, 27 nt, Human
ucuguucugggaauguuucagcagcca

SEQ ID NO: 40741 - RNA, 23 nt, Human
aucuauuuuguuacuugcacuug

SEQ ID NO: 40742 - RNA, 24 nt, Human
caggccucagagucccgcucuguu

SEQ ID NO: 40743 - RNA, 21 nt, Human
auacauuuugaaaauauuuua

SEQ ID NO: 40744 - RNA, 23 nt, Human
ugugauucuuuuuggaaaaucau

SEQ ID NO: 40745 - RNA, 28 nt, Human
cagcuaagccaggcgcgcaaggaguugg

SEQ ID NO: 40746 - RNA, 24 nt, Human
ggagugagaaaucaaggagacaga

SEQ ID NO: 40747 - RNA, 21 nt, Human
ggcuguguuguccugccucag

SEQ ID NO: 40748 - RNA, 20 nt, Human
ggucguccucuccaucugcu

SEQ ID NO: 40749 - RNA, 20 nt, Human
gguuacggugaggaucaugu

SEQ ID NO: 40750 - RNA, 22 nt, Human
agaaaucaggggacauguuaua

SEQ ID NO: 40751 - RNA, 18 nt, Human
ccuacuucacaccgccuu

SEQ ID NO: 40752 - RNA, 22 nt, Human
uacuucagccaccagguuuuuc

SEQ ID NO: 40753 - RNA, 25 nt, Human
guggggaccgggcucugacagcccu

SEQ ID NO: 40754 - RNA, 20 nt, Human
auuuucuuagcagugucucu

SEQ ID NO: 40755 - RNA, 22 nt, Human
aguuccgaaaagcaacaggaaa

SEQ ID NO: 40756 - RNA, 21 nt, Human
uucuggagauacugguggaag

SEQ ID NO: 40757 - RNA, 22 nt, Human
gcuccugaugaccuaauguauc

SEQ ID NO: 40758 - RNA, 25 nt, Human
ucucaaguaaaacaaaugaaauuua

SEQ ID NO: 40759 - RNA, 25 nt, Human
cagcccucugccugcagccauggaa

SEQ ID NO: 40760 - RNA, 21 nt, Human
ggcugaggugggaggaugguu

SEQ ID NO: 40761 - RNA, 25 nt, Human
ugggucucuuuuaugaccucuuuuu

SEQ ID NO: 40762 - RNA, 28 nt, Human
gcuggccaucuggccugccuggaggaga

SEQ ID NO: 40763 - RNA, 23 nt, Human
guugcugcacuccagccuaggca

SEQ ID NO: 40764 - RNA, 24 nt, Human
cugcuauuagucauggucacucuc

SEQ ID NO: 40765 - RNA, 19 nt, Human
accuuucugugguaauacu

SEQ ID NO: 40766 - RNA, 21 nt, Human
ugggagcgugagcaggacggu

SEQ ID NO: 40767 - RNA, 27 nt, Human
ccguuguacuccagcuugggcaacaga

SEQ ID NO: 40768 - RNA, 19 nt, Human
cacccaggugauguuagug

SEQ ID NO: 40769 - RNA, 23 nt, Human
gauuaccuuucuguuccuugcag

SEQ ID NO: 40770 - RNA, 20 nt, Human
gggcuggagcaguuuggggc

SEQ ID NO: 40771 - RNA, 19 nt, Human
gcaggaccccaaaaugcag

SEQ ID NO: 40772 - RNA, 22 nt, Human
cugccucucuuuuugggcuuuc

SEQ ID NO: 40773 - RNA, 21 nt, Human
gguugcugcaaagcucaggcc

SEQ ID NO: 40774 - RNA, 20 nt, Human
guuucuuguaacuggguuca

SEQ ID NO: 40775 - RNA, 25 nt, Human
gggagccugaggcaggagaauugcu

SEQ ID NO: 40776 - RNA, 24 nt, Human
gccugugagccccaggcacuuugc

SEQ ID NO: 40777 - RNA, 21 nt, Human
uguugcccaggcuggucucaa

SEQ ID NO: 40778 - RNA, 25 nt, Human
acuguucuugguuuuauuguuccac

SEQ ID NO: 40779 - RNA, 26 nt, Human
cguguguugaggcccucuuaaagaga

SEQ ID NO: 40780 - RNA, 25 nt, Human
ccuacuugcuuucugcuuccuucug

SEQ ID NO: 40781 - RNA, 21 nt, Human
ccaggcaugguggcacaugcc

SEQ ID NO: 40782 - RNA, 27 nt, Human
aggguucccagggcuggccaggguugu

SEQ ID NO: 40783 - RNA, 21 nt, Human
uagaugacuucuuucaccucc

SEQ ID NO: 40784 - RNA, 20 nt, Human
uugcccaguaccauccagug

SEQ ID NO: 40785 - RNA, 19 nt, Human
agggcacucucagcagcuc

SEQ ID NO: 40786 - RNA, 27 nt, Human
gggaguggugcccugccuacgauagag

SEQ ID NO: 40787 - RNA, 26 nt, Human
ugagagauagaggaggcugugaaugc

SEQ ID NO: 40788 - RNA, 19 nt, Human
ucuagaaccaaccaagcua

SEQ ID NO: 40789 - RNA, 22 nt, Human
gcaaccaguuuauccaccaaga

SEQ ID NO: 40790 - RNA, 23 nt, Human
gggaggaggcaggcucaaccuuc

SEQ ID NO: 40791 - RNA, 22 nt, Human
gcuagugccuuuagaggguacc

SEQ ID NO: 40792 - RNA, 19 nt, Human
ucacaguccagcaauucca

SEQ ID NO: 40793 - RNA, 29 nt, Human
gcugguucuuuguucugucccccaugcuc

SEQ ID NO: 40794 - RNA, 21 nt, Human
uuaggacgccuuaaauuugua

SEQ ID NO: 40795 - RNA, 24 nt, Human
ggaucauguuuugaacugacuagg

SEQ ID NO: 40796 - RNA, 23 nt, Human
uccuuucuuccuucauauuuuac

SEQ ID NO: 40797 - RNA, 21 nt, Human
uggccuaggcuggcuccagug

SEQ ID NO: 40798 - RNA, 25 nt, Human
uuuucacccucuguaccccaugacc

SEQ ID NO: 40799 - RNA, 21 nt, Human
aaggaauuuuggugaaacugc

SEQ ID NO: 40800 - RNA, 25 nt, Human
uccagccgugaaccuuugcacccca

SEQ ID NO: 40801 - RNA, 23 nt, Human
auuuccuuacugauaaaaugggg

SEQ ID NO: 40802 - RNA, 23 nt, Human
gcuccacugcuucaggucacuuc

SEQ ID NO: 40803 - RNA, 20 nt, Human
ggugaucugcugcagagcag

SEQ ID NO: 40804 - RNA, 22 nt, Human
gccuuucuuucuucagggagcc

SEQ ID NO: 40805 - RNA, 19 nt, Human
ugucccuaucuuaagggga

SEQ ID NO: 40806 - RNA, 19 nt, Human
augagacaccucuuugcug

SEQ ID NO: 40807 - RNA, 22 nt, Human
uuuauuccugagaaggugaucu

SEQ ID NO: 40808 - RNA, 21 nt, Human
ccucauugcaaccuccgccuc

SEQ ID NO: 40809 - RNA, 21 nt, Human
gccguugugcuccagccuggg

SEQ ID NO: 40810 - RNA, 25 nt, Human
gcggcuauaaagggagccugggagg

SEQ ID NO: 40811 - RNA, 21 nt, Human
agguuuugcaggaaagucccu

SEQ ID NO: 40812 - RNA, 28 nt, Human
ugcucauccugaagaucagcugaccauu

SEQ ID NO: 40813 - RNA, 25 nt, Human
uauaauuuauuuacccugcuugacu

SEQ ID NO: 40814 - RNA, 25 nt, Human
agggucugaggugacucuugcagga

SEQ ID NO: 40815 - RNA, 23 nt, Human
gcaacagcaacagccgcagcgcc

SEQ ID NO: 40816 - RNA, 20 nt, Human
gcagcccaggcuccugcugu

SEQ ID NO: 40817 - RNA, 25 nt, Human
guuucaguucagauaauuggcaacu

SEQ ID NO: 40818 - RNA, 23 nt, Human
ccaucuacaaaguugcaguauua

SEQ ID NO: 40819 - RNA, 27 nt, Human
gaaagagaguaccaugcuggcggcgca

SEQ ID NO: 40820 - RNA, 23 nt, Human
gagggcaggggugcuguggacau

SEQ ID NO: 40821 - RNA, 22 nt, Human
gcccaggcuggagugcaacggc

SEQ ID NO: 40822 - RNA, 22 nt, Human
guggcaaaucccguuggagguu

SEQ ID NO: 40823 - RNA, 24 nt, Human
uuucuugccacaaauuuuguuuuu

SEQ ID NO: 40824 - RNA, 22 nt, Human
uauuugaacuccucucagcuga

SEQ ID NO: 40825 - RNA, 23 nt, Human
ucccagaaccucagcauuuccuu

SEQ ID NO: 40826 - RNA, 23 nt, Human
ucuuucuuucucuucucucucca

SEQ ID NO: 40827 - RNA, 22 nt, Human
ggagccucacucacucggaagu

SEQ ID NO: 40828 - RNA, 27 nt, Human
aggcagcugagggcugagaaugaggca

SEQ ID NO: 40829 - RNA, 23 nt, Human
ugguaucugcaagcguuuuugcu

SEQ ID NO: 40830 - RNA, 27 nt, Human
cccugcacuuuuccuuuccaaaugcau

SEQ ID NO: 40831 - RNA, 27 nt, Human
cgcugccucuuuccggcugugacccuc

SEQ ID NO: 40832 - RNA, 23 nt, Human
uucuaaccaauugccuuuucuug

SEQ ID NO: 40833 - RNA, 22 nt, Human
cucagccucccaaagugcugag

SEQ ID NO: 40834 - RNA, 20 nt, Human
gccccuggaagcagauuccc

SEQ ID NO: 40835 - RNA, 27 nt, Human
acccugcauuuuccucuuguccuggcc

SEQ ID NO: 40836 - RNA, 27 nt, Human
cucuccucugcuaaauuugcaugacug

SEQ ID NO: 40837 - RNA, 22 nt, Human
caccuguaauccuugcauuuug

SEQ ID NO: 40838 - RNA, 21 nt, Human
acuccggccuagacagcugcu

SEQ ID NO: 40839 - RNA, 22 nt, Human
aggaaacaaaaccuauauguua

SEQ ID NO: 40840 - RNA, 19 nt, Human
uccaggcaaucaaaaugag

SEQ ID NO: 40841 - RNA, 22 nt, Human
ggugguuugaucauuucugcca

SEQ ID NO: 40842 - RNA, 22 nt, Human
cccauaguauucauuuggcuuc

SEQ ID NO: 40843 - RNA, 21 nt, Human
gugugcaaaaacuauagagcc

SEQ ID NO: 40844 - RNA, 26 nt, Human
uagaggagcaacaggagaugagaguu

SEQ ID NO: 40845 - RNA, 24 nt, Human
aggauuguuguaaagguugggcau

SEQ ID NO: 40846 - RNA, 29 nt, Human
gcuguucccuguccugccucagugccucc

SEQ ID NO: 40847 - RNA, 19 nt, Human
gaagaugacuuccugagcc

SEQ ID NO: 40848 - RNA, 25 nt, Human
gaugccuggcugcuggaguacaugu

SEQ ID NO: 40849 - RNA, 22 nt, Human
ccccgggagccgcacuccagac

SEQ ID NO: 40850 - RNA, 19 nt, Human
gacuacaggcgcccgccau

SEQ ID NO: 40851 - RNA, 29 nt, Human
ugacuuguucauuuuucucucccucuuuu

SEQ ID NO: 40852 - RNA, 23 nt, Human
auugcgccacugcacuccagcca

SEQ ID NO: 40853 - RNA, 25 nt, Human
aucugaaagugguacuugaucauuu

SEQ ID NO: 40854 - RNA, 22 nt, Human
ugcagugagcuaagaucacacc

SEQ ID NO: 40855 - RNA, 22 nt, Human
ugcagugagcugagaucacgcc

SEQ ID NO: 40856 - RNA, 22 nt, Human
ugcagugagccgagaucaugcc

SEQ ID NO: 40857 - RNA, 22 nt, Human
ugcagugagccaagaucauacc

SEQ ID NO: 40858 - RNA, 20 nt, Human
gcacuucaguggauauagca

SEQ ID NO: 40859 - RNA, 26 nt, Human
caacugaacacacuguguuggaucgg

SEQ ID NO: 40860 - RNA, 20 nt, Human
uccagccuggacaccucugc

SEQ ID NO: 40861 - RNA, 18 nt, Human
caacaaaucacauuugua

SEQ ID NO: 40862 - RNA, 22 nt, Human
agcgcugccgcgggaggcgggc

SEQ ID NO: 40863 - RNA, 23 nt, Human
ggaggugggguuuggugagagac

SEQ ID NO: 40864 - RNA, 21 nt, Human
aauauuuuagcaaaugcuuuc

SEQ ID NO: 40865 - RNA, 27 nt, Human
ucaguugucuauguauuaccuuccuua

SEQ ID NO: 40866 - RNA, 21 nt, Human
uaacccaggcuggaaugcaau

SEQ ID NO: 40867 - RNA, 22 nt, Human
uccaguauuuugucauuguuuu

SEQ ID NO: 40868 - RNA, 25 nt, Human
gcacugcacaccuuguauauuguca

SEQ ID NO: 40869 - RNA, 19 nt, Human
agcagcaucucuccacuga

SEQ ID NO: 40870 - RNA, 26 nt, Human
uggacaccugccauugccuccucucc

SEQ ID NO: 40871 - RNA, 24 nt, Human
uauauuuaaaucauuuuaacuucu

SEQ ID NO: 40872 - RNA, 22 nt, Human
cguucugucccucacacuguga

SEQ ID NO: 40873 - RNA, 24 nt, Human
auuuuaguguacccaucaccugag

SEQ ID NO: 40874 - RNA, 17 nt, Human
ggauuccugcugcucca

SEQ ID NO: 40875 - RNA, 23 nt, Human
uugcccaggccuccccagcaccu

SEQ ID NO: 40876 - RNA, 26 nt, Human
gacuccgucucuaccaaaaaauauau

SEQ ID NO: 40877 - RNA, 20 nt, Human
uguguuuaaaaaagguucug

SEQ ID NO: 40878 - RNA, 22 nt, Human
uugcccaggcuggagugcauug

SEQ ID NO: 40879 - RNA, 23 nt, Human
cauggguggacacggaucugcug

SEQ ID NO: 40880 - RNA, 20 nt, Human
cccuccaggguuugggcagg

SEQ ID NO: 40881 - RNA, 25 nt, Human
cuccuggauccgcuccugccugcgc

SEQ ID NO: 40882 - RNA, 16 nt, Human
caugagcucucuuaga

SEQ ID NO: 40883 - RNA, 22 nt, Human
gggcggcggcgacuggagcuuc

SEQ ID NO: 40884 - RNA, 22 nt, Human
ugcucacugcagccuccgcuuc

SEQ ID NO: 40885 - RNA, 22 nt, Human
ugauauuguauuucucuaccuc

SEQ ID NO: 40886 - RNA, 22 nt, Human
agucuaccuuccuuauuugggg

SEQ ID NO: 40887 - RNA, 21 nt, Human
cugcagcugccugaaggagcc

SEQ ID NO: 40888 - RNA, 22 nt, Human
cugggagccagggugagagucu

SEQ ID NO: 40889 - RNA, 19 nt, Human
aacuauacacaaaguucuc

SEQ ID NO: 40890 - RNA, 20 nt, Human
gggcccuuucacaccccaca

SEQ ID NO: 40891 - RNA, 25 nt, Human
ggcugucucacaggucacagagcca

SEQ ID NO: 40892 - RNA, 25 nt, Human
ggcaaggacuagagagcaggagugc

SEQ ID NO: 40893 - RNA, 26 nt, Human
gagacaccaugagagcccucacacuc

SEQ ID NO: 40894 - RNA, 24 nt, Human
gaaaacugcuccugugucggggcu

SEQ ID NO: 40895 - RNA, 27 nt, Human
aaccgacagaacaugggcugucuuccc

SEQ ID NO: 40896 - RNA, 22 nt, Human
agcaugagagaugacuugcuca

SEQ ID NO: 40897 - RNA, 20 nt, Human
gcgucucucuuucucccuca

SEQ ID NO: 40898 - RNA, 30 nt, Human
acacagaugauuaaacagacuuuagcuuac

SEQ ID NO: 40899 - RNA, 19 nt, Human
acccaggcugaagugcagu

SEQ ID NO: 40900 - RNA, 23 nt, Human
gcucaagggguuauucuaccuca

SEQ ID NO: 40901 - RNA, 22 nt, Human
aggcuggagugcaaucgcgcaa

SEQ ID NO: 40902 - RNA, 22 nt, Human
agaccucgucccuuccuaguca

SEQ ID NO: 40903 - RNA, 22 nt, Human
aacauuaaacucuccuuccuca

SEQ ID NO: 40904 - RNA, 23 nt, Human
gcuguuuuucuagcuauaguguc

SEQ ID NO: 40905 - RNA, 20 nt, Human
acuccacugcucauauuuuu

SEQ ID NO: 40906 - RNA, 22 nt, Human
agcaguuucaaacucuaccaug

SEQ ID NO: 40907 - RNA, 27 nt, Human
uccucaccuuaauuuauuuuuuaaguu

SEQ ID NO: 40908 - RNA, 21 nt, Human
ggggugcagaacugagcccag

SEQ ID NO: 40909 - RNA, 23 nt, Human
agccucucugugcacuugcuguc

SEQ ID NO: 40910 - RNA, 22 nt, Human
caaguuaggccugcucuggccu

SEQ ID NO: 40911 - RNA, 21 nt, Human
cugucuccuguaccuccuggg

SEQ ID NO: 40912 - RNA, 21 nt, Human
ugcccaggccuguggguagug

SEQ ID NO: 40913 - RNA, 27 nt, Human
cuccucucucugcaucugcgcuuucca

SEQ ID NO: 40914 - RNA, 26 nt, Human
caaacucaggcggaggugaccaugcc

SEQ ID NO: 40915 - RNA, 22 nt, Human
aggaagagaaagagaucaggca

SEQ ID NO: 40916 - RNA, 20 nt, Human
ucugcuguccuguuucuguc

SEQ ID NO: 40917 - RNA, 19 nt, Human
gaccaggcuggagugaagu

SEQ ID NO: 40918 - RNA, 19 nt, Human
uggacguuguuuucugccu

SEQ ID NO: 40919 - RNA, 22 nt, Human
ccccaaaggccacgacugccug

SEQ ID NO: 40920 - RNA, 22 nt, Human
auccagucaaagcggaugcugg

SEQ ID NO: 40921 - RNA, 26 nt, Human
aggcccugggcucaaucuaagcgggu

SEQ ID NO: 40922 - RNA, 25 nt, Human
ucucugcuccucagucaacccccgu

SEQ ID NO: 40923 - RNA, 20 nt, Human
cuugcauagucucucuuguc

SEQ ID NO: 40924 - RNA, 23 nt, Human
guccaaggguaggcaaccaccuu

SEQ ID NO: 40925 - RNA, 27 nt, Human
guugcccacacugggggccagagcuag

SEQ ID NO: 40926 - RNA, 27 nt, Human
ugggccucugguucugacacuuucugc

SEQ ID NO: 40927 - RNA, 24 nt, Human
gcccgaccgccgagaugcccagcc

SEQ ID NO: 40928 - RNA, 22 nt, Human
ccccaccuugggccucaccucc

SEQ ID NO: 40929 - RNA, 20 nt, Human
caguguccggaaagaaguca

SEQ ID NO: 40930 - RNA, 23 nt, Human
gugauuuggaaaggggaaacaga

SEQ ID NO: 40931 - RNA, 26 nt, Human
ugugucucugugccuauguggcugug

SEQ ID NO: 40932 - RNA, 20 nt, Human
augcagaaaagcagcacuug

SEQ ID NO: 40933 - RNA, 21 nt, Human
gacucuggacuauaucaguuu

SEQ ID NO: 40934 - RNA, 21 nt, Human
cugcuguaaaggaaaccugcc

SEQ ID NO: 40935 - RNA, 26 nt, Human
cacugcacaccagucuggagacagag

SEQ ID NO: 40936 - RNA, 22 nt, Human
aaauguucuuuagaugguggca

SEQ ID NO: 40937 - RNA, 32 nt, Human
caggucgcagagcagaggagacccaggcagug

SEQ ID NO: 40938 - RNA, 20 nt, Human
ucaaguuacugcugcugcua

SEQ ID NO: 40939 - RNA, 21 nt, Human
agagucaggguggcuuuuccc

SEQ ID NO: 40940 - RNA, 22 nt, Human
gaaccccagaggcagagguugc

SEQ ID NO: 40941 - RNA, 24 nt, Human
ucccugucgcucucuaagcacuuu

SEQ ID NO: 40942 - RNA, 26 nt, Human
ucaugccagucuguugcaugcaggcu

SEQ ID NO: 40943 - RNA, 22 nt, Human
caugguuccuccagucuggacu

SEQ ID NO: 40944 - RNA, 22 nt, Human
ccgaucuguuacaggcaaguuu

SEQ ID NO: 40945 - RNA, 20 nt, Human
agcauagugccugcaugcuu

SEQ ID NO: 40946 - RNA, 22 nt, Human
ucucaaaagucaccugccuaca

SEQ ID NO: 40947 - RNA, 21 nt, Human
agagcagugggacuuccuccu

SEQ ID NO: 40948 - RNA, 23 nt, Human
caggccccucaccagcccugggg

SEQ ID NO: 40949 - RNA, 21 nt, Human
gccauucuagugauauaucga

SEQ ID NO: 40950 - RNA, 20 nt, Human
ugcagcucccuccgugccuc

SEQ ID NO: 40951 - RNA, 24 nt, Human
ccuacuuccugugacuucagcucu

SEQ ID NO: 40952 - RNA, 20 nt, Human
gggacucuguauuugcucgu

SEQ ID NO: 40953 - RNA, 24 nt, Human
ugaucuaaauguggagaaacugua

SEQ ID NO: 40954 - RNA, 19 nt, Human
aaagcaacaacaagcuuca

SEQ ID NO: 40955 - RNA, 27 nt, Human
uggacgacugugcaaugcugugugcuc

SEQ ID NO: 40956 - RNA, 21 nt, Human
acuccacaguucccaggcugg

SEQ ID NO: 40957 - RNA, 24 nt, Human
uuucucuugggugaggcucuggca

SEQ ID NO: 40958 - RNA, 22 nt, Human
uagggaggcucugaggggaugc

SEQ ID NO: 40959 - RNA, 22 nt, Human
cuuccuugccacaagcuuccca

SEQ ID NO: 40960 - RNA, 26 nt, Human
cagaagcagaggcuaauucaguguca

SEQ ID NO: 40961 - RNA, 27 nt, Human
caaccaaaaugucacaaccaaaacuuu

SEQ ID NO: 40962 - RNA, 22 nt, Human
acugacccauccugggccuugu

SEQ ID NO: 40963 - RNA, 21 nt, Human
cuuaccucccaccuuuggucc

SEQ ID NO: 40964 - RNA, 22 nt, Human
ccgccuggccuggccauacugu

SEQ ID NO: 40965 - RNA, 27 nt, Human
aacuauacuuucaggaugaauuucuuc

SEQ ID NO: 40966 - RNA, 26 nt, Human
gccuguaauuccagcuacucaggagu

SEQ ID NO: 40967 - RNA, 29 nt, Human
cuugucuccauuuuaguguugaggaaaac

SEQ ID NO: 40968 - RNA, 30 nt, Human
gacucgugucuguaucauacaaguacaaau

SEQ ID NO: 40969 - RNA, 23 nt, Human
uccuguuaacuuuauauuacaaa

SEQ ID NO: 40970 - RNA, 21 nt, Human
uuaagcaaaucuggcuuugua

SEQ ID NO: 40971 - RNA, 20 nt, Human
guaacuuggagagggacgaa

SEQ ID NO: 40972 - RNA, 22 nt, Human
caggcuggagugcaguguugca

SEQ ID NO: 40973 - RNA, 27 nt, Human
uccugcaggagcauugcgcuuaaacua

SEQ ID NO: 40974 - RNA, 24 nt, Human
ugaguaauugaggaaaaacugaca

SEQ ID NO: 40975 - RNA, 26 nt, Human
ggacuugccuuugggcaccuuccagg

SEQ ID NO: 40976 - RNA, 23 nt, Human
ucuguauuuaagaaacuuaagca

SEQ ID NO: 40977 - RNA, 21 nt, Human
ugauagcuuuuuaacaguuau

SEQ ID NO: 40978 - RNA, 26 nt, Human
uggaaagaaaaagaauggcguccguu

SEQ ID NO: 40979 - RNA, 21 nt, Human
ucccugcucccuccuuccuca

SEQ ID NO: 40980 - RNA, 24 nt, Human
cuccacccucaauccaccagaacc

SEQ ID NO: 40981 - RNA, 27 nt, Human
cacugcacacgggaaugccuagguccc

SEQ ID NO: 40982 - RNA, 19 nt, Human
uuagguugccaugagccau

SEQ ID NO: 40983 - RNA, 22 nt, Human
gagcccaggaggucagggcugc

SEQ ID NO: 40984 - RNA, 21 nt, Human
cagccaggugggaaugacgga

SEQ ID NO: 40985 - RNA, 21 nt, Human
uguccgcugggugaguugacc

SEQ ID NO: 40986 - RNA, 22 nt, Human
cacagcuguggccguggagcug

SEQ ID NO: 40987 - RNA, 20 nt, Human
ugugauucuagguccuagga

SEQ ID NO: 40988 - RNA, 23 nt, Human
ucagagggaggagccagaccagc

SEQ ID NO: 40989 - RNA, 22 nt, Human
uugcccaggcuggcgugcagug

SEQ ID NO: 40990 - RNA, 18 nt, Human
aucucccucuccucuguc

SEQ ID NO: 40991 - RNA, 21 nt, Human
gauugcuuucaucuaauucug

SEQ ID NO: 40992 - RNA, 23 nt, Human
uaaaauccuuaauuaaaugagua

SEQ ID NO: 40993 - RNA, 26 nt, Human
gggucaggagggaaaauaaugcacug

SEQ ID NO: 40994 - RNA, 23 nt, Human
guuuuuaacaagaucacauaacu

SEQ ID NO: 40995 - RNA, 19 nt, Human
gaauguuaagcagaaggga

SEQ ID NO: 40996 - RNA, 27 nt, Human
cccuccaggacggacaccgggugaccc

SEQ ID NO: 40997 - RNA, 27 nt, Human
ggcggggaccaagcuggaaggagcagc

SEQ ID NO: 40998 - RNA, 24 nt, Human
ugcugcccugaguccagccauggu

SEQ ID NO: 40999 - RNA, 22 nt, Human
guaguuaaagggcagaagggga

SEQ ID NO: 41000 - RNA, 25 nt, Human
guccaggccccaaaaccacagcccu

SEQ ID NO: 41001 - RNA, 23 nt, Human
cagggucugcaaggucuuugguu

SEQ ID NO: 41002 - RNA, 23 nt, Human
uuugcccagaguugggggcuagg

SEQ ID NO: 41003 - RNA, 22 nt, Human
ggcagggguccuguuaacguca

SEQ ID NO: 41004 - RNA, 25 nt, Human
aauauggcuacacauacuuccuaau

SEQ ID NO: 41005 - RNA, 20 nt, Human
uuucuuuuuucccuuuggau

SEQ ID NO: 41006 - RNA, 23 nt, Human
cccugcagaggggcuccaggcug

SEQ ID NO: 41007 - RNA, 24 nt, Human
uugcacaccacacuacaucuuuga

SEQ ID NO: 41008 - RNA, 23 nt, Human
acuaccugcagcuaagcagugag

SEQ ID NO: 41009 - RNA, 27 nt, Human
ggucucaaacuccugacucgaagugau

SEQ ID NO: 41010 - RNA, 20 nt, Human
ugaaacuguugcauuuuggg

SEQ ID NO: 41011 - RNA, 23 nt, Human
cacggugauguugucauaaccuc

SEQ ID NO: 41012 - RNA, 21 nt, Human
aucaucugcuauuucugccac

SEQ ID NO: 41013 - RNA, 21 nt, Human
ucugcacccacgugcauucac

SEQ ID NO: 41014 - RNA, 23 nt, Human
gcguuuccagaaggcaucuggug

SEQ ID NO: 41015 - RNA, 24 nt, Human
uguuucauuugugaauacuucuug

SEQ ID NO: 41016 - RNA, 27 nt, Human
cuguuaauugcuaaguugcugcugcua

SEQ ID NO: 41017 - RNA, 25 nt, Human
agguccuguccacagcuggacagga

SEQ ID NO: 41018 - RNA, 20 nt, Human
aaucaaaagcagccacaguu

SEQ ID NO: 41019 - RNA, 19 nt, Human
gugggcuccccucugggcc

SEQ ID NO: 41020 - RNA, 25 nt, Human
cucuggugccuuaucucgaagggac

SEQ ID NO: 41021 - RNA, 18 nt, Human
caggcagcacagcagacu

SEQ ID NO: 41022 - RNA, 26 nt, Human
ucacucuguugaccaggcuggagugc

SEQ ID NO: 41023 - RNA, 23 nt, Human
gaccggcgugacagccuccagac

SEQ ID NO: 41024 - RNA, 27 nt, Human
gcucacaugguuuacauccuucacugc

SEQ ID NO: 41025 - RNA, 22 nt, Human
uaacaugaggcccauucuucac

SEQ ID NO: 41026 - RNA, 22 nt, Human
accagccuggucaacaugguga

SEQ ID NO: 41027 - RNA, 22 nt, Human
acuagccuggccaacaugguga

SEQ ID NO: 41028 - RNA, 21 nt, Human
cucgggggcuucuccauccag

SEQ ID NO: 41029 - RNA, 25 nt, Human
cccaaccuggugaguggcggggcgg

SEQ ID NO: 41030 - RNA, 21 nt, Human
uggcaggagucccagcugcuu

SEQ ID NO: 41031 - RNA, 24 nt, Human
cgagcacagagccucgccuuugcc

SEQ ID NO: 41032 - RNA, 22 nt, Human
cccaccccgccccgccccgccc

SEQ ID NO: 41033 - RNA, 24 nt, Human
cuucugugacuccugggccacaga

SEQ ID NO: 41034 - RNA, 20 nt, Human
caggcuggagugcagugaca

SEQ ID NO: 41035 - RNA, 20 nt, Human
uucccagaaaggggagaggu

SEQ ID NO: 41036 - RNA, 23 nt, Human
ccacgccaugcugaccagagguc

SEQ ID NO: 41037 - RNA, 21 nt, Human
ugcuuacccugauggcugcuc

SEQ ID NO: 41038 - RNA, 23 nt, Human
cccaugcuguuuucccuuugcca

SEQ ID NO: 41039 - RNA, 22 nt, Human
uaggcuggagugcaguggcacg

SEQ ID NO: 41040 - RNA, 21 nt, Human
ucuuaaauuuuucuaaaagaa

SEQ ID NO: 41041 - RNA, 21 nt, Human
gugcaaguucauaggucucca

SEQ ID NO: 41042 - RNA, 20 nt, Human
ugguccuuggcucacucugu

SEQ ID NO: 41043 - RNA, 22 nt, Human
uuugauacagugucugugaugu

SEQ ID NO: 41044 - RNA, 27 nt, Human
guugcccaggcugaauucagacuccug

SEQ ID NO: 41045 - RNA, 24 nt, Human
gacaaguguuuaucaaacugaagg

SEQ ID NO: 41046 - RNA, 21 nt, Human
uccagcugagcagagauuuua

SEQ ID NO: 41047 - RNA, 22 nt, Human
uuggcagccuggucccucuuuc

SEQ ID NO: 41048 - RNA, 27 nt, Human
ucucaccucuaggccucaguguccuca

SEQ ID NO: 41049 - RNA, 24 nt, Human
gccaugauguggaguggggccagu

SEQ ID NO: 41050 - RNA, 19 nt, Human
ggaagauaguguucugcuu

SEQ ID NO: 41051 - RNA, 21 nt, Human
uuagcucccaccucucagccu

SEQ ID NO: 41052 - RNA, 25 nt, Human
uaaugaguccuauuuuucucucaca

SEQ ID NO: 41053 - RNA, 21 nt, Human
aucucuagagcugucuugucg

SEQ ID NO: 41054 - RNA, 21 nt, Human
gaccaauauggugaaacccca

SEQ ID NO: 41055 - RNA, 25 nt, Human
gucuguuggcagacuggagugcaau

SEQ ID NO: 41056 - RNA, 22 nt, Human
cucaauuuaaaaugauccaugg

SEQ ID NO: 41057 - RNA, 23 nt, Human
uugaucuacuucuguaauugugu

SEQ ID NO: 41058 - RNA, 26 nt, Human
gguuggauuuuuccacuaucuuuuua

SEQ ID NO: 41059 - RNA, 23 nt, Human
gccuguacaaccuacaugucuuu

SEQ ID NO: 41060 - RNA, 23 nt, Human
ggcaaaagaaaugcagauuuccc

SEQ ID NO: 41061 - RNA, 19 nt, Human
uaacugcacuccagccugg

SEQ ID NO: 41062 - RNA, 21 nt, Human
caacagcacuggcucucucca

SEQ ID NO: 41063 - RNA, 27 nt, Human
cuguucuugggucuaccacaccuccuu

SEQ ID NO: 41064 - RNA, 22 nt, Human
cacaacacaccuugcccaugca

SEQ ID NO: 41065 - RNA, 22 nt, Human
cucuaacuguggagugaaugga

SEQ ID NO: 41066 - RNA, 25 nt, Human
aaacucaucaagauuaugcugcuca

SEQ ID NO: 41067 - RNA, 21 nt, Human
cucacagccccugucauuccg

SEQ ID NO: 41068 - RNA, 22 nt, Human
ccaauccucuuucuuaguauau

SEQ ID NO: 41069 - RNA, 21 nt, Human
cucaacacuuuggccaggcag

SEQ ID NO: 41070 - RNA, 21 nt, Human
cccugcuccucucugugguug

SEQ ID NO: 41071 - RNA, 22 nt, Human
ccuuuaacugcaccugaauccu

SEQ ID NO: 41072 - RNA, 21 nt, Human
auugcccaggcuugagugcaa

SEQ ID NO: 41073 - RNA, 21 nt, Human
ugcccccgaugaggaccaagg

SEQ ID NO: 41074 - RNA, 22 nt, Human
gauuacaggcgugagucaccac

SEQ ID NO: 41075 - RNA, 22 nt, Human
accucaaauaugcaauccaguu

SEQ ID NO: 41076 - RNA, 24 nt, Human
gccugugccuggggaggcuucagg

SEQ ID NO: 41077 - RNA, 17 nt, Human
gaguccccucccugccu

SEQ ID NO: 41078 - RNA, 27 nt, Human
cccuccaggccucagccaccugcccgc

SEQ ID NO: 41079 - RNA, 22 nt, Human
gggaagugcagguugcagugag

SEQ ID NO: 41080 - RNA, 27 nt, Human
ucucucugaauccuaagggcuggucuc

SEQ ID NO: 41081 - RNA, 24 nt, Human
ccuccaacuaugcccuccccacca

SEQ ID NO: 41082 - RNA, 27 nt, Human
cuaagccccaaggcccggagugggagu

SEQ ID NO: 41083 - RNA, 24 nt, Human
cccuccaucuaugcacagcuuucc

SEQ ID NO: 41084 - RNA, 22 nt, Human
uuggggggugggacagggagga

SEQ ID NO: 41085 - RNA, 24 nt, Human
ggucagaaagggaugagugaagaa

SEQ ID NO: 41086 - RNA, 20 nt, Human
gcggguggaucaugagguca

SEQ ID NO: 41087 - RNA, 27 nt, Human
gaccuccagcauuggucauaaccuucu

SEQ ID NO: 41088 - RNA, 25 nt, Human
cuguugggaacagcauggaggcaga

SEQ ID NO: 41089 - RNA, 26 nt, Human
ccugcggguccuugugucccugccgc

SEQ ID NO: 41090 - RNA, 20 nt, Human
gucaucuuaaaggcuucuca

SEQ ID NO: 41091 - RNA, 26 nt, Human
cugccuggucugucuggaucccgagg

SEQ ID NO: 41092 - RNA, 22 nt, Human
uguugcccaaccuggagugcag

SEQ ID NO: 41093 - RNA, 22 nt, Human
uggcuaacacggugaaacccca

SEQ ID NO: 41094 - RNA, 20 nt, Human
ccucuacugccccauaagcc

SEQ ID NO: 41095 - RNA, 27 nt, Human
gucacccaguccaugguacuuuguuag

SEQ ID NO: 41096 - RNA, 28 nt, Human
cugcagugucugugauucugugugaacu

SEQ ID NO: 41097 - RNA, 21 nt, Human
uggcuucuuugagcauguaag

SEQ ID NO: 41098 - RNA, 20 nt, Human
cccagaggcuggcagaggga

SEQ ID NO: 41099 - RNA, 28 nt, Human
gcccaucccgaugaaccugcaucauucc

SEQ ID NO: 41100 - RNA, 27 nt, Human
ggguccccagugggcugucucucugug

SEQ ID NO: 41101 - RNA, 25 nt, Human
cugucugcccugaacccacugcugc

SEQ ID NO: 41102 - RNA, 27 nt, Human
augugggaucaauuaaaaauuuguuuu

SEQ ID NO: 41103 - RNA, 29 nt, Human
ggucugaucugcauuucacuuccagcugc

SEQ ID NO: 41104 - RNA, 27 nt, Human
augcccagguugcacaggagugggaug

SEQ ID NO: 41105 - RNA, 20 nt, Human
cugggucgaggaaacagaga

SEQ ID NO: 41106 - RNA, 19 nt, Human
aggggagggggcaaagggc

SEQ ID NO: 41107 - RNA, 22 nt, Human
cuggggcaugguuggccuccaa

SEQ ID NO: 41108 - RNA, 24 nt, Human
gugaaggcagucgucucuguuaca

SEQ ID NO: 41109 - RNA, 22 nt, Human
ucuguauuccuagaaacugaca

SEQ ID NO: 41110 - RNA, 22 nt, Human
uaaguugauucgguaucccccc

SEQ ID NO: 41111 - RNA, 27 nt, Human
uuccuaaggugaccaugguugaacuuu

SEQ ID NO: 41112 - RNA, 21 nt, Human
uuauuuauguauggugcaaug

SEQ ID NO: 41113 - RNA, 21 nt, Human
cagccgggcuggaggcugugc

SEQ ID NO: 41114 - RNA, 23 nt, Human
uuuuaauuuuaugagacaggguc

SEQ ID NO: 41115 - RNA, 24 nt, Human
gaagaguacacuuaaguugaagac

SEQ ID NO: 41116 - RNA, 25 nt, Human
gcuggcaucucccccacccugugcc

SEQ ID NO: 41117 - RNA, 21 nt, Human
cuccuagugggcucccggggc

SEQ ID NO: 41118 - RNA, 21 nt, Human
gcuuacuuuguugaaaaagaa

SEQ ID NO: 41119 - RNA, 22 nt, Human
augcugggacucagccuucaga

SEQ ID NO: 41120 - RNA, 23 nt, Human
ccgguccucuggcaugucuucag

SEQ ID NO: 41121 - RNA, 21 nt, Human
cuacgguucccugccuaggag

SEQ ID NO: 41122 - RNA, 22 nt, Human
uaguauggcauugaguugugau

SEQ ID NO: 41123 - RNA, 21 nt, Human
aaccucugggcucaagcaauu

SEQ ID NO: 41124 - RNA, 21 nt, Human
ucugcuuuucacacuggguga

SEQ ID NO: 41125 - RNA, 21 nt, Human
acccauggggguagugggguu

SEQ ID NO: 41126 - RNA, 24 nt, Human
cagaaggcugguuaacugccagaa

SEQ ID NO: 41127 - RNA, 21 nt, Human
uuugggaagagcuuuuaaaga

SEQ ID NO: 41128 - RNA, 25 nt, Human
gcccuccagcucuuuccuccuucca

SEQ ID NO: 41129 - RNA, 29 nt, Human
uccugcucuccgcacgccaccuuaggccc

SEQ ID NO: 41130 - RNA, 27 nt, Human
acuagaaggcaggcugccucagggcca

SEQ ID NO: 41131 - RNA, 25 nt, Human
acauauaaaaaccucacauucuacu

SEQ ID NO: 41132 - RNA, 23 nt, Human
uacccaccuggccucugcaccug

SEQ ID NO: 41133 - RNA, 21 nt, Human
ucugggcuuuauguaucugua

SEQ ID NO: 41134 - RNA, 26 nt, Human
cacugcacuucagcguggcccaccug

SEQ ID NO: 41135 - RNA, 22 nt, Human
gccuuggucuccccccugggca

SEQ ID NO: 41136 - RNA, 25 nt, Human
ggaggaggcccugcccucaaacgug

SEQ ID NO: 41137 - RNA, 22 nt, Human
uagguggagcaguugguguggc

SEQ ID NO: 41138 - RNA, 24 nt, Human
cucugccucucccucccuuccuca

SEQ ID NO: 41139 - RNA, 21 nt, Human
aauauacaaacuucuacuuuc

SEQ ID NO: 41140 - RNA, 21 nt, Human
aaguguggggaagagauagga

SEQ ID NO: 41141 - RNA, 22 nt, Human
ggaugcaggaaggaauggagga

SEQ ID NO: 41142 - RNA, 23 nt, Human
agcaugacagaaaauauguauua

SEQ ID NO: 41143 - RNA, 22 nt, Human
acaaccacccgaugaacagggu

SEQ ID NO: 41144 - RNA, 20 nt, Human
gggaacaaaaagugcugcua

SEQ ID NO: 41145 - RNA, 26 nt, Human
cuugucuccccggcuggagugcagug

SEQ ID NO: 41146 - RNA, 29 nt, Human
aacugugcccugccuucagcuuuggugaa

SEQ ID NO: 41147 - RNA, 21 nt, Human
guacaaccacacccacacuca

SEQ ID NO: 41148 - RNA, 21 nt, Human
uagcccgacccucgcuccucc

SEQ ID NO: 41149 - RNA, 21 nt, Human
cgggaaaaagacaagcauuga

SEQ ID NO: 41150 - RNA, 27 nt, Human
ccccagccaggugcaggcguaggaaua

SEQ ID NO: 41151 - RNA, 20 nt, Human
uccgcagcagccuccuuucu

SEQ ID NO: 41152 - RNA, 20 nt, Human
gcucacugcaagcuccgccu

SEQ ID NO: 41153 - RNA, 23 nt, Human
ucccagaggccaggaaucugcca

SEQ ID NO: 41154 - RNA, 27 nt, Human
gccugguucaauuucuuucuuuccuua

SEQ ID NO: 41155 - RNA, 20 nt, Human
gccaacucccccugccggcc

SEQ ID NO: 41156 - RNA, 22 nt, Human
guuguggggugagaggauguga

SEQ ID NO: 41157 - RNA, 26 nt, Human
aaccucaagcaauccuccugccucag

SEQ ID NO: 41158 - RNA, 21 nt, Human
guggggaggggaguuccaagu

SEQ ID NO: 41159 - RNA, 28 nt, Human
ggacaaagucaacuuccacauguuugac

SEQ ID NO: 41160 - RNA, 23 nt, Human
agcucuugggaaggacuugcugg

SEQ ID NO: 41161 - RNA, 27 nt, Human
ucccaaaacaccugacagccccucccu

SEQ ID NO: 41162 - RNA, 19 nt, Human
aggggaggagaaggagagg

SEQ ID NO: 41163 - RNA, 28 nt, Human
gcacagccucacaccugaacgcuguccu

SEQ ID NO: 41164 - RNA, 19 nt, Human
uaauaacaagucaaacuuu

SEQ ID NO: 41165 - RNA, 27 nt, Human
gguggggagcugggggagccaccccuc

SEQ ID NO: 41166 - RNA, 23 nt, Human
cagguuuacugugccugcccgug

SEQ ID NO: 41167 - RNA, 22 nt, Human
cauaauguaauauucuuuuuaa

SEQ ID NO: 41168 - RNA, 21 nt, Human
agaguggugggaucagagcca

SEQ ID NO: 41169 - RNA, 24 nt, Human
cagugcacuccagucugcagguac

SEQ ID NO: 41170 - RNA, 22 nt, Human
gucacccaaguuggagugcagu

SEQ ID NO: 41171 - RNA, 19 nt, Human
uggaaacagugggccugga

SEQ ID NO: 41172 - RNA, 22 nt, Human
cacuccccucugaccuccagac

SEQ ID NO: 41173 - RNA, 26 nt, Human
cguggacugagguagacccugcauga

SEQ ID NO: 41174 - RNA, 27 nt, Human
ccugccuggcuuccuuagcuugccccu

SEQ ID NO: 41175 - RNA, 23 nt, Human
ccugcugcugccagggcuuccuc

SEQ ID NO: 41176 - RNA, 24 nt, Human
uuguuugcaagcaggacuuugagg

SEQ ID NO: 41177 - RNA, 21 nt, Human
cccaggaaacagaacugaucu

SEQ ID NO: 41178 - RNA, 25 nt, Human
ggaaagggagggaugaccuucccag

SEQ ID NO: 41179 - RNA, 27 nt, Human
ggggaaaggaaacguggcucucccuua

SEQ ID NO: 41180 - RNA, 25 nt, Human
agaagagucgaguccucugaggucu

SEQ ID NO: 41181 - RNA, 26 nt, Human
gagacaccugagacaugcugaaauua

SEQ ID NO: 41182 - RNA, 19 nt, Human
auauuauccuugcuuuuca

SEQ ID NO: 41183 - RNA, 26 nt, Human
uuguugucugugaaauuucucuuuug

SEQ ID NO: 41184 - RNA, 28 nt, Human
aaggccgauggggaaggagaaggagugc

SEQ ID NO: 41185 - RNA, 19 nt, Human
ggggcuucuggagggaggc

SEQ ID NO: 41186 - RNA, 21 nt, Human
gugucucuucaucuacaggau

SEQ ID NO: 41187 - RNA, 25 nt, Human
acaguuacaaaagcgacagucuucu

SEQ ID NO: 41188 - RNA, 24 nt, Human
agcaggaggaggagccgugacccu

SEQ ID NO: 41189 - RNA, 23 nt, Human
cugaacacccuccuuucacuccc

SEQ ID NO: 41190 - RNA, 21 nt, Human
aagacacugucucaacugugg

SEQ ID NO: 41191 - RNA, 19 nt, Human
gucuuaaaagucucuccuu

SEQ ID NO: 41192 - RNA, 22 nt, Human
ccaggaagcggagguuguggug

SEQ ID NO: 41193 - RNA, 22 nt, Human
ucuauuccugacacuaccucuc

SEQ ID NO: 41194 - RNA, 26 nt, Human
uccccaggcuuggggcaauugguaaa

SEQ ID NO: 41195 - RNA, 25 nt, Human
ccucagucuggcccuuccuuuucgc

SEQ ID NO: 41196 - RNA, 17 nt, Human
uccaauaaaaugccuca

SEQ ID NO: 41197 - RNA, 21 nt, Human
uuauauuuacucaguguuuca

SEQ ID NO: 41198 - RNA, 21 nt, Human
auauccugccuuuuaccuuca

SEQ ID NO: 41199 - RNA, 21 nt, Human
ucaaguaguuugacucaguau

SEQ ID NO: 41200 - RNA, 19 nt, Human
ccaggcuggagugcaguga

SEQ ID NO: 41201 - RNA, 24 nt, Human
ucuccugggcccgcuuugccugcu

SEQ ID NO: 41202 - RNA, 25 nt, Human
cuacccaggcuggggcuucugggac

SEQ ID NO: 41203 - RNA, 22 nt, Human
cuguagucccagcuacuuggga

SEQ ID NO: 41204 - RNA, 22 nt, Human
ucacuucugccugcacagcuua

SEQ ID NO: 41205 - RNA, 24 nt, Human
gggugggugcugagggagcgccag

SEQ ID NO: 41206 - RNA, 22 nt, Human
ugggcgagcacccccaucugcc

SEQ ID NO: 41207 - RNA, 24 nt, Human
guuuacuguaaauuuuuguucuuu

SEQ ID NO: 41208 - RNA, 24 nt, Human
ucucucccacacccugcccuccuu

SEQ ID NO: 41209 - RNA, 22 nt, Human
uucccauggacccggcacccca

SEQ ID NO: 41210 - RNA, 22 nt, Human
uuguucugcugaagaguuguca

SEQ ID NO: 41211 - RNA, 20 nt, Human
uccagugcuucuaguaggag

SEQ ID NO: 41212 - RNA, 24 nt, Human
cugugaucacuuuauuacucugaa

SEQ ID NO: 41213 - RNA, 20 nt, Human
uaaauuggaacaccuccuca

SEQ ID NO: 41214 - RNA, 22 nt, Human
uucauuucccaacauuuuuugg

SEQ ID NO: 41215 - RNA, 21 nt, Human
cccagcacuuuggaaggcuga

SEQ ID NO: 41216 - RNA, 29 nt, Human
cacccuauccuacacuacuaggaacuugc

SEQ ID NO: 41217 - RNA, 26 nt, Human
ccaggucggcggguguucccaggaag

SEQ ID NO: 41218 - RNA, 24 nt, Human
gcuccuguuagcuccucacugugg

SEQ ID NO: 41219 - RNA, 22 nt, Human
accaacaaaaauaauuacuucu

SEQ ID NO: 41220 - RNA, 24 nt, Human
gagacuccugcauuccuccucccc

SEQ ID NO: 41221 - RNA, 18 nt, Human
ugugcuaugcugggcagg

SEQ ID NO: 41222 - RNA, 21 nt, Human
ugaacaaagcacaucuuucca

SEQ ID NO: 41223 - RNA, 22 nt, Human
caggggccugaaaaggagcagc

SEQ ID NO: 41224 - RNA, 23 nt, Human
ugagccaagcagaacauuccauc

SEQ ID NO: 41225 - RNA, 22 nt, Human
aggcugagacgcaaggaucacu

SEQ ID NO: 41226 - RNA, 27 nt, Human
ccauguccuuagaucuaaucugugcua

SEQ ID NO: 41227 - RNA, 20 nt, Human
auugcaaaucuuuacuuaca

SEQ ID NO: 41228 - RNA, 22 nt, Human
aaaacaauccagcacucugguu

SEQ ID NO: 41229 - RNA, 22 nt, Human
ugccagggagagcagggacagu

SEQ ID NO: 41230 - RNA, 22 nt, Human
ggugaagcuuuggguugccacu

SEQ ID NO: 41231 - RNA, 25 nt, Human
cagggcaaugugaauuuucuuuuua

SEQ ID NO: 41232 - RNA, 24 nt, Human
uccaguaauuggaaugacuccaga

SEQ ID NO: 41233 - RNA, 22 nt, Human
cacccgagcuggagugcagugg

SEQ ID NO: 41234 - RNA, 26 nt, Human
accaggaucccaagccuccugcugcc

SEQ ID NO: 41235 - RNA, 26 nt, Human
gagggaggagaggcgcggggagccag

SEQ ID NO: 41236 - RNA, 20 nt, Human
ugccuguaaucccagcucuu

SEQ ID NO: 41237 - RNA, 25 nt, Human
guagacucucgaugguggucuccgc

SEQ ID NO: 41238 - RNA, 22 nt, Human
uuuucuuuugguaaagacuggc

SEQ ID NO: 41239 - RNA, 28 nt, Human
agucaccccagagggcagggcuaggcga

SEQ ID NO: 41240 - RNA, 25 nt, Human
uagccuugagaaugguuuuuugaaa

SEQ ID NO: 41241 - RNA, 23 nt, Human
ugcucccaccuccaccugcccca

SEQ ID NO: 41242 - RNA, 19 nt, Human
ugggccccucacccccagc

SEQ ID NO: 41243 - RNA, 20 nt, Human
uucuacaaauuaauuuuaaa

SEQ ID NO: 41244 - RNA, 27 nt, Human
agaggcagcagcagcccgaggccugag

SEQ ID NO: 41245 - RNA, 25 nt, Human
ucaucauuaguuuuguagucuauua

SEQ ID NO: 41246 - RNA, 25 nt, Human
uggcuaagauacugcugaugcugaa

SEQ ID NO: 41247 - RNA, 25 nt, Human
cucgccucgacucgcccugcccugu

SEQ ID NO: 41248 - RNA, 21 nt, Human
uuuugucccaaaucaaauauc

SEQ ID NO: 41249 - RNA, 20 nt, Human
uucacaguuguagcuacaca

SEQ ID NO: 41250 - RNA, 21 nt, Human
uuuguuuuuauuguaaaacaa

SEQ ID NO: 41251 - RNA, 21 nt, Human
uucccuucuuuuucaucccag

SEQ ID NO: 41252 - RNA, 21 nt, Human
gucagcuuucagagccaguga

SEQ ID NO: 41253 - RNA, 21 nt, Human
gccaugauggaaaaugccccu

SEQ ID NO: 41254 - RNA, 21 nt, Human
aggaguaaggugcugcaauga

SEQ ID NO: 41255 - RNA, 25 nt, Human
uuaacuucauuuuguaucuugcuua

SEQ ID NO: 41256 - RNA, 20 nt, Human
gcugggucaucagcccagcc

SEQ ID NO: 41257 - RNA, 25 nt, Human
ggcuucucccuccccucccaccuga

SEQ ID NO: 41258 - RNA, 27 nt, Human
gaugaauggcguccguggguugcuaac

SEQ ID NO: 41259 - RNA, 27 nt, Human
ggcaaggaaaugaacucaggauucaga

SEQ ID NO: 41260 - RNA, 23 nt, Human
ccagcuuguucugggcucaggga

SEQ ID NO: 41261 - RNA, 27 nt, Human
ugggcaucagaccuuaaccaccaggcc

SEQ ID NO: 41262 - RNA, 23 nt, Human
gccagcucuucucaagcagggga

SEQ ID NO: 41263 - RNA, 20 nt, Human
ccgguccuuucucccgggcc

SEQ ID NO: 41264 - RNA, 27 nt, Human
caggaaggucaagacgcucuccaaagg

SEQ ID NO: 41265 - RNA, 22 nt, Human
uauuuuucaguagcuccaggua

SEQ ID NO: 41266 - RNA, 18 nt, Human
ucaugaugcuucuuguca

SEQ ID NO: 41267 - RNA, 21 nt, Human
gcugcgucagaccaguacugg

SEQ ID NO: 41268 - RNA, 25 nt, Human
aaauguucauuuuacugaugcacuu

SEQ ID NO: 41269 - RNA, 23 nt, Human
ugaguauccagcccgcagcagug

SEQ ID NO: 41270 - RNA, 19 nt, Human
ccuccaggacugagacugg

SEQ ID NO: 41271 - RNA, 23 nt, Human
aauuuucagccaccacagaccuc

SEQ ID NO: 41272 - RNA, 22 nt, Human
gcugccgcugcucacgcgcgcc

SEQ ID NO: 41273 - RNA, 22 nt, Human
gggcugggccauggagcuggcc

SEQ ID NO: 41274 - RNA, 22 nt, Human
uucaguuaaaccuguguccaca

SEQ ID NO: 41275 - RNA, 25 nt, Human
cacucaggcuguuguagucagcaga

SEQ ID NO: 41276 - RNA, 22 nt, Human
acacaaugugucuuucuuuuug

SEQ ID NO: 41277 - RNA, 26 nt, Human
acagcguguaaacacauguucugugc

SEQ ID NO: 41278 - RNA, 26 nt, Human
ucucuuccucuucagaacucuugucc

SEQ ID NO: 41279 - RNA, 21 nt, Human
ccuaccacacaggaaaccuug

SEQ ID NO: 41280 - RNA, 22 nt, Human
agugugcugggauuacaggcau

SEQ ID NO: 41281 - RNA, 22 nt, Human
ccccaaaccucaacaucacaca

SEQ ID NO: 41282 - RNA, 23 nt, Human
aacaaauuccuggcucacugagc

SEQ ID NO: 41283 - RNA, 23 nt, Human
acuccaucucccuccgugcucca

SEQ ID NO: 41284 - RNA, 21 nt, Human
agcuaaaaguuuuccacuauu

SEQ ID NO: 41285 - RNA, 22 nt, Human
uugggugauuaaaaaacugaca

SEQ ID NO: 41286 - RNA, 22 nt, Human
uucauuugguuuuaauuuuuaa

SEQ ID NO: 41287 - RNA, 27 nt, Human
gcugcccugagcagagucaucaugucu

SEQ ID NO: 41288 - RNA, 21 nt, Human
aagagacuccuugagagacca

SEQ ID NO: 41289 - RNA, 22 nt, Human
uacagguuugccaaaggaaaag

SEQ ID NO: 41290 - RNA, 20 nt, Human
cccaaccuggugcuagguca

SEQ ID NO: 41291 - RNA, 24 nt, Human
uaccuuuauaaagguucucuaguc

SEQ ID NO: 41292 - RNA, 23 nt, Human
agggaaagccccucggcaaggac

SEQ ID NO: 41293 - RNA, 25 nt, Human
ccuucucugcugagcaauuguggcc

SEQ ID NO: 41294 - RNA, 25 nt, Human
ccugcucuguucccuggcauguugg

SEQ ID NO: 41295 - RNA, 27 nt, Human
gagaggaaacaguggaggcagcggggc

SEQ ID NO: 41296 - RNA, 24 nt, Human
gucauugucuacuccuagaagaac

SEQ ID NO: 41297 - RNA, 21 nt, Human
ugaaguacagucccagcacau

SEQ ID NO: 41298 - RNA, 20 nt, Human
ggccuucaggagaugccggg

SEQ ID NO: 41299 - RNA, 24 nt, Human
aacuuugugauuuuauuuuuuguu

SEQ ID NO: 41300 - RNA, 27 nt, Human
acaaaccugugggccuguugcaauacu

SEQ ID NO: 41301 - RNA, 21 nt, Human
uagcagauuguuuaacucacu

SEQ ID NO: 41302 - RNA, 27 nt, Human
agggucgugagcccaccccguccaugg

SEQ ID NO: 41303 - RNA, 20 nt, Human
gccuggacacaaccagcaca

SEQ ID NO: 41304 - RNA, 22 nt, Human
cucaggugccugggccgcugaa

SEQ ID NO: 41305 - RNA, 21 nt, Human
ggaguacugaucagcccacac

SEQ ID NO: 41306 - RNA, 27 nt, Human
gggcugaagagaagauggaggagcugg

SEQ ID NO: 41307 - RNA, 23 nt, Human
gggcgagaugaagggaagagggu

SEQ ID NO: 41308 - RNA, 24 nt, Human
ccugagcccucacuccacagcccu

SEQ ID NO: 41309 - RNA, 19 nt, Human
gcauaugccuacaaagcuc

SEQ ID NO: 41310 - RNA, 26 nt, Human
cuggaaggcaggcaggacgggggcgu

SEQ ID NO: 41311 - RNA, 25 nt, Human
ugggcuguucauugucauugcugug

SEQ ID NO: 41312 - RNA, 27 nt, Human
ggaggcugaagcaggagauuugcuuga

SEQ ID NO: 41313 - RNA, 23 nt, Human
gcugguggcagaaucuguuacca

SEQ ID NO: 41314 - RNA, 22 nt, Human
cgcuccugggucguaggcacag

SEQ ID NO: 41315 - RNA, 22 nt, Human
gagcaaaaagccgagagccaga

SEQ ID NO: 41316 - RNA, 27 nt, Human
cuguggcuggcagcuuggugggcccca

SEQ ID NO: 41317 - RNA, 20 nt, Human
gaugcaguauugaguguucu

SEQ ID NO: 41318 - RNA, 20 nt, Human
cacucccugaaaucuggagu

SEQ ID NO: 41319 - RNA, 28 nt, Human
ccacauaaacaugauaucaucacacuuc

SEQ ID NO: 41320 - RNA, 25 nt, Human
gcaccgugccaaccccacccagcuc

SEQ ID NO: 41321 - RNA, 24 nt, Human
cugaccugcugacagucacccucc

SEQ ID NO: 41322 - RNA, 25 nt, Human
ucaguggacaaagaagaugagacau

SEQ ID NO: 41323 - RNA, 21 nt, Human
cuauuuuucucuguagagagc

SEQ ID NO: 41324 - RNA, 23 nt, Human
gcaaccaacugcugcugugcaca

SEQ ID NO: 41325 - RNA, 21 nt, Human
gggagcacgaugacucugagu

SEQ ID NO: 41326 - RNA, 20 nt, Human
ggguuuggcaugcagcucgu

SEQ ID NO: 41327 - RNA, 31 nt, Human
ggagcuacagggagagaaacaggaggagacu

SEQ ID NO: 41328 - RNA, 23 nt, Human
gcacuggcucauuccugccucag

SEQ ID NO: 41329 - RNA, 21 nt, Human
cauccugcaaucuaagccaca

SEQ ID NO: 41330 - RNA, 24 nt, Human
uaaugauuuuuauaaaccguuuuc

SEQ ID NO: 41331 - RNA, 20 nt, Human
ucugauuagaagcugucuaa

SEQ ID NO: 41332 - RNA, 21 nt, Human
acacuuuagacuuaguaguaa

SEQ ID NO: 41333 - RNA, 22 nt, Human
uaacuggaguaagcuacaggau

SEQ ID NO: 41334 - RNA, 19 nt, Human
agggcacagauuccccaga

SEQ ID NO: 41335 - RNA, 23 nt, Human
aguauuuucacguaucuuccaag

SEQ ID NO: 41336 - RNA, 22 nt, Human
gcgugagccaccgcgccuggcc

SEQ ID NO: 41337 - RNA, 22 nt, Human
gugugagccaccgcgcccggcc

SEQ ID NO: 41338 - RNA, 20 nt, Human
gcauguaggauguugagcag

SEQ ID NO: 41339 - RNA, 19 nt, Human
augcucugcaguccuggcc

SEQ ID NO: 41340 - RNA, 26 nt, Human
cuccccaaccccucuccaggccuguc

SEQ ID NO: 41341 - RNA, 27 nt, Human
accaggauaagaccacagggaagcaaa

SEQ ID NO: 41342 - RNA, 22 nt, Human
uagcuguagauuaguuauguuu

SEQ ID NO: 41343 - RNA, 24 nt, Human
gucucucuuuugcucucucauucc

SEQ ID NO: 41344 - RNA, 23 nt, Human
cuguugccuuuuaagcauguacc

SEQ ID NO: 41345 - RNA, 27 nt, Human
ggauacuuggauuuaguuucaguagau

SEQ ID NO: 41346 - RNA, 24 nt, Human
ccucacugcugccucaacuuccug

SEQ ID NO: 41347 - RNA, 22 nt, Human
uguggugagcagaaguggagcu

SEQ ID NO: 41348 - RNA, 19 nt, Human
aaugaucuuaacaccggaa

SEQ ID NO: 41349 - RNA, 27 nt, Human
gcccccugugccagugcucugccugug

SEQ ID NO: 41350 - RNA, 22 nt, Human
aacagguuggucaucaggaugg

SEQ ID NO: 41351 - RNA, 21 nt, Human
accagccugggcaacauagug

SEQ ID NO: 41352 - RNA, 21 nt, Human
uccagccugggcaacaaagug

SEQ ID NO: 41353 - RNA, 27 nt, Human
uugcccaggcuggucucgaacuccugg

SEQ ID NO: 41354 - RNA, 22 nt, Human
gcagaaccauugcugacuuuag

SEQ ID NO: 41355 - RNA, 24 nt, Human
cuugucccucuccagcaagaggcu

SEQ ID NO: 41356 - RNA, 28 nt, Human
cugucagggcuagccugccugcuuacgc

SEQ ID NO: 41357 - RNA, 23 nt, Human
uccaguggccauaaaacuagcca

SEQ ID NO: 41358 - RNA, 24 nt, Human
ugccgcccaaacuggagugcagug

SEQ ID NO: 41359 - RNA, 23 nt, Human
ccuccgaaucagcuccuagagug

SEQ ID NO: 41360 - RNA, 21 nt, Human
gcuccccaacccuucuugccu

SEQ ID NO: 41361 - RNA, 25 nt, Human
agcuuguuucuacaguuugcagugg

SEQ ID NO: 41362 - RNA, 21 nt, Human
gucugagcgaggagugacugc

SEQ ID NO: 41363 - RNA, 22 nt, Human
cucuccuccaugcugccucccc

SEQ ID NO: 41364 - RNA, 24 nt, Human
ccugucugucugcucacauaagca

SEQ ID NO: 41365 - RNA, 20 nt, Human
uuucuuucuuuacuuugugc

SEQ ID NO: 41366 - RNA, 21 nt, Human
gacacuugugagaaggcauuu

SEQ ID NO: 41367 - RNA, 20 nt, Human
agccugaagcagauucgccc

SEQ ID NO: 41368 - RNA, 21 nt, Human
ucuucuuucauuuuccccgcc

SEQ ID NO: 41369 - RNA, 24 nt, Human
gacugcacuuagaacugcauuuug

SEQ ID NO: 41370 - RNA, 26 nt, Human
uuagugcuuuacacauucgggccuga

SEQ ID NO: 41371 - RNA, 23 nt, Human
cuucaagagccugcaagcacuua

SEQ ID NO: 41372 - RNA, 22 nt, Human
gggacuuuggcauuuccauagc

SEQ ID NO: 41373 - RNA, 18 nt, Human
gcucaggccccugccucc

SEQ ID NO: 41374 - RNA, 22 nt, Human
ugcccaaccuggagugcagugg

SEQ ID NO: 41375 - RNA, 27 nt, Human
cagcugcauuauaaaccaaauuuacua

(The sequence listing continues in the following parts.)

The invention claimed is:

1. An isolated nucleic acid, wherein the sequence of the nucleic acid consists of:
    (a) SEQ ID NO: 140670 or 140732;
    (b) a DNA encoding (a); or
    (c) the complement of (a) or (b).

2. An isolated nucleic acid, wherein the sequence of the nucleic acid consists of:
    (a) SEQ ID NO: 2 or 9;
    (b) a DNA encoding (a);
    (c) a sequence at least 80% identical to (a) or (b); or
    (d) the complement of any one of (a)-(c).

3. A vector comprising a heterologous sequence, wherein the heterologous sequence consists of the sequence of the nucleic acid of any one of claims 1 and 2.

4. A probe comprising a heterologous sequence, wherein the heterologous sequence consists of the sequence of the nucleic acid of any one of claims 1 and 2.

* * * * *